United States Patent 9,487,797 (GENOMIC PLANT SEQUENCES AND USES THEREOF) - sequence listing, part 66

SEQ ID NO: 72648 - DNA, 37514 bp, Oryza sativa
tctcccaaacaccccctcaaagcagctatgcagctatgagtatactgctagtatttgactaattgtagttgcaatatttctcgagtattctgcaatatactcaggcctagtaggctagtactatatatgactgccattttgaggttgaccactttgtatacgtaggtttgattacttgtagtgctcccaactggggtctgcaatttaatagctagcgcaaaatccaattgaaccacatccggtgaaccacaaaatagctgctttgacaaattttacaattcaaattaatctgatgaatttaatttaagccatcgaatcaacatccaagcatgtacatggcccttgaaaggtgaatatatttctcgatgcatgcatatatatggttcaccatcatcaaccagcaaataaggaatgacttggaattaagcagtggggatcacactatcacaaacaatatattggctgtgtttagatccaaactttcaatccaaacttccaactttaatttttccatcacatcaacctgtcatacacatacaacttttcagtcacatcgtaccaatttcaacccaaacttttaattttagaaggaactaaacacagccattgacgagaaaagtggactactgcttaagaaaggagtattcacgagcaggcgatccaaaaacaacgtagcatcaggcacagtggcccgtcccgtaaggcacgcagaccagtcggcgtgatttgatcaggatgctgcctctccgatgggacgctcgcctcgcacccatgtgtgccccatcccatgcatacatgcttgctagccagcttaggctgtgtttagatccaaagtccaaacttcattccttttccatcacattaacatgtcatatatacacatacaacttttcagtcacatcatctctaatttcaaccaaaatctaaactttgcgttgaactaaacacagccttactcgtttgtccacccaaactgtctctgaaccctctttcaggccggagtaacagtgtgctaattggccggccattacatgcatgcatgctgcagctatctgacccggactaattttacatcgacggtaataatcaaagatagtactggagtactattgatatctttaagttattcgtcgagatggaagccagagagagagagagagaggcagagtgcagtactgagaaacatccaatccaatatcgtggacaggcaatctggcatctcttgagtttacgcaaacggcaaacgtatgaatcctcccgtggaatattataacaccggtcaactgtttgcgaatacggagagaacgttataatatgtggtcgcgtcgatcatcgcatccctcctgccttcgtctggtcttgtcgcgcgccacaggcgccggaacttggatcggaggagtactagctacgagtatcatatggttcgtgctcccatccatgcaccagagccacgcctgcccccggccggtaacatgcatgcactgccggaaaggctacgagtcaaacaccctctgctagctgctcgtactcgtagatcggtcagtacagcgacgacgtcgacgtacgtacatttttcaatggtactagtagaattctgcatgtctgcttcttcttcttcttctctctttagcaaccaatattacacagtttcacagtgtagaagaggggaaagatattgacttagtagccatgtcagataaaattgatgtcaaaactaccgaaggatctaaagtgaacggttttttaaattgagagatgttatatattttatggttgaatgacaattttgtaattcgatgacaagttgacggaccttcggttgtactttttcctgtccctcaacatataaaagggccatcctacttcgctgccgcacacgtaacaggccggtggagagttctacctggcccaacttgtgaggtcgtctgttcatgggctatgccacaccgtcccttgggccacaccgctgcctgactcattgcagcccaatccgaaacacagttcgcgactctgccaccaagtcagcgacagcccgcaaggccgcaagcgccaagagatcgtgaccgggtcacagcccgcacggcaggcgaggccgtcccgtccgttctctgccacgcggcccagttcagctcacgtcgaccgttgcgccggttcgccctcttttcgaaaggcaaagacgcaccgcaccccgtcaacctcgcggttaaccaaaaccactccatgacatgtgggctccatggtatcctcggacccaccaggcagtgactcagcctcgaaaccaacgcgtggcagaggcaaagatatggtgtctctgagagcaagtttaatagtttaactcactactagctccaattcatctatagccaatctaataactcatccatacaatagttatatactacactattaatatatggtcccacctgtcatacacatactgcgtcttggagtccgtgctacagctagctataaatctgtagaccgctgctcttttctctccttatttatctttttaaaatatatttgcagctgacttatattatgctattgtacctgctctgatgatacctttccctcctcccctcgcttggcacagattcccccatcgctgccaaaagcggacgcctccagcgtcctcccgccattactcacccagcaaccgactcgctcctccctttccgccgctgaccggtgggccatcccccccaccctcctcctctcagcttgtataccagcgcttccgcagagtcacgcactgcacagttgaagttggtggagtgtggagtggagtggagtggaatggcgggggtgtgtggctccgtcgcggcggcggcggcgatggtcgtggttgtgatggtgtcgtcgttgccgggcggcgtggaggcgaagacgacgatcgagccgtgcacggggtcggactcgtgctcggcgctgctgggctacacgctctacgccgacatgaaggtgtcggaggtggccgcgctgttcggcacggacccggcggcgctgctggccgccaacgcgctggactttggggcgccgggggcggcgcaccgcatcctcccgatgggcctcttcgtccgcgtccccacccgctgctcctgcaccgacggcgtccgcaagtcggtctccgtgcgctacgccgcgcgccccgccgacacgctcgccaccgtcgccgaccgggggggtcgccgacggcgtcttcgcggggctcgccttcgccgaccagatccgcaacgccaacgccgtcgcatccgcggaccccgacgcgccgcttgaccccggccagaagctcgtcgtcccgctgccctgcgtctgcttcaactcctccgacaacaacctgcccgccgtgtacctctcctacgtcgtgcaggtcggggacaccgtgcccgccatcgccgccagctacgagaccaccgtcacggatgtcatgaatgtgaacgccatgggaagcccgatcgccgcgccgggcgacattctcgccatcccattgccaggtacatgttcatctcaaactttgcaaacgatatcgcagatgagccgtatggtttattgcattgagctaactgttttgagctaaaactttgcaaacgagcatattttctgcaggcaaattggttcgtcagtatgtttttgttctgaataaataataatcagacaatgcatcattggggatataaacagtatgcatgctagtggacattgcattggtgccttagctttaatatttgattgcttcataggctgcttatattctagggtttaattgattagtacagtaaagaaaatcacatcagtttaatgtcgggcttcaccatcttgctcgattttagtcttcctcatgttggtccgaactgaacatttgaaattatgaatctgtcgtcattacagtagcccaattactagctgcagtttgatgtttggtacttcctccgtttcataatataagtctttttagcattacacacattcatatagatgtttatcaatttaaacatatatgtgtgtctagattcattaacatctatatgaatgtggccaatgctagaaagtcttatattatgaaacggaaggagtatatgcgatgtttcaattcgctaacatcggagtcagataaatagaactttgtttaggcaatcgattactcttcaataggaattaggaagatactattggagagttatgcacgaactgttcagttttcctttctattcattcagtgagtttcagattgtgtatcctgtaagaaaacataagcatcatattatgatgagcctctgcgtttatggactctatcttttgttgattgctaattcttctgttctgccttctgtgacaacagttgggctgcatcatttatcttttctaaatatcagcattttctccctagttcttccagtgacaattgttgcttgtttctgtatcttagcatgtacatctgcatttcccaaatctgcttcagaccatggactaattgtggcaaatgggacttatgcacttactgctggaaactgtgtgcagtgtagttgcgggccagggaatctcaagtaattttcagattgtaccttttctgtttaacacgatattatatggaaccattatttgggtcgtaatgtctgtcttctcttctgtctcagtttatattgcacaccagcttcattgacagggtcatgtccaagcatgcagtgcagtaacagcaatgttctgctaggtaatgtaagcgctcgttccaccagtgcaggctgcaatgtttcttcttgtagctacggaggttttgttaatggaaccattaccacattgtaagtaacatgttgctcagagtctctgttttttctacttctactatcaagttgttacattctaccttcctttgcaggctgagcacaggtcttcaatccagatgtccaggtaattactgttgctgtgagcttgtggcctgcaactggcttacaatgcagcaatatcgtgcatttgaatttcaatctgcctcagatgttagtatttttcaggtttttgaactggaaaagcatgcatccttttttattaaaaaaaacagtagtaagttgcatcaacagaattaacatcccacctgaatagttgcaaaaattgcactttgtcactttgaattccagagcaacctgcatcatactttgcgaatgaatacattcataccttcgctttggctgagcagcaattgttcgttctatgattacaagttctttaactcggctcttttagtcagcattgccacttttactttgatacatgtccactgttttttattcttcttctgcacgcaggaccacatcagttccctgaactcactgaaccccctaccacggtgaaccatgattcaacgtttctcccgccattatcggcacctggacctgcagaagccggcggcgccattccccctccgaactcaggctcaccatcagtgcaaggagggtctttcacactgcccaaagtatccactgcaaatggccctgccggaagcgtttcagaggctccttggatgaacaagccgcatcagatcctgtcaagtttcatcttgtgtctactacttctctactcgcagatgtgaattgcaatgtgtagtcaaggaccaattctgtagtaattgtaaacttgaagcctcatttaggcaaggggaggtggacagtatcatatcggcgatgtttttggagcttctttctatgggtatcaattcatgccatgaattgtggctttctttcatgacatcttccagctgtcgtcgtactcggtcgcatctctgaatatggccgagtttagttccaaactttttcttcaaacttccaacttttccattacatcaaaactttcctacacacacaaacttccaacttttccgtcacatcgttccaatttcaatcaaactttaaattttggcgtgaactaaacacaccctatatagctttgcaatctttgcatgaaaggagaggtttcaagtactctcttctctgacgactgtcaattctgtccatgttatcatacatgaccattggttggcttttctttactggggagccacggacaagctctttttcttcgacccctcatctgccggcgtcgaaaaagatctcgctagagtgttacgggtaaatttttttaactgcttggaatcagatctcgttgctgatctgtggtctacaaagcagttttgagccatgtgaagttagctttcacgctctctccttttcttctaattctctttggactttggcctcatctttggtacctttccgtccgcgcaatggtactttcgctttcagtctttcagttgaaactcattttcatcatgtaggagtagcttcttgcctaacgcaccacactgtttgatatgcagttctgcacatttccaatgctgaattccctgaccaaagtagggaagccagtccactaacacgatgcacacctcatatcccaaccaaccaacgcataggaccagcaggaccatgccactgtatcaggcagaagtgaaatgccattgctcttctctctgaaatgaattcagatgctcagctccagataacatttcgcctttcagaagcatctctgcaggttgcaacaagtgtctgctcctgtgccgaaaggacagtgaatagctccatgagtcatggcccgtggaaggatcaattggcgctgcaaatcggaataaaaatccaagaaatgcaggaatatccaacggcgccaggctttctgaagaatatagttctgctgctgctattgctgatgctataagctggtagctctcgccatttgctccgtgtaaatactgtcaagttaagagtgatacgcacgctttagcaagtgcttttatcggcttaagatgccaacctcacgtggtgattatccactttcggtaatgtagcaaactagcagcttatcttctttaatcaagaaggagagcagtgcctttcacattttccttttgtagattcctgaccaaccaaccaaatctatgatggtacggagttcaggattagtttttgttcactagttacttggatttatctcacatgagaatagctgtttttttttatgttgatcatgtgatttacagcacaaaaattgatcaataacaccacaaacatgcataaattgtgcctggtaacttagatgaagcgtagagcaggcaagttccatcgtcctaccatttattttcagatcagcataatttcatatttacaaaataacattttctttaatgtgtcacagttcatttagctaccgtagcatctctctatttcagctattgtacttatcgtcatattcaaatactaccaaatataagtcaccggtcatttcactcatttcactttggtaccatagcaattcaataaccccgctgtacacacctcataaacacacaaaagtctgatcttcagagtttttttttcgagtttctccagatcttcggagtttctttttccagtacatgaatggtactgacaggaccatagtataacacagagtcttgtctaaggttttctctaccgacgaaggatcgagtatttttcaaccagtccaatcaggccagattcaaaagaagttcacaaagctaaactctttttcacgtgaacacgcaaaaaaaattgcacgttaatatattgaaaggaaaaaaaaaattgtaacacaacgcaatccactgcccggaatccgcacaattctggtggattgtgatgaatgccattgggcgtccggatctcttccctgcctctcagaactccatctcttggtggtcggcagccaggaagggagtgacgaagcagctccgtcgtggtttcgatacagttgtggtcctagccgcttggttcatatggaaagagaggaacaatagggtttttaaccagaagcagtgagcgtgagaggaggttgctagggcagcagcagaggaggccgccctatggaggctagcaggtctactccccgagtagatcatggctgtcgtggttgcaaagttgatgtcatgagattatagcttagcctccttttcttgcctttctttttcggtttctctttcagttgcactgtaaagctgtcacaatttctccccaatcttaatacaaaagatgcgcaactcttttgcgcattctcgaaaaataaaagctactccaatcagcgagagggtagaggtggagccacactacactaaaaaaaacacaaaagcagcaacgccagtggaagaccacagacaatcctctgagaggatggactcgaaaaccacggagaccgaggagagcaccgagttgaaaaccctaaaattccgctcctttcacagctactaagagaccagaaggaccagagagtcgaagccgacacgaagatgttcaagtaatcaggccctagaagacggccaccggtcctgaagcgagctgccacgggcctcaaactctcaaagataatcccaaagaataatctgtgttcaccaactgcacacatcacctccaaacacgtacgtacggacgtaccatggccgccggcgacgtctaatccaaaatttccaaaccaatgaacaatagccggtttgacacgacgaagaagcgacagaaatgcagatagacgtgtcgaggccgattggctggcctcttggacaatttacgaggagtatctgtctagctgatggcctgttgctgcagaagtagcaattcgtgctctcccttttcgttgaaagagagagcgatcgagaggtagcaattacgtgctcaactgatcaattgacaaagcatactatacatttgtctcaaactgaaggattccgcgagaagatttgtggacttgttttcagagatgctaggcatcatatgaaacactgctcatgacgcagatctcagaaacttcagagttactagaggatcacattcacggtcatttttcgtcgccgttgtaaactagcttttactactacttccattgacaggcagggaaaacttcagagcgatccaatctgttcttttctgttaatggtactaaaatatttgcgaaaatctcatttggaaaagtgttctttgcactaataactagtactaacagaagcacttttattgcgagaataagacgagccatccaatggcaactcgttacgctggcacgagctctgaaattccgatctccacttgggcagcacatccaaataaacaagctgcttatgttgtcatctctgtccattactttgccctgcaattcttcgtgaatatcgttatctggaacatggatcagaacaatctagtggcagccagattagttgctgccattatctcttggttaattaaaggctaagacaagctcaggttaaagcgcaaaaggaagtggaaagaacaaatgagcgagctgaggattggttctgacttctgtaggagatgatagttgaagttaaaaaagattaaacttgagaccactcatgcatgcatcgaatgagctgaactgcactttgggtgatttttacggcagtagtatatctgatctgatatttgtttactctgaacaaagcagatcaactgcacaaatggagtgagatcacgcgcctctgctagccttgcagctggattagtacggcaactagtacaagttgacagtattgtcaatatatacagttacatctagtgcttctgttcgttcacagtgatcagttttgttctttttgaaaaaaatcagtgttcagttttgcgatcggtgaagattgcaggcatttattattattattattattattgaactgagccacgaagctatatcattattgatcgagataaaatagttgaaaaatgaaagtacgttttatatgatataataattcttgtgtctacgcagttatacatggggaatatgctggaaatgtgctaatggagagaagagaagttgatacggcaaggggcaagaaccatgtacttatcaaattgcaactatttgtctagcttgtttcagctttccagatgagtttctttcttgggctatggtaatggatgtacaagcttttgtaaggttaatatatcattaggcatctagtgttcacttcaatttgtactttctacctgaaaactttaattgattaaaatcaacttgcatggtgatatgatatctgtgtattgctcaaagataagtagtcactgtacattactattatggtatttcccattgttccaccagatcattaatcctactatacaaagtccaaattgacttatagctttacatcttaaatacattagaagtcttggtggcaagaatacgagtcatgacttatatccactgagttgcaaggacaactttactgtattccctccggtcacagaaataatggcagtctaaaatgaatgtaatcttacggtgttaattttcagctaaaagaaatgtcaaattttgactaattctagtgtataaatttataatttggatgtacactaatgtacaagtaagcctgtcataaagaccaccacttttagtgtataaatttataatttggatgtacactcatggtataagtaatgagtcttttacctttatgccattattaagaaagttggaggttacgcgtgtgccacaaaaaagttttgagttacatgtataccatgacacaaattttcgtttacctgtgtgccattccatccaccttctgttagagaatgagctctgacatgtgggacccacgtatgaaaataactaaattgcccctaaagcattttcatctccactactcctctcctccagtgcgccttgaaccctagccgccgctgccgccgtttgtcgctgtcgccggcacgctgctgcctcgcctcgttttccgtcgctggcacgccgccgccgccgccgccggtcgtcgccgtcgccggcacgccgctgtcgccgccttgcctcgccggcacgccgcagcgccaccaccgccgccgcaaaagtggatgaaatagaagggcaaaatagatctttcaaacctctgttagtctttgttagtgctaattccatccaaagtggcgcacaggtaaacgaaagtttgtgtcatgtcatacaggtgactcaaaattttttttgtagcacacacgtaacctccaacttttttaatggcataggggtaaaagactcacaagtaagcctgtcataaagaccaccactttttgttgactttgttaactcaagaacaccattcttccgtggctgttgggtgggcagggtgtaggtttggcaatgtgcccagagcctaagaagaagaaggaaaacgatgaactgctgaaagccttttcgggttaaaactgtttttgccataatatggggaggtacacaactgcgtctcttgcctaggcttagcctcaagtaccacctataaattcacgttaaaaatgaagtagtggagattttggttgtcaatttgatttgatgtatagtgcaaagaaaagaaggaaaagaaaaggaagagaaagagatcgagagacaagatgcactgaagatcaggtcctgagacgagtgctgtcacctcttcgcaaattgcctcaatgctgaacctatcctgattcagtgattcctgatggacacgacatggatgagtcgtccagaggaaaagaaacgccgcaccgagaaaaccaacaaaaattaaccctcatttgagatcatacatgcccttaattgaaacccatcgacagtcaaaagataacttttctcaagacacttattagtcaatcaagattcaagagcctggaaacaacagtcaaagtagatcttatacatactaatcaaactattttgcaacaaagaacatatagaaactaaccgatcgattgggttccaggagatcgccggagctccggcgagttcgggcattcggcaccagaaggaagagagtcgccggcctaactgataagagcaagtttaatagtatagcccactactagctccaaatcatctatagccaatgtaatagctaattcatacaatagttgcttactatactattaatatctggtctcacttgtcatagacaaattacgtcttggagtccattctgcagctggctacatatctgtagtttgctgctcttctctctcttactttatcttttgctcttctctctcttactttatctttttaaaatatatttataactagcttatagcccgctattgtatctgctctaatacgaacaaagaggagggttttatgaaaaacaagtcctactctctccaatgggattgatatcgaccgtcagatgataatcggacgatgaagagtgatccaagatggtcgcgatccaaactctcgggagtattctcaacgaaaacgtcctacctgcactcgagtccaaccaatctgaactgcagagtttgatcgaacggcgaagaggtattctagtcagatcgctaccattaatcgcgacccaattctcaggggttgtgaaagataattcgacgaaaacgagggtttcctgtgtaaatatacctccaccccctcaactcctctctctgacaggtgggctcactcgctgacccgcagtcaacggcggctttcacggtgagctaccgccgccgctgccgcgactcctcgccgtgccggcgttggtgagaggtgggcctcgccggcaggcggcagaagcaatcgcctcgacctcgagctcatgcctaatccgtcttgatcaatcagcggctaattaattcgtctggcttagcaatggacagagaagcaaatcgagctataaaatgtgtgaagagaatataatagctatgaactgtgagttcaactgataattatacatacataagtcgacctgtcaattctatcatacatgcgtctatacaagatcgatcaaaaagatcaagaagaagaaggggaaatcaagagaccaaaatcatgagatcgaaaacccggagcaaatcactaatcacctagctactgtatgccactccactctcctctcgtcgtgtactgtctctgctagctatagctaatcgctactgtacacgtacgcggggcgtcctcgccggcagatcgactccgccatggcgcacggaagcgagctcgatcgatcaggagctgactttggcgcgggtgcacggggagaaggagtagtggtggtggtggtgcgatccgccgccggcgtggacgcggtgcggcgacgacgagccgccgccgccgccgccggccgcgtgggtctcccgctccacgagcgagcggaggcggaggaactcgtcgacggagcaggggagccggagcgggccggccgagtcgtagccgtaggcgtcgcgcgccgcctcaagcaggcggcggaacaaggggtggtagaggtaggcgatcgggatgacgaaccgccggaacccgccgccgtcgccgccgtcggcgccctccaccccgaccctcaccgccagccaccctttcttcaccttcccggccttcttctcctccccctgcagcatggcggaagcaccaaccaccgaaacagacgccgtcctctcctccgcgacgacgacctcgccgccgttgcagctgattaacctcgctgcgcaagtgcaatcaagctacgcacactccacgagctggagctgatcgatctcgaattggggcgtggtgtgctctgccacgcgtggtgtgtcttttataggacgcggcccgtgcgggcgaggagtttggctttagcttagctagtggcagtggcgtacgtacgtcctttgctacggaagccggccgccactgtcatggcgtgctcgcgttccttccggctcccgtgtcgctgacacgcgggcctcggggaatatcagggttcaggtgaaccgctgcagtgaacgagagagagattgttatgctcaaaaacgggaaactgttttgaaccctccctcagttgtctcctcctccatctaaaaacaattcaatcagttacaaaaaattctgaaaaaaatagatgatatttatgcagcgtatatatatatcgctccacaaaatcttaggtcgttaaaactcatcatatatattactaagatataaaaagtttcagttggtaaatagtagtggcactatatatttatatccaaatttgtctctttttcttctttaatacgtaggtcgaatttgatgttgattttcggttaagcgctagatttcactgtagtctatattgttattttctttaaatctttttcataactatttgcatagaatttagaaggaaaaaagtacacaagtctaaaaaaaaatccaaaatataacatgtgagcctgtttggcgcctacacgaatcgccgatgacccgggcggtggcgcccaccgggggatcgagtggggtggcaatagcttgtggtggaactgatccggccaagtgggggagggaatagcgtgtgttcgtgcagtgtgtgctgccccacgagagatggtggggattggcatgcagatcatgacggaatggttcgtcagattgttgttgctgctgctgctgctgttgttgagtactaatcactattggattttgttctttgtgcttctgcttctagctgtttcggttatcttttccagtgatggtgggggatgcgtgattaacccaatctcatctatggtgtgcgatcgatcgacatgactgcagatatgggcgttcctttaatttgatcgaggatgatacacatacatacgccacaataatctgtgtggttgcatgcagtgctattgattcagttcttctcgtcaatctttatctctgttgaaatatctctgttgtcgtcctcaatagttattctgaggttagtcttactggtagacagggaagttgtcacaggggaaatctcacatcattctagctccaaaccaaatgacaggtgctttgtcagggggtgtgatggattagcgatccaggattattccaggcagctagggccacaatgttttactaatttgtttctttgcacgagtgagagcaccatgcacacagatatctcgtactactactcttctactagtaatttggataaaatacgcaactactcctacctacgagttttctttttaaattttaacagatgcacgcgcctaatggttgtctttctcgaaaggatagatatcatatcacgatgagtagaccgacatcttggactgctggattgcttatctacatgtatgtcatgattattggttatgtcagccaactttgtggtcacaagatgtgttgtatgcttgtaaagttgtactaataaaactacccaaaattttcacgtaattctacgcaaatcgcaggttaaggttcatttacaagtagaattgcatctgctatacaatttcgttgtgtttcgacaaattaatatgtatattaattgagtgaattgtagcttagactactttctattgccaatgtttcaatttatactatcttttgactaatcctttcgctttgcattagttaaatacttaaatttactctctctctctcactctggaccaccccaattctcttatatacccatatctaactacgcctccgacaaagatatagcttggggagggagtttatcagtgtattggaaccaatattggttattgatgtgcttaaaaaagtggtttgggtggtttaaatctgttgacagaaaacacgaggcctgggagatctgcttaactccagtgcaggtccaaagctcgtcttcgaatgtatgagcgtgccagttgatttaatcctgtaatcaacaagaaatagagacaaagaatttgtggttaaatctataaatgatagccgatcggctaagtgccgatgacatatcatttatctttgagccgatgtcatttatgaatcgatcagtggttataaatagatagtaaggaactaaatctattcgataggctgtagatattaacgatatatagttcttatattaatatatacttcaatcaaatgattgggatagatcggtcaccatgccgagacagtataaatcacttaaatcgaaatatatattaataataggattatatatgtttatagcatagccgatcagatagatctagcatgtatcggttaatactccgatactactctatataaagatatcaaaacaagtataatataccaaacaaaagcttaatatacttaaatgcaataagatcttgatataaagggcatatttaacatgtcactgaagcatatagattgaatatggttaaatcagataagatcggctgaaactccgatattaccctaatcggtaaccagaggacatgctagagattgatattctaagcacgacttaatagatcaaactcaactaatacagcattaagtatgaaaagaagaacaatatctagacaacaaagccgctggatgtttcataaagtggtagatatcttatataatctaggacaacgtcgctatttaacctaatcggctgccttctattaacagatgttagccgattgtaggttagatgacgatattgccaaagattatgtaagatatataataactcgacgaattatatagacaagattagagtgtcataaagatggaagcactaatctcgagaacacaagtcgtcataacaagttttacctcttgttgaagatcgaaaccgatgcagctcaacccgaaagcaagaactcgtcgaaacaaaactaaagcaaaaaggtggcgatgcgccgaaattgtattgaatgtgtgtgttaaaaattacatagggctcggggtctatttatactcgagaattacaagatatgtccataccggacatgaccactatctttaacaaacactaagataccataagtctttgcggcagacttttgcccaaacatatctctaaggaagttacataaaacatcctaattaatagatacaattgccttcttgggactctatccatgtgcggaaatcatcttgaagcacctcaattcaacccgatgtcatacaccaaattatactgtcggaatcggctgcatcggcttacctagtccgactcagacccagccgatcctaatcgtagccgatctggacttcagccgattcttgctctgttctcggatcaatctccgccttcgactccacttcgatctaatctccttttctgatgctgatattaccaaatttggtcgttaacacatgccccccaagtccgggatatttgataatgttccggatttgccgtgtaccgactccgagcaagtttcgcactctgccgttttttgaccgttattctatcgctttaaataccaaccgttgccctcgagaaatctcacgccgtgacttccgttttcaccgctcaagcaaaactttgtcctttctctctccggcgattcctccgacgcaaaagcgatccccaggcgatttcgcttctgatcagatctccgcctgcggtgatgtcgtcttccactagcccgtctactgcgccatcagccgagtacgctgaggtaagttctcaccggctagatcccttttcctcgcatgaaatcgatttctccttttctcattatgttttctgcttcccgattcctttggatttgcagcacctttccaacctagttgcgattcccagcctatcgcacaaaaaccattattttcttggcccaatcggcaatcttgaccccactgatttcatcattggtgaaaccaacataatcccctttagactagctaaccctaacctgggtcactggaagaataccttcaagtcttggccatctctcgaaaggcctacccctgataagagctggaccacctggtaccatcgcatatcggctagtaagaaagtccactgggatgagattgggatcggccaagcgctttctctcaccatagccaattctgctaaggatgaacctctaatggctgccgctacctatttttggtccaacaccatcaatgccttcttatttaaccaagggccgatgactccaactttgatcgacatcatcatgattactggattagatgtaacttcatcggctaaccctatgagtatgaacaccaagaaccaatttgacttcaagaccaaaagcataggagggtggtctggttatgcagcggcatacatgggcaaaaggcctgtcactcctcgagagcacgtagctttcttgctaatgtggctagaaaagtttctcttttgtggatccagctgtggtctcacaaccaattggcaatttgtagccggagccttaggatcaaagaaacaattccccttgggcaaaatccttctcggctatctataccaaatgttgaacaatgcatcggctaagatagccgtcggctcaatagttggagcaggtggaccatggtggctactgcagacctggctaaacctggtagtcatgaaagttgtcaatcggccatatgtaacagaagctgaattcccaaggttggagccaattgtagaagacgatggagaagaacgcacccatcgcagatgcatgtcatatggagaatatgcatccacactagccgatgctggggtaaaactattggctgagctgctcaaagattggttctgcagcttttatgaaggcttccagaaagatgcccgggtttggtttctttatgaagacttagcagaccttgagctcccattagacttcagatttgaagacatcaatcatgaaagatatcaaacgtccagggaagtctttacagctgcaatcagcccatgcatcctacatgtcggtattcaccaaggaagaaatatccaagtctcctacgaattctatcaccctataagttcagctagacaacttggattagaccaactcccaatcggcttattctttgctgacaagatccaatgccgaggagaaatttcttcaactctaatgatggatcgactgcttaacctccaaggaccttccttaggcagtatcgacaatattgagttagcaggatttaggagtaggaactttgacagatggtggggtgaatggaagttgcatctatttcatcaatcggccacaatgtatatgacagatctattccctgacgtcataccccaggtaaactttgtcatcactaaatttcataacggttagccaattcattacttgactaatcttttgttcttgttttgcagacaacagaatcctcccctccacatcagagcaatagtggtaggaacattgaatatgccctaggtctgattcctaatggaggcagattgtctccccctgtcatcggctatcatgcccccttaggtctcaaccctcctccaaggcgccatcagggaaccaaccgatgtaaccaagaaaagaagaactagatcattggctgtgagcaccttgactctagctccaaagaaaaaggccaagtctaagaaaaccaagccaaccgatgacctgcctgctttggatccatccattgaacaagctctggatgaagaagatattgaggatgatgttgatcaggctgcagccgaagtaagtgatactgaaaaaacaccatcggcttcgcctaagcatatacctccaactccttctgcccccactccttcagagtaaaacgtctttccctgcaaacccttttataatcattatttttcagccgactactcataagctttgtaattgcataagaagaaaactgctataaagaagaaatcggcagcagcaattctcaaaccagctccaccagtaagatactctcaattttactagttgattccagccgatattgtctaacacttgtctttttacagcctcctcctcctcctccttcttcccctgtacaacaatcatcgagtgaccgaactccatcggccgtggggagtcatcatattgtggaagaagaacaaccagctgctcctgctatcccagtaagttttcctttgatgcaagaatttagatcggctatattggcttagctctcaaactgtctgaacttatacctgcaggttctagccgatctcttctcttttgatatcaaagattatcttgatgaggcagaagaagatacttcaagcaaagctctagctctcttatctaacaatgcaaagaaaacacttgaagatatctcgcgtcggctagaggcctcttctctggatagcttagtggtcgattgtagatcgattaggacacgattgcacgaagttcaagctctaattcctgaagaactggccgatgtcctaactccagccgcttatcttgagcaacatcaatttaaactagaaaaagccaagctaagattagccgaacgccgtgaacgcaaggagattgaagccacaatccaggtcaatcggcagcttgtgcatgaagaaaaagtcaaactcgatcacctatccgaaggtccgatcaaatccaataccgattggcttgaagcccgcaagatcgatctcttagcacagcttgaagaatgcaatgctgaattggatatggagcacaaaagctagccgatctctcaaaatctgtcgaagagcaaaaagcaaggctcaaatcggctatcaagaatgttgctgacctaaccaagtccctgaaggtcatttctggaactgatgctcaagatgcccaagccattgaagaagtcgaacacattaggcaaagagctattttggctatccagcagtacttgtctcaataacttttgtgtaataggacttagaaattcctgtaatcggctaagataccttaataccctgctgttttaacaatcctttgtgccgaataacataacttctaattttcactttcattttttgtatatatgtgccccccaattttataatgtcaacagcattgataaaattagaaaaacaactaagggcgatataacaatatcggtcgttatatatcggcaaaccataaccgatgacaattggaaaaacgactaagggcgatataacaatatcggccgttatatatcggcaaaccataaccgattacaattagaaaaacgactaagggcgatataacaatatcggccatctcaagacgatgtaaaacacatcggctgtcatgcatcagcaacactagccgatcatgcgtcaacccaaacacttgggtaatacttcttcaagtatttgccattgagcgctcgtccataaacctcaccatcaagcccttgcaacatatatgcccctttagacacaaccttatagatttgaaacagtccttcccaatttggtgaccacttgccgaacttgttatcccgagttccaatcggcaaaatcaacttccatacaagttcacctttcgaaaaatccttggcactactttcttgttataatgcctagcaactcgttccttatctttggtaaccttagcaagggctcataaacgcgattgaaccaagtcctccctctcatcggccataaggttataatactcatcagctgtcaaactgtcttgcaattctatccttctagagccgattctaacttcccatggcaaaacagcttcatgtccaaaaacaagcttataaggaggaacttgaattgatccatggcaagccatccgataaaaccacaatgcttcggccaaccgggtatgccattaccgaggataatcagaaatcttccgcttaattaatttgatcaagctcttgttagatgcctcggcctgcccattagcttgtgcataatatggtgaagaattcaacaatttgatacccacgctatcggcaaactgaacaaactcatcggacacgaagattgaaccttgatcagatgtaatagtttgaggaataccaaatcggtagattatatgttcttgaacaaattgaattgcatccctagaatcaactttcttcaaaggaatggcctccgcccacttggtgaaataatcagtcgccaccaatataaacttatgccttttacttgatggtgggtttatcataccgatcatatcaattccccaacctctgaatggccacggtttaataataggattcatagccgacgtcggcactcgttgaattgtcccaaacttctgacaatcttgacaccccttataatatctgaagcaatcctctagcattgtcggccaaaaataccctgcacgccgaagtaaccaattcatcttatgggccgattggtgagtgccacaaattccttcatgaacttcgccgattgcaactttagcctgatcggcactcaaacacttaagtaacactccatcaatcatccgataataaagctcatcatccaatagagtgtacttcaacgccttatattttaatttcctagaagccgattgagatggattatgtaaatattgatgcacatcatatctccaatcatcggctgttattgctgcaatttcaaccttaacatctttgatcatcggcttataccccgatgccccttgggccaaatcattagcttcaatattttgttctcgagatacatgctttaaagtaaccagccgaaatttcttcatcagttcttggcacttctcattataaaccattaatgtatcattcttgcattcatagtcccctgccaattgactgattaccagcaaagaatcccccatgatttcaatagcatcagcttcaacttccttgagcaattgcaaccctttaagcactgcttcatactcagcttgattattagtcgcataaggtttaatagtataagcaaacttgaaacatgccccctaggggaaattataactaggccgataccacaaccatgagtacacaccgatccatcaaagaataaagtccatggcaccatttcaactgagccgattgaatcatcacgatgttccacgataaaatcggctatagcttgtcccttaatcgccttcggtgactcataccgaagatcaaactcagttaaggaaaatatccaatttccaacccttcctttcaatattggagccgataacatgtatctaacaacgtcggccttgcatataatagtacattcattggatagtaaataatgccttaacctcgtgcatgaaaaatataaacacaagcataacttctccacaggagaatatctagtctctgcatccaagagccgacgactgagataaaatacaactcgttcttttccatccaactcctgaatcaagactgagccgattggcttctcaccggctgacagatacaatctaaaaggtatccctttctgtggaggaatcaaaacaggaggggaactcaggtatcctttaatattatccaaagccttttactgctctgccccccaaataaattgttgatcggccttcaatctcaacaatggtgtaaaaggttctaattttccggacaaattagaaataaaccttcgaacaatattaatcttgccgatcatctcctgcaattcggtcttgtttcccgggggcttaatctttttgatcgcattgatacttctttgagttatctcaattcccctctcatggacaagaaatcccaggaactggctagccgatacaccaaaagcacactttatcggattcatcttcaagccatatttcctggtcctctcaaaaacttttcttaaatcggctatgtggtcttttatttccttagatttaacaaccatatcatcaatatagacctcaaccagccagccgattagatcatgataaatataattcatggcccgttgatatgtagctccagcactcttcaagccgaaagtcataacaacccattcaaataagccgattgcaccaggacatctaaaatctgtcttatggatatcttcatcagccataaaactttgattataccctgcgtttccatccataaaactcaaaattttgttccctgacgcagcatcaaccagctgatcggctactggcattggatattcatctttcggtgtagctttattcagatctctaaaatcaatgcataccctcaccttgccgttcttcttgatgacaggaactatgctagaaacccactcagcatatcggcaaggacgaataaaaccagcatcatataaacgcttaatctcagccttgataggttcaagcatatcggctttgcatctcctcggaggctgctggtgcggcctaacccctggtttgataggtagccgatgttctacaattgatcggctgagtccaggcatctcataatactcccaagcgaagcaatctctaaactcttttaagagctctatcagcttggttctaaattctggatacaaattcttactaataaatgtcggccttggccgatcacctggacgtatatctatttcttccaaatcatcggccgacataaaaccttgaccttgcttgtcatcgagatcatctaccgtatccttagtgtagacatttgaaccctccacgacaccctcaaaataatagcttgggttctccatcttcaactggctgtatatcagaatcggacacttttagaaaatctccatcccaaacttttccagataaacaatcaaggccatccatctcccaaagagctaaatcggcactggcaacattaactgacatgtcggctggtacgatctctattttgtcgccttgccactgaatcaagcattgatgcatagttgaaggaatacaacaattggcgtgaatccaatcccttccaagcaactagctgtaagaacccttcccatcaatgacaaaaaaacgtggtaggaatagtcttactgccgactgtcagctccacatttagaacacctttggtttccgatggattgccaccaaagtccttgagcaccatatttgtcttgatgagatcctcggcatttctacccaacttcctgaacgtagcataaggcatcaaatttaccgcggccccaccatcaaccatcattttagacatcagcttcccattgacatagccatttatatacaatggtttaagatgctgattctctgtcccctcaggcttctcgaacaccgcatgttctggtgatagaaccaacttagccgattcctcttccacctcgtcgacatcggcttgatcgatcccgaattctgctggcaaggtaaaaaccatgttaactggtgccgtcacaatactctttccttttgccaacctctttgcctcatcggctgcaacatcatcggctacaggagcctgattcttaacacgccactcctgcctcggttttgctttcttcagccgatgatcaatttcttgctcgacctcttggaagcgttccctactcctcaatctttgaacccttcttttctaattcttcgtaaaaataccagaaggacaccattgagtcttcctattttcatcatcttccgaatcaccacgttggtttactgggcccaatctttgatgaacaggtactcttgtctgttttggtcgattgcctctatcgtacaatcggcttgaaccccctgcaacatcactgcatccaggacaatcctcgatagatggtagtctcataccttcattccaacagaacctgaagaactcacagccccaataaggatcaaagccaccattatcttcttcatgatgcctttcctgttgcttgtcgtattttctttgatatttgtttataattctagctgaacttacttgataatccctcatgcgccccgtatcagctgttcggtcagctgtgtgtaccatgttaacgggaaatgggttaccatcgaccctcatcggctttttggaaccatcaaacttaatcttgcctccctcaatgtccacctgaatctgttgtctaaaaaccttgcaatcgttagtagaatgggacctagaattatgccatttgcaatatctctttttgcctaattcctcagccgatggaatcgtatgaccaacagggagttgaatttgcttctctcggagtagcagatcaaaaatcttgtcagctttagtaatatcaaaatcatacttctctttctttccagaactctttacccattggcacggtatgacctttttacttctcacccatttggctgcagctatttcagaatcatcctcatcgtcatccgacccatacatgtaaggacaaacatgattaaccttcttagagctttttctagcctccgcagacctatgctcgtgcaaggttaccttttgtatcagatgtgacaagctatcaaagtcttcagacgagaatttctccctaatcggagcaatcataccctgaaaggccaaatcggctaactgagcgtcagttaaactcaagctaaagcatttgttcctcatctccctgaatctctgaatatactcgtgcacaggttcatcatgccgctgcttaatcgccgtcaagtcagataacttcatctcatgaaccccactgtagaaatagctgtggaattgcttctccaaatcggcccaactattgatcgacccatacggcagagaagaaaaccaagtaaaagccgatccagataaagataactggaacaacctaaccctcagagcgtccacagccgatgcttcaccacactgagctaaaaatcggctaatgtgctcataagttgacacaccatcttgtctcgaaaatttagagaagtccggaactttgaaccgattggggagaggaactctctcaaaccactcagtgtaaggctgccggtacaagcttccagtctcttttggtttaagcccaaaccgttccctcattacatcagcaatcacattggcccacggtcgttgctgagctgttccctgtgactgttgttgcatgggctcgaactgaccatactgagatgcaaactgaggttgagccagtccccctggctgatattgggcttgcggggaaggagactgatattgataattcaagttgccccccctggtaattatgaaggatcggttgaatattacgtgccaaatgctcgggaacaacttgaggcattactgtgtcatctggctatacgtggtgaaccaagtgttctgtgacgacttgatttaaaaattgttgtataggctgtccaccaggcgtcacaagcccggccgatgcgctcattgagccttggtgctgaatcggctgaccgatttgctgtcttaatggcgtctgctgaatcggccgcggaggctgttgccttggtaacgtttgctaaactgattgcacaacttgttgctggattggttgtacaacctgctaaattgggagtgtctgttgaatcggttgctgttgtattggatcaacagcaggttgaggcggcagaaacatggcagcaacctgatcttgcgtcagccgattcgcaacctgcccacatgctgtggttgctctctcattaacaaccgagagttcaccagctggcctagtgccaatgctgacggagcaggtaagggagtcgatgccggcgccgtcagctgagctgatggtgcgatgggggaaactgcctaaatagatggctgggcatcagtgatcaaaggccgataatttggaaagacacctccttgcaaataaactgggcctgcagcctaggagatctgcttagctccagtgcgggtccaaatatgatgagatgcgagcgtgccagtcagtttgatcctgcaactgacaagatatgcaaatagtatatcaaaatagccaatcgactgacaagccgatggagtagttccagcaaatagccgataatagccgatgccgataccagccgatagtgatagggtttaagcaatgggctatatgtcaaatgtagataatgatataacggcaatcgactgatgataataaaatacgacaacaatataatccggtataaaccaatcggctatcaatacaatatgatagaataagcattgatccgaaggttaaagcatacatcggctggaggtccaatgtcataaaatccacaagattggattaaacaatgaaacctttgttacgatcgactaaatccaatatgtatgcaatccttgtaagccgatgcaacgtccacataactcatcggctgaaaccccgatgaaacccttattggcaatcaagaagcaagctagagattatggttctaaacacgacttagtagatcaaacttaactgatgcagcactaagtatgaaaagaaacataatatctagacaatcaagccgttaactgatttttagggtggtagatatctaagctaatctaatctagcaacacgatttagccgataccggcagaaaccctaaagcgagaagcagccgatagaggtaaattgatatgctaagactagattaacagagacatatgataaataggtaggcaaatatatcatccaaatcagagcaatccaagaggtcgaatgtactgatgcagccttgaacgacgccgacgtagacgatacaattgctcggaccggcgaaacattggacttaccccttcgctggagatcgaacaccgatgcagccccgcgtcgggtgccaagtcccgccggatgataaaataaggtagaaaaggtaaaaggggtggcgatgcgccgaattgtattaatcgtggagatagattacatagaccccgggtgtacatatttatacccatgggttgatacaagtccttgtcggacaagaaagaaactaacctaaagataaaaggaaaatataaagtccttatcagacactaaacacactttcctaaagataaaaggaaactaacaaactattcctaattaatagataaactgtcatgccgcatcctctttaaactcggtcacttagggataagcttcctttagtagattgatttccttaaccgaatatagcaggaatccgactattggcgacttgataactcccatcggcgagatgctgcagccgataatgattctaacccgatgacgtcgttgccgattaccaaatttcactgttaacaaaatcacaacaaagataaaattactagtttaaagtgaaaatatggtataaatggtggttcaaaataaaaaacttgaaaaatataagtggtccagactataatttattcactaattaatttataatgttatatagtctagaccatcacaatatactgcgtacatatttctttttctaaagttaacatgataaattataggtcatcgatgcaaacgtgttgattctttttttttagttggccccttttcagaacataaactttataatgcaatacatggttttcgtatcagctccctttcatgaggatactggtctatatatgttaaactaacctttagctacaaaagtaacgtgtacctttttttactggtatcaactttagaagataaataatgaagcaatcgattaaaatacaagaaggcatgcatgcacgccttgcatgcttactgtaaaaccacggctaactgtggttttgatggcaaaacttcgaatatatgattggtgataacagcaagtttagtactagtatatacgtttctctttaaaaaagtatacttttgtaaaaaaagaaaaattgaaagtatatcttccaatatgagtatggacttctcttgtcgactcatgctatagatgctaatgttggatcttcatggtgggcatgtaagagtatgctacacaaaaacccacggtgaatttaacaatgtgcactatcaacaatcgtatttgtttttttcctgcttgtataggtcgaatttagatttgtagagtgatatatatcatatatctatcaattttttttcaatttttatggcgttttcgtgacatgtaaaaacaagggggcatcctctttgaaaaaatagcttattcacactacaaatatttcgaccaaactatcataaaactacatatttaaagtgttgtattataaaactatacattaagtagctaaattatcataaaactataaatttagtaccaagttaaccacaaaactacgccatttatagctccaacataaatgtagtgttatggatttaaactctaataaaggttataattttttgatgacttcttcgatattaaatctatacttttatgatactcaacattaaatttgtagttttattataaatttggtactaaatctatagttttgtgataaaataccttaaatttgtaattttacgatcgtttagttaaaatggttgtagttatgtaatcccttcatccaaaagtctaagggtgtatttggttggggtgagtttttatgagagattagaagtttaaaaggatgaggttattaactattctatttggttgagagacaaatgagttttcgtgggatgggatggggaattgagggaagatctccctcctttttaatatttgggtaggggctagtaattgataggaaatttctcctttacgttgcctaaataaatcttagccatccattttcatttaaaatctagtcaccaactaaactccttgtcaattcccaccacctctatcaaaaataaaattgtgactaaaaatcaaattcacatgttaatctcaccatcaattccctcatctaaacttccaatcatttttcctcaagttgccaaaccagccataagacatatttttcttttgtcactaaaaactaaatagaaattaactcatacaccatgtgacaaaacgaaagaaattatacgcatgcaaccaatgactattaagatagcttttcaggtattggtcgataatttagtttagcacatagaaactacaaatatgtttatctcatttaaaaaaccagaaaataaaatatatcttaaactttttgatggagggagtacattttacttcaaataaatgatttcccacacaaagctatgtacactatacaaccctgattaattggcctcaatattactactacatcaataactaaaattagcatgcaaatcaaacatgcaccagcacaagactgtatacatatcctcttttattctccttttgttgccactttcgctattcacaaacagctatctagggtctatcaagctctgcaggccccccgagaaaaaagggcaaaccaacaggggagaaaaatcccggccgttgtgcacccgaacagccaaacgccacccgacccacgaacatggccacggtcgcgtcaccaccaagccatctcacctgtccggtggccaccccgcatacgtgccctattgcgcttggcatctggcgcggcatcatccattgtaatcctcctccccccaccaccaccacggtctacgagaacgggcctgtttagtgagcttaagattttgagaaacaactgctgagaaactagctggtgaaaatctgaagaaactgaaaaacttagcttctggcttctagtttattttccagattctacaagcacatattctcataatctaggtaaaaaaaactatactgtttgggagagcttctggtaactggagattctagaagaagctgcagctgctagaagctctctaaacagacccaacgtctgctccccccgtccgcgaaacgcccgatgggtgtaccgaacggttgcgtgattccaccacgcctcgcctcgcctcgccgcaactcaacgcaacgccgcagccgcccccacgcgagcgagcgacgtagtactacgtaacgtgatcgcgcgctcgcgcgcggagacgataaggcggaggcgatggcacggcaccacggtggggatggtggatgatggatgggtggatggacgcgggatcgcgcgtgtggccgtcgcgagcgcgagccccctctctccgttggcaagctgacagcgaggtataggtggtggtggtggtggtgcgcgctccgctcccggggcgggcgccacacggtgtttcgcctttgctcccgcccggctcccgttgtcgttgataggaacgggagtgcacgcgcgatcgatcgatcgatcccctcctgtgcggtgcggaagccgtacggggctcaaccgctcaagacgcgtcgatcggtggacgtggaggcacccatcattcgatttcgcccgtgcatgccggccccgcagcctcttgccacgttggctttgtcggtacaacgacgaaaggctcaactaaattcttcgaagaaaaaaaaaggagaaaaagctaaactaacaaaggaggaggatggcgatggcattgcgagcagatatccgctgtacgttggtgatcgatagtacgatgctcgatcgactttttatcagtgctcacaagatagtgtataataataatttcgtaaaggaaaagtgcacaaaatggagctttgcgagtttgtcacgaggtgacggagtacacctgctttggtacttgtttggctcgctcgatcaccacacatgaaaaaaaaaaagtgacctaccatggtaagtgggaagggcctgcaatcaacttcgtccccttcagatagctaccctttagagtaaccaatcaggacgtacatgatatcctagctagaaactccagttcattttagtagttattgttaattatcctacaactaacaaagcgaggagagatcaagacacacttggattagcacaactggcgtgattaactccaggggacagcaataagatcgatacgctcatgattaggcgccaagcgcacaaagcaaagtgccgtacgagtaaagcagcaaactccatgcaaaacacaaagccggcagaaagtgccgggccattcgaggatggccggggtcaagaggtcaacaagaaaatctcgagctagcgcgtgggcatctatgatctatctccatcctcttcttttctcttctcttcctctcctgcgtgctatactagcttgcaagcgaaagaaagctaagctaccggcttcgatcgatctccacttccccccggtgcagggcacggctcccgtcccatccatcatctcgaaccgcacaacaacaacaacaacaactagattgcaatgatcgcaatgtcgtggtcaccgagaccctgcaggatcatcagaacgatcgaagcagatcgatcgatcgatcgatcaatcgaacaaccgcatgcagcagcagggcaccgaataatccgcgctttggaggtgaaagcaacgtggggtatcggagcccagccacacgccgagcccgagccactcgcggatcgaatcgctctccctcgccgccctgctcctggcacgtacatcgtcgagggagatagcacatgtacaggagcaaatattcctcctcctccttccggttctttttccaaaagcaacaattcgctggatgattggtcagcaatcagcactgttcattggtccaagctagtagctgccgacccaagctgcctgaatgagggtactggccttttgttgcgcttttgacccagtgctggtagggaacgacgagacgcaacgtagggccgtacaggcaaatatgcaatgcaagagaggagaagagaggctcccgtgagacgggcggctcgaaatctccccggcgaaaagggacagaaaaacaggagtcgacgcgaccgtctagaagcagagaagcctggagatatcagtgcgtgtgtgtgtgcgtgcgattttccctgcaaaagacggcgcctcgcgcggctgcaacaacaggattcggtcgatcggttggagatgcggcggtggtggcttttcgaagggtcggtcaagttggagttggggggtcgcatcgcgtgcgccgcgcaccacaccgacatggcctgtcacagtactaccaccgtatcacggatgctcattcgtcccgatcgatatttttgctggtcggctcggcttcgtgccgtatactgtcgtgtcgtggccggatggctgcaagcctgcaacgagtcgtcgttgccttcgctagctgacattgtggctctgtttattgcctgctagtatatctcgcggcggtttttcacgcccctgcacgggtactgatctgtacagcaaggctgaacagagtagagaaattaacgtgaagcctatcaataaaatgttggttagtcctcaccctcctacgactacgagccagatgattccaacctactccctcagtccaaaaacaaacacaattctagatttgaacctggttcaaatttagaattaggttttttttaaggacggaggaagtagttcttttctgtcgactctgtaaatagctttatttatttgttcatatttgtgtaatcagcaagcatattactcagtgctacttttttactagtttcacaatgattattatctagtagttatcagggtatgaataagacatacctcagtatccttggggttgtgcagtgtacagatatgatataccctcgaatatacgggaaagttatcttagtcctaaggaattcagcagatatataagaaaactgtctttccaaatataaggtgttatagtcatattcgaaggagttgcggactctgtgatctcgtacgcgtaaggtattctccaagttctatttgaaggccaagacacttaggggtataaatacaaagctctcaaggatacgggatcatcgaatcataatctcacaaccgggcatagcagaatcaattcggaggactcggagccaagccgccggttaatctcgtcgagttaatctcgacaaaggtctaatcggtactcgtcggttctattgttctcttaatttctgtggttttcttcataatctcatataaactggattaagcctatcaccttacgaggggtctgaaccagtataatctttgtattctgtgtgtttgatatcgtattgtgtagatcctactccagcgtaccctgataccctcataataggtctacgggtatcacctgtcaacaatagtagaggagcatctaattcttatttatcaatatatctctccccatttattttctattaaaatgtaaatttttttcatgattttcattagcacatttttaaacggttaaacggtatgcttctttctatatagaagttgctttaaaatatcaaatatttttttacatgttttaataaataaaactcaattaattatgtgcaaatagtttttttattttgtatacactgactttgtcttcatcttaatctattttaaacaccacctgaatgctctatgactacgagcgtatcatgcttacatgttactgtgcattgcgtttctcgagcatgtactaatcggtggttccatccaagtgataattaaccgtggaagaacggttaatcgagggagaaatagtagtagcagtactgtattctgtatataaggggacaaggtacacattgggaaagggaactgtactctaaaaagtaagtgtaaggtcctatgacagtgatttttgcgacgtgcccatatctgctgggacgcgtctaaacatcaacgccgtagaggaaaaaaactgttattgctacgatgactccaaaaatttaaagaacggccgcaaattatagccctacattcatccaaaaaagagtataggtttgtcttggttattattaacgtttgaccatatgtcttatttaaagaaattatgattaatatttttattgttatcagatgataaaacataaatagtactttaggtgtgactattttttaaaaaagtttgctcataaatttttgaaataacgaacacaaaaatccataattgcacttaaattgagacggaggtagtagtaatgaccagctaaatcattcgagttaaatccccaaaaatttacaagttaaatcttgtatgaaccctcatgtagtacatcagtatgtgtttagttcctgtgctaaaaattttttaagtatacggacacacatttgaaatattaaacgtaaactaataataaaacaaattacagattccgcccgtaaactgcgagacgaatctattaatcctaattaatccgtcattaacaaatgtttactgtagcatcacattatcaaatcatagcgtaattaggctcaaaagattcatctcgcgatttacatacaaactgtgcgattagttttgttcgtctatatttagtgcttcatacatatgtccaaacatttgacgtgacggaaaaattagaagttcgaagaaaaaattgagtctaaacaagcctatgacaagtaggcaggacactggcgtaccgaaataggagtgggtgacataagcaaacgcaatactgaacgcataccaatattgcaatacagtaacatgagtactggacagcagcattattacgtgcagtacgtcatacaacggtttactatatcggcagccttaagctcagctttccgacgactaaaaaacaaaaatgcaaatgcgtacaattaatgacaaatcaatatttggaaatatacaccaggtacttggggtccggtccaagcatacaacaaatgaacataagtaccactaaaatctttagaaaatgtttttttacatcgtctgtgtggctcccaatggtaggaaagattattaacccaagttacaaatctggacggcaagaggaaaacacctgtctcagactaaaaaattatctgcatctaacatataaaaaagctgactaccacaccagactaagttattactagtcattaaaacaaaaacctcttgtttgctgaaatattaaatggttgttaacaagctccgagcaagtcacccgcaaccaatcaacataaaaaagaacagggtcagactgtactgctgtatctaaaactataccagctatcaccacttcaccattaaaatggctgctgtaaaccaacagttccatttcaactgctttcgccgtctccatcccaacaggcagcaatgaatcagacctcattagccattaccaattgcctgtctccaatcccttgagcgattatcagccccgcggtggccctgactcgcaccaatggaccatttcttttcttgtaatcccaacaaagagtggttatttctttttttgtcttctgcaaagctaaactatcacttctgcaacgctaaactatcacacgcaaaggcaagaatgtacaaagaaattacagagaatttatatgtacaggcgagaaaggcatctttgtatatcctcaaacaggtaaatccacccatgttgccgttcacccgagcgacctgaggcggagcaagatttctggtaaagatcccacaccatacattcatctgtttcgttctctcgttcacattaactcagtttgcaccgttctacaacttcagcccaattggatcatcgtttgcttggaaccctttgtagcagcaaaagactggccagccccacttgacgcttgtactttctggctgtgaagaccaaggaaacaaacgtcttctggcctttcttgagacaagattaaccatcttgatctcagctgctcctatccaccaggctcttgtggttcatgggcctgtgtatttcgattccgcaacttgtctttagaaagagagtcacgaggaacatatgcataccccttcggaagacgttggttctgtgtagaagcttgatcagatgtcataaaaagctccttttgaaatgtttccctattctgaaaaaccatgtggtctacacattagcaaggtacagaaaagaagtaaaaaacctgaaaacagaagtacaaaccttcttatccttcgtcttcttttctccagcttccaatttctgtgaggtaactggtcttcgcgggagctgcttaccagcaagtgatcctctttcactaaacttccgtttgaacgatatcagtgtccttgagctatcagctgtgtttatctcagcatccctgttattcagagaaaacctgatcgcctttttcccagaaatagtactgtccactgtgacatcatcagacctttgcatggttccactgtatgatttgttgttaacagaagtagtggcagattctgaacttgctccatgtgtaaggtagg

SEQ ID NO: 72649 - DNA, 32264 bp, Oryza sativa
tgataggcagtggaaaacgcccgacaggtccactaatgtagcatcattttgaggatctggtacttatttttgtttcagtgtgttggtgttgtttggcattagattgacaacatggataaggcattattatgtcattagaatataaatgatcgcttctgttctccttgtatcatatcatgctaaaataagtgatttgagcttgttcaccttgcttgccctttatatgatagtaatagtgtttacctttttttttttaatcattttggatgctagcctgctcaatcatatttctacaacagctagttcaggggaaaataagtttatgcctcgcctttttgttcagcttttaattgatggtgttgttttactgcttttgtgacataccatatgttttgatctgtccttaaaccactcggtacttgtaaccctgagcaacttagacccatgtagatgtaattttttctttctgacatcatagaacatgccatgagttcctgcagtactttaattgcatttgaattgaactgttcattttcattgtgtcatgttgtggaatgtctattcttcaggatccataccatggacctggtcaggcgatggggttgtctttctcagtaccagaggggatcaaaattccttctagcttagcaaacatatttaaagagctgcaaaaagatctaggttgcaccgtgccttcacatggaaacttggaaagatgggctgtgcaggtaaggcggtttgataaacatccgaataaactgccctgagtccctgacatttgtaacaacatgccgtttctcttatttttatcttaatgttaactcgtgttgcaaaaacaagaggatttgtatgcactaatacctttaacaactagatagtgttgtattttggggtctatatataacactatttggacgccatggagaccataggtctgttactttgagacaggtcttgtgaaggaaaaaatccactagggtctagtttgttcttattaattctatctgatatagaaagtggataagctgttattccattagttcttagcaaagcatgataaactttctatgactgttttttgggagatgttgtctaacatgggaaacacatgttttacagggtgttcttatgctcaacactgtattaactggtatgattattgttcccatttacattgaaaactatttttatttttgttgctttgttagctcttatgtattcataatcttgattaaactgtgatgtaacttgtaggttcttttataatcatgaccacaaaaataataaagtgttgcattacacataggcctgttttgggagcccacgatccatggcccatccacagagatgggctggggattacaggctccccaaaggtttcttccagttgctactgtatcacatttatttgatgttgcttgtcctcttcctctagcttagtgcaaagtaatgcattcctctgttgagaatctttattccatgggaattcactattgtgatcttagttgctctatccttgcacgagtttcttatcagcactgaacaatcctacttcttaattttctatagtgtcaatctataatcagagaaataaaacatctcttttgttgttactatattgctaggataataatgtaaacgctaaacaatttccttactgaaagctccaactagaagtttggttgccaccagctgtgctgttctgcatttccagcaggagataaacaatactaatatcattaccatgttagtttcccattaaaatctactctcagtatctgatctgcctgaatgctgtggtagaattgatttgtttggaagttgtatcttgttgggtatatttttgctgatttcattttcatcttgtcgggccagtgagagaacatcaagccaattcacatgccaagaaaggatgggagcaatttactgatgctgtcattaagacaatatcactgaagaaatctggaatagtctttattctctggggaaactcagctcaagcaaagacaaggtattgcttcgttcacatctgcaaatctgtgacttggaatgttggcgctatcaaaagaatattttgtaaaactggctattataatgtcagctgagagacaagagtacctgcatgctgttttgcagattgattgatgaaacaaaacaccacattttgaaatccgctcatccatcagggctgtctgcaagcagaggtttctttggatgcaggtttgttttcttgtcagataaaatgaactttcttcatttgtttctgtgagttaaaaaataagactagactctacataggagtaaaacatcacagaagggagagctgatatatttctgtaacttaggttaaatttgaatagcatacttcagagagaataaagactatgttacttagtataaaactgaattattatgattgttcagcacttgcatatcaggattgccctatatgcggcgccataatatctatttgatgctagacaacccaccaatggctggtatctttgttactgtagatgatttagtgggtgggttataatgatttatcctaagatcaactttaactcacctgcaccactatacaatggtactgtcggtccatgctgagtggtgctatactgctataaaccctcaatgcttttggccgtcttgtcctgtcttgtttttgccaacttgatattacttttgccttttcactcactagtgttaatggctagatccaaatgagcattagctcaggcacaacatatagaacgtgaattggatattggcatctcagatactgtttatggggccaattcaaatcattctaatgctacttttgcccttgtgattatcgttgaatcagcctgcaataggataaatttttattgatgatcgttgtgctgtgcttatcttaaacaggcacttttctaaaacgaatcagatcttggagaggctgggactatctgccattgattggcaactctagaccatttgaagacatcatgtggtctgtctgcctgacaaccacctcagctttgaaggtacttgttgcaaggaccatcgaattcggccaaaattttgtaggaccttaaattatatatggccgatcaaaatgctaatgtaattacgcagttcttatatggtatctaatgccgcaccgaaacatctaaattgtttcggttgtcgtatgtgcagctactttgcgtagcgcttgggcgccattttggtcgctttgttagatctgaagaattgcttaacaaccgtcctggcctttcaagttttttaaataccataaagccagatcgtccttcctcatctgggatccctttgtcctcttagattttgctcgtaggcctgtcaccaacccttagatcctaagaaattcccgtgctagagacatgtcccctcttttaattcgatgagtgccgcacctacgtacagagtgagtatttaaagcccgtgatgagcaggtgaaagggtacacgtctcgcacgatacctaccgtggctgtagtattttttgtacagcaggtggttgcctgcaaataattagacagatactccatgcttctagagcttgcagaaaaccggcacgtcagtcgccgtgtgtgcagccagagagtgacatgtaatactccagaaccgcagcgtaagcgttacaactccagaatcgcagcgtacgtacgcatcaggcatcgcaacgtgttagtccatccagagtccagatgctttgctgaaacttgacacacaaccatgcacgttgtctcatcagctcaaaccgggggcagtagaaaacgacatggtggcattccatgtattgacatcgcatccgatccttccggctccgtcaagtcttggatagattgtgattgtgagatcgatgcatcctcccgtcgtaatctctcggcctcacatcaaaattttaagtattccattccacggggcaaaatcaccggatctttgcagatctgcaagcgtgacttccatgtttcacccagctccatctcatgtttgataacatgactactaaatcgcacctacgtacgtacagtgggctccattgcaatggaagcatcgcaagtcgccgatcttggaaaagatcggcacgcacttggatggaagtctagcagcaaagcagccggtctcttgcactgttcgcaggtcgttctgaaagcgacgaggtgagctagctcctgcccaatctccttgattgtaccgtgcccatttgattatcattacgccctggggacatgatagcatgtacctgtggacgcaattgacgacctgagacgctgtacatcgtaagctcacctaccggtcccatgcatggccggtgtctgcgggcaaacgtacatgtcaccgtggacccgtattttatgttttcactctctagttccttaccttcttcactgggtgaatgcacgccacatgcatggctgatattctttttaggaaaaattggaaccatgccattatacttctttttaagtagcttatggtaaagttttaaaaaatatatacggagtcctataaaaaccataagattgtattcccaaattatagactcatcagctaaattaccattagctgtttcttactaaaatctaaaagcttcgggcttgtttggtacagctccaactcctaaatttaactctaggagttgagtctggagtagagttgtggagctgcctaaacccagctccacaactctagtttattttgtgagagagctccactcagctccactcctagttttgattgagccgaaactatttttggctgagctccagctccagaagaggtgaagctggagctaaagctgtgccaaacagtcccttcctttgaaaccattagctgttactgctggtgggtagatctctctcctgtgacactcaggactacagtggtaagtaccgtactagtgttccctattctagtaggggtccggatgagcccaaccccgatcgaccgtgccgatcgatccagccagtggcagcggccagcggcatgggaaggccaagcgtccgcgtcggcgctggccgctatcaagcggtcgggtggcggtccaccgcgcgagatctcccccgcgatcctgcggtcaaatcccccgcgatcgcgttcgtgtcgcgggcgaggcgcgaggcgacgcgatccccccgaccaatcaaccaccagaccgcgcctccatgccatgcaaaacccgcgcgagcgagccgcgagcgctcatggtttccacgcccacgtttccctcgtggatatgccaaatacgagagagctgtccagttcatttctatagagttttggatgaagataaaaattttcatgacacgttttttaaactgataaatagtgtgtttcgtgcgaaaactttttatatgaaagttattctaaaatatcatatgaatatactttttaagtttataataattaaaacttaattaattatacgttaataccaacttattttacataagtagattgatctttatttttatttttaagagaaaagaacaccaccgtagcctggtggaatgtggatggctgcctgccgttttgcatgacctggggctgggattggagtatttggttccacctgacggcaggtagccccaggtctcggttcttctcgcttgtcgcctctgccctctcgattgtatgcgcggtttgcctcgctcgtcgtgatccctttcccgtaatccccgagatttggatgcttctccatgggatgacagccatgccaacgccaacgccaacgcccatggtctggccatgcaacgatgttcagtcatggaggcctcaaccgtagcacgtgcctagttgcaccggacacgtctatggcctactgtggacgacagggtaaacttcatgtacgacatctggggttctcaatttgcatacactgtacacaacctgacagctctgcttgtgtcgtccattctacgcgaatgcgaggtcgtcattcattttcatctactaatgtactcccatctggtaaatgcaatgtgaccatgtgctgcacctgtttttcgtacaggagtgcttccgtttacaaataaatgacgttgtaaaatacgtgccgttaaacctcaaaaacttaaatatacaaatattagaacttcacgcgagcaggagcggatccagtatatggtagcggggtctcgagtctccactattagcgtgaagactctaagagccctgatgaagccctcaccgctattttttttaccatacatagatgagagagatgattgtagctttatctagtttgttttctggattcaccactgcacatgagaaaataccgtggaggtgtttggttcctagctacattttgccacgccatacttttagctgcaaagtatgactggtaatcaaacacaccctgcgtaaagtagttagaaaaagtaatgacaaaataattgggaaactattttaaactctcgaggagatatttcctcgttgtttgcatatcactcaaatggttatattttttttagaaaatcaacaagatagattaacatgtgacagatcattccacaaacatgaaatgtaaaattaacttctacatgttacaatgaaaaaacatttttttcgaggaaaaataaatttaattgcgaatatacattaactagttgtagtttaattttttttaacatgtaaaatttgaatttcaacttgcatatttgcagagtgattatatgctatacatcttcttaatttattttataactacttgagtgacatgaaaaaacgagtgaacgtttctcgagagtttaaaattcactctccgaaacaatatctactagtactatataatatacacatcaatacacatagttagagaggtagcttcaggtggcaatgtatagacctaaacgtacatctgattgggatcgtatgacatgaaatcagaggaacgtggtcactgacaggttaggcccaccgcttatgggccgacctatcaatgaccacgttatcggttagttcacgtcagaggaaccgcttccacgtacaccataattaagtactcctagcttaggggatggaccagttgttaaaaagaggatcccacgagaagcagcggccgtggcagtggcaactggcaagtagcaactgaaccaaagcacacagggtttactagcttagtttaagtacaacgcccccacctccccccgtacaccacgtaccacacacgggatacgatcccgtcgggtccccacacgcgccgcgacgcactctcgcacgcacgctacacgacccacccgggccgtgttgcgtgcgcccgtcgctgtctcgtatctgcatacggcctcggccatcaactctccccgtacgcgcgatcgatgcgtttggttgggtttttcccgtagagaatcggaatcgccagtacgctcgatctccgtctagagaaaaactgatctaggacgagatatgacgaactactatctccgttttattttaattgtagttaggagtttccgtattcaacgttttaccgtttatcttgtttaaaaattttttatgattggtatttttattgttattagatgataaaatataaataatactttatgcatgacttattttttctaatcttttcataaatttcttaaataagacgaacaattaaacattggacacaaaaacgacaactacatttatattggggcggaggtagtattagaccacccgcaatggtaaaataaggtgctctctataaaatatgtacatctcagcaatagattagattaatagtaaaccacctcaatagtatgtctacatgggtatctatagctctctaatccattgcctcgtttttctctatagactatccccagattagtagatagttttactctctctcttcatttaatctcttccaagtaggaaaatatgctgacatgtatctcttgtagagagcttatagataaccattgtgggtgcccttagggaaatttttataatggaggtgagtgccatatctaatttaaaccatgtcatattctcattaattaagaggtaacaagtacaacatgccacctatagttcacaaaccccaacattaatttactctcacatcatcttatatttttcttggagattgtgtggaggttgccccttacatgagaggtggctcattttctctctctcctaacttctctcctccaactcatcacctaatcttagggcatgtttagatccatttggaatggcaaatggcaaatggcaaaagtcttggtggcaaaagttttggcattacaaaagtactagttggtgtttagatgcatgttaaagttttgtcattctagcactaaagtgagagagagaaagagagagggagtggtcccaaagcactttttggcacaatttgctactatgtactagcaaatgccaaataccaaattgccaacttttgctactagtgtttagatccaaaatggcaaaaagtgctataaaatgacaaaacttttactattttagagaatctaaacagtgccttatgtggtaaatttaggggcaacatgcagaggcttatacttgcccttatacatttttccattaacgcatttaagatactgctactgtagccgattggtcatgtgacgttcagttggagcagtggtgactggtgaaattaatggtgcccggccggaagagtttagtgaccgtcttaaccgtgcaatgcaatcaatgcaatgtcgtcaagagaaaaggaaagtttctcatcaagctgattccattcgtgccgtttaagctagtactaattcaacacgaatttagacccaaagaaaagcgatttcactatcaatcaggatttggagtacgtgcaggttagattttgagtgtagagatgcaacgaggagcagacgagagacgacctgtcgtccagggaaaaaaaatgtttgatttatctacacaagtgaaacgtccatgcgtagcaatcaaacggagatggacaaaagaaataaaaatgtttgagtacatcgtttttaaccagtaaacaaatcaaggtcaaagtcagacgtgctcacacacacagctgaagcgatcaagcaaaaaaacatggcatggcatatcgcacagtgttttcgtggacttttcctcgcaagcaaaccaaaaactattccaacgaaccaacacgtccaatccaggctctccaactttgacgttccagaaaatcgcaagaaatcagaacagttcctgtacctgacctaacagttgctaaccaatctgaatgcatctctctctctcagatttttattttcttcagatctcttttcataatctggaattagcactgtacattccaacgacatcagggctgagaggccacatgcaatgcagggtctcttttgaagaatctgcttccaggtaagcaaatctctgagcagatccttccaccgtcttgtcatctcctcaattatcttatctatattatgctccccctttggactttttcatttgtttacacaccgtatacaacaacagctcacctaagacaggccaagaacatttgtggtattatttgtttatacgtatacacgctagtgcgatgatcacaacaagattgcgattatacctgtactgatacaataatacagcacgtacagatcatagagaaaagaacagataagagacccttttttttttcttgatgaattagtcatatacagggtagggcagagcagagcagacaagaaagacaatcacaaggacagaaatatgtgaagaaactatgatgatgatgcatggttaattggcaagacttaaattaatgtcaaaactctgaccgatcttgaaacagttaaaaagaacagattgatgctctggtgccatttcaacattgtgacaagagaaacctcctgaacagaagcttcagaagaatctcttctctctctgtttttttttcatggcgtctttgcagagcacacaggggaacaagcaaatgcctgacacctaatttcaattctaacttgctaaggcagtaaggctaatcatctcctaaagccccaaatgtttagcttcttgtttgaggcagcagcagaagaagaagaactatgtccaagaattgagaaagccaccaaaaaaaatcctaggagttaatcatcctctccatgatccaacatggcgagcgagcgatcatctgatacggctgcagagccgcgacacgtcggaggggcgtacgggcttgagcaggaagtcctcggcgccctcctccaggcaccggctgatccggttcggcacgttctccgacgacatgatcaccaccgggatctccttgagctgagacgattcctgcagcaagaaccacacacgaaacaaattcagtctcaagaaattgggggttccacattcacatggatcatcgcgataattcgatcgaatcgaatttaaattaccttgacgcgcttgaggagctcgtagccggtcatgccgggcatccagtagtcggtgatgatcatgttgacgttggggacgaggccgaggcagaggagctcgagcgccctcgtcgccgactccaccgtggtcaccctgtacttggagctccggaggatcttggcgatgacggcgcggtccacggagctgtcgtccaccgccagcacgtgcatctcgctctgcgcctcgtcgccggccgccgccgccaccacaaccggcaccaccttcctgtccccgccgccgcctccgcctccgcctgccctcggcgacgtcgccaccaccaccttcgccgccgccggagcctgcgccgctgccgccattgatcaactcaaaatccaacccaataatccaatccaagaatcctcgagcgattgagtaagcgagtaggagaagaagaggagaagaggctttgcggttgcaatgagttggaggcgcagccatcgctggcgtatatatacaggcggggtgatatgcgtgtcgtgtgactcgtaattagaaaaagaagaaaaagaaaaaagaaaaaataaatgggagaaatcctgcgagatctccaaagggatccgaggctcggggatcgagtaaaccccccctcaccctcacagcgggtggggcccacacccacacggctcgatccggggacgggatccgcggggtccacacgccagacaccgccaccccgcgatccgcctgggattttcgggcttggttggtttcgtaccaatttgtagccctaccaaattcatggtaggttcaatagtaacaaatgtatatttagtttgctatcaattttttgacacaatagtttaaactcaatagcatttaatttgatagtgtcaaaacttgtcaagatttgattttagcactaccaaaatttttggtaaggtcaaaattggcttcaaaccaaagaagccgttcctgcccctctctctcccccgtcgctttcgcctcctcctctcctctcctctcctctcctctgcgtgcgcagctgtttttcttttcttttctttttttttttggccttttgatctcctctcttcttcttcgcttttgaatgttcgcttttgaatgctgtggttgctgtgctgctgctcgcggtatcagaaggcgaatccgagagttgtttacgtgccggagatttgcatgcatgggtgccgcgtgcgattcttctctgcttttttttctctctcgattgcacaatccgcttttgattggtcttggatttagctatccggtttggctgatttagttcagttcaaataggattcgtcgatatccaaatccgtatcatcgttgatatgttggttcggaagaagttttgttctgatctcttctgcagtgcgggtttgactgatgatacagatcgcttgtttttaggcgtctctgtttgaaacacggttttttactattaaaaaaaatggagacttaacccgaaaggcaatacggagtgtgaaccagacaatgccaacatctgggagaggattttgtccttcggagattagcattcctgaaaggtcagctggctctttgctgggaaagattaaagaaatatactagtactaatcgcttctcctgatggccatatttgatttgattagtttttagtctgacaaaacctcctggcttctgggttagcaacaccctggacccgatctcctctggatgccacacgatcaaatcaatccatccatgtagtgtatcaatcagtcgtggcgtgcatggcaggatccgcgcgaattcaaagcccggtggttcaatccgttgccatcaccgccgatccgatccgatcgctcgctttcgatatcgatacgtatatcaatcgatcgatcgatatcgcggcacgtacgccgtccgatccgacgacgaccgcgacgccgcccgacgaggggacctgcaattaaccaaaggtgtaaacgtgtcagtccatatttgggtggctgtgttcttagattttttcgcgcatacgtattttaaacagttaaactatataaaaatataataaaaaagttgcttttaaaatattatattaattcagctttaaagaagttttatttaatacttataattaataatgtattagtaagttgcttttaaaaaattataaaaaatcattattaaagtaattttatttaatacttaattaatattatattaatatgttgttctgttttatgtgtcaaagggatggttctcaccggacacaaacgaacacagcctcaatgcctcataatacggattatccatttattagcactgaaataagtgggttcgtaaattgatccgtttacgtcctttaatcgacacccaatccgcatggctgcacgaatgccggccgaccgggcggccggccagctgcatcgacggcgagcagcggaacaggggatccattaactcctctgccgcggaaaccaatggggattcgggtgcgtaaattcgagagatcggtgtggagatttgctagctgctgctgtggtcggatggatggatggatgaatgaatgtcacggtgctgctgctcgatttggtcctataccaaaaggacagatcggataattgtgccagtaggagtagtagtagggtgcatctgcgttttctgcgatactctccgtgctgtgctgggcctgttcatgttcagaagatcaatttacggacgcttgagatcggaagcaatgtcctttgtgatcgtcctccttcaatgtgtccttcccctgtctctgtctcgattccaacatcggatttgacttagacaaaacgtgtatctttttatccggagtactccctccatccataattctgggacgtatttcattttttatgaagatcaaagaaaaatcagctcatcctatatgtaataaaaatcaagaaatatatacatccatgcaaacagtaagtattaagatagccacttaagtttcaatcaaccattaaatttatctttatttaagttttggatacatgatgattacaaatatgactatctcgtttaaagaaaatggaatatacttaaaacttttggataaagagatagtatttaacttgatcaacaacaaaactgacacatagcgacataggtggtgtttgaatctactgaagatgaaaattaagtgtttcatgcaaaacgaggtgttaatagcgtgtgattaattaagttttaattattacaaacttgaaaaatggattaatctgacattttagaacaactttcatatagaaagttttcgcacgaaacacactatttagcaatttaaaaaacgtgccactttaatacaaaatttaatccatccttttcattacattagaacagggcctataatagtatttctactacccgtaataacttcttacagaattaaagccccccaaaaaaattaacattttgtttagattctcggcttctctgtattctcacctgttggattcacaataactgtagaatataaagtttcctaaaggttgatatatatgtgtgtcagttttacaggttatgaatacatcctatacttatatttctaactaccaggaataccacatatctgatattatacaaaaggtatattcaaatatgaaaatatactatttaagaatggaaactccttcaagagtaaagtccatcaccggtccctaaacttgtaccgttgtgtcatcccggtccctaaactcgcaaatcgactgtttagatcctcaaacttattcgactgtgtcatcccagtacctaaacttgcatattactcgtttaatttctctaacttgtttagtgagaatagaagatgtcagaccccgatctgaataaggtaaggtcttttctgccaagttctatttgaacatgaagttatttacccgcataaatgcatagtttataaaaaaagttatttacccatataaatgcatagtagtagagaataagcaagttgtgcctacttttagagattttctgactccgcccatgcctattaattgcgatgtgttatatgtacacttgactccattgaccagttgctagaagatctccattgatattctacacgacaaaagtttcaggaaattattagccccgtatcgtggtcccatcagctggggcacatgctccctccctctctcctttttggataatattttcttcacgacagaaaagttcatggcttgatgccattgccgccgattcggcacgtcaggagctgcgaattccgtgtgcttttgcaggaaggccgtatctgtgcgcttgcttgcgtcaaccacgtatccgagcggattctcagcgtcgaaacttctcacctgtcgcgttgaaaagttttggttgaaaccttctcctcctccaactaccttgtgtgtctggatgtaaacctgcattgacctgtgaccccagcagcacacactggtcccctttttcatttctctttcgtttccatcttctcaggtggcctacgcttagtcaaacgttaacggagaattggaattaagggaaaaacaagaaacggtctattgccgatatggccggcagtggtatatatctgactatcttgatcacatgggagctgtatgatcatgctagtatcgttttcatttcgggcctctagaatttccgttcactccatggcctgataggaacagtgaagcaagaaaaaaaaagaagaagaaaaacagcgggcaggctgtggtcggctgctgcacctgcttgccgaagaggtctaatttaaatgggaatgtgacaccacataaggtaacgaataatattacacattaaatgaaacacgtgttatacgattgagtaatttgaaaattttagtttttttatacgatgatcattggtcatggaacggagagggagatagtactaatttcctaggacttcatactttatggtcaatttcactcgtaagcattaaccgacttgtgtaaaagttacagagagtaacatggacatgatttgttaaccatcaaatcatcgattggattatacagatattgctcataatctgaaacgcatcgtgcaaaaagaagagggagttggcaacgtacggtgcacgcagtttacaaaataaaacgacggattgagatatgggaggagaagctccaaatcggttttgcttgatcgtgttggatctgtgcacgccatcgatcagtcggtttggcatgtgacggatacggagaatctgggtgggggtgtatgtacagttcagaatcctcggcaggtcaggaattacaatcgtacgggcaatcgcatctgtctagcctttgcccttctttctcacttgcatttttcttttaaaaaaaagttggtacgaacaatcgcatcattcattccttctcactcgtacgtatgtttttttaacgtaatatttacaaaactaaatgtcctttatcgatctatcagaaaatcataaatttaagaacgtgtatgataaagtacagatttaacatcatatatttttttttataaaactacatatttaagaatgtatatactatagttttaactatttttttaataaaattgtagatttaacgtattgtataaaaacaacagatttaacatcggttttattgataaaggaacatattagaagggttcttaaataacttgttgaatgggtgaggctccgaactcagtttatctagcccaccacctcgtggagctagtcagaagaacctgggaatttcttactgtttttgtctctaggttctacatcatgggaagcatcgtcgcagcttgtgtcgatttggatgtcagtcattcccttgttctggtacgcagatctggtacagctaggctgcagctttgagtatcttgcctcgaaggggaagggaaaggagaagagcagctcgctcgctttctctgaaactgtgatactcctagataacgcaagcagaggcttttctctgaaagtgtgatactcctatagagaacgcaagcagaggcaggcgtgatctgcatgcaaacaatcacgccagccatgcccacgcattcctcttcttttttgtgaatttggatatgcttcccgagaatcacaagagtagtcggcgtcaggaggacacggtggacaggagtagtactcctactccgggatatgttcactgcggcaacctgcagctcaagttgcgagtagtagatgtggatggaccacccgggagagtggtagtaggagtagatgaggagatcgcggcaacatgctctcgtgccggagaatcgcatcgcatcgtatcgaatccttgccgctgctgctgctgctttcggagatagagatagagaagggctcgtttgcccaagtcatcagaacccaagtgggggcgtccggtacgagaaggggagatatcgtcagagaatcggttgtgctgctccacattgggaacagcatttacaaatcatccgtatccataaaaaagctcactactgctcctagtaggagtatttactattggtaccgtgatcggtgtacgttcttcagtcagaaacaacggcatctctctcaactctgatgatcgccgtagtagcactgacgatggacaacgccgacgccggcaaaatccaacgatatcaacccgaaaatcaaccgcatccgagataagttagaccactcaagcttggccgacgggaagcatattgcgaaattgttgtcattagaagttgaaaggtcttatgtgtaaacttatttaccgtcagaattgtacagttcttttccttttctttaagccttcggctgggtggcttgacccctatatcaatataacaccaaaccaatctgtttaggtgtttgaaaaaatcatccaagaagatggcaagcaagaaacggcggtggtggcaccggcgcgccatctgctcgatgccggtcgcgcgcctcgaaactgcgcgcgaggcggtcaaaattactcgccacttgcgtttgctactcatggccggatggtcggcatggctcacgtggctgattatccttttgctgctttgcggaatgcggatttgcttatcgccggagattgatgagactgcatcggtttcggtggcagatccctcgccctagagccgtacgcactgcacggcccagaccaccgatcaagatagtactccctccgttccaaaataaatacaaccatagttttccgtgtccaactttaaccattcgttttatttaaaattcttttgaaaaaaattaaaaaaataagtcatgagtaaagtactattcatattttatcatctcataacaacaaaaatactaattataaaaaaaattaaataagacggacgatcaaagttgagcgcggaaaatcatggctgcaattagtaaatctcattgtcatcctggcctgtcgaatcttgatcggttggtgagaaaaaaaaagagatctagagcaattacaagagtaggctataagttagttgtaaacacatatgacacatatatagagaagagaagagaagaaagagaaagaaagcggactacaaatttgtactcttgtcaactgcagcacgaactctaatacgttgtgtgtgtataaaaggtgcagtgggactatatattaatagtttatagataaatattgtatgaatgagctattaaattgactatagatgatttgaagctagtagttggctatactattaaacttggtcttaaaaggagatagtccctctaaacatttattaaaaataaattattcgtgtattgatgattgaacacaagatttcgagattgaggggttgtttggttcaatacttcaacttgccacaccacattttaggctgccacacctccttagccttgtgtttggttcattgccatagttatggcaagccacactttcttaccatcttacctcatatgtcatagacttaattctttgcctaactttgccacaagtgtggcttataatttgtaggccacaaaagtgtggcttgcataacattgtctaaagtgagttatggtaacgttagttaagaaccaaacagcccttgaaaccacatattctctccgtccctaaatataaggtattttggtaggatgtgacacatgatgtgacacataacacattctagtatgttcatattcgttatattaggatgtgtcacatcctatcaaaataccttataattagggacgaaggagtatcttttatcactgccctgtctagtgcatctagatcggtcggtgagacgactgtatgcacgactccttccttccattcttcatctcttgctttcaccttgtcaaatctcaaatataccaatgaacatgcgtgcagcctgtacatacacagtatgtgggttgttgtctgcaaatcctcaactgttccggcgaggcagtttcgctgtgttgagttgagtgactcgaaagtcaacatgaggggagctaatctgcatgtcacaatattctcgagcagatcataggatcgaagagaatcgccacgtcagtgaattttgttgtttactagtgcagctaaatgggatccgtatcaggacgagccaatgatgcaatttccaattccgtagtcgatgtcaacgaggtttgattaaggggagtagtatttgctaactagtactagtatatagtagtattagtcacgcaacatagttgaattcttttaattttgggcggtcaaagtaatatggtttttaaactctgaagatgatgtgcttgcgtctggtgatcttgttactagtttaatgaagccatcggcattgtcaaataccgaagtagtcagctcagaattaagaaatgccgagacattctgttcatggtgagctactattcggaagacccgggcttcagtgtctgggttcagaaaccctccggagctggagagatttcatgagatattcaatgggattttgacagcaacatttgctcaaaagaatagcgaagcaatcttgacggttccagtttgaaatccatattgcattttttgtggtttggtcgtgtcaagcgcatctgctggaaaaatctgaaatgtagcaagtagactagacattagagcatctccaacagtctctccaaatctgactctccaaatgtctatttggccaactctccatctaatttatcaagtcaaactcgttgtttactccaacagcctccccattcaccctctctattctaagtctattacagtgggacccacgcgtcagtgtctcaacctttccttcttctcatctttctccccctttccccaagctctgctggtctgcccccatccgctgccgccatctaccgccgccgccacctaccgtcgccaccatctaccgtcgccgccgccactcgggctccatctccatccactgccgcggtaccgccattcgccgctgccgctcgggttttgctcccatcactcgccgggcgctcgggctccgccccctccatcaccgccgtcgctcgggctctgtccccatccactgccgccatccgccactcgggctccgctcccatccgtcgccgccattcgcggccgccgctcgggctccgtgcccatccgtcgccgctcgacggcgagggacgacgaagactacggtgacgacgacggcgagaggggagaagccagcgccatcaagccgtcgccggcagtagctagttgcgccgattgcaagtagtaggaggtgagagagaagcatcttcaacgtggggcccacaaatagcaaggcatttgggctggccaaatttggccattgaggggaggagtttggccagtcatttggcttagccattctagtagagaggctgttggagtaggatttttttgctaaaatggctaaattttaacttggagagcctattggagagtttgttggagatgctcttagtagttttatactgatttcgctatcaatattattccagcaatcttctaaaaataaataaaaggaaaataaaggtttaaattgaaggcttcaattgactagctcctcccacaaatgtcagtcatatatttacagcctgtcaaggcccattcaactttggaaaaatcaaacatatttcaagtcaattatttttccactatggtgtaaagaaaacagtaaataagcccctacttccagataaacttgagcatgtgttgacaaattgaacactcaccgtttgactccaccacaatagttttgaatcccatgacaattttttttgcaggaaagcatttttttcctcattgggccgggacaacaacttcgaaggcccaaacaagtgctgtgcaattacccagtgggccagaatcaaggcccgaatttctgcatatgtgggctattcagacctgtgcactaattcaaccgtttggttttactcagactagacatagatattagcccataattatgccacttttgggctttaggcccactaatttttgtctaattatagaaggcccaactgcattaatgccaacctaataaacagatacactatattgtgtcctctgaaatctgaaccccagggaatttcggtaccatctctggaaataagctatagaaatattttgaattatatactttaatggcgatatgagctaatgagcagcataaagttataatatacgcgtactaaaatagatggcgaatcaagtcgttcaaaaccaccagaattattgcgatcgagaacaagtgcaatcgagagaatctgatctttgctttcgagtcaacatgaatacggatcccccccacgctttgtgggctgatttctgacgaaatttctcaaaagaggaacacactgcttgatgggaataacaatcgctacaggcctacagcgcaggcgaacacatattcttcccccaattaagtgatgatctggcagtttcctcgtttgagccctgggagttattccgcaagactgtaaggctgatggcatcatcaccacctgcttacgaaaaccatttacttgggatgctaaaacttggagtcactaattatgcatgtaaatatttgtcaagtttagctaaagatttacaaatagatttaaataaatatatttctccttatgtgtttaattaagttattaattaattctgtgcctttttttgtattttttatttgctctttgtttagtgaacattgggcctgttcggctacactcatgcggcggtggtgcaactggccggaacaatgcttgtataagcagtttgtggcaacaataatgttgcagcagagccgaacaggcccattggctgcaataagtggttgcaatttatttgaacaaagatcaggatttgtttctttatagaaaaaggataaaactatatactcgcagctgaaagctctagcctggagagctcctttaaaatataggaattttgtttgataagttatgttctatattttctatgcaatttattgcattacaaacacggtgatcatcctaaagagctaaaattaccacattaattacatatatttttaaagatattagatcatgcaggatctaatgtttttttaagataatgtagattggtagttaggggtgggcagaaaaagaccgaaccgaaaagaccgagaccgagaccgagaaattcggtcctaggtagtgaaagaccgaattttattcggtcaattcagttagtctcctcgggtaaccgaatagaccgaattatcaaaaaatgtctaaatgcaacctacaatccactatgtttaataggattaaaatctaattttcacgtccctacttcttctaggcatgcaacctaataagaatctttactcataagtgcttacgattttttttttatgatttttgtgttgaaaatttccattatttctttgtatatatgaaaatattgttgaatttcggttaggaccgagaccgagaccgaatttgtctgtactaacatttttgcgctgaaattcggtcttcacttttcaaaaaccgaaaagacagaaagaccgaagaccgagaccgaaattttcggttagaccgaatgcccacccctattggtagcaatagttgtatgcaaagtacaattgtactacctccgtcccaaaatataatatttttttgctatgaatttggacacacagttattcagattaatagctaaaaatgcttatgggacatagggagtatatgatttcaatttaactagcccacgcaaaatcgtgcatggaagttccctagtttgaattaaattcctctgttataaaggaccatgatcatctctgacggcaagaattttttttgaattcaaaatatgtggctatttatatttatttcagatcccagagcaatgtactaccacaatgttagaggggggggggggggggggggaaaggagaaaaggacagctagggtggcatacatctccaatgatcacgggggtgaagtgaagtgagagtagcagctcacatctcggggagctggccaatgggaaggccggtatagcgggatgcatgtggtggaggcatggcctcgtttgcgtggagcttactttaggattaggattagcactagcttaggagtagctgctagtatgagtcaaccttaaactcgaaatgattaacgggtgatgataaagccgctccctaatgatgctgccccgcaactgtccagcaactatctggatctctcgctttttctctgcccctctccattactctatttcctcttcctcttggcactttggccttctttaatttattcagggtctaagatatttttgatgtgttttattttctacgactttaaatgtgagtagttgtcctagctcttaacacctttttaaaatgtaattctcctgggaacttctagttatttttcatctttttatcgtctctttgcttttaaccaaataaattgtactttccgttttaaaggatagcaatttctaacgactaaaatctaggaagtgctacagatcataatgtatctcatttaatttcttcaaatacttccctatttcaaccaatcataactatgttctatttaattttacactcatcactaattcttataaaaaataattataaaaatacttatattaattctaggatggatggagtatctctctttcccgacccatttttctgaattgtatcataaatgaaggatacaatcccatctaagttgattttaaattaattcttatgtgccaatgtaaacaaacttatgtttttaattaatcagaggcaacaaattttattttcggtgttagttaatggggttgcttttgtgcaacgtactgctagagctagagtgttaatgcctcctctcacgtcatgcgcggtggcaataatggatggatttggtggagtcgcgtctctttctcttttgtattcctacaacgtcttctgtacttaattctttccttgcgaatatactacgtatgaagcacatttttgggtgcaccagaaaacacctaagttatagcatgtccctgacctgccaatttggtaaacaaaatgtgcaaatagatttggaaatttccaagaaagtaaatgatgattaaatatggtttcaatcatcacccacaaaatttcaaaccagcaaacgacttggtaaccccaataaagtttcatttttcaactaggagtggctcattgatatctaagggctcctttgatttgaaggaaaaatatagtaattttggaggatttcaatactatagaaaaaaattcctatgaatgcctttgaatcaaaggattgaatcctattcgatccttcggaattcctatggaatggacaatattatagagattttggaggaaacttagcaagagctcaaagctctttgaaaatttcctttgaatctctctctcatatccgattcctacgtttttcctacggtttaatcaaatgatcattcctgtgtttttattgtattgtacaattttctattttatacttccattcatgttaaaatcatgtggttttttttattcttacgatgcgcccttaaaacccaccctatatatatttctcgtatcaatattagatttctcctctcgaactctaaattgccatgagatttatgactaattattttttcagtgacagacgacgcaccgaccgacatagagacatccttgatgaccttattaatatatacatataaagatatgttagttcaggctttcgtatatgctctagaaaagtttcacaagtttttagtttcaaatagacctatattatataactagtaactaagtaggccttccaactttcaagatgcgtaccatttgcaaagcgaattttatagcaagagcggtggtcctgtccgtccgttgggggatcacgtagttggcagctcaaaccagttcatcataatatactagtataataattatataaatatgccaaatatttaatactccctccgtcccaaaataagtgtagttttagcacggttcatatctaacgtttgaccgttcgtcttatttaaaaaaattgtaattaatatttttattgctattacatgataaaacatgagtagtactttatgtgtggctattttttaaaatttttttaaaatttttttaaataagacgtatggtcagaacgctaaatacggatatttatggctgtatttattttagaatggaggtagtaggttaatgttgttgctttaggggtaaccaagatgcatgcatgtcttttgccccgtaatcacctagcagcttgctgaaagtttaaggactgctccgtcgtgtcgtgctggccttcatgtagccactcatggagctttcatataatttatttatttagaggagacatataaaaaatgcattttctctccaaatccagcttgggacattctgaactttgacaatatatattatacactctcctggccgtacttatcctgggcaggctctaaccattggctgagactctgagattagaactcttaatctacttaattaattaaatgggatgcatgtgattgagaaaaaggtaattaagtaaatggtacatcaccatcactgtgtggacataagcactaaaagctgacgctaatggtagttaattatcgttccgtttgcaatgatcaagtctactagcatgcgactgcaacgtctcgtcttgttttgctctcttgtgttttgtctgcttgctgttcctgccatacaccgtattctactgtcacttggtacgtacgggtagttattttttaatgaactgtaactgttgttttagggagttgttagggaaaactgtgattattaagccaccggaagaaattaaagatgctaccactagcccctttacaaaggtgagataagctagactactggagggtagcttggggcccgtttggtagtgtaaatattttgggttgtggcctatgaacagaaagaactcgactggtgaacgaaaaataattttattttacagtaagacttttgtacttatatttaaaaaccaaagttaaatgatacaaataacaaaaaaaattattttcaaagttaaattccaaaatttaaaatttgttacggaagtactccatccgtccaaaaaaaaacaatatagatagggatatgtctacctaagacaataaatctggacaaaagattgacaagattcattgttctaggtggagttacatccccacccacacctaggttgttttttaagaacggagggagtacagcttaggtcgggttattttagctcatagcctatcaaccggttatttaatgtgtctatgctttgaaaagtgtgctttctcaaaaaaagaaatctataaccatatgtattgcttagataactttctgaactactccatccatctacttttgatagtcatatttccaaatctaaaaattttatttttgataagcatatttcacttcaacaacctatcgtcttgatgagtttctcggatttaatgcatgactcttcattcttccacacatgattggctacatgggcattgagaaacgtaaatatcaatgaatcgcttgtttacgaggaataactagtagcatgtttatatggatgataagtagaattacttattcttagtctgtgtgccaagatgaaatatgactatcaaaagtagatggagggagtattataaactttatgatgtataattatgtctatatatattcatgcatgagctttcgtgggtatttaggggatgtttagatccaggggtgtatagttttggtgtgtcacatcggttattatacaaagtatcgcatgtggtgttcgagcgctaataaaaaaactaattacagaatccgttaataaaccgcgagacgaatatattaagcctaattaattcatcattagcaaatgtttattgtagcaccacattatcaaatcatggagcaattaggcttaaaagatttctctcgcaaattagtcgtaatttgtataatttgttattttttaaactatatttaatactttatttaggtgttcaaatgttcgatatgatagggtataaaattttagaatgggctctaaacacccccttaagctaaaaacaacattgtctaaaggtggtttccgcagccaaccgaagccacatacgatgaacactgtgaaccacacaagggaaagtattcctcttgtccggccggtatatatatatgtacacatatatgcctttttataactttctagcacagcgatgtgcataccacagaaaggagaaagtactttgagtgacgtatgtggtgccgagtgccctgaccgtctcccagttgatggatcgatctgcacaattgcttatggatatcggtttcatccatccaattccaaacccaggcggaattcaactgaaaacggcggccacccttagtttctctgatgacgcagtagtgaaattacatcacagtttcgagatatcagtcacacacaccctgcaggttttacatattgatcaggattattagtatgaaaaaactacgaagtggcttaggctttaagacatggttagataaattattagctaattaagtcatgtcataatcatgctattgtcatatgcagttactagtactaattaatttccctacactactagatgaaatttgttagtcgctgtcaaaatggaagctgtgtctgctgctgctaagctgagtggaaatttggaggaaaagaaaggaaaaatccagcaggagggtgacaccgcggcgtacgggtagctgtcctgggggtgctggctgccagttgcgtcaacggcagatgcgatcaatgtcgatgcagagatgcaagttgcagcatgttggcgtgtcatgccgaaagaagaaacgggcccgcgtttaattagccaaattgtcacaatgcacccggcttcttcgccgtactatagtgacctcaaacgcatacaagaacaagttccatttcccatcttgctctctccaagttaatagtagtagccttctgtgtagtcaaaatttaaaatctgaaactttgattttaggattttttttttcttatcatagtctatttatcaaccataatttgttagccgctaattatacatgtataagttaatgttttacatatgaattattttcagttgcttcgtttatttatctttacacggctgaggcttatcacccgtagctcaaccaattagtgccgttaaaatttcgcaacaggatgtgaaattatattatttttttaaaaaaaaagattataagataaaggtaagattgtacagtcacactagcttgcctagtgttgagacatttgttagggccttagggcatgtttgcttcgtgccctgaaaaatttgtctaactcaggcacaactctcaggcgtccgattttgtgcgcccgcgactggatcgacctgcctgagcgagagcccccggaccagggcagcaaccaaataagcccttaccccttgcaagtgcttctttgcaacaatatggaatgtgtagcgagcagtgagaggaattttgcattggtacatccctggttcatttgggttgttaagacaacaacaatgaaatttagagttggtcccattttccatactgctccaagttagattggactactgactatactgtactagtagtctttcattgtctgcttgttgacttataagccacaactaattttagaattgattttgggacttttcaccatggtctattttcagccttaacttttaaatcactagttatgcgatataaaagtgttacccatgaacatttttcggttgcttcagttatttttctattgcttattagttgtagctcaagcgatcggggccatgagtaaaaatacttaatagcaggatatgaaatcaaactattattttttaaaaaggagagaaaagataaaggaaaaattatgcaatcacattaccctagtgttgagacatttgttatggacttgcaccttgcaaaagtgtttctatgtaacaatatggaatgtgtactgagtagtgagaggaattttgttttggtaaatcccttgttcactaacaacccaaatttgtaaatgtcattattattcataatactacttgccacgcgctactgaaattttataaagttaggatcatactactaaaattttgtaaaattagaaccatatcactgatatggttctaattttatgctatttttactaccatggtattttaatatttatgtaaccgatgcaccctaaaataatggttattttcatcagaaaccaattaaagataccattgcaatcacccgaaaatatgcatagaatccaggcgagaaaaaagaataacacaaaggttgagaaaagattggatgctccactttggtggattgtgggatgtgggatttcagatttggtccttttccacaaggtttgggacacgcagcagtaggccagatacgaggcactcttcttcttgtctcagcttctccttgatttcttttcccctctttttttttcttttctttctttggtccgttcaaaagtacagtggtgggccccggcgtgcctgtggtgttccccacaggggaattttgtgtcgccctcactgcttgtctttcttttgctttgccccacaaactttctcattgtttttctttttttcttttctatttttctatttttttgcttcatgagtacgctagctacatggcatggcatcctctcgtcatcaatacggccatacaagcaagccctcctggctcgtgatgatcacggccacgcgtacacagagtagtaaatttgttgcttaggtggtgtttggatcgacttaactttagtccctctatttagacactaatttagagtattaaatatagactacttacaaaactaattacataaatgaaagctaattcgcgtgataaattttttaagcctaattaatccataattagagaatgtttactgtagcatcacataggctaatcatggattaattaggctcaatagattcgtctcgcgaattagtcaaagattataaatgggttttattaatagtctacgtttaatatttataattaattttcaaacatccgatgtgatagggacttaaaagttttagtcccatctaaacagggtcttaattaacttgtgcattgttaaaacaatttgggatgcatatcgcgtacgataataatgagatgagaacaacaggaactatcagtcaatcgcaaggttttttcctggttgaccaaggcaaaaattaagactttgtattctatcgcggtcaatgggttttttgtttaagatgattccaaaacgtgtcgggctagggtggtgagaggtgtgtggatatatacaaacgacatgcgaaaattccacttgcaccggtgcaaccaaaatgcagctacatggaatcaatctttggtagaaaaaaattaaaaaaaaaacatgcccaaagtaataaaaagcacacataaattaagcacctaattgaccattactatcctataggtaggctaaaaacaaatctatgtccaatcattacatgacaagtaataatgtatgacaaacataaaagatactcctacaaacaaccacaaacacgctagcatgctttataacgaagatgtttgtataatgaccacaccaacaaagactgcacagataaaatagttctcccatactaggttagttgaccaagaacgttactaagcaacatatataatataaatactgaaattcaacatcatatttcgacgatatctaccatccaaatcggtactatcctagtaagcaacaacgacaaacccagttcgtgtctacccatcattcgaatacgttcatctgtatcgggtgggttcatcactacctttttccctaagatacatgataaagctagttctggatgaaggagctttttccaaaaagcaccacgcaggaaaggcgttcttcaggagatggaaaatggatattgccgtggaaagaattcacgagaagcaggactttgcccggttgggttggaagttggccaggagactcaacgagaacaccggcggcatccaaccaaggcctggtttagttcccaacttttttttcaaacttctaattttttcatcacatcaaaacttttctacacatataaactttcaactttttcgtcatatcgttccaattttaatcaaacttttaattttagcgtgaactaaacacacccaatcggtgcgtggaattttgtggtgtgtccatgcagcatttgctcgatcttggtgggcaggaggtttccctgtgacctgtgagagtccgtgccgccgcggctggccaatcaggtggcgaaacgttgcgcgtctcgattgggcgccgtgatgccttcaccgaaagcaaagagcgtcgcacgtgcgcctgccccatgctagctatagcaaagcctatgtaggccatgtttggatagctcttgttagctgtagcttatgtcaaaaatctcttactactgtcagaagttttctcaaactgttttaattatcatatatattctgagaatgtataattatacaatcagaaaataactagaagcttgagttcctagatttttcggattctcacaagatggtttctgattagctgcttttaaaaatattaagctccctaaggatagtaggacactggctattgctatccattgaagcccatccgcttcgtagcctagtttttactgcatggattggaatccttgtgggctcgcttcctcacgggatgttctaaccagatgggtgtactccttccatactcataaaggaagtcgtttaggataatgtttaagtcaaaccttgggaatataaatcatgaataactcttaaattattgagtttgaaaatgtaaaaattatatgaatagatttgtcttgaaaaatactttcataaaagtatacatatatcacttttcaataaatatttttatagaaacaagaagtcaaagttgtgtattggagaccgtgtcaatgtactaaacgacttcctttgtgagtatggagggagtatgtatagtttgtaggcaaattttgctacaggacatcgcgacttcgtggttttagctgtaggacactgcacgaagtcacttttggggaaagacactctcaaaatatggttatttgccaggggacactgcaaccaataaaatattaatttctggttcaataggagagctaaacagtgtaaaaggtcaaaaatgccctcgggcccacttgtcatattcttcccccaccccaaacctcctccttgcctcctctacctccaccggcgatgacgtcctcaccccacccacccccacccacagccacgagcaacgagctcgacgctaggatgggcggccaactcggcgcagggggaggcggcgcccgccgacggctcccacggcggcggcctcaccggagctccgccacgaatcgaactcgcaggttgagatgaagaagcggaagaggcgcggcggtggcgcctccgccgccttcgaccggagcgtcttccccattctgctcgccgccatcgccccggacagcggtaacccgcgacccc

SEQ ID NO: 72650 - DNA, 1109 bp, Oryza sativa
aataaagtgcctgttacagtcaaggttattccgtgcattaagtagtaaccagcttaatacaatactaaacctctatgttgctgtgcagagacttgatcacctgcaaaatgagcaagaaatgtatgaaattagagtggccacagtaaaccacacacaggaaactcaattctgtaaccccattttaacttgtggtacagggatagacaaatccacaatcaaatgcaattcttgaactgggagatggtcagatgatcagggcactcacgtaaatgaacatctggtacaagcgttccctctccgcatccgtaaacgacgggaaagccctcttcacatcctgcagtgcccaccacaacacgagtcaacaccgcgcacgaatcgatttcacccccaagcactctctcgctctaaatcacgccccccaacatttcacgctggtctctctcagtagcaaagcgcagtggccgcgagagctgagcccgagaaattcgaaggtggggagagaaggggaccgaacctcgcgggagcaggcggtgaggacggagcgggcggcgagcttgaaggacctttcgaggttgccgtacctccccgccgccgccgccggagcggcctccatcggtggtggattccggcgaggtggaggcgccgctcgccgttaggtttcccgattcgaaattccgacgagcgaaaaaaaaaaagaaaaaatggctgcctctccctctcgtctccacgctgcctcgtgaggaaattgttatgtgggccttattgagccgtctcatccagattgaaccaggcccagatatagatggtcctaattgatctaggcccaaataggccgcgtcagacttacaggtgggccgtcaggccgcctaacaaaggcaagactgacacctctcagaaggaaagacacttgttgtccgaacagatggacacgtgtcagggtggcaggcgctcacatcgtgagcggttggatcaacatcctaaggagtagacgaggagtacaatgctataaatatcgtggcaaccacatgctaaccctaggtgtccattcccctaccccctcgccgccgccgcagctctaggatctcttcacccttacatgtgtgccatcg

SEQ ID NO: 72651 - DNA, 5677 bp, Oryza sativa
ttcctgcggcccgttaatattgttgtagaggcttcaatagagagaaagaacacttgtagatgaaagttctcaggtattctcaagaaaacaatctctatactttcttgctcgaggtaaaaggtatttactttcaacgcggatttgataggttcgatgatgataagcataacaaaggaaatggtctttgcagaggcctcatcaaggggaggggcatctatccttcttatcaaaatcgttagatatggtaagcaaatcctcaattaatttcctcttttttcttttggtagaaaaaaattccaattgtctcaacatgatttatataggttggatatgctacaatgctgatttactgttgttttttgccttttttgttgtctttgctattcttcttttatgagctatatataaatctatggtaaatctaatctaaatcttatcattgaatagaaatacctataatgtttacgttggctacgcaacttcgagcattcaaacattcccaattaccatcgcctccctaaacagcaatggtaattggggatgttcggttgctcgaggttgcgcagcatgctgtgccttgaccgtcaaacgaccccattaataatagcaaaagtggacttgtatatgaggtttggtttgcggatagagtatggtgagggcattttacaaaataatgcattgtaaatctaaaccatttctgagattcttatcgaataccagtaataatggtttttatctctgattgtatttttttattaaatgatttccatctgagtggcttatagaagtttggtgctttgaaagacagtggtaatgacgatggtaatgtcaggagcagacttattgctctgatgtacttcctccgttttataatgtaagtcattctagcattttccacattcatattgatgttaataaatctagatagatatatatgtctaaattctttaacatcaatatgaatgtgggaaatgctagaatgactttcattgtgaaacagagggagtatgaggtttggctcggggctagggtatcacaaatgcgttttctcaacaaattcagaatagatatactatttgggtgatattcatgactatgaagtgagacttggagaccattatacaggctagggctgaatttatgatttttcaacttgaaaagatttatgattttcttactagagaatttagatttgcgttattaaatgcatcgtaaatcaaaatcagtatctacatcttacatcttagtagtcatttattggattctaatcaaatttcaatactcttggtttatctttgattttgtatatctttttattaaatgtttttcttcaagtttcgtggttaccaaaaagttcggttttcagtggcaaccacctcatagaacacctaactcgtggcaaccacgaagttagaaaacatttaataaaaataagatatacaagaaaaaaaaataaaaaaccaagaattggtatttaatatgagtacaataaatggcccctatataataacctaaatctaaatattctaaagttagaaatcattaattcatttatttaatataccctacatctaaatcttccaaagttagaagtaataaattcgcccaaccctatatattggcctctaacctcacttcatagtcatcagtcatcacttcttcccaagtaaaaccccaagaagcggctattacttctctcccctgttcttcttcctccacattcccatttcctaaaaaaaaaatccccaaatctccacatgattcctccgtaattcggcgcgccctctcatggcgtccctcgccgaattccccctcccggtgatctctccgacttgctggagctatcggtagcgggaggaatcaatcaatcaatcccccacgctgggtggttcttgagcaagaacggctcatcgccgtgccgatcgatcacgtcggccgacggggaaatcctctggggatttgtgggtggttttgggctaaagattccgtttctttcgagcccttttggtctcgggtggatccgcttagctttggttcttttgctggttggggggcatggcggcggagtcgtcggctgctgctgctgcgggcgggggcgagaggaggggcccgatggatctgaacctgtatctcgcgctccctccgctgccgccgcctccgggaaggctggatgtcgccgccgattacccgtcgctgctgctgaactccgccgccacggtggcgaacgagcaaaggggctcggtggtggtggcggcccgcctccggcggcggcggcgtactcgccgtcgaacgcgctgtcagcgccggagcaggtgctggtagatcctgttgcagcgtggcttgttgatcccggtgagcagcagccggtgccgccgctcgagacgccatcgtacatggccagggcctcgtcgacgctgccacagatttttgcttgtgcagcgttggaaatgcttgtgcagaccggtggagcaatcccacctactggtcttataaggggagcagagattgctgctgcaagccgccctatgacgccggaggatcggctgcggaggttgatccaggtgagcgatcaacacggcgtcgggaatgggagggcggggactgggccagtgagccgcagccgacgggcgaatagcccggaagccgataatctggcgcgggccatccagaggtctcataattctcttgaggcatcaaggaggcagatgcttgatggtgatggcagtgatgccaccaagaaggatgacggttgcggatgcaacggcagcttcgaatgcaatatctgctttgaatcagctaaagatcctgtggttaccccttgtggccacctcttctgctggccttgcatataccagtggcttcatggacattcagagcactctgattgccctgtctgcaagggcgaggtgctcgaagtaaacgtcacaccgatttatggaagaggaggtggcgaggagaactcctccagaaatgatatccaaatccctcccaggccgagtgcgcagaggaccgagagcttgaggcagcagctgcaaaggccagacacaagaggaggcattgcaaacatggtgaggcggttgatgcaaaaccaagatatagtggtaggccaggcggcttcatctgcaccccggccaaggggtaggggtcgaaggcaggcaagacaagatgcgccttctgcaccagcaacacagcagcaggtggtcaatgctgatgctgggagtggcaatcaggctcctttgccacctcctgatgctaatggtgctgcaccggctgctgctgtcgctccccaacagtcatcatctgtggagcaagcgtcgacttctagcaccgtgggtgttatagcgggagggccagcacaaggtaggaggtcaagagtttctgaatccacccctgcaaggaggacaaggaggaggcatcagtaggtaacttagagttgttactgtaatagaacatatacaccatgtttccttgtaaccttgatcatatttaggctcatcccaaaattatgtagaattgtggatgaaatcttttcttttatttaccttgtatccaccattttaccttaggcaaaggaataaagatttcgatttcaatatatatggatggatctctttgtcgctgtgtattccaggataatattttctgacatgatatctgtttctgataatgagtttcagatattctggttgcaccatgtacctttatgctattgtgattcctggtactgaaactcacaaaacttgtggagccaagtcatgtgtatccttttattcagctagatttgtactgttgagatcgaagataggaaccaatgcattatgcttttcaatttaaatttgacactatgactattacaagttaactagagttcagaaaatcactggtactcagagtcaggtacaagtctcttcctttgttttcctctgattgcagctccattttgaatgagagcaaaacttgcagtattcaggtggtcaagtttgtgtcagcatgttattgttaaccattttaagatgtatttttatgtctattttgcagtgacattccataaatgaatactgtagcatacaagatcatgttatgttgaggcctgacagattatagactccttgatctgaacctctcatggggcataatcagttcctgtgtgtcatgaactaacattttgttgcaaatgtaaaagctatcaaaaacatataaaccaattgtatacttgtcaataatcatttacatttcaggtacatctgaacatttgtgttggcaaaaaaaaaacatatatattccccatggctccataataatattgtttgcgaattactctttgaaggtcaccttgtcaatgtaccagcctctgcaacaggatgcacattgattatgcccggacaggatgcaaatgaaattacttgacgaaatcagtcttctgcgtaataatttctatcccactgactcgataccatatggaacatatggccactgtttattgtaacttctttgcatggattctttttgtacaagaacaatgtcagattggtgctatgcaactagctacaacatacatgtctcggtatcaggcatttatcttaaaattattgctccagagtcagatgctcagagcacaagctgcttgggttagacttgcatgctgctagatttgctgccattcaaatggaggttggtactccttgtgtatccagcatttgggcagcgtagcactgtttccttaagctttataatggttatcttgccttcctttatatctcgttccgtcatttgcacattaaaaacaccaggtcgatgtgtgtttcagggggccgaggtgtgaagatggttgaagtagcacaatgaaacctgcaacatgttgtgtaaccactaagcagtggtcattgtaatatcctgactacctttgtttgcttggaagtgtttgtcctccatctgatgcaatttttcctttgcactattcccctactttgaaaatgcagtgtacatcacctgcaatgtttaggtgtgggggtttgtggggaagaaaatgttagattacaacatctggttcttaggattcagctgacctagtttagcatcttatatgcttcttacatagtagaaaaacaggtttcaaatattcgaataattaatgtttttaccttgggcaacaacatatttcagatattcgaataattaatgtttttaccttgtgctagatgttcaggataacaaaggtagctgcgaggcctgcacttcagcaatgatttgtgctcatcttcagacactgatcatgcaccatgaataccagcgataccatcagtatgacaattggaatattgaatgattatgtgccaaaatgttcacatgttaccaccggttgttgtatggctcagttcagtatatatcatttcaaactccttcacagctacaatagctagtttgtgtacaggttcattatgtcttgaactgctctatcaatcccagtaggctgtatgtttcagcatctggcatcgctcctctcaaaatcatcgctcttaacaaatctggctcataaacttttgcctttacatgagctttaagaagggtattatacacaaatgaattcctacagtactttgattcattcagttcgtcaaaaactctctttgcatttaccaagtcgccattttctgcaaagctttcaagtatcatatga

SEQ ID NO: 72652 - DNA, 20327 bp, Oryza sativa
  unsure (1)..(20327): unsure at all n locations
cggtcggggcgtcggaggagcgggctcctcgaggccacgatggcgcgggcgggagccgcaggggggaacaatctaccccgggagggggtcgtgcttctgggccccgcgacgggggtccggggggcaactgccctgccgacgcccgggggaagaggaagcaagagggtaccccttccccatctcctccccgagggggcggggcggtgcgtgccagcagcaggcgcccggagggtaccgcgccgacgtcgcagcccgaggggggcgaaagaagaagcggctccgcaagatgggggagacggaaccatgccggggaaacctcatctctcccccaaggtggtcgtttagccgacctccccgcaggttcgtccccgcgcccactgcggccgtattcattctcccatcccccaaggcgagtttttactcacccgcttctttttgtcttctggtttttcttctgcttcagcgagatcccgtcgcgcccccctcgccattccaagtccggccggtctgaggtcgaggagacggcgaccgcggagactcggaggcgagaagctgaccggcgagaagccgcggtccgcctccgggaatccgaggaggctgtccaggaggccgtccgggctcgccaggctgaggaggccgctcgggaggaggctagactccgccgggccgaggagtccgtccgggaggcggagacggcacacgcacgccaggcggcccgccaagcccccgacccgactccgcctgaggcgacgacgacttccgaggccacccacgacaatgccgcgggcgcaccgctcgggcccgacccctcgggcgacgctcaggacgagccggcttcgggggacgcccccgagcccggcacgtcgatcggcgggccgagccgcgcggcacccacaccgaggcggctctcccctctgccttccactgccccactgagcgcggagcccctcctgcaggccttagccaccgcgaacagcacggtgctggacgggctaagtgcccagatggaggtcctgcaggcggagcgggtggagctcgacgcggcgtgggcgcgcgtcgaggaggggcggcgctcagtggaggccatggtggaggcgggccgcaaggctcactgccggcacacctcagagctcgaggcccgtcggagggagctggcggagatcgccagggaggtggaggaggagcggagactgccctcatcgccaccgccgtgctcgacgagatgcgggacgacctccgcctccaatacaggagccgggcggcggagctagagaaaaagctcgacgccgcccggggagtccttgacgcgccgctgcccgggaacggcgggcggcggagagcgaggcggcgtcccggcggcgtgaagaggcccttgaggctcgcgctacggcgctggaagagcgcgcccgcgcgaaggagagggacctggcagaccgtgaggccgccgtcgccatccgggaggcaacgctggcggcgcatgaggccgcctgcgccgaagaggagtccgtactccgtctccgcgaggacgcgctcaccgagcgggagcgagctctcgaggaggccgaggccgcggcgcagcggctagcggacagcctgtccctccgcaaggcagcgcgagaggagcaggcgcgctgtaatctggaaggcgcccgcgctgagagggccgcactggaccagcgggccgctgagctcgaggcgcgggcgaaggagctggacgcgagggcgcgcagcggcgggcggccgcgggtgacggcgacctagccgcccgcctcgcagctgccgaacacacatcgccgagctgcagggcgcgctggactcgtccgccggagaggtcgaggccctccgcttggcaggcgagatagggcccggcatgcttcgggacgccgtctcccgtttggaccgcgccgggcggcaggcgggcctctggggcgggcggaccgcgaagtacgccgccaaccaggggggcctcgcccagcgcctctcagagatggccgggaccctccagcggctccccgagagacctcgcccggggggcggtggagctcgtactggcaagctatcaggccagggaccccgacttttccccgtgggcagcgctggacgagttccctcccaggaccgaggacgacgcgcgcgcgcaggtccgggacgccgccgaccacatcgtccatagcttcgagggtacggcccctcggctcgcgttcgccctcgactccgacgaggaggatggtgcggacgacgaggctagcgacccgggcgcgtcggagtgagcccccgggcccccgccaatcttgatagccctttttttttcgaggccttcgggcctccttcttgtatagactaacttaatctgcaatcaaataaagagaaaatttctgtgtcaattctatttgttgtgtgtatgaggcaaggatggtctgtgccgcggtccttctgagtcttggcttgaacaagggctcgtgcccaggtcccagcctcaaacggcgcgggtcggggctagtgcctggggagatccacatgtcgagactggccaggccgggagcgtggtgaccgagggttatggatgacccgattgtgggcctttgccgattcccccccggagttcaccacaccccggggcacggctcggttctgggccccttttggcgattttagccggcccgggccaccgagggcaggatcgagcacgagcgtgctaattcaagtcaagattcttcaaaaggaaacaatggcacagatacagtccttaggaaatcgaaaatgcttttattgaaatacggaagagaaaaaagataagtatatgcatgtggtagcccccggccaaccctgcacgcccgggggggtgcggggttggcccgagcccgagacctgatacccaacccccactaggggtagaaacgacgaaggtgttcgatgttccacgggttaggcagctccgtgccgtcgcccgtggccagccgaacggagcccggccgggggacaccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctgatagcgcgcggctcggagggccgcgcgccgccttcgctcttccaagtagtcgaggtcgtctctgcgaagctgatcttgatcagcctcgcaatacatggtggcccgaggggacctcagggtgagctcagatgggaggaccgcctccacgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggctcttgaggatttctgcgttggcacgctccacttggccattgcttctggggtgggcgggggaggcgaagcagagcttgatgcccatgtcttcgcagtagtcaccaaagagctcactagtgaactgggtgccgttatccgtaatgatacggttaggcaccccaaaccgagcagtaatgcccctgatgaatttaagcgcggagtgcttatcgatcttgatgaccgggtaagcctcgggccacttagtgaacttgtcgacagcgacatacagatactcgaacccgcccggggcctgcctaaacggacccaggatatcgagcccccagacagcaaacggccatgaaagaggtatggtctgcagggcctgggccagctgatggggttgcctggcgtggaactggcacgccttgcaccgccggaccaggtcgaccgcatcgttgagtgccgtcggccaatagaaaccctggcgaaaggcctttccgaccaaggtgcgtgaggcggagtgggctccgcactcgccttcatggatatcggcaagaagctcgacgccttgttcccgaggaatgcacttcaggaggactccgttagccgcgcgccgatagagggtcccttccaccagcacgtagcgcttggagatacactggacgcgttcactcccttcgcggtcctcgggtagagtcttatctgcgaggtacacctggatctcagtgatccaagcaatcaatctaggggagctgggagcgctcccctcgggtcccgaggcctggactccgacgggcctcgggggccgttcaggtgcatccgtctcccctagggggtcgggtcgcgccgacggctgggcaagcctttcttcaaaggcgcccggtggggtctgggctcgcgaggaagcgagccttgagagtccatcggcgaccgcgttatcccgtctgggcacgtgccgaagctctatcccgtcgaaatggcgttccatacgtcgcacctggcgcacgtaagcgtccatctgcgggtcggagcaccggtactccttacagacctggttaacaactagctgggagtcgcctaacaccaggaggcagcggatccccagtccagctgccaccctgagtcccgcaaggagtccctcgtattccgccatattattggtcgcccgaaagtcgaggcgaaccaagtatctgagaacgtctccgctcggcgaggtcaacgtgacccccgcaccggcgccctgaagagacagggagccgtcgaactgcatcacccagtaggcggtgtgaggcagatgcgaggggcccgagctggcctcggggacagagacgggctcgggagctggggtccactctgccacaaagtcggtgagggcctggctcttgatcgcgtggcgtggttcaaagtgcaaatcgaactcagagagttcgattgcccatttcaccacccgtccagtaccctctcggttatgcaagatttggccgagggggtaagacgtaaccaccgtgacccgatgcgcctggaaataatggcgcaatttcctcgaagccatcagaatagcgtaaagcatcttctgggcctgagggtatcgggtcttagcgtcccggagggcctcgctaacgaagtagacgggtcgttgcacctttcggcggggccaaccctcttcgctaggggccgcatctccagggcgctcttcgtccgagaggccgcagggggcgcactcggcttctgtgccaacgacctcggggtcggagggcgacaggcgcggccttcccgcagtggccccgaggccatcctgggggtcgggggtacctggcaccgtcggacaagcaggcggagggccatctccggccgtcgggggccttgggccaccgttcagctcgggggcctctcctccctgctctctcccgggtcgagttgatacaggattaacctcggggtcagagagcggcaggtgcggccttcccgcagtggccccggggccatcctgggggtcgggggcgcctgacaccgtctgacaagcaggcggagggccagctccggtcgtcgggggcctcgggccgccgttcggctcgggagcctctcctccctgctctctcccgggtcgagtcggcacagggtggggatgcgcggaatgagggttgtcctcatcgcgctccacaaccaacgccgcactgaccacctgcggggctgccgccaggtagagtagcaacggttcatctagctccggggcgaccaggactgggggagagctgagatacgccttcaactgagtgagggcccgctcagcttcctccgtccaggtaaacggcccggagcgtttgaggagcttaaataggggtagcgccttctctcccagcctcgatatgaaccgacttagggcggccatacagccggtgacgcattacatatccctaagcttgctgggggggcgcatccgctctatagctcgtatcttctcggggttggcctcgatgcctcgggcagagaccaagaacccgagaagcttgcccgcaggtacgccgaacacgcacttgtcggggttcagctttatgcgggcggagcggagactttcgaaagtttccgctagatccgagagtaaggtctcttggttgcgcgtcttcacaaccaagtcatcaacataggcctcaacattacgtcctatttggctacccaaagaaattcgagtagtacgttgaaaagtaggacctgcattctttaacccgaaaggcattgtcgtataacaataagttcctacaggggtaatgaatgcagttttttcctcatcctccctagccatgcgaatctgatgataaccagagtatgcatctaaaaaacacaaaaggtcgcaccccgcggtggagttgacaatctgatctatgcgtggcagggggtaagggtccttaggacatgccttgttaaggtcggtgtagtcgatgcacatccgaagcttgccgttcgccttgggaacgacgaccggattcgccagccactccggatggatgacctcacggatgaatccggcctccagaagtcgcgccacctcctcgcggatgaaggcttgacgttccggggcctgccgccgcactttctgccggactggccttgcgcccggccgcacggcgagacagtgctcaatcacctccctggggaccccgggcatgtccgctggtctccatgcgaagacgtcagcgtttgcccgcaggaaggagacgagcgcgtcttcctatttgccgtccagaagaccaccgattcgtgtggtcttggacgggccgtcgcccagggctacctgcttgatcgggacctcgtcgcatgtgatcattcgctgcctcggggcggctgggacggaagcgctgaacctctcgtcgccaccctcgggctttgatgccgcggcgaggtggtccgcgcgctgctcatgcaagcaagcgcgactttgagctcgccatggacggtgatggggccaccggggcccggcatcttcatctggagataggcgtagtggaccgccgccatgaacttcaccaacgcgggcctccccaggaccgcgttgtagggcagactgaggtccgccacatcgaagttcacccgctccgtgcggaagttggcggatccaccgaaggtgaccgggaggtcgatatgacctaacggccaagtgtgccccggcgtcacaccgatgatcggctgggacggccggagcaccatccccggggccttgatggcatcaaaggctgcgggggaaaggatgttgagggctgcgcccccgtctatgaggacgcgccccaacttcacattgcaaacggtgggggaaaccaccatcgcgatctgtcctccccgggcaacgcacggcgggtggtcggtctggtcgaaagtgagggcaacctccgaccaccgcgcccgccgcgtcgcctcatgggtaggggccacggccagaagctctcgcttcatggccttgaggctccggcgagaaacgtgagcgcacgctcccccatcgacggtggcgacgatggccccgggctcctggaacccaggtcaatngtcgccatcgtcgacatcaccggtggtggccttctgcttggcctcacctcgccggttgccggcgggagccgccggggccttgccctcacggcgctcctgcctcctctcctcctcccacttcctcgtccgctcagccaaacttttgaccgcgcggcaatccgcgaggtcgtggagggaggtgttgtgcacggaacaccacttgccaaacttttgaccggcctccttctttttgtcgctcgcaggcctcccctttcgggtggcccgcgaagcgccctcgacggcgaggacgtgaccctcgtcgtcggaatgggccgacctcttcttcttcctcctgtcccgccgccctgaccgagcggcggtcccggaggcggccggagctgccacaccggaaccggaggagttccaggtccaggcctcctccttgcgagccacacggtccgcgagctgaaaaagctccgcggtggtctggggctccttggaggcgatcttctcgagcatgcggttgtgccgcacgccccccctgaacgcgtagatcaccgcgtgtgcagggatgcatggtatggtgttgcggacttgacagaaccgctgaacatacgagcgaagagactcatcgtcccttcgctgcaccgcatgcaagtccgctttttcgcctgggcgcggatatgtgccctggaagttcgtggtgaactgctggcacagatcctcccaagagtggaccgacgcgggtggcaagttcattagccaaccccgcgcctgacctttcagggccatgggaaagaaattcgccatgaccctatcgtcacccccggcggcctcgatcccagtcgtatagatctgaagaaactcggcggggttgacgcttccgtcgtatttttcggtgatggtgggccggaaccttgggggccaacggacgttccgaaggctcgccacaaaggctcgacagccggcaccgccaaccggggacacggggggctggcccctgtgcccgaaccgaagtggcgctccggacgaggaggcgccctccattgcgtgggcagcacgacgaccattgcgccggcgctcgatactggggcgggtatccggccccccacgcacatcttcttgggtcggaggcgttgacgagggaatggcggacgaacggcgggaaacggccgccgctcgccgcgccctccgcctcgacgacacggagccggtggtagcagcaccagaggtcttggtggcggaggaccgcccaccggcgcctaggcgctgctgcgccgtcatgaccaagtcggccacgtcatccagccaacgtcgggctggagtctctggatcggggacgatgggcgggtgacgtaggagcgcgcccgcagcctggagcgcgccctggggcgtgctaccatcgccgtagacgaggaggcgacgctccccgtctcgccgtccttctccatcgcccgcgggcggtgaagtcgcggatctttcgaccccttcgaacgcctcctcccgcccaagacttcggcgagagggggacggtggagtacgaactcgacggcgcgggttctgctccccgtcgtcaccgctagcgctcggagagaggttgtgcgccactgcccgttcggccattgggccgagcgggagaagcttggcgcacacgaaagaggatgagggcttagaaagacacacgcgccccctacctggcgcgccagatgacggagcttggggctcctcaccgggagaccgcgcaggcccccctttgccggttcggccgggggcgctcagtgaggttctttgccctcggtctggggaaagttcgcgagagagagaatgcacaagacacgggcgatgtagacaggttcgggccgctgagaagcgtaataccctactcctgtgttctggtggatctgtgtatggagaagttacaaagagctggggagcaagagagttcaggctctagaacccctctattccccccctggctctcgatctgatcccatccccttcttcggtgggtaaggtcttccttttatatctcaaggggaaaccacatgcaccacttctacctactcttcttttgggtggggacccaccctatcttgaccaaaacttggctcgcatcttcgcctggaagctaaatcatagcttgtccttgagtgaggcccagcgccgtcactcgcctgacataggggatcaccctgtcattccttcattaatgggcggagattgcaatggctgcagtccgaatgacccttcgatgggatgggtcatacctacctccactccgccggatgcagatgcaacgtgggagcacagtttgtcttccgatgacgtgaccggcatcagaccagtcacagaccggtcattcttgtccaccacgtgtcagtttagcatgccgcacgtctgctcttctttatacaattacttccttgtaatggttgcgatgaagcctggcatgaacctagccgggactgacgtgccaactgcaggagttagcacgccggccccggctagggacgagttccaggaggctctcatcattccgacgggacggggcgaggcgtgtgacaggccgcctgttgccacctaacccgcgatctgaccggtctgtgaccggtcacacactgcgaccggtcacggaccggataagcgagcgcgctgcgctgcattaaatgcggcgtggcgcgctcgtccaaactgtaataaatgcggttaggtgagccccgctgtgttcacctaacccatacacgtggcgccagaaccacagagggtcggggcgccccagccctcggggtcgaaacgggagcggcccgacccctcggggagacggaggaaggggtggccacgtcaccctcgggcccgaccccccccaagggggtcaggccacgtgggtgaccgcggctgcccaagcctctagtcatgatactcccggtctcatgtcaccgacaactgtggtaggtagtggaaatatttaaaagtttgaaatttttgttcaagtttttgtaaacttggttgggttacggggctccagtgacaaactccaccttttgatccaggcacaaccacacagcctggtagctccaacatatccaaccccttttctctctcaccattttttttggaaattgtttgttattatttattttttttaactcaccacatttccacataactctgccgcatgctcttgcacataccatgttttgctaaaatgctaatacaatcaactagaaggcattttctaacataacacgtctcttgagttctacttggataaagtgacacctagagagtatgtaagacatcacctcctagaaagagaggggaaaatctttcgaatgatgaaacagataagtcatcccaagttgacactaggagaaataccgagtcatttccacattgctaagagtcattgctaggagtcccgttgacttagactatactagattagggtcttcaccttatactattgagtatttatagtagatcaatacatataaacacgatagattgctattacccattaggaggctcgatttgtataaaaaccattacctcctacttcatagctcaccttcgcgagcatccttgtactgatcaatccttatatctgtataaaccattgtctcctacttccttattatatcttgatgagcatcctttactgtccgactatacaaaatcaatactatagtcatgccctaacatgttagcaaaggtatcatgtgagcatctctatgacatgccacatcaaatattggattgatgctaatacatttaactagtttatggggggtataatatgtattttttttaagtttgtggacaaacataactcatgtttatttactcatagaactttgcatccacgattcacccatccataaatcacactatggatatgacccttggagtcaaaatgcccttgtttcttgagaggaataagtctatttcgcatccctcatcttttatccttgatcgaatcgcctcctccaaccgcaaaatcgggtataacacatcccccatctttgaaaaccggtgcaaatcaactcattcggtggtgtcggaagtagttttcataggtggggctcacatgacaatgaggtatggcaaaaatatatggccccacctacaaaaaccaatttcgaaaccattaaaggagtcgatttgcactagtttttaaatatgaaggaggtgttatacctggttttgcggtttgggggatgggattgatcaagggtacgagatgagggagttaaaatagacttatttctttttgagaaacatcaacaggagaggaagaattatacttgggccggaaaaagtacatctaaggtccctcatcttgtcatcggattacaaaattatcccccaatcgcaaaaccagatatatgggatccctcaacttataaaaccgggtcactttgggtccctagacggttttgacccggttttatccgacgtggcagctgagtcagcatgggtcccgtatgtcagtgtgtccactttatcactccctctttttcccatctctcttcatcctctcttctctcccttaggtcccgttcttttctccaacaaagagttggatgaagattaagattttcgtggcacgcttttcaaactgctaaattgtgcgtttcgtgtgaaaactttctatatgaaatttgctctaaaatatcatattaatctatttttcaagtttgtaataattaaaactcaatcaatcatacgttaatgccacctcttttgcgtaaaaaacttaatcttcatctattcatcttcgggagaaaagaacaccacctactcggttactctctctctctctctcaatattctttgggcaggccgacccgcgggtgcgaggtgggagagagggagggcggccgatgctggggcggcgacggccaatgcgggagaaggggagacggtgtctcgtcctaccgccacaacgacgccgtccattccttcctccttgctaaggcctctggctctgatttcgtcttctcccttctccgccgcatcctctcgttctccccacccgccgactccctcttccgccaacgccgtccactcctaccctcctccgccacatcctcataacctcgccagcggatggttgaagatgaagtggctggggtcggatgccccgcggtcatcccgcgcggcggtacctggtaccgcccgagctcctccagcatcgcctccaccgtgaccaacgcacgcgccgcggcaactccgcgagacacatggaggaggtgatgctcgccacaccaatgcctcctgcgagtttagcatcatcctcgacgcccgtctccctcccctcccccactaccgccgcaaccccacccggacgacgcgcgaccattagaattttcgtggaccacccattgtgcagtgccagactttgaagtacaacatgaagtcgagggctgggagaggctttatccttgaggtgctgaaggtgatgtccttgttgtaccactatatttgagtagcccttatcaatctagtgtatcttttggaccctgggggtgtttagatccaggggtgtaagagtttttgtgtgtcacatcgagtattatatagggtgtaaaaaaaactaattacagaatccgtcagtaaactgcgactctacgagacgaatttattaagcctaattaatccgttattagcaaatatttactgtagcaacacattgtcaaatcatggagcaattggcttaaaacgtctcgcaaattagtcacaatatgtgcaattagttatttttatagcctatatttaatacttcatgaaggtgtttaaacgctcgatatgatagggtgaaaaattttgatgtgtgatctgatcagggcctctgtttggttaaatctgaactgtttgcttgtagataatagataagtaactttgtcttgtcagtagattagaaacccccttccccttctctaagtgttgaatgccatttaaatttggattaagattctagtttcattgtctaatgctttgagtgtgttccggccatgattagagcaggtacaatagcatgctataagcgagttataaacatattttaaagagataaaggaagagagagaagagcagcggactacggatctatagccagctgcagcacggactctaagacttaatgtgtgtatgacaagtaggactatgtattaatagtatagtaagcaactattgtatgaattggctattatattggctatagataatttggagctagtagttgactatactattaaacttgctcttatctgtagaaaaaaaatacatttgcatatgtaaatttatatttgtgttgatggtgttctcctataatcataggctgcgaacatcccgaagaagtatactccgaccattggaatttccgtggaccaccgccgcaagaaccgctcacttgagggctccaggctaatgtctagaggtttaagacataggccttgtttagttcacgaaaagaaaatttttgagtgtcaatgtttaacggatatcggaatgggttttcggatacgaatgaaaaaaataatttaataacttgcatgaaaaccgtgagatgaatcttttgagcctaaactaattcgtcattagcgcatgtaggttactgtagcatttatggctaatcatggactaattagacttaaaatattcgtctcacgatttctccctaaatgtacaattagtttttatttttatctatatttaatactccattgtccagagattcaatatgatgtaaaaatttctggggactaaacaagggcaaggtatggctgcagtttgttgtccctgactccttgtatatgtttatcgaaggtattgtcttctagatctggttttgagcttgattgtgctagctcttgtgtcaggctggtgattccactgccgaggagcttgccactgccacccaggtccagggtgattaattacatgcctattgctcgcggtgagaagcgctcggttgaggctgtgaaggtcaccgatgagatgaaggcgttcaaggcctacgctaattaagctccgtgttgagaggatgaaccagcgccatgttggtgcccgccagaaggaagagaagtgaagtgaccggacatagtatctgtttcgttatattcagcagctagtggatgctatcaggcactaaatctaaattttgtttttgtgctggaaatagagaccagcttatcatcattttggtgtcatcatacccttctgtttgatactccctccgtttctaaatgtttgacaccgttaacttttcagtacatatttaactattcgtcttattaaaaaaatttatgaaatatgcaaaactatatatatacatgaaagtatttcaacaataaatcaaatgatagaaaaagaattaataattacttaaattttttgaataagacgaatgattaaacatgtttaaaaaaatcaacggcgccaaatatttaggaatggagggagtatttggtactgatttgcatgctctgctatcgaatgagattcaatagatgtgttgtgtcagattactttgcgctgtgtgtggaccttcatcaatgttgggtaagatgcattatgcatgtagtagaacatatacatgctgtgtgcatagtgatgtaatgtgagtatagatcattctactagtgcacagtagcatatgctctgtgactactgtgaaaaaccttgtgctttgtctgcaagtgatatcaactgagattagtagtttctatctgaccttgactggactttttgacaagccttgcatggtgcatggtttgagttgactgctgtaatttgtgcagattatgcaatcattaggtgctatcctgtttgagtggaatttcattgtttctatttggctggtagctttgtgggaataagttgtttttagaaaaggaggattgctaggttcagtgtgtggattgtggaccttggaatcgattgttgcttgatgctctaaaaaagaaaaaaaaacataaatgcactgaattgtagccactgctgggctggcaatcttgcattgtggtaatgtggcatggcatcttcggatctgatctaatcttgtagagattgaaaggggatgatattctgtgcccactcttgcaccacttgggaaaaaaatgactgatggatttcctgccgttcttttcggctggactgctgcattctcttgctagaatatgttttcaattgtaaaattgatcaaaaagttttttttgtctgattttgcccatcatatgatctgatctctttgggcaacgtactcgaatcatacatcatatgtatttatcagttcacgagcttatcatacaacctggatatatatatgtcttggaaagggatcctctgacttaactgctgtgcagttgagtcactgacatatgggccatagcaaagtgggactcacatgtcagtgactcaactgcatgtgcagttaagttagaggatctactttcatatgtcttacggtgaccaagatagacatgtaggatgtagctagctttgcccatacaacaatgacttacaaaatgaataaaataaagaacgaaaaacagagaaaatgaatataagaacaggttgcgtcaatcattgaatggagcataagttagtgactgagtaatttattcagtaggatacatttagtggtataatccattgtaggcagagtgctttggctaagacagcagttggcctagatcagcttaactcctgcttgcatgttactgctattagtagagtgtagaagcagttggtgtaggttatattagctgctgctcttcaatacataatgccaaaacagttggctacagtctgcattacactaatgctgcttacaagataattgcatcagtgctgaatataaaatgagaaaacagaacatctacaaacttttgctgaagatctctacgacagttaggtttttatttgaagttttctcatatcattttaaattaatccagcacataaaatttcagttctggtacaagaacagcaacatttatctctctcttaaaaaaaaaaaagaaatcacgctgagggctttcctgaaaaaaaaaataaaattgtgcttcaggctaaggacttgttcataagtagaataaaaatcagggattttggtgctatgctacacattcccagacctcgctataaaacagatccgatcactctcctgatcggcgccggcgttaattccaagaaaagaagaagagaagaatctgaaaaactttaagccgctatgggtctgcaggtatgcagatcactctctcaatccaccagcatcatcgtttctacgcttaataccgctataaagatgaagaaatctttaccatcgtctgctccctcgtttgtttgattgattttattctgtgtgtaaaatgtattgtaccttagatttagcctagaacaattcttgttcttccccttccctttgtggcgtaaaagaaattcttaatctcccgtctcctccgctccttgcgccgccaagacgagtcgctgctgaccaggggaggggcggcgagcagagcaggggagaggatcatgatgagcatcacatcctctttctgattcatctctctctcccatcgggtctggaatttgcttgtgttcgttcgttaaccctagcttctcttctagatctggaagaagctcttcccttaatttcagagccttaaccttaatacaggtaacagtttgtttgttccccgaaaagttagttgatccgcccctggccgtagagactagatctgactcttccctgctattacacatctctcatctctttgtctgattcgttcagtgagtcttgtcaaaagatctatgagatgcaatcttcttgtttaagatgctgcaattgttccgtttgaattgtaattttccattgctttgcggcttaacattacaacttctgaagaaagatttagtgtgacagtgtgactgaagcatgatccgattacaatttgtgactgatatccaattgcaggaggattttgagcagtacgccgagaaggcgaagaccttgccggagagcactagcaacgagaacaagcttatcctctatggactctacaagcaggccaccgttggagatgtcaatactggtatgtatactgaatatttggtattattcagttgttacttctgttttgccaggcatgttctggatgtgtaacacaattcttgagttaatgacttgctgtgtttgattacattcagagacatgggtacagttttacatgccatggattatgatcctaacacaagatctcatagatcaccatgattttttttatcactcccccaaaaaatctgtctgatttgaaacaagaccattctttcccatcaaaatttttgggatgtagtattgagtacttccccatttttgtagagttgtaatttacaagtgcaaccattgatattgacctgcacactacaacatagaaatttgctgcatctagcttctgagttctgatagctgtccatattcagtcttctagtgtgattatgtcctttcacaacatgtttgtgaaatgtcatggtttttatctatatttttggttttgtgctgaaaagtagtagaagttactacatgctagatgtgttttgactatctatttctttgtcaaacttgtaaaatctcactgctacttccaaatttttaactatctattgccctcatgtcccttttgtaatcaattagtcaattcttatatgaatctgatctaccttgccaacagttctttatattaacttgttactgtgttttgtgttaacgaagatatttcacgatgacgttgctaactatttctttttctataatcttctgaagctcgtcctggcatattcgcccagagggacagggcgaaatgggatgcatggaaagctgttgaaggtccatatacttctctctgtccttacataaatatgttttcctgtctgtccattctaatactgttgggctgtttcgccgtgctactgaactgaactttttgcaatcttcgcaggcaaatcgaaggaggaagcaatgagcgactacatcaccaaggtgaagcagctcctggaggaggctgctgctgcagcctcttaagaagttatgaactctatgctacatggcttctgtcagctgaacaactctatgctaatctggttgctgacaacttaccattctatcaattcgggatgtgaactatgtacctctttgtgtactgttgcataatttatccatctatttatgaagactattagtcctatgaatcatattatcttgtaatctttcatctctctggctgtgtactgcacaatagaaaaataatggttgtcaagccagttacatgccccaatttcaagtaaccataagcagtaataaccatcatatcctggatcatattccaatctcagaagacaacacaatctaaagagaaaaaagatctattgatcagaaggccaaaaacatatctatatgaaaaatgaaaatgcttaattgttcatagttagatagatcaacaacaccgcactgcacacatatatactgtttactcatcatgttcattcattctacacatgcatatgatctcatctggcaatggcaagaagccaagaactcctgaaaaaaaaaggatgaaatcttcagagatgtccatagcctaagacctgaccacctgagaagaggttgaggcagagcagggaagcagccagcagcgtccctggaatccaccacctgacaccctcgtcggcgaacatggcgcacagcaccaggcacagcagcagcagcatgtagaaccccagcccggaccagaatccgccgccgccgcaccactcgccgccggcggtgacgccgtacttggcggcgtccgccgggtagtagtatattccggcgaagtaggcgaccaccagcagcaggaccaagaacgccatgatgttctgcagcagcatcacggatagcacgatcgccaccggcacgaccaccacctcgctccggcggctgaggagcacggcggcgagcagcaggagcccgccggcggcgaccagggtgacggcattgtcggccaccgtccccggcaggttcgccgccttgtcgtaccactccgtcagggtctcgttgtagttgacccagaccagggccaccacgatgaggagtggcaccaccggagacggcccaccaccgccgccgcggcggcccagcccccacgccggcgaggtaccccggtagtagctcatgatcacctcttcttctttgagctctttctgcttcttatgctacttctgttcttgctgcttttaagcacactacttagtactactcagttgtaagtagcattagcagtgaaaaagtccaggtttgataatatttagtttctgaaatgtggattagtgttcatcttgttccaactaattttaactacctgcttgtgtcctgatgtcaattgtcttggaatttagttgaggtagggacctgcttaaagctggtagatgaactgattttagagaaagatggcatagaggatagtgatttgtaggtcttgtcattttcatgtatgtgtcattctttgtttttgtttggtttggctggggttattaactggaacaaaatcttctattgcctccatgtagacttgggaggtacttagcttagcaacagaaaatgatggctgatatcattaagtttaccatgggctgcttcaaccatacaaagtaaactgattaaactcagtagttgtggactcagtacaactgcttttattctaatggttatctaagaagattgtaaaaagcttatgcaatcaattggattcatttcagagtttcagattagaaatttcagttcattagcaaattccttgattagtttcagattaggagccatactgacaaaagaaggcattagtacatggcaagatgaaccaaacaaagccaacatatccggtttttt

SEQ ID NO: 72653 - DNA, 1615 bp, Oryza sativa
  unsure (1)..(1615): unsure at all n locations
tgtgtgtcttatttgctctatatctctctcccacatatcaaggagacaacggaaagctctagaacatcatcttttatccaatgactaagatttattttacctgttttgtttgtttattgatttaacggctattattcattagatgatgtggcacattcttgttctgttttgggattgtcttttcaagagttaaaataagacttgaaagatttatttatgtgacactgatattgcctatataatcacaatttaacataatgcccaaccaaataagataatcacatatttttacataatgtctgatcacataagctaccttcaagttactacttgggagccatcgtttcttttattcgtggaataagcggaatggcaaatttacaaacgaaaagtgatttataaataaaacttttatataagtgttcttaattaatgatctaaaagcaaacgctgaaaaataaacttcgatgagaaaacctcaaaatcagctctaaatttaatgttgaaaattcaaattttggttgataaatataagcataagcgaaaagatgaggccccatgattacaccgaaaaaaaaacctctcgattaaccatgcgtcatgtccaaaaagaaaaaaagattaattctgcaagaaaatgcttgcaggttcttgaggaagtgaggaggctgatggagttgtacaaggacgaggtgacgagcatcaccgtcgtcgggcacagcctgggcgcgtcgctggcgaccctgaacgccgtnncatcgtggccaacggcgccaactgcccgccggcgagctcgtcgtcgtcgcagccgccgtgcccggtgacggcgatcgtgttcgcgagcccgcgcgtgggcgacggcttcttcaaggcagcgttcgcgtcgttccccgacctgagggcgctccacgtcaagaacgccggcgacgtggtgcccatgtacccgccgctgggctacgtggacgtggccgtgaagctgcgcatcagcaccagccggtcgccgtacctgcggtcgccggggaccatcgagacgctgcacaacctcgagtgctacctccacggcgtcgccggcgagcagggcagcgccggcgggttcaagctggaggtcgaccgcgacgtcgcgctggcgaacaagggcgtcgacgcgctcaaggacaagtaccccgtgccgccccggtggtgggtctccaagaacaggtgcatggtcaaggacgccgatgggcactgggcgctccacgatttcgagcaaatttaagctctcgatttcgaaaaatttgcaaaatggattacgtatagaagtgctcgttaatgggcttgacacgtcgaataaatgggatttccccctcatatcacataattcatttgtaaataaactcttgtccagtcaaatgcatgtgttgatttggacattgttacagatacaaaggtattgatttggacacgttgagatgtccagtaattatttcttgatgcatatgcgagttcatgctcatgcacattgatacactccatccaatcatttactctgcactatcctcatcttcctcgcggtccatcagagtccagcggccatcggcgcctctcaccatgcccctgttcgacgggatccaccacc

SEQ ID NO: 72654 - DNA, 704 bp, Oryza sativa
  unsure (1)..(704): unsure at all n locations
gtgcgtgcgtgctcgctcgctcgctcgatcgatcgaaatgaaaattcaagctgagcgtgtgcgtgtgttcacccatgccccattattgctagctagcagcttgtttacaacaacgcggagtggctccctcactgtgacgtgccccgcatcaaagcatgggtagaaaaaatggcagcgtcgtccatccctttcttcgcaacgccgggtcggtttccccgtggcggacgtacgccgctgcgaaacggccgaggaagcggaaagggaaacgggcgatcgtcgtcgtcgtggtggaccagtagctgtagctgtagcggcacaagctgagggggagaagtagaaatgagaatcggggggggcggcggctaatggccacaggaatacgcacgcgagtaggagatcaagatcgcggccgntggcgggtcggggcgtatagtttaaaggcgtgggtcgtggcgaggagcgccccacgtcgcgccgcgccggagccccggagcgccagcgccgcaagggattttttttttgccctctcttcacattctcatttgtgtgcgggttcgccgagcccgcgtcgcggctgcagctaggggagggtggctacgacggctgttcatggagattaactgcagcttgattttactggtatggttaatttggcgtgaggcgttgagcagcctttatcatttcctcgcttggggctgcaggaa

SEQ ID NO: 72655 - DNA, 682 bp, Oryza sativa
tttgcaccaaattggtgctagaacctccctcgatatttttgccccggttgtcctttgctctcgccttctcctcaacacccaaagagccaatgagattagtaacactgaactcttgcctcttgtgttttagagaagtagcaaagtctgaccaaaaaggtggcaatttggcaataatgccacccgccacaaacttgtccggcactcacagttgttgttctcaagttcctttgccagcatctgaatctcatgagcctgttccactacagaacggtcatcgaccatcttgtagtcatataactgctccatgacatacagctcactgccggcgtcagaaactccgaactggcctcaagtgcatcccacatgtccttccctgaaagcatgtgcatgtacatgtccactatattgtcagcgagtacactgatcaatgctccacggaacaggcaatccgaagcctcgaacttagcctcctcctcaggagagagaggcggttcacttcgtttgccccgtgaaacatagaagcattgcatccctgtcaaccacagtagtgcacgtgctttccatctcttataattagaaccatcaaaagcatgtggtttcagtgttgcagcaaagccaactaccgaaaatgacctagcaggtttttggattgttggaactttggtcataattcggcatattt

SEQ ID NO: 72656 - DNA, 987 bp, Oryza sativa
ttagaaattattcatagttaaatattttgaagttcgatcttagccttgtccaaaacgatgaatattataaatccagatagagtacttgtgttagtcttttttcactttgcatatatgaagaaatttatatttcaaaaaaattgagcaaattttatttgtgtttactttttcctctgctagaacaagtgcgttgcctttactgcgagcatcaagggattaggattgtgcatccatcggtggagaatttccatgggcgtgaggtggaatttgagaagatggtatgtggaaaagatccctgtgaagacgattttgatcttttagttgatgaagaaccgttttacaccaacgatggtatcgtcaacaacctcgagtatgcaggtgctatggatggttcgaagaggacttcatttatcgagatagcgatgaaggcaccgacgaggaagaaggaaactctgatgatgatatcgattttgtgtgaggtttacatgactgtatattttgattgatggagctgtgtacatgttcaatgttcatgttcagcccttataccggcatgtttagggagagtttagttccactgggccaaagttttccgaaccgtaggcgaactactcctacctattttttggaattttgttttattttcttgattgactatttgacgtaggatattccagttcaagaagggtctaagcaagagatggcaatggttccccgtcctccgattccctgcggtgaatcctcccattagaaggtgggggtggtataaaatatgtctccacagaggataaatagagtaaaaacaccttccatcgggtctggcaggggcaggtttgtttcagcgtccctcgtccccgctctccgtggaggcccgacataatagtgtatgtgtagtattatcatgtatatttggcccatctggcccatagaaaccaggcccaacacctagagcatataaagcatctgcaaaaccctacccattccaat

SEQ ID NO: 72657 - DNA, 5334 bp, Oryza sativa
ttctacttcttctgcagaagagagctaagagaggcttgacaccaaaaagcagctctgtacaagagtcaagaagcatgggcacacacatctttagatctcactaccaccatggcaggcactgtcacctatcaatgaggtttgccaaatatcagcaaggctgcagactgacaagcatagtcagcaataaatcagtgccaattggctaattgtcataccttctcatgatctcatctaagcagtggttgcaatatgcatttttagataatgagaatgtattacatctccggcctctgccataaggcacacagccaacgaggttgcaaatacggatggactgaagaaagttcaatatacatgccagatgatgacaaaggaacacattatatttgttaatggagttcagctgaaacatacgtcttcggccttgattatattatgtgcacagttcaattactgtcttacttgagccaagagcaagagatggcttgatttggatccaatggtgcttgataatacacatataacatacttcctctgttttacaatgtaagtcattctagcatttcctatattcatattgatgttaatgaatctagacatatgaatgtgagaataatatatatctagattcattaacatcaatatgaatgtgagaaatgctaaaatgacttacattgtgaaacagagggagtacaagcctgttgattctgaaaataacagtaaaggcatcagatagaaatggaccaaaccaccacaaaattatgaaaaatatgtgttgatgcatacaagtctgactggcttcttgacaaggttacaataatcacaaatgacatgatcacgcacgctcttcagggtataaaccaaagtgtgaatcaacatgggatttacagatgatgcaattttgacagtactgtacagaaacgggcaattagttcagagagacataaccatcttggatcttaacatgacagtcaaccaactagactcgatttcttgcaaggtgcaacgttgtcaagaatgatagctgctaacccattgcgtatttctgggtccaggccctcgccgtctcctcataacgtggcctctggctcttgtagacgtgggcgatctctgggacaaggggatcatctgggttggggtcagtgagaagagagctgatggataggaggacctttgatatggtcaatgctgggctccactgctccttgaggatgtcaaggcaaatgcttccattggagttgatgtttgggtgatacacctgcatcgtcagtgaaacgattcatcatttatggcattagtggagaaaaatgacaaatatcactaacttcagaataatttatcaaatcatctaggcttttacgccagcgtcataacaatctagtaactagctaggtgaattaatacaatgtgtcttgcttgaatctttcctgatatttagaataggatagcaatacaactgttcttttctgatatatcggaaagattactgcaaactgttagcacatattgttatcaattctttgttcaactcattccttgaagagattatgatagtggggccacactctagggaaccaacatgatttcagttacatctgggaatggcagtgaatcattgctgagcgcagacagattggaactatcaaatataaactccatattgtccattccaatttgtgaagaagctatatagccttactggttacaatttttgatgattttaatttgggactcacctggagaaacatcgctacatggcatttccgaagcatgtaacaaagcatgcaattgaatgagaatttcagtctgcaacagcctttgcccaagtaatttgtcagaagtgcaatactaccagctcaagcttagagtcgcattatagttaggcagagcatttttcttatgtttttcccctgcttttcccctgttttctgttttgtcaaccttatacttattttcctaaccccattatcttaatgaaattatgcaagggatctcctgctatctgggacacaaagtgataatcacagtagcaatgtgacagtaagaactgcaaataatgattataaacagtcagtatgattttaactatgaaaacaatgatgctacggagaggcataaattttagccaatttgtggtgaactgtgctttagaatttacaccagtacataactttttactgatattgactgatttataaattctcctattcatcttgaatttccaaagaccgcactctaccttatctagtacatatcaataataaggttaagagtaacaatttaatataatcaagaagttaaaaaaacaagaaagagagacaggtaaaacaaacaactcacctttgtttggaagttcacttttggaggcttaaaagggtagtcaggggggaaatggatgttaacaaagaacaccccaccagcgtaggggctgtcgctagggcccatgattgtggcctgccaatggaataaatcctctcctgcaggcccagcactgcatgatgttggtggatccttccgcaaatccatgagttccttctgaatccttttgcttgccatatctgggtaagtggaacacagaatataatgattaaggcaataatgcacaccaatatgaatatattgcaccttctttcagcttgaatttgataagatggatctcctcatacaaaattttcagaagtactgaattatagtttcagaatctggatatgactactaagtaattactacagtctatgtactcaagagaaattccttgttgtctgcatagcatgggtctcaactctcactaaaagtttgtaggagttcactcaatttttgtatgccactttattctttttgtcgcttaatattaataaacagatcacaatgccatattatataagatgacacaaacaacagactacaaccagatggaatagtcaagtgaagcacaagctgattacttcagtatccaagtaggttgcatccatagtgctatcatcatacagcttagcaaaacaatttcttgattaaggttatcaaaacacagagttataattaacttactcagattacaaactacactgatataggttaagtaaaattttcaaatcattgacatatttgtgttgattgacattcttcagtaaaacgcccaccggcgtcccacaacctgtctgtttcaccaagaaaccaaaaccaccaacttgcctaaaattaaaatcaccttccctcctttccccaagtagcaaatccaatttcacatttcctgtttaagaatctactcgattgtgacagatcactggtcagagcaaggccctacagctcaaacaccaaactcatctgaaatttcagcagaaggaatgcgcaattaattctttctcctcgttcatccccaagtcaaccccgaccccaagatgaccaaatctttctaatcttgcgatggctacacaaccccaagtaatcttaagcaaacaagctacttctattcaatcatggcgtgcgtcgccaagaactcaaccaacgttcaaaacgaagaaaaaaaaagagaactaaacagaacaagaactagtacactttgaatggaccaggaaagatttggaaagaaactgaagattacctgcagactagagagctcagattagatgtatcctcaatcgggtgaagagatttggaaggaatcggctgcggcgacgatcgatggagcgtgggggattacgggatgggggcttaatcgtgggcttgtaggcctgagagaccctggatcgagtcttcgcttgtgtgcagttggccaactggtaattcttttttccttttttttctagtggaattgcactttgcgccccttttctcaccttaattgcatattggaccagggtctgctaaactttgcacttaatttctgttgttagatcaaatcaatcaagagaaatttgttgccattgcccattttacatttttcccctccaaatcgatattactgtagtaacatatactcaggccttgtttagttcgcggaaagaaaatttttatgttacatcggatgtttgaccggatattggaaggggttttcgaatacgaatgaacaaactaatttcataacttgcatggaaaccgtgagacgaatttattaagcgtaattaatccatcattagcacatgtgtgttactgtagcacttatggctaatgatgaacttattagtttttcattttatttatatttaatactatatagatatgtctaagatgtttgatgtgacgtttttggaaaaaaaaatttaggacctaaacaagggcctcaatgttggttcaaaaccagcagcaaggaccagttatgaatctttgacatcctctcagggtcgatgctatcttcgtaacattgtatatttaactttttatctttaaaacattgtcatcgcagtgatgggtactcatcgctggttcaaaacccagtattaaaaccagttataaatcgtcagcaattgttggttcaataccggccgataactcatcttccatagatttggactgaaatgtctgaaatccagagaatttcatccattttagtgaggtccgagacaaaatttaaatcccattttgtaaattttggtcaaatttcatttggaatttccaatttttgtccatttcagcggagccgaaatttttacgcaatcccatcacagaactttgccaacggcaacgcattgcgcatgacgcaaactggcagagtaggtgtagtcatgaggacgaatagaaattaacgcagcagcagctaatccgattttaaataccatatttagccattttgtgatttttaacatacaagagtcgaatgaggaacgaagcaaaactgatcaaatattaatatgcatattcaataggaaactcacaagataatttttattactgacaataagtaccataatatagagtgatatggctatgtataaatgaagctattttctactacttaaaaaaacaagacttacaaagatttaaatgacttaaatgcactacatgtcttcagtggcagagcttagtggaggccatcctaggtggtccccaccatagccatgaactgtatatagggagcatgcatatgctctcaatctctcatcttggatagttgtagtgtgttggcttagttgttattgcttttttttatagtgtcgcgggttcgataccagcatcacagttatttttctatttttcttattttttctgtttctcagcacatttctatttttcttgctttttcagttcctcagctcattccagcataattgttttcttttttttcccaggtctcaagtcttatacttcctctgtttcacaatgtaagtcattctagca

SEQ ID NO: 72658 - DNA, 954 bp, Oryza sativa
  unsure (1)..(954): unsure at all n locations
cagcgtgcaacgcatggagatgcgcgagcgcgagccgagcaagtcaagctattttttttttgaaaaaaaataatacgtgctcgtgcaacggtgcaacgtatttcatccgtccttaaaaaaaagactcgttatatatctagacatatatcatagcatttgcctctagctatgtttattttttttatgtatgttcagatatatagttagagtttgttttttttaatagagaaagtacatttacggtagattacgtgaagcgatgtgcgattttgggctagggtttgtgtcaacttcatcggtggccgtttgggttggcgaaaggggtgagctgcaatcagggtttaccttatcgtttgggtcggggttatcgccaccccgcggtagcgcgataaccgtgataatcgcacgataatcgtctaaaatcgcacaaaaatcacatccaaaaatttgaattcaaaactcaacggtttcgcggtttcaccgcgataatcgcacggtttaccgcgatattcgcacggttatcgcgggctgtgtagctgaaataatgtaaatgtaaaataaatagggtaaaaaaaatcaaaaatacggttgaatatgtgtagaaaactagaaactgagaataatcaaaaatatgcaggatacttaaggccaatatcctcttcatttttcaattnnnaaccatttttggttttgtcctcaaatttgaatttatcttactctatttaaaaaaattcttcaccattggcaattacaaatcaagaactacatccatgaattttttcagttttttttgattttttttcggaattttgaatttggtcaaaattcatccaaaccatatcgccggtttcctctaccgtatccccgcaataagcgcgatactcgcccgattatcgtgcgataagtgaaaccctggctgcgatgcgaagcactggtgtgtgtatacagtagtcg

SEQ ID NO: 72659 - DNA, 6162 bp, Oryza sativa
tcaagcttgcatgcctgtagtttgttttcttaggggagtttttcttcctttgtaatcacccaaaaagatgaccggtgggcatccatagaaacaactgtacaactgatcagtaatcctatgagggtatcacgaaaataagtgatctcgaccattaatttattagttctattatcaagataaaaattgatcaaactataccaaataatctgtttcctatatctcgcaagtcagaatcaactgtttctgtcgagaaatggaaaaccaacgattgtatttaattccgggtgggctgccatcgttacttgctttttttttttctatctgaacttgctttttggttaaaaaataatttaaccgaagactagaacagatcacattgcaggcgtggttatagatggccaaagggcccgcccggcacggcccggccctggcccggctaggtacggcccagcagccatcgggccggcacggctcgataggcacttcgtgccgggccgtgccggcccatgggctgcacctcccgcccaggcacggcccaccagctgtcgggccgtgccgtgccggcctgaaggcatgggtggtccatcgggccttttttaaaataagtatatttttcgttcctcctctttgggctatttcatatgtatagctaaaataagtctattttccgtccctcctctttgggctgacatatgtatagctaaaataagtctattttatgtccctcctctttggctgacatatgtagagataaaaaaagtctattttagatccctattctttcgtccatggcatataatatgtctatttttactcccctattttttttgtgtatcgggcctagctgccggcccatcgtgccgggccggcccaacatgccggtggaggggcccaggcacggcccggtggtcggcccgggccggcacgggcccgacctctgtcgggccgtgccgtgcttgggccgggccaaaataccgtgccatgggccgagccgtcgggcctcgggccttttggccatctataggcgtggtgaagctggacaagcgacctccccactctgctttggccactgcctccaatttaacctgcctacgatgttggcctccatcacctctcgctcaacaccggataggttcctgatgaggactagggtctcgagctttcattaggtattgggataggttgattagaaagacttgacgttgatgatacaaaggctccgatcaggacgatcagacccctcacacacgaatgacctcgtcgataaggctatctcctacaagcgaattgagaacacaagcaagagtgtagaagatgcaatctaaatatattgtgcatataagatgaatctcacaaattagggttcgacaaaccagactagcggtaaaactacattggcagaataaactaagcaaaactcccctctaaacgatgaaggctgctaaataaataggattaggaacattttagggttaaccccaggtcgcacacccccttgcacttagtccatgacataattataaggcccattgtccaaatcagactcaaactagataagatacgaattgttttgcagattgtcgattgctcatgaagaattttaatgtgtgaccaaaaccatatgatagtagactccataagcttttcaaaagtactcacaagcctgagagtccttctatatcagtagttaggtccgtttgatgttgatgttgtcatgaggctcgaatctgattccaaaatatggagaagttattctcttgctttaaatggaccaaaagtgacgtggggacgttggagtagacttggtgaaggatattgattggtctccaatcaacttaattgattatcgaatgtttgttcaaatatatagtaaataaacctaatatatatatagagcatgtgaacgcttgttgatgtgtaatataagaatgattatatccaagccagtaaaatcctcatcagtcgagacccctgccaatgccacgacggcctcccacctgcctagcctttagtcggaggctactacaaaactatatagctttattggatgtttaattagattatgaatgtacgtttccaattatgtattgaacgagttgaaattatttgtattttgtcaataaagaattgttaattaattttcagttattggtctgttaacatcgtgttcttgtgagtgttatcattaattaaaatatagctctaacattagtaaaactagatgaatatcccgccacgttgatgggggaattaagttagataatatgaatacattaggtgaaattaagttatataatttgcacatgggttgcaatatagttcaccatgaataattgatacttaaaaattttgagcctaaaaatagctgattacatgttttttttatgagagaagatagaagagacaatttgtatcatagatccatcatccaaaggataagaataattgggatgatgtgactgtgttctcttggaggggttggaaacccctcccctccgcacgcaaaacagagcgatagattaacacaaaattaattaagtattagctatgattatggtaggaatagaaggatataggaatgaaatgaacactaatatcctgtcgatcagagtatattcaaaaaatccaatttaaccgtgctgccttcacagctagcaatggaaacttataggttagctacccgtaccctttgtcaggactgcacacaaaagttgtatataaaaccaatcacactcctcttcctacatgtaatcacacattgttctttggttttccaatactatcaacagttcacttttctaaactcgagttgataataatactggaacgggcggttccagtaaatatgttagctcgatctcgattacttcttcatgtagcatggggatcaatctaatgtagggagggctaggtgtccaacactttgtttactctgttttatttagtgcccccaaatataagctctacgtttgtctacttaagaataatcatgtattatttacctcttatgatattccacacatcagtacaatcatcgttgtcatgagttatgacattaagtgatacatgccagtttcagtatgttgtacacgtcggttacctctgctgttcaatttccacaagttcagttcgttgaattgatattttttgttcaagtttaaaccctggtctggtttatcaggaatattgattcattgcagctgtgcaggtgtatgtagggtgggcgtcgatttttttttttttttggcttcataagttcggtttctcatgagctcggttgtcatagaatggagaccgaagaaactgcgaaagggcccgtagcccggtagttacaagagtctcagtagcatcttagattctgggttcgattatccatgagagtgaattttccaggatttatcggcgttgtgctttcagtgatttttctaggacttatcggcattgtgctttcagtggtagggggtgagtgcacgtgcgttgtgagtgtcagtgttgttataaatttataaaaaataacttgagaaaaaacaaaaaccgaaatagaaacacctaaatgcgttgtgagtgtctgcgttgttactatgtaatttaaaaaaaaagaaaaaaattgagaaaaaaaagccgaaatagaaacaccgaaaaaaatccgaaataaaaacagcgatgtaatttaaaaaaaagaaaaaacaaacacagaaaaaaatcggttcggtttttcccgaataaatccatcgccgttggctggtcgatctcatgggttgcagcgtggggcccatgcgggacatcagcggcgcatgcatgcgaagattccaggaacactgtgtggggtccacatttaagctagggaaaattggaatcatgccattataatttttcaaatttgagatatatcatcctaacccacatatcattgaatcatgtgggtcctacatgtcattaagataccaatggcatatcttaaactttacaaaattataatggcatggttccaaattacccaggaaggtaaccatgttcccatggcccggcccgtggcccgacagcccggcccgtggcatggcgctttggcacagcacggcccgactagtgttgggcccgtgtcgtcctagcctaaaaattgggtcgtacctaggccgctaccttgacatggtgggctagcccggtacagcaagaaagatagtgaggagaaataaacttattttcaaacatatgtaaggcatggaccaaacaagagggatgaaaaatagacttattttagccagaaagaggagggatgcaaaatatacttatttcaaaaaaaaacacaataggctatcataccttcggaccggccgaacacggcctgagtcttattgggtcgcgcctgggccgtgggtgtagcccatgggcaagcacggcacagcttgacgtttagatcggcctgtgcctgggccgtgccatgccgggtggcctatttgggcatctatagtcacagggagacaaatcaggcaaataatcagctgaacgcatgaattcccggttggtacagtgctatcggttcacagagaataaaaaccgagtaacaaacgagacactgaacttgataaaaataaaaaagagccaccaaccgaataccgtaaaaaccgacacttcggtttggtttggtgcggtttggtttgacttttggtccacagtttctttttgcccacccataggtgtatgagaaacttgattatgtcctttagctcttagttgagacttttcgctatcgacatggaagatgtatgtgtaataacatatcctagttgtagaggttgcgtatgatccatcatgtagttttcgtaggattagtaccacacatgaagagtttatttaaattttttgcataaagcaagagcagaagtgcaagtttggtgctatgaacaggatgatgtggattattgaaagatgaacattacaccatggcctttaagccagactatataatagcaggtacaatagcagactataagccagctatacacacatattgaggagataaaagagaagagatctaaaaaaagtagcggactacatatttatagccagatgcagcacagactccaagacacaatgtgtgtatgacaggtatgacaggtgtagtatatgtttataggtaactatctatctatctatctattatatattaaaagtccattaaccttcctacaaacgctcttaagccgccacttggcgctcctataaatactctttaatcgccacatggcactgtttaatctcaccgtcgattttcacttaaattggtggacctggtattttagaccattagattagatgtactattttaaaagtaatacttttcctcctgtgggccggaataaggaaaaaaaactattctacttacatctaaaggaaaaacgatgaagaatacgttcaagaaaaacctatgtacggacttatacgataaaagcgataaagtaaagaaaaaaaaagcatatatcggttgtcattgaaaaaaaaatcgatgggctttaaaataggattttctactatttaaaaataaaatatagtactctataaatatatgcagttaaactatatcttgtatataaaatctatatattatctattatgtactagaagttaattaaactttctacaaatactattaagccgtcatgtggcactataataaataaaagaaattcctagaaattctaagataaaagcaaaacatgtagtccttaattttcacataaattgatggatccgttattttcaactggcagattagatctatttaaaaaactcccctcttttaatttcccgttctcgtaagtactgctcgtaaaaacaccccccaaaatacaagtactcccaagtcgccacgtggaaccctaataaaataaaaaatcttacattcgatttttatttaaatcggtggatctagatcgttagatatatcttaaaaacaaaaacctcccatgtccgcatatcgtgcaccacgcacgtactgatcaatttgtacgccccttctgttcctttctctttttacatacctatcacaattaaaattaaaattatctttatggaaaaaaatcacaaataggcattaaagtcctttcaacatcttataaatatttctaaactattgtgtgacactcttaaattagagaaacattc

SEQ ID NO: 72660 - DNA, 606 bp, Oryza sativa
aaaaaaaaggtcagctcgatctttagtcccggttatttcacccgggactaaagatagcgatctttagtcccggattgatactcccggtttggaaaccgggactaaaggggggttacgaaccgggactataaagggtttctccaccagtgattcctcgtcattgtttaggagaacagtgagtggtacgcacctgctgctaagcaacgtgtctcgatcgagagctagtcctgaattgatgtcatcctgtattctcctgtgagatacagtaatataatagttttgcacatgtgtatgtctcgtatatactctcatggcatgtttattcatcattaattcggccacatgcatggggctatatgtatctatgatgcaacatgcatacggtgctccaggacaaaacacagttagcgacacgatacacacacactatgtgtatggtcaggtgatcatttgggaagccggcctatgatacttaattgcttgatcctgtagagttgggtacttaggtctgaaggattaacactttaacatatcttatacttatgggattaattaatttcttgtttttgggagaacttacttgtcaacttagagcaagtttaagaa

SEQ ID NO: 72661 - DNA, 1022 bp, Oryza sativa
tgttacactctgaaaaataagtttggatactcccaccggttttataataattctcgttgttttggacaataataacacggcatattcactacatgacaagtaaaaatcatgtgattggttgacggacatcgcaaaaatgtagtttattgaatgcgtggtactccctccttccctaaatgtttgacgccgttgatttttgtaaacatgtttgactattcgtcttatttaaaaacttttatgaaatatgtaaaactatatgtatacataaaagtatatttaacaatgaaacaaatggtaggaaaataattaataattgcttaaattttttgaataagacgaacggtcaaacatatttaaaaaagtcaacggtgtctaacatttagggatggagggagtatatgcttagagctaactattgtatgcgtggattattagattggctataaatgatacgccaattttgacagctagaaactggtattaaatcaacacataactatgacctaaattaatcaaattttgggaactactcctacatagagcgtagagctagacaaaataaaccaaacgctcctctagtcctgtccacacccaacgattccaccaccctctccctttttcactacaaccacacccatcctccttatcccgttcagtttcttcactacctaggtttcttcgctaccgtcctggtcaacaggtgatggtgggacatggggcggtgtgaccggccaaggaaaaacagtgtgacaagaagcgggccatgaggcggtggacaccagtgtcaggaggatgtagccctcccgggtggcaatgttgaagatgagagggaggacagtgtgctagttggcgttggcaaccggatcttgcacctctcaatcttgtatccactataaaccgagctctgcccgaactgctagcttgacgaggtggaaggcggcagccagatttggaggatgggatggccttgaagtgttgccctgctatcctcatctgcccgatgcgatagggaaccgaggcgg

SEQ ID NO: 72662 - DNA, 1376 bp, Oryza sativa
  unsure (1)..(1376): unsure at all n locations
cccaagattgcattatttgtaacaccggccccccaaagcctcgtcgcgctccacacatgtcaacgtcgagcctccagagctcgagccttcggacatgtcaccagtgcagcagcgtggtgttcatgggcgcatctcgtaccaggtcggccccgtcgtgtctctttgactcgtcgtcgacaaggccactggcaaaccgagggccttcgtgttcgtcgagtacctcccacaacacctgccgcaacctcgaccgccacgcctattgcagccgcgtgctccgtgtcnnntcgccgaactggaagtagcagggcgctcgcgcggcagcggcgagccgcacgagctggtgggcatcgaggactccacacacgccgcatcgctcgtgaagggggcaccacccagcgccgacgacagctgtggagacggtgggcgccgtggaggcccagggagacgtcacgcgcaccgctggccgcgtcgccgttgtcccccgccggagccggtcgcccccgccgccgggctaagtgggtccctctatttggtcgcctgctcggccgcccacccgcgccgccggctgcccgggaaggagagagagaggggaaagggaagaagagatgaggaagatgaggaggctgacacatggagcccacgtgggccccaccattttaaaattatttttatgtgcagctgatatatggggccacactttttattattttttcgagatatacttgccacgtcaatgccacgtgggacggagaactagtcaaacaagccacgtaggcgccacgtcagccaaaacagacttcaaacccgttgagggacctcgtttacccggtttacataagttgagggacgggtcgtacctggttttgcggtcagggatgaaaatcggactgggcgacaaatagagggatccaaagtgaacttattccaacggaagaggagaaggcccataattcatagtgggccgtacttgaggactggcccaaattttgccgttcgtctttgcattgcaggtttttctctgaacctgattcggctcttgccgctcacagatccagccagcttctttcaaggcgaaactgatcaatggtactgaccaaaatatgaatattttttttattttttcatgaagtaatgaagagaaaggtaaaattaaataggtggactagtcgtaattggttaagatgaaagagtaagtaaagaaattaaacaagagatacattgtgtttgattgagatgaataagtatgccaagaaattattatattttgagataattttaaaatgctagaaactgctatatcttcggacgcagagcagtagatcatttgtcagattggatggattgtgctactgtacatgcatagtgtttcagacttt

SEQ ID NO: 72663 - DNA, 1589 bp, Oryza sativa
  unsure (1)..(1589): unsure at all n locations
tatgttgcagtcacactaggtactgcaccggatctaaatccgtctgcatgtgtccaaagggaaaaaggcaccaaattacttgcagttgcaggcttgctgtattttcttaatcactggttgattcagtgtaaggaataaacatggtgactgtttggagtactaacaccgtgtttagttctaaaccttttttcaaactccatcacatcaaaacttttctacacacataaacttctaattttttcatcacatcgttccaatttcaaccaaacttctaatcttaacataaactaaacacggccttaagttaataatcaccgaaaaggacatcattagaccagagtttttggacttggtgatttactctagtggctctcctttgattttttttagagaaggttattttctacccgacctccatatccaaccggatatatacagccattgagatagggaacttagccccgtaaacaacctaatctgaaattcactccatagaagattttaactcagaacctcgtactacttttgtactactcaggctctcctttgatggggcagtatattactctctccgtttcattttaagtgtaaccatgagtttacatgtcaactttgatcgtccgtcttatttgaaattttttataattagtatttgtgttgttatgagatgataaaacatgaatagtattacttgtgacttatgtttttatatttttttaaaaaaaatttnnncagacagatgattaaagttaggcgcgtaaaatcatggctgtaataagacggagggagtatcactgtatcgtatatttggacacaatcaagcaagtcagtactgagaaataaaaatgatctgtactgtaaatgccaagttaagtacatcagcacgatgtagcacgttgtacttttgtaccgcggatcaggtgcagattcagggaatgattgagtagtctgctctacagccattcactggtgggctgggccgtgggcttcccaacggtccaaggtcgtgcactgcaggaaatggggcccagcccgaagcataagtgcaaacaacagcccaggtaggtggcacacccgcgccactggactgacagcaagtgtgggtgaaacggaagaggaataagttcactttaggttcctctatctgtcggccagtccaattttcgtccctgaacctcagaaccgggtacgacccgtcccccaacttatgaaaaccgggcacataaggtcctaaggcggtttggatagcggttttggctgacgtagcgcctacgtggctggtttgactaggtctccatctcacgtggtactgacgtggtgcttacttggcaattcaatttggaaaaatataatacccatgagacccacatgtcaattacataaaaaaataattaataaaaataattaataaaaggtgggctcgcgtggaccccacatgtcaatcccactcccatctccttcctcctcactccccgtctccccttctcttcgtctctctccgactctcccccctctcctctctcttctcctctctcgggtgcgacggccggcggggtggacggcgtgacaggcggcgaagagatgggtga

SEQ ID NO: 72664 - DNA, 1308 bp, Oryza sativa
cagtagtcggatgagatcagcagaaagtgaatcaactatatgcttccttgaaaagaaaatctcccagtttttgtacgctgaagcttcatctgttatgtgttaattacataaaaggaagtgactgctaggagccacacaagctgtggcgggcaaactaatactcttttgagctgtgagccagtgaggctagattgattgaatatatgtggagaaaactgcccacaatatgtattttagaactagctgacattaccaactaatttctatcatggtagcaccgtggtcaggacagagctttggagtttttaggtgccctctatgtagcaacaagtgcaatgcaaaatttgaaggttcacgtccactttagatttcaggtcggtttgaggttgtgtcatttgtgtgccatgaggttgagcacccaccaccttgcctaggagatgcaacttacttttttcctgagtcatgtctttgtatcaagctaactctgttagaattatcatcctcattgactaatgcaaaagcagattaccagatttggatctacattacaattgtgtttctgtgttaaaaggataaaaattgctaatatttatctttctttctagtttgccttctactctaattggtatgtgaaatggttgttaatagacagtggaatctttttttttagagaaataggtgtaatctgattataaatgtgaatatcaaatctgatgactccttttgttttgtccacgtaaaaaggattggctactaccatagaaggtgctcaagtttgtcaaaattccaggagtttcttgaagttgatttttggttatctatcaaccttgtggctctgctttctcatgttatattgtgctaagcagctacattgcagttcaagatgtattattttatacacaatctttggaaatgtttgaattgccacttagattcagttttccttgaatgccatgactaaatgcatgtctttaaatatagcggggtatcactgcttagttgccagacaagaacaaataactgataatagaacttgctgcactgattattatctcatcttcctattttgtttgatattagttttttcctttctaaattaatggacaagaggaacaaaaccaaagtcaggagttctttttttgtttactctgtttttctatatcaaatttaagtgacaatgctgtgacacttcttaccgacaatatgtactataaaatgattagaaaacctatcaattgacctccatgactatctttgtacttaatattactctaaatgggatattaaaaggcaatgatgatttgctct

SEQ ID NO: 72665 - DNA, 19405 bp, Oryza sativa
aatttctttctgcacaacaactgtaattacatcagcagtcagtaggtctgaaggatgatttcggatgattccctgaacatgtgagatggtcttcatgaaattgtctcgttggatatcaagtaaaactttctcaagagggttgacatgttcagcgggcttccatgtcaaagataactcgtttattctcaaacatgctggcacctcacaactggctggcgatgacttgatgcaacctctccttgtgaatgactcagaggtctccaccgcatttctttctatttgctcttcatcagtttctttattattgacttgatctaaattcccttcattttctccttgattatgttgaggctcttcacataaatccacctcaccatgtgctggtttaactttcttagagtcttgaaataatgaacctgaaatgaaacaaacagatttaactacaaactacaatatcaatcattacaccatacttctaacaagaggagcctaagaataccactgtctgttttatcgtggcataaacatgcttgctctgatctgctctctgcctgatctatcatgctgtctggtgatggttgtcgctcttcggatctttctttcaatgtattctctgcactgtcatgagaattattctggcgtgccagtcttggtgatcttcgtggagtttcaggactacaaaatgaacctcgcttccttctctttttctgagaaaaattacataaatcatgctcatcaactagcctacacttctctgttgtcaagtcacattgcagtggttggttagacaacttaggttcctcaaggctgcacttcctactctcaagtattggagaagaataataatcatctggagggaagaactttcgtagtttcctctttacaatatcaactgaaatacagaaggatgtgttgtcaatgctagcagtgcaagaatgacagaagacgaggcgataaaaacttacattgaaaatgaagtttgtgcttcagaaacaggttctgaatttgcggtttgcccctacatatgtcaaagtcttctgccaccgcatccacattccatttatagaaaacaagcattgcacagaataattcaactgtcactttgtcaacatccaatatgctcattacttcagctatcgcattagctttatcatcctccattggcccgttcagtgataagtgttcatctaacccatctttcgagccgcatacttcatgttgatcagggaaactttgtggtgaaataagctcatggccttgagttgtcctttgcaatacctaaaagttgtataaaattttcagttcaaggagacaacatcactactaaggtacaaaccaacaattttataattcatatcctgcctgttcccaaggtggaacttattaaacggaaaaaatcaagttaggaatagttatttcaaaacgtcaaacctcctaaagttacttgaaataattgttctgcaccttaagattcccaagtgaacagtagttttattgtgtttttagagatagtcaggtattctggtattccatattgattctaacagacttgaaaaatcaaatgtaaagctattttcaaacaaagtgattccatatgaactgtgtataggcaaaaaaaatagtttaaaaaaaatacaggcaaaaaaaacgacctgtatgaaactgatttaattatttgagattacactataatattacctcataacggatccatttgttatctcaacctacctgtgaatgactaggcgtgagactgttggctgcctctgttagtctatcaccatcccgacccctcttagtacagcagaatatatcacatggaagttttccttgtggacttcctgaagaccgaattactttctcacaagcattcagaccaaatggcaaaaccatgaatgcatgttatcatcatatctgaagagaaggaactcatattccctcaaagaattgtcctccacaaacttcgcccatccagtggtcagaaatacatggccatcaagtttctctagctcaacaggccaagtcttcccttctgaattctgaagcgtgcctttggcagatgatggtaatgaagcatcaaaagtactgtggtccacctctggaatgtgaataaggaagccttgaggtatctcctacatatagaggctttaggagttagggcatattttgagccgtttctgcatgattcgagatagcaccttggccgtcaaagccattgctgagaggagatgaaatgcaaatgcaagatgcaactctgtgtgctttcagtaaattgttcacatatagtaggggtacttgtataatacgcacagtcgcacaagcataatatcaatgctcgtaatctgaaactcgaattgcattatcagaccacatgcatcatgcatgcacaaggaaatgaatgttagtatgccaccaacaatttatttttcttgcctaatactcatccgtttcaaggtataagatgttttgactttggtcaaagtcaaactacttaagtttgactaatttggtagaaaaaagttgtaatttttttaacccaagacaaatatattatgaaaatttattcaattataaatttaatgaaactatgttggtgttgtaaatattactatttttttctacagagttagtcaaacttagagtagtttgactttgatcaaaatcaaaacgtcttataacctgaaacggaacggagggagtacaacagttagtatacaaatataatcatgttatcagacactacaaaactatttccccctttatatatttaccaatatccatctcgtctattagaacaaagaccacaaatatatgacaccaaatgcatcatccattatcaatgagcatagcatatggttggctaaaaatagatgcatgtatatgttaattaatgcatcatccattatcaatctccgccagataagatgccacaatttttgcaaccatactagtactccatatgtcaatgtttggggggcccctacgggtaggcaggagagagggagagagagcactcacgaggcggcgggcgaactcgccgaccatgaccttgatgaagtgatgatgcctcctcacctcctccattgagaccgcgggcgaatacagatctcttccctcggttcggttcctgagaagaggaaagtagaggagacgagagggggggaggcggcgacggccagtggtggttggatggggggtgcgttgatggcggagtgaatgaggggggaggcggagcgagcggctctctcctcggcctcctcggcttgtcgtcgtgtgcggccgcctaaatgcaaggcgcgcggaatcggcgcccgccccgcagccgtttctccctccgcttgtcgagcgagagagcgagggagagggggcggtccttctttatcggcacgtggcggcgcgcggcgcggcgcctgcgcctacttggggggaagtggggagcgctcgatgctgggcgtctgttgcgtccagggcggatgcgacttgtcacggttaaaaagtagtccacggaggaggacaacacgcttcccttcacacgtccgctttccgctggcgttgcgctcgatcgtttcgatggtacagcgcaagagttgtaggggtttttggttgatggtgataaagaggatcaccaaaagtgcacctctctattcctaaaactgatttagaggtattatatgaccttatttttttcgtttatgtttatcggttaaaatttaattttttcagctttaaatttgaagctgatttgaggtttttcttaaagcttatttttcagcctttgcttttagattgctaaaaacgagtatgtaaaaattttatttacaaattattttttatttgaaaatatgtcgtttcgcttattccgtgaatagcaacgaagcaaagaagcccttacattgccgattgtccaatcgcattgggcatcaagggaaagagggtgagtgaatgacagcatttcaactatcaatgtgtggtcgacctgacagaccacaagaaacagtacgttcaactagccaaggcacaccgcacattaccagcggttcaaaaaaacaaggcggcacatcacttggcgacagtagcaggcacaactacacaactacagtgataaaatatggcacaggctgagaaaaaaaatgcaagagaaaactcagcagaaagtttattggacagttttatttatagaacatagctcgactcgttgacttcttttcagtcagattattaagcaaactatcctatgaatatccttgccgtttaaccaattcatggaattttcacctgaggtttcaataaacattaagaacatatcctttctagaaagagaaaaaaatccaagagcctgaaaatgtgggggaagaatgaactaaacaatatcccggttggccaagcaaacatagtgaatttgctaaatctgaagagcagaagcaataggtcctgccagactgagaatttcaaacggctgcctgtccttgaccgcattgacagtgagagggcatgaatcagtaatccagaagtggcttagcccatgacccggaccctctgaaattttacaatacacaatgtagttagtaactatatcagtcgaataaacaacagatttttcaacaactataggtgctacaatagccaaaaacaaacaaaaaaaaaacagaaattcattggtctcaaaaagaaaagaagaacaacattcgaccagagcatgattatgttcttgtttatgttgtgttagaagttgaagcctcctacgcaactagcaaagtatcaacaaataccaaatactccatccttcccagaatataagaagtactaaagttggacacggttattaagaaagtaggtaaaagtgagtggtggagggttgtgattggatgagtagtagaggtaggtgggaaaagtgaatggtggagggttgtgattggttgggaagagaatgttgatggagaagttgttatattttgagacaaatcctgaggactaaaagttgttatattttgggacggagggagtaggatttttgcatgatgttcccatacaaaactgtatgatgattaatgagggttatgactcagtgactgcattattaaggtatttgatgaaaatctatttggttttcacttaagaagtccttatgcatctctcactgcagtattattacaatggtctatatttgatgtcccaaagttttattccgtacaaacagctaaaagtttggcaaatttgcaggtagaaactagaagctatcttaataaaaacataaatatgacctaggtttccaagatgaagggtagtctctcttgattggaaaacgttacttgatcaataaaaagtacagtagcaggcaggtgaattggtaaaagaacaaatggttaattattaaacaaagaaaaacaattcaacctaccaactctaccagggatctatgccattcattggaaaacatataagttccaatgaatttacggaaaggtgtcaaatgagaaacaaacaactttgtttgcattaacgcctctagattcaaaaaattcttaacaaggaatcatataaaatatataagaaacttgctacaatgctaatattaaaactttgtgtacatacctccattatcaggctgaaatttctcccacgacttgttggggaaaatgccatgtgtcacgtatgcactaacctttgctgctccatgctctgccaatactttctggaaagaaaattgaataagttagcaatcgaaggaagacaggagaactacatagttacaaacagttatgaagtacactaaaaggttaactgctgtgaaataaacttcctcaatgacaagaccagatgagctgatgatttatcaacaaatttaattacctggcattcaatcaatgtaccacctgactgtaccaagtcatcaactataacaacatggcggcctctaggatccccctcttttatccgtactattctctgttccccttctctaactttgttgcatacaacctaccgagacacgtttaatgaaatcagagggtcaatattcagtacataggaacaccatttcttgttgggatttgaaagtggtcagacaaaaataactaccattgggaaatgttgaagttgcttatagaaccgtttccatgcaccgtcatcaggaaaagctatggttatctgataaaagtataaaggagtatatcagtctacgtttcatcaacgctgtcaagaaaaatgaaagctttaattatgtagtcagagaactcacattgtcagaatcaggtagttcctgaagcctacttttgagtaggggaatgccactctcaaaacatggcaagactgagtctccaaagtagaatctctcctgatatgttgttaagtacaagttattttcatgttgccgtctaaaaaggacaagtgcatttgatatggaagaattttacttacttgcaaagcatgaatatcaaagatcactagacttgaaggaccgcctcttgatattggtatatttgacaaaattctagcaagtgtgaaggctgtggcaacatctccttcatcttccatccgctcagacgtcccagtagggaaaaatgggagtataagagtgaatgacgaaataaacagctttggcagagcatatataattgatagttgctcaaatatgacacttggcgaactaaatgatgctaagaaagcaacatgttgtccgcggattgtgtgggcattcgagatgaataaatttggaaacccatcggcaaatgtcctgaaaaatggtaccaaagtaaatgtaagagataagtttggactaattttgataaagtataataagtttctctgagatagattttaggaaataaaaagattgttcctacctgcaaaattaccagtcagaacatcctaatgagttatcattccaattctaggtcccttgatagaggtacgacagaattaaagtattgacctttaagtcaatttcgataatgtatactcgttttgcttatatgctgatcaatcaggaatggaggtagtacaatggaactaaattttgaatgcaaaaatgtaaatatcagtgcgctgactgcagcaaatttgtgttttcccacaggtcccaagcccccaataaaacacaacaggcggctaccagatcatattagagctgcagatatatatagcttcacttttcatattgacctttccctgttccattaagggccaaggttaaaggtagagctttgtaatcccgacgaactaattgtgaaacaaagcaaaaattgttcagcgccgatgtatcgattcgggaaacattcaagaaaactccttccagttcagatatcctttcccactgagcgctctttcatccatgtagcgggaaagattcccattatgtaccaaacgaattaaggagcggttgagatacttggttggccagatgcaaaattcgggcaacaattaatggtaaacaatcgcaacattaaggactccaggggaaaaaaaaaacaacgagatggtagtaacaaagggcgggtaagaatcggacctccatgagatggagcgcagctcgatgtcgtcgttccgggcgaccacctgctcggcgagctcccgcatctcctcgcagtggaagagcaggacgttcttgtgcgccccgacggcgccggtcatcttcggcacggccaacggcgcgagcacgggggccgccaggtggatgccgctggcgttgctgacgatgctgctgcccgtggcgctcgcgccgccgaggtggaggcttgcgtggagcctgccggcggccgaggcgcggggggaaggcctcgcgaatgcggatgcggggctcgggctggggctggggctggggcccgggcgtcgggttttggcgccgaacgccgcggcgggggaggcggaggcggaggcggaggcggccgttgccatccctgcccgcgccgctgccgaggcccgggggggggggggggtcgttgggactgatgtggtcgagccgcgcgagtccccgcggtgcgttgcgttacatacgcgtgtggcgcgtgccggggagatgatgcgtttttttttttgcgagatttcgcgtgatttatagcctgcttcacggagcggcgtacgcgcaccggcggtgtgcgggtgccgggcgggtgggcgcggtggatgacaaggcggggtggcgtatgcccgaactggtcagccgataaggatgcgaatcgcccgagttttgttgggacgcatgacgctcgccggctcgccgctcgcgtcacacgtgtttaggtgcgcgtcgctttttagggtgtttgctttgtgaattttgtccgaaactcggactaaattaaaatggtctccacaggtgttgggactagatatagtaagtattgcattattgctagtactactactaaacttttaatttaggtggcacaaggagctaaagtgagaacccataaacgcagaatgatgtaagcatttagaaaatgagtattgctatatgtttaactcaattttatagtcgtagatcaattaaataagagaatgttcatatgcattgcagtatttatagtcgttgattaaattcgtacatgagtcggatgactgagttatatgcatagcaattgtcttagaaattttagtgggctgatgttgcagtatttgacggataggaccctaattaaacaacacaaatgatcacaaaccggcatctgtcgtcatccaagagaaaaggaaaaaagctttggttttgttaaattgcccaatggttaagaatcaatttggacaaaataatgccctctaaacagtaaacagtcaacatcaacgtggggaaatggcctctgagatgttctaaagccatctaataccactctctagcttccaccaatgccgtagtaatatgccgtcaagactgatgggtgagagtgagactgccagcgttggcgcccgttctatacaagaatgtctactacctgacgagttttctaagttagaaacgagagaaatgaggtagagaaatcagaaattactttggccgcggacacccgatcaaactttccgggaagcgaagttggcctccggcgggggcacggtgtttgggggtttggtgggatggactaaacggtactcgaattgtccacatgatgacgtacacatcgcttccatcaggcatcatcgtctagtagcagcaaatttccagtcaggctgcggtcagtctgctgcacgattttgcgacgaacggcgtcgatttccacgtgccggcaaagcacctgtcgccgttatccacgcgaagattaagctaattaactactactagtaagctgcacgctggtagtagcaaatctgtcgatacgcgaagtcgcgagagctccgttgttccaaatctccagtacggttggggtctgcggccaggggtacgtgttggaccaaccatctgcagtcctgcacgctgacaaacacgaccacacgcccacaccaacccgaacaaacagagcaataccgaagacagcgatccagcttattttgccctgttctgaatcctgaattattaagtttcattcatagggcttgccaatccaaattgctctgtttttcttccccaactacgtggggccgcggccacaggtgacggtgactctccggagcctgaccgctggcacggccggctcgaccacccggaagatgtggacccggaactcggccgcggcgacgagctcgaacacgcagtagtcgccttcctcgaggcagttcccgcgcgcgaacgcgcaccacccgcgcgacagccggtcccgcgtgttcgggatgtacagcaccgaccacaccttcccccccgggtctcgcagcaccacgtccgtcctctcccgcggcaggtgctgcctcgagaaccccgtcggaaacctctgcatattaacacacacacacacacacacacacacacacacacacaaaatctgctcatcaggctgtcacacgattcaggtgttgtgtgtgtacatacgatcgatcgagtagagttgttcgcgcaccatcatgaaggagtagtagacgtgcatggtgctcatgcggatgacgcagtaggggagcggggaccggaacgcgtgggcgatctccgtggcgcgctgccgctcggcggtggcgacggcgcggcggcgggacacgtaccccttgtagcgccggatggacggcgggatgctggcgagggccaggtcgtcctggaggctccgcgtcttcgccgcgccacgcctcgccgcgccgccgtcggcgtccagagccccctcgggcacgtgcctcggcggagacgccgacgatgcggggagctcgcacactgggagctcgtcggcgtcttcctcgttcttgaccgccgttgatcctgcagaagagtacttaggagcttttgagtaacgtatagttgtgtaatactaacaacaaattaaaacagttggcaacgaaatcgcacaagctatatatatatatatatatatatatatatatatatatatatatatgggctgtgtttagatccaaagtttcgatccaaatttcagtcctttttcatcatatcaatctgtcatacacacaaattttcagtcacatcattttcaatttcaaacaaactttgcgctgaactaaacacagtcatggttcaatataattttgtcatgtcactgtcagcgcaaacccgggcctttctgcagcattaggctgcgtgcctaacatatactcccttcgtcccaaaaaaaacccaggattgagttttttttttttgggacggagggagtagtgacgtgatgtgcgacatcggtaaatttgtccagggatttgatgatttgatatcgtcgaaagtggagtacgtaccaatcacgggccggtgggagtgggagtgggcctgggatgtttctctttgtggggtttagtagttggaccctcatataggctgttcccttcaccttcgttcttcaagcccatctttcaaatggagtcttggcaggaaattcagtgatgttgcgactttggaagtggaaccgtatgaaaaacttgtcttgtacatgatggtcaagttacccacttgccctaaacgttaagggcttgtttagttcgcgaaaagaaaatttttaggtgttacatcggacgtttgaccggatgtcggaaggggttttcggacacaaatgaaaaaactaatttcataactcgcctagaaactgcgagacgaatcttttgagccaaattaatccgtcattagcacatgtgggttactgtagcacttatggctaatcatggactaattaggctcaaaagattcgtctcgcgatttcctcctagctgtgcaattagttttttaatttatctatatttaatatttcatgcatgtatccaaagatttgatgtgatgtttctggaaaaaagtttttggaactaaacagggcctaaatatttataactgaagggaatatatgaattcattgtaccaaattatctaatggtacgatttatttaacacaaattcttgatacaattcgtggttatgataatatggtattcttaatcatctttgtagcgcaagaactttcttaagtgcccaattagctcaactcgcgccttgtaatccctccgtcctagaatataagaagttttaaagtttgacacagttattaagaaagtaattagaagtgaatggtggaaagttgtgattggatgagtagtggaggtgagtgataaaagtgaatagtgaatggttgtgattggttgggaagagaatgttgatagagaagttgttatattttggaacaaatcctgggggctaaaagtagttatattttgaaacggagagagtacatattattaatgtttattttttgttgtaaccagagtatgcactccatgactatgcacatacactacacgcatgtccataagggcgccctcctattagcaaactcttagacagacgggtctaagtggcaaatcactggcctcgttgaatttctattactagcgtattatccacgtgttgcaaaggggttctaattaataaaaaaaatatcattaactagttattaccattatttttatatacattatcttttaatttctatataaattgttaccgacatgtgaatttttgacctcacactatcatttttccattcccataagtagagaattggtggttgtcatgtgggtcctctagccccacatgtcatttctttattctaaaataatagggaggtggtggttggggtggtggcagattcatcactcaccaccacatacaactactactactttttgaagaagtatagattttgaaagccaactcatatggtttaaatcgtctcttcttccttctctcgtaaaaccatacaatcttaatgatttttaggtcaaaattcattagtatcaattaaacataaaatatattcacctcgcactatatatgcaaccatatgcaaactatataaaacacaggaagccttttttgttctattaaacatattacatcttatttatacatagtgtaacttaattttccgcattaacacgatagagtcttcatgcagtttacaatatttgtcatcatcaacatctgatgatgatcaatgaccatatcttttttgtggttaacgggagagtttcttttggaggctagctagctatagatagattaatggatgtacactattatctatatctatatatcttatatagttcatccccactaacaacattaattactatttctctgcactatgagttagccacgtcattacatttagctacagtcgttggattacaattaaacgccattcatttgcacgagcaaagttgctatctatcccccactgttcatgtatgtagctggcgccattactacgttgttctaaaacggcagaatatgtccataaatccaagaagctaagaggccatatgcatgaaacttaattatcagacaattagaaggcttaattatcagacaattgctatcattttttttctccccactaaagccactatatagcactctgccatttaggcactcttttctttgtgttgtgtatgtcgtccaaaacttccctagcaacaagatagaatatttgatccttcctgccacgcctggattattgacaccactgcagcaatttgggatctccgagaaaaggaaaaagaaagtttcccttcaccgatttgaattgttaatattggtcattctcaaatcttctacaaggtatgattgtcgttctaaagccctttatgtttgaagcttagctatatagcagcactgccagcacaagtactgaacatttcttctttggatagtaattatttgttagttctgaaatataagttcctatcctgaatcctgcgtttcttttcctttaattagagatggtctttacgatccacatttcctccaagttaaaccttcttattttgatttgatgttgtattctgcttgtggtgcaaaatacatatattatttttgttctacgatatgtgataaatatcatacttatcttactgctaaaatttccgctacaacgcgcggggaatcttatagtataataaatagatcactactcctcccatttcatatcttgtcattttggatctaaatcaaacttctttaaatttagttaactttataaagtttacaggaggattcagcaacacttttaagacgaaacgaatatttactagtagaatttataaattattaattcagtgttgcatatattactatacttttatatttgtcaaccgagttacacaaaccaaaacattctgtaccgcgagacggatggagtaaattaatactacctccgtcccatattactcgtcgctttaaccttttgcttgtaacatttaaccattcattttatttaaaaaattagtgcaaatataaaaatagataaatcatacttaaagtatttttgataataaaacaagtcacgaacaaaataaataataattccaatttttttgaataagacgaatgatcaaacattataaaaaaaactcaaagcgacaagtaatatgtgacggagacagtatatactccctccgtaccccgtaaaggaaatcgttttggacagcgacacggtctccaaaacagaactttaacttcttgtttctatgaaaatatttattaaaaaatgatatatgtatattttgatgaaagtatttttcaagacaaatctattcatgtaatttttacattttcaaactcaacaacttgagagttatttatgatttatatttttaaggtttgatttaaacattgttccaaatgattttttttactagcatggagggagtatactgtataatagtggttcttttcttacctggttccggtgtccaactggagtccacgatttgcaacggctggccaccactaggcgacgcgcggtacgtcaccatctccttcccaaccgaatccttcttgggccgcgcggcatcacgcgaggcggcggccgtcctagggcgaccccgtttcttgcgcggccggtcgccgccgccgcctcccatcaggtcctcccgctcgcacgccgtcctgtcgaacaccatcgcggtgaagcgcgtgttgccgtcgtagcggaacacgacgaactcgagttcgcgcagcgcctggtcctgcacgaacttgggccagccggaggtgaagaaggtgccctcggccgtccggcggatgacgaccagccacgtccggccgctgggcccctccagggtggccgccatggacgcctccttcaggcccttggccttcctcgactcctcccaggggatgtgcttgcagaagtttggcgggattttctgcattattcacacatgcatgcatgatgcatatatatatacacaaatgacattatttcgagacttgcatggtgcatataacagattgtttcgagactacgcaacgcatgcaaagctcgctttgcagaaaatgcatgcatgcatgctagcgtgacgaattctctctgcgcaaagtattggctagccatcgtcccgatccaaaattgtgatcgccatatttcgcacgatggcaacaagtgtaagctaagtgcacatatgccagacaaaagctggctaaccggcactcgtgcactcaccaggcgctgcttgaagtcgccgacgagcaccttgaagaagtgcggccgcctctcccccgacgcccacggcgacttcttcttccctcccgcccccggcatcgatccctcctaataaagcttctccaactctcactgctcgtgcgccgatcgatcatgcacggatgctcacgcagcagcagcagcggtgcgcgcgccgcctacgcgctcactctcacggcgaggagagcgagaagcttggcgcgcgccgcggggcgcggggggccgggagaagagaaaggaaaagagacgcgagagctcggcttttgaggcgggggcctgccagttttttggctgtcgcgatcgatcacacattcgcacactcatcactcactcagcagcgtcgcgtccgcccgccgcggcgccgcgccgagtggagggatgtatcaagcgtcggtctcctactctcccctccccctctcgtggctaaatatcgcctaaacccccggatatcgcggggggcggtggacgctcggtgcgcccgtggaacggagggacagagggggcaggtcgctgccatgtggggccatcagcgcgttagcgttaagctgggcccacatgtctgtgacaggtagctggtaccgcccgttccgtggggccggtggatattgctgcatacacacgctgtgtttctaatctaatttgatagtatcacacggaggcgcggctgctcatgaaaaccatgctacatggttgatgcatgggttgataaatgataaacatgtgcgatggctatttatacgtgctaattatatagtaataatgtgtgatattctttatgtacaaaatatgctctgatatctagtgaaatattggatactgttatcgcgagaggacatgtacatgacaccaaaataatggatacgatgcgtccacaatatataagccataacatatactgttgtcacatgaaagcgtgcctgaggcatcatgatatcactgtgtaagagctcacctttttttggatggaagtgtatatttcaatttgttgtcacatcaaaagcataccacctatcattggtggtaaaaaaaattgatcagagcaaaagtgcccaataatggaggttatgcggtggttttcccagagttgaataaaggttaggttaaacaggttgtccacttattgttcatagtagatcgttgatgcttaattcttcatagaccattttttctcaactaagattttcattttcagtgccctctaagtctaaataaaacttttacactattttctaccaagtaacttgatcacaacatgacaaaagaccatctatttgaagaatgaccacatatgtcgtcgtaccaatatgcatgtagtactagtacctttctttttccaatgttagaaatagtgtagtacattcgtacgggtggccgaaattgcaacagttccatttctgtctcctttatctcactttatctaatctaatttgatgtagctgtagctaggtccctgttcaatcaaaatggaatttgctcttcagatcttctcggtgattgttctcaactttagaagctacagtaaagtgaagaatcggggccagcagcccagcaccagcacagtgtcaatcggatggacgtaattttaacaccctccaaagagaacctggtcatgtactataaaatcacattggatctttgcttttggaaacatatgctgtggccaaagccatttcaagcaatgcccccctactatgaatgccagcttttcccaatggttcctgtctgggcatcgcactcacgacccccgggagaatcttttctggtgtctgcaccaaagaaccaaacatgcatacggccaagtacgtacagaaaacaatagcaaatgtagcaagagcatcgaggtgaacatagaaacagtaccgagaaaggaactgtagaaactttattccagatttatcatttattacccatccctaggacggtaacattcttgtgatgaaaatacatatgcccatgcttaaggtaactggatacaaggaacttcacatcacgtcgaaaaggaaatattacaatacaggcatgaacgacacggggaaaaaaaggcttgaagtaactccggtagactcatcagaattacagcgtgcagtactgaacaagtagtaagattttgcaggaaacagttcatagatatacatgactggaatagatccggataccggatgaccagattcaccggtagttgcggtaaagtgggctgtacatgcagctctctgcatacttaaccaggtcctttggccgagggcgcctgcttgccaaacctacagtcaggaagaacaagtgataagcaagctgtaaaaaggaaccatggacttatctttgaggaagtgaagataaattaggatgctgaccaagttcatatgcctttgctgcaacgttggctgcaatgtgggcagagatctttctgatgtttgagaagggaggataagtaaggccctgtcgaaattctcttgtgtgacctgctgagccagtgcttccgctgtaccaggatcagaatgtatcatcagtgttaacttgccagttcaacatatatgccaaagaagatctaaggatgaatcaatccgcggaattacgctagaaggaattcattcaaataattcattacagcttgcttatcacttgttcttcctgactgtaggatcagaatgaattatttgaatgaattccttctctactcttaccacctcattttgtgactgatttggactaatgcaaatagtactgcatcgagaacaatgtaatctcggtaaaaagaaaaggtacttgtggctttagttatatagtatggactatggagcacttacaagctgcaagaagcatgtcatcatgaacacggattgcaccagacatcaccacaccaaggccaaaccctgggaagatgtaggcgttgtttgcctgtatgacagaccatgatcgtatttttagtccagaacagttgcaactgataaaatctttgcaataaagtcaatggtgtttattgttaagacctggccaggcacgtatattttgccatcatactccaccggatcaaatggacttccacttgcaaacaccgcgcggccctgttatttcagattgttataacaaaactattgcccatgacaacattgtagtaagcactagggataacaaattccgagaaaagaaaaaaagcaaggtcattactgatagcgatcataccttgctccatgtgtacgcttgttcagcggtgcactcagactgagatgttgggttggacaaggcaaaaatgacaggcctctaggaatttgtgcaaaaaaaaaaaaacatcagctgctaacttcagtggttcaacagactcaaaaatattaaattgacatggtgaaatttacctcattaaatgaggaaatggcttcaacaacctcctgagtgaaagtttgcccctttccagatgtgccaatcaatactgttggtttgatagtctggaagatgcatttgagttagaatagagcctttcatagttattcatagtaaatgcaatgaatttttacatgggtgtattcatactttgactgcatctaagagatttccaacaggttcatgctcatgggcccatggtttcttgaagtgttgaagggtctcctttcgtgaactgacaatcaagccctgtcaatttattaatatccacagttagcaagtaggaacaaataaagttctgaacccaaacagtgaaattaagcaaggagatctggttcttttcaacctttgaatcaacaagccatattttcttgcggcactcctcaattggtgctttggtctgcatgtgcaaataattattaggtcatatagatatgtgtacaagccagcaaatgacccccccccccccccaaaaaaaaaaaaaaaagatgcatcacctgtcttgatatctcgagagctataagttctgcaatgcctgtcccagcctgcaagcacaagaatgaagatattgtttgggagaaaatgtaagtcaaatctatatcgatgaatacacagtcaattaaatgccattgagaagtacatgccacaaatatattgtgtaatatctatatagctcataatgagaaaatatatatagttagaaaaatggaagaacttatcctgatagaataagcataatacagtattttaaatacaaaattgcaaataactgtcgcacgaaggatgcaccagcaccaacttataaaatagatgaaaatggtcagtaaagaagcagataactacactaagatagactctgaattgtacaattgatggcatttggagttcttttcagttaatctagcaagtccacttcagatattgcagctccacaa

SEQ ID NO: 72666 - DNA, 904 bp, Oryza sativa
cgttgtcatctattaaaaaacggatggagtatgttttttcataaaacgtttatgacgcacatgcactctcaccaaatacatacacactctagtacgttctctaatccaacaaaaaattcttgttgaaatcatactgctatgtaagagaaatctgacatgacatggtgccattgtcaacagtggatttcaccaaaatatcacttcgcagaagatattcgataaaataatgccactctcgatccatgtctacaagctacggagtataatgctaactaggaccaaattgccatgagcggtgactgccgtggccgagcttggatcgacggcaacagcggcggccgtgctcgaggaaggcatgtcctcatgtgggcgggcgcctgtgatcaccgcgccagccgccgacccctgctgcgaatatttgaggagacgaggaaagagcagtacgtacagttgctagccatgaacgacggcaaggaggagccgaagttggaatagaagatagggatagcacaagtcaaatgaaatttagtcatggatagtattatatagcgtgtagctaaggatcgagagtgacattttttgggtctcttctgtaaagtggaaatttttgacagaagcacaatatcagatttctcagtgtgtaaacaacatttatggatactgaaatttaaacctagtgggtggagtcccacatctatgactcattattacagtgccagtgctttcccaacatattagtgtatatgatagtgtcaacctatctacatgatcatacaaataatccaaccaacactggtggagaaaccctttgtagtcctggttcgtaacccccctttagtcccggtttctaaaccgggactatcaatccgggactaaagatcgctatctttagtcccgggtgaaa

SEQ ID NO: 72667 - DNA, 3097 bp, Oryza sativa
tgttcagtcatgttactcgctaacatatttgtgatcagaatccctcatgttttttaacggagggattagatggcagtagtttacgtttgttagaacatttagatggagctaagcatacattttacatgatctattagggcaaaaaagaacggcactgatatgtgaatacgtgatctttaataatgtgccaatattatttgcttaatctatatgtctagtctatctttggaacttatcccattgaagcctggtttggtttagaggggattgaagaggattgaagggaattaagggggaataattccacaccataataggtgtggaataaatcccctccgatccctccctcatagggattaaccgaacaaggtctgacagcgctcttgttcgagtaacaacactggtttatttattgttgtcttaaaactcttagagctactgcggcctcttaaaatatagcccaagctagggctcttcttcccctctcaaattccttaggcaactggctggcagccggcccctctacaaattccaacttgaaaaattcagtctatatacaagtattgtgataagaatggaaggagttaggaagaaaatcaacacgacaagtgttggtcatcatctccaacgagcacacgacattacatgttcttcccgtcgattatctcccatgcccagatgttttactacttagaccctctgggtgaggtttagcactgtggtctgttggctcatcggaaagcagcggcaaccggctctggcccctgctatctggcaaagaacagaatgcagacatttgaagaacaggacgagcttgagcatgcaagaacggtaagctgtaccgtgcggaggcgacgtgatcggctcatgtagaagttaatttagaaccctagcaaccattatttgtttcatgagctatgggtttaaaacacgaccagccatttgatttttgcaacgactttgtatatgtagaacgtttacgaaaggcagaggacacaagtcctataaaattaagcatattgttatatatatatatatatatatatatatatatatataatttctgtacatatatagcataaatatatattctgaagatgcaaaatatgtgcaaattagacatcgatcaggtcgatgcaaacaaactagagtattgcatagtttcttcagttgccatatagtttgctgcaatttttgttccattaattatattttgaataccagagccggggaaattctttcacctgtttcatcagttttagacaccagggaaaatcaattttcgcaagcttgcatgggaaaacaaattaatgctagaaaaaatgcccatgtctgctggtgtcaagctaaagtgaactgcgagtgaaaacaatttttgaagacaagaaatttgaaaatcatgacgacgatggcaagctccaaccccggccatggcctactcgtcgagctgcgttatcacagcggttgctgtgtctatccttgttagcctcgccgtcgttgtgtccatcctccatgagtgcggattgatctacgccgaagggatggagggcagaggtcagctccccatcaactagagtcgccgccagagtcgacatcccttggagtcaccgccgaacagagttaccaccgccggatccgccgccacccgtggatgtcgctgccaaatagagtggctcaagctctaccttcgccagtggatgtcgcccgaactccaccgccaccagtggatgccgccgcctgtggggaatgaggaggagacgggcgcgcccgtggggaacggagttgcccaagctccgaacggcgccggtgggaacgaggcgagggagactggagggagatggaggaagaatgggtatgggaggagagaggggacttagcttgtggggtttgcccggtctcccctttaatatggcaatttttcccctaagggtcctcttcaacagctatttttcgcagcagtcactaattaagaggtccgcatgcaaaaataactctatttttgcaagcggacctcttaagtggctgtccggaaaaattgattttcgctagctgttcgtgaccagaatctcccaaatgtatttctataagcatatgttttcttaaccctctaataaaaataaaaggcgatgtcatgaaaaatgatttttaagtagtgcctatttagaggtaaacagaatagtaatataatgcttggacaataagccatattatatatatatatatatatatatatatatatatatatatatatatatatatatatatatatatatcccatatggtagtttcgcctcgatcctcccactgacactagtaataagattcaccatacacccctctccagaattattgagttctcagatgaaaatttagtttacataggaactgtggtaggaacgggaggatgaaggaagaaattctgcacagtaagaatccagtgcctaattctgccaaacctagttattcgtcttgatgaaaatcgtcgttagcaaggccggcaagttgtcacaacgcgattctggcccctattgatgagtgatgacaaggtactgctggccccagttcaagcattttgatgttcaaattagccgaaacagatcctggtatttcacgacagagatgttcatcaaaatgtcacttttgatccttgccaacaaaagaaataatgcttcatcttttgttatgggcgataagtgatcggattggatatgtgtggaaggtgggagggcgtggcttcggtggcttggaggaccggcgacctgtgatgggcacgccgatgaaacgagatgagaaacagagatgaggaaatagattaaatctgacttatcccttgaatgatctaaacgtgcctcttataggcttgcaaaccataactaacaatctgctaatcaaaaagaactaactctaacaactccctaaacatctcacgagataactggatactattccccgtccggcacggagaagatcacgacgctaatccttttgctgtgccatcactatcgccaagcgacgccttcttgcgtcttcgttggtgcacaatcccgaccatgacatctttgtgcatttcgactccccacaatggcaatctccttac

SEQ ID NO: 72668 - DNA, 5175 bp, Oryza sativa
agtgatcggattggatatgtgtggaaggtgggagggcgtggcttcggtggcttggaggaccggcgacctgtgatgggcacgccgatgaaacgagatgagaaacagagatgaggaaatagattaaatctgacttatcccttgaatgatctaaacgtgcctcttataggcttgcaaaccataactaacaatctgctaatcaaaaggaactaactctaacaactccctaaacatctcacgagataactggatactattccccgtccggcacggagaagatcacgacgctaatccttttgctgtgccatcactatcgccaagcgacgccttcttgcgtcttcgttggtgcacaatcccgaccatgacatctttgtgcatttcgactcccacaatggcaatctcccttacagtcgtttgaaacgacgagactaattgttttgagttcttttacggtgcacctcttaccatcctagaggtaagagggaaaacaaatcaaaagcgttatctcaatcaacatgtttacgtttccaatgcactacctaaacacgaaatccagcagattatggttttcatgaaatttgacatattttttttacaaacttaatttggaaaccaaaatttgagtatgatcagcacttgaaattttgggagcagcgattgaattttggtcgagatattctaattaaattttgacaaaaatgcatcaaattttattagagagcatgtagtccttcgtgagtctgtgcgatgtcacaactggttatagataatggaagatgagtagtactctctctgtttcacaatgtaagttattctagcatttccgatatttatattgaagttaatgaatctagacatatatatatatctatctatattcattaacatcaatatgaatgtgggaagtgctagaatgatttatattgtgaaacggaggaagcaatacacatttcttttttctgcatttagtgcaccgagccaaaactgtaacaacatgtacggaggactgatgaatcactacatgggaatgtatacgtacttaaattgttgtattttagagaagtgaaaaagataaaattttcggtagtcattaattttgtaaatatagagatattttcttgttttgatggaatcattgcattatgaatttaatgtagattgtacagataccatgcgtgtgtggcttcgatgccttggcacactaacaatttttatttgcttgttttatatatatctgagttcccgaccatgccaattcttccccattcagatactaagacaacctcaaattcttaatacaaccatggactactaaaacgacgtttttctacaaattgggataggaatgggaggattcgaaaaggaaaatagagcttttttcggcggaggaacactgctatcgtgagacaccatgtaatcagatgagccatgcatgtttctaggtgtcaccgtgcgatttttctgtttcgatccagcggaatttaatatcgttcaaaagggaaatatggctaactgctagtgacaatgcgcgattaagagatgcaatgctgcctcttccatttttcctggtggaatgacatttgctgcatgttgccatgtccgttttctaatattcgagtgaataattccatagcgggccatctatttttatccggcctatacccagcctgtaagctgtaagtcgtacccgctaacctatctgatatgagcaattctacggtctttaaggaggtaccatgaggtaccaaaaatttagtgtaaaatttggtaccttatggtacctcatagtatctacatatcaagaggtaccaaatttacaatagaaaaagtggtacctcatggtaccttctcaaggaccataaaattgctcagctgatatggtgtgcacaccaccatcgacctaggcaggcttggtttatgcattaacgcatgcactgatgcaccgacaccaccattgcgatcaagcagggcaacactttatatgtttaattacacgatcttaagtgaaaggcaaataaatagtaagatgcaactcaagtaattatacatagcccaaagtgcaatttaatatttttttaatatacaacacaactgagtttttttttctcgaaaatattatgtagtgttagtctgttacctcaatttatctctcatcagtttagttacttcaaatgcctacactgacatgtcaacattgtatcaacggcccaccataggtcataaatctaactactaccatatcatataagcaatttgcaatgcatatttatttgtcttcgatgccccctccatttaaattttatatttgaaggcactctttgattgattctattaataggagtttcgatagtagaaaaatgatggtatagaaatggaaaggatcaaacgtacacagttaaaccgagacggcagtcagaacatatcttcaatccaactatgtatttttcactaaattgcggagaaacacattgggaatgggaagatttaggaaaatagtgttgccaagtcagagttgatctagttagagtcttcgactgtatagctgctacaagtggaagctaaactgatcgaccacgagagtgctcgcaataatatgacaattgctggcgacaatagacaacaagaataacaacactgagatattgtgccttttgggtttactctactttttggctaataatgcacatttgagaatttgtggtttatagatagcaattcaaatgtgtgcgcagattcttgttggatgcaagggaagagaaatagtatgaacaacattaggtgataagcaacatcatgaaagaagtgattgcttgagtttgagagtttcgaggaactatacttttcttgaaagagcagtcaccttactgtacttttaggaattcaaatttttctaccagcaacagataacatgacaaacaattggagaggaacatcgagagcatttttcatgttaagtcatgtcacttgcctagtaaagttataacatactagccaagagcccgtgcgttgcaacgtagacagttgagtttctagcttattaagtcaattaagcacacatttaatcaaaaatagtatttttatgattttccttattgaacaagtaggtctttttgaaatttgggagagccgaccgtgaaaccgaggactcgttgaagggtgatgtaacagtagagattgtgagacccaaatatcaataggggtggtatggcagacttggacaccgccaccattttaaagtagtatagatatagatgtcagtttcaaaatagatatccccttgccttcattagtcgttgtctctctccatccaaaaacataaggaactccagaaattgaggtgaaaagtaaaagatgcttgttaaatgagggatgagagggtggttgggtgtatgattatgtgaaaataaaatcataagtggttagtggaaattgtattctaatagttctttatttatatggacgaatttcaaatgccagaatctattatattttcaaatggaaggattcaatggcatttggtagagtatttagatcgagtatacctattagagtagagtacctgtcacgcccagaaattcactagtaattttcgaactaatttgtgcataaaaccctcgtccaggaatcagccgaggtacacaaactgacaatttaatatacagaatcatcaataatacagcgttacatacttacaaaagaaaagaaaaacagcagcggaattacaatctagcgaagctccggctccactcccacaggcagctcaactggggtataagccaaacgtcttctccttcgcaacttgtctttaactgaggtttgattgattattgcaaggtgagtacatggaatactccgcaagccacacaacaaatatgcaagtgcacaaggataccaaagaatggcataatatagggctcatttgcaaaagcagaatttacaaacatttgagaattgtaaaacagtagagtacttaatcatcaatattaatcaacactgaacagcacacccatgctgctcaggcccaaccatcctgaacaaccatacccggctgcacagatctatctccaaaccaggaaatgtaccattgcaaaccaggagctaatcaaattattaccagttataatatcatttattatggtgagaagtgtgagactaatcacaacagacattgttagacctgcgcataaccgcgggcatggctattcgaatagttttactctggccagaggtgtaccactgtacccacaagacacagccccacaacatgtcaccatgcgcctcaataccaccacggtacctcagaaaggagctgtgacagtacccctcgcacaacataatccaccacagcgcaccgttcctggatcataatcacccccttataaacaaggcatggactccccagcgaaccccgtgggcttatctccgccacttctcagtctggtgccccgcaatgaaccatgctatacaaaaggtaaagccgttgcccacgctggcttgtggttggcacggttaatgtttcataaccgaaactcatgaaccggtccttaaatgtcatgagcacgaccatcaaaaccatgtgctcacaacccaccattatcaagttttagttggcacattaattaattaaccaatcacgattagccatcgtgagctatcattaaatatccatcattaagtaatagtgaaacatttgttatcccaatcgtgtgctaatgtttctaagcatgactaagcaattatatctaatatatctagctaaaccaatatatcaatccaactagtcaaattataacccgaggtaatcaagaaatagggtaatcaatgcaaattggccataacaaaggaacaggttcacaccacccaatgacattcgaaaataaatacacagttgaaataaatagagaatttaaatataggatcaacatgctcaaaggaattgtgtttgggatctatgtgacttgacttgcaataaagggtcttcaattaatcttctgaaccacttccgacgctctcacgaaccttcacaacgacggaaacgacaagctaacacgcaaaacaaagaaaaagactaatacaaaccaaataaacagtacatataaagtaaacaaacatgtagatcatgattttagatgaatttagagacttgaacggcctcattctgatttcatatgaattagt

SEQ ID NO: 72669 - DNA, 2563 bp, Oryza sativa
atataatagatagaagatagatagatgtaaatcagagattatgccatctcataaaaatatagcccgggctagggctcttcttcccccattgaaattcattgagcacccagtggccggtctctccacaagttcaatccagcttgaaaattcagtttatatacaagtgctgtgatgggaatggaaggagttaggaagaaaataagcacagaaattcagttttacagcgccttgctgtgcccttttccttcttgattatgtcctccgactgtgccacatacacctcctcgaggtcacccttgaggaacactgactttgaggccgaggtgatgtacctgctatccgatctgctgcgagagcgagcacgacgcgcatggtgtcaagcctcaccaccagcatgaacacttcatcgaagtccactccttgccgctccactcctcgcttgaccacctcgtctgccgtgttcttctccggtttgaacacccacttgagcccgattgctctatggccagctggcaacgtggtgagcgaccacatcgcgttctacatgagggttctgcttcaacaatgattgatcaaaaaaattctatagtgcgcttaggcaaactctactacgacaaactactagtatagattaaattgaagtgcatccttacactttgtttcatgccgatgagcccaggcgagtgacttgggtggccagacactggctccactgctgtgtgttggcttattgttgggagaggtcttaggctcttagctacaatgaatacccaaaagctccgaaaaatcttatgtaatctttagtagtcctctttgtatgccaaaggagtatcttggaatttgtttcgctcttggttccattgcgtaaattatatactgttttccactaaaggaaagtactattacatttatattactcatcaatttagttacttcagatgcctatactaacatcaacattgtatcagtggcccaacataggccacaacaaagtaagagacattgcatgaccagctcacaacataggctacaacaaagtaagagattgcatgaccagctcatctatttaacttggtcaccatttatataagcaatttgtgatgcatatttgtttgtcttagatgcgctttccatttaagttttatatttgaaggcactcttggttttggataagttgaaaatatgatgatcgtgaaatataaacggtaaaacattgttaaacagagacgccaaccagagcatatcttgctcgaaactatgtatttttctcttacaaaattgagatagaaacacaatgggaacgagaggacttaggaaaataacgtctctgacacagatttgttccacttggagtcttggactgcaaagctgttacaacttcagataatgctggtagttccacccggagagcgagcataatataatgtgatgcctgctaagggaaaaatagaaaacgatagtaacatgcagtgagatattgtctgtggtttttctctattttttgggttaataatacacatttcagaatttgtggattgcagataacaatttgagtgtgtgcaaagactctagttggatgcgagggatgagaaatagtataaagaacattaggtcataaataacatcatgaaagaagtgattagtagagtatgagagttgcaaggaacagtttttgtcctaaaagagcagccacctcattatcattttatgaaaccggccagttacgttctttgtaccagcaacagatagcatggcaaataattagagaggaacatcgacattaattggaagccatcgtttggcttattttaagcataagcgaaacggcatatttacaaacaaaaaataatttgtgaataaaacttttatatacgtgttcctagcaatttaaaagcaaaagctgaaaaataaacttcgatgaaaaaaacctcaaaaacaacttcaaatttaaggttgaatatttaaattttggctgataagcataagtataaacgaaaagatgaggctgatttttcatgtttacgtcgtatcacccgcctcgtgaattaagtcactaagttatactatcagtttcagaactgatatccttgtacgcctctctccatctacaattaaatataagcggttttactttgtttattggaaattaaggtgggaaacaaaacgatgcatgcactcctgactaaatgagggatgaaagggtggttgggagtaaatattatatgagaattaaaagagaagtggttggtgaggaaagtagtactctttattcccatttgtagacaaaattgaaatatcagaatcacttttatttttttacggaggaacaaaatatcatcagtagatagaatcccttgttatattttagaacggcgtgactagataaaactaaagcatgggttttacaagaacaggacaaaaaagagcaacccaaacggtttgtgatctgtagtaatgtgtgattatttcctttttagatgatcagcactatccctttgaccagatgggactgttcttggttaacgacacttctgggttaataaatgatggttttaaacacttg

SEQ ID NO: 72670 - DNA, 7428 bp, Oryza sativa
tttagcgtatttggaagaaaaagaagcaggggtttcaaaagatccaagaattttttttaaaaagaataatatcaacgtcatctttagtattgtgctatttgctttgatcgtatatcttcctatatcatttattaatcgtctattcacctccctttgctccacctcatactcacacgtagcattgttacctattttgcatataacattatgtttttcccttccaagtcttgagagataatgctaactttttttccaaatacaactcaaaatactgtttaagatgtgagttttgttatattatgcatgactatatagcatataattattaggtatcattacctgaactcattttcaaaactaagctggagtaaagtagagaggttatctaactgcaacgattcccatattgcggatgaaaataatattcatataatataacagtacacaacgatgctttgaaaaataaaagtattgtaaaaacatagcatgtatataaagctacattatcagttgcacctaaccaaatcctcgatttagtttgacgataaaactacaaaacccgtggtaagacgcggggtgccaactagcttatataaatgcagtactccctctacgtcagtttttgtaagatcgtgggatgtgctggtttgaacataactcctggattgttgattgttgtttcaaaaattcttttttcttctttaatgcaagagagtggtcttgttttctcttaagaaaaacagaatattattcatcgacaatactatactccctgcatcccagtttgattcacctaagatttttggggggtttttcaagatgatcatcctataacgaagtgtctcttcgtttatgttgcaaatatagtaaatgcgcatcatggaatgccttgcatgaagccaaccagaatgattttttattggttcaacccatgcaatgaggatcaataaagtgttccttgatcgatgaggatcaattttagaatgatgggtgttttggtatccttggtcttgatgccctttatctagagaatgaccaaactaggatgggggagtattacatatcctctcttgctataaagttagagccccctaaatcttaaagcttaacatacaaagatgtcacatcattatccactaacaattattacatttaaatataatgcaagcatgttatattatctattatttcataatttattaaattttatagtttttcaaatgcaagcatgttaaatcatcatctcacataattcacgtaatatttgaatatgtctcttcatttttttataacatcttatatccctatatatatagttcatcctaacttcaaacttagttagtgggttatctcttctctcattaagctgtatcacatcaattgttttgtccttagatgattatctatggtccaaattatctcccttcttttcttctctaattaagtcatatcaactccattatttttagcccatagatgattaatctttgatccgaactatcttcctcattttattctctcataaattcatatcaacttacttttatatttaaattattctatataccatttaaatttaaattatcataaaccacatcaacttacgtaagtttatattgtctagctagcttacaaattacttttacttagtgtatcatactaaaatcctacagcaacgcacggggtttcacctagtaaactgtgatagttcacctcttcgcccacatgccactcgaattctccacgcacccctctgcacaactgttgagttcatacatgaaaatttaatttacaaaggaattgtggtaggaatggaagaaacaatatggtggttactttagccaaaccatattgttaggacaaaattttgtaagcatctcttttccaaaatgcaggcacaactacttttttatgatgtgtcataatataaggtgtgtatgcatgcaacaccaccttctttcccctaaattccaccccacgcactattcccatccgacgtggcatcgcccagcggccgcctcaggagcgccttttatttatcgaattatcttttaaaaaacatcctccaccctcaagatttctaattctattgggtgcatggattatatttattgggtgattcaaataaggaggtgacaatagttgtttcattgtctttaggttaagggtggttgtgccttatattttagaatggtgggagtaataggcatctacatacaaagccgtgcaccctaatctggaactttttgaattttacaaacaaaaatatgcacaagtggaacatgaaggattcaaacccgagagtccacactctccatccataccattcttaccatcgcacctacacaatccttcttgtagaagtcatatgctattcttgtaactctttttgttcaaaacatgtattacatccaggacattcttgatgaattaaaatgagaaaaaacatcaacaacaaatttgtcgatcttgtggagcttcaaaattttcatattgagtttgtctccatcaagtcattggaaaatttaggcatgcaagcttctgacgcatatttgggtatgtaaatgaatttaactgaaatggttgttacataggatattgtagatctcgtcaagatctataatattgatatagagcttgtattcatcagaagtcatttgaaaattaaaagtatcggcgaatttataacatatattcggggtatgtaaacgatctaacgtggaaacattgtcaatggcatggttttagatctcattgagctctataattttgatataaagtttgttttcatgttactttgtataaacatattatttttttattaaactattatttgagtatcgctactggttcaacactcaatagatacgctagtccggaccatagtttgtgttaccgattcatggagaaactgtactgtaggttcatgtcatgaacctacaatgatacttccccctctcattgcagattcatggcttgaaccggcagtgatacatggctctgcccattcaagccatgaactgcctagtaatacactgccggttcagtatgatttagtagggaaattgaagtgaactggcgtagtgatgagctgacagccttttctgctagtgaaaactcaggctctacaattatattcaaagaaccaactttccatgggaaaatgttcaaaaacatcaaaagtatattactatatacattttccatgagaaatgtgcagaattgtaatttgtaaagagaaattttcctgtccttaaggagggaccaagagtattaaatcactccatacaaagcattctattttcaatgatctactcattgcccaacttaccaagtatcatttgcatgtaccataacttattactctctccgagttgttaatacttctcggacaaggctatggtcaaactttaaaaactttagctataaataatatctaaaatctttatcttagaagtatggtggagatttcttaaaaaatagttcaataaaatcatatttttattgatataattatatatattgtaataaaaagaatggtcaaagttactttatggataacatgtccttgtccaaaacgataactattatcaacccgaaaagagtatatcgtataactgattggggcatatgcacagttgcagaatattgcacagcaaaattatgctctctaatgaagaagatgctaatgaagtttgatatttagaaggctttttgtatttttaaggatttgaatagcaaatattgttatacctgattgaacataggcatcaagtcatctatctcgggccttctttttatgctaatgatacgatgttgttactagattgtttatgatgcctttgccattagaactttgtatcaagaaaaaaacggtttttcagtaatttggattctggaaatgcatctagcctgcatagaaacctacataaatatttgaatgcgccaaattatatgtatcttgcagaataatgcatgtgaaggtacagccatttgagtttgagttcttattttctaactgatgttttctttgtctaacagaaaatcaactttgccccccaatggatcatatgactggggttcagggttctaggcttgtttggctatggctggagcccgaccatgcagaccatggatattctggttacacttgaattgaaaaatgtattgtcaccaagtatttaggaagattgctattctgggaggacaacagtgctcaaaggtgacaagctcattcaagggcgcattatgcttgcaaggagcacaagtgacacaaatcttgcagaatatgatattttttacttcaatttgcagaaccaaaatgcgaaaagaagggccattgcaatccacccgtcaacataatacatatggcacaaagctatagttaagtattacagaaatagaggcgaatgatatcaggaagctataccgtacctaaggtatcacaaaggcatggcacatagacgtatatgttgcggatatgcatatcattgcttaacaagcaggtgcggtaaagattttaatgaatgcactacctaaatattcatgatatctttgataaatgtagtctctaacaataatcttgtggtacagagcttttactctataagtaagaatatatattcaggatctctcacagaagatgtatataaaacgagctatttatgcacttcttccttcacttcacacagtctcaacgttctctagcaactcatgccattatcaattcacttttcaaaatttaaacaaatataaagggaatgggtggctccaggaaatatctcagttcgacacgcttgaccttcttcacgtcatttagggagagctgtatctaatgtgtgaagggccagatgaaccacaccttatttactttgttttagggaccacctatatatttctcgacaatttttctcctaaaaatttgatagatgtaattatagtacaatcgtagtgtaattacactgtaatttgtatgtaactacagtgtaacttatatgtaagtttcacgtaattttgaatcattaaatctattataagatttgttttggtgaggaagaaaaaacaattacagcacacatatatgtgaaagaatttgttcccacaacctccattttaccgaaataacatgttacggagagatttttaaaagttacatacaagttacattatagttacagtgtaattacatgcaagttacagtgtaattacactacgattgtactgtaattacatctctcaaatttttaggggaaaatttgttgacaaatatatagcaaaattgttgttttatttagttccccaatctgctaaaagccaatatgggataattagatgcaccacagctcagcaaaaggtagaatctagtagtgagttctatataatcccatataattatggaccaatttcagaagttaactccttatatttttttatcgagggactagattgaattgagtaattagataatatgctactcgattcgtagtgctttcagcatcagccactcaattcgcagtgtcaatcgatttttgcagacgtgaccagttacgatccgtctataaactatgggggtacttgtatagaaaaatcgtttctatagtagtgcgatttgcttggaatcttcaactgaatagtcactacaagccacgattaggctgtccatcgtcaccagaatatcaaacgaagagtacgcagcagatgctagttgaaactagaaaaccaacactgacatattgtgtctttggtacctttatttcttggtttgtaataaatacagattttagaatttctggtttacaaattcataattcaatgtgttacaaacagactatcagacactgcatgattagctcatcaatctaactaggtcacattgtgcattttgttatgtgtattcatgagtctccaatgcttactgcatgacactgcattgattattttgttatgtcatgtattcatgttttctatttgaaggcactcatggatactgtaagtgggagattggattcgtagggaaaatgttggtagagaaaaaagaggagtaaaacattgaaagagagacatcaagcagatcatatcttgctcgaaactattttccacttgcaaattttatatagaaattttcattgggaatgggatgatttaggaacacggttagaacttgaaccaccaattcttcaactccgagtcaatttgcttggcgtcttgaaccaaatagtcacaacaaaccacgactaggctggccatcatgttcagaagaccgagcgaaagtgtattatgcttgttgaaactagaaaaccaacactgacatattgtgtctttggtttacctgtattttgtggttgataatccagttctgagaatttgcggtttgcaaaattcgtaattcaaatgtgtgagtgtgtgtgtatatatatattgcagttggatgcgaactaaataacaatgaataagggaagaaggattggatggagaacattggtgaaaagtaacatcacggaagaagtgattagcaggtttcttggtgtgtccactagcaaggaacaatatatgtatcattaacacagaagcccctgcatttccatctgaattcattgttttctatccacgttagatattgttcatcacgccagttgctagtattgaagcagtgattgtgtatacttgacaaaaataatttgagggaaaatgtacatgaatattttccttgttaacgatcagttatgtcattgaccaagtgaaattactggcatatatttgatttgcaaaatcagatgcccttatgcccttgttactcaattagcgcatgcttgttataatttttttcgccgggaaggccgaaggaggccaactgagtatattaagaaggagtaaaagttacaagaaaagacatcaaaatgcaccaaggtgcattgccacacaccacacactaccacccaagcacaaaccattgaggatgaagcctagcaccaaacgacccccgctaagcatggccggatgccgctaggcctacggcaacaccacagagaagaggctccaaaaacgatgccaccacggtggtcacgacatccaagaatgccgccatcgcccatctaaaaagatgtgcttttcacctagagaagctcatcaagcaagggagagggtaaccctcgacaacaccccaagaggttacgacacccaaaggcgtagccgctgccagcccggtgaaccaccgaactaggcttttgcctgagaccctacacccttgactgcagatcgccatccaccaactcagaaaccccacacatacatatggcagcacgcagcatccaccacaccacaccgacgcccgtccgtcggccgacttcatcgaaccaccacccctaagagctagcccaggacccctccgttccaccacccgcctgccgcctcgccagatttggccgaagg

SEQ ID NO: 72671 - DNA, 1386 bp, Oryza sativa
cgttgctgtagtgctatcgtgaaatttcatggtcagtagttcatgtgcatggtcgccctgatcaatggtggtaggacatctctggagctgtttttatgcgatattcctgcaaaattcctagtacgaattcatgcgttgcaaacaagcccgtatgtctccttcatttcttgatacgacatggatggattgtgttttggttgacaaaatccaaggagagcaattttatgcatgaaatgagaatgagcaattatcaggctgcgcggccgcccgccggcaccaccgtgccgtcaggcccggcggccggccgcctccatgcacccccggtcacggcggtagggcagggcggcctagcgcctctccagtcgcggtggcgcgcctcccggctggcttcgcgggagcggccgacaagggcgaggtgaagcgccggcgtacgcggacctgagggcgaggcgaagttgagtctgtctcaggctgatccggcgtacatggacgaggacgaggctaagtgcgtcctgtgcgcgtgcgggcctcctgttaggttgaaacggagattctttttgcctgcgtgccggctcaaacgccatctccgttggattcattctggacgcccgagatgcatggtatgtcacgttgtgacttgcctatgctaagtaaccgaagctgagtccctccgcgtttccacgctcatgccccaccatggcgccttcccccgaccgctacacgcctacaccttcccggctcccgctggcgctcaaggccgcggctcaggccgagacgccaacctttgccgacaactacacgccgccgccgtcaagggtgggctagcgcgctgcgcgccaccccctcactgagagcgcgctcatcagctactaagcgaaggctctcgacctggatcccgcatgcagggtgttcgatgaaaacccccaccggggcctgggttcgtggaacgccatggtctctctcaagttggggagtcaagggaggcgttggccttgtttctcgatctgcgaaggtatggcatactcgtgctgccagatgatctgaccatggtcagggtcgcaatcagcgtgctgttctgtaggggatattcgttttatggagcagttgtataggtgcgtgctgcaatgtcatcgacaggacgccttgacgtgacgctatccaatgcattggtcaatatgtatgtgaaagaccaagaacagctatagaggagggggggtgaatatagcaattcaaatcttgcccccgaaaatactcatcaagctggatttctcaaaatccttattagaaccgcggctattagagaagccggatctagaaaagaagcgagaaggaattcccgaaactagaagaggaagagaaaaggaattccccaaacttgaagagagg

SEQ ID NO: 72672 - DNA, 4661 bp, Oryza sativa
aaaccgggactaaagatcctatgcgcctgacacagtctgacatggaaccaaccgggactaaaaatactaaagatgatttttaatacaaaccggaaataaagattatctagtcctatttttcttataaaccgtgactaaaaattatttttagtcccggtttttaatgaaaccggcactattatagattttggtcgatcaatcaaaaatggtttctccacaagtgcaggttgcccccagggcaagacgatgctgtagatggccccgagagcgccgccgatcccagcgtatccgacgttgtcgatggcctcatgcaggggcgccggcgtgagcggcaggaacagggtcgtgtacgtctggacggaggagaccagcgacatgtagacggcccacgagatcagcagcggcagccgccacgggacggcgaggaagaaacgagggtcggggagcacaaggcccaagcagcagattattatcatgcatggcacaacaccgaagcgcaaccacagcatgtcggaggacacgtccggccacgcctccccgactgtcagcagcggcggcggcgccgttgtcgccatggtaactggtggagaaaccatctttactcggtcacctaaaatttataatagtcccggttcgaatagaaaccggaactaaagatgtttttagtcccagttaaaaactttttgacctttagtcccggttggtaacattaaccgggactaaagatcatttttagtcccggttcaaaaaagttgtcgggtcgagttaggtcccagctcatttttagtcccggttggtataaacaaccgggaccaaaaatcaactgagccgcgcgcaccagtccaccatcctctcccctctcattaattatcccttatcccttcgatcccaccgtcctctccatcccttcgctagctagcttatccctctcagcctcaacctcctccatccattctcctctcaccttcctcccccttctcttcctcctcctcctcctaccacgtgaggccgagcggcagcggcagggaggcgggcagccgagcaggcggcaggcgaggccggcgaggcggcgggcggccgacgaggcgagtctagcgaggcccgcgaggcggcgggcagccgggcgggcgaggcccgcgaggcggcgcgcggccgggcgggcgagtccggcgaggcccgcgaggcggtaggcggccgggcaggcgggcggcgaggcccgcgaggcggcgctcctcgggcgggcggtgaggcggcgggtggcggtgctcccaatgcggcggcgctccccaggcggcggcggagcccgaggcggccggcgggaggccggtgaggcggcggacggtcggcgcccgatctctgtgatgtggttttttttcctgatctgtgtgatatgtgcagccgatttgtgcgatgtcgattttttttctgatctgtgtgatgtgtgatgtgtgaatgaatttgtagagatgtttttgtgattttgtgaatgatttgtgatgtatttggggataaaaatgcagcttgatgtatttggggattttgtgattgatctgtgatgtatttggggataaaaatgtagcttgatgtatttggggatttttcgaatgatctgtggtgttaaaatgattcgtggataatatgaatggtggtgctcgaaatcatgaaagcaggaaaaaaaagaaaaaaaaacattagtcccagttgttaattctaaccgggactaaatctttagtcccggtttttaacactaaccgggactaaaaatccatctttagtcccggttatttaactgggactaaaaatatgcatctttagtctcggattcgtagtcccggttgtataaccgggactatagggggttgtgaactggtattaaaaagggtttgtccaccagtgtgtgaagacgacgtaattaacaacacgtactgcagggtttgagctgtacttcgatttgactgatgatttgtatttacggcctacgtacaggcgcgcggtgcatgaagatcttttgtagcgaggcgagcgtgataaagttcgaatcggcaagcaacgtaatcacgtatccgattccgttgaaaaccaacgtgatgcggtccgtctggccgctggacagtggggccccaagttgccgaccggaacacgactgcagcagcatatcccttgccgctgttcgtcgggggctttcttcttggcgcgcgtctttcttggcaatgctgtattgctgtgcctgtgccctgtgagcctctgacctccgttcttgtttgagttgccaatcaggctgtattgaatcagccatggataagcttgaggctttagcccttgggagcagccatagcccaagtacgcgacgccaacctcgccgcggcatggctcgagtcctgctccgacgagagcctcctgcgatctgcgcctcggcctatcctccccttacacgctgccgccgcaaaaagatccctcagttgcctcgaccgataaatcttagtgacattttggatgatctcgttcagtcattcgggcaaaaaaaagtttttgttgctcacagaaaatcacacttgaacattgaaattttcttcaagtcagaatgcattcttgatgatcgaactatctgaccacgagcagcagtggcagtagtacagtgctagctgcaattcataaccactgaaatgaccttcaacttgaagttcaatcttatccacaagttcaatcaaaaggtatgccccctgtgctgcacaaacgacgaatctaacacttcacctcctggccaaatgtaggttcactaagaggatttgggcggaaatccagatatggacgcacatggacctccaaatgggcaaatgaaatgattgcccctcgatcgaacatcggtggaatctcgttgtcgagtccactaacaccctaagagtccctctgcaaacactactgatgctagtcacttgagagatctgggggatcggaatgcaaggatctttcgaagcacagcctcaaccccggcctcaattcttgcaaagatcaaagaagaaggtagagcttgggtcaaagcgggagcgactaggctataggagtttggaattttaggagatatcacctaacgagctttccttcttgcgggctggttttcttagattggccctgtatatactttgtataatttttacccactctattaatatataagccaaagcttttgccctcctttcaaaataaaaaaaatcttatccacaagctttcaaactagtactccctccgtttcaggttataagacgttttaactttggtcaaaatcaaactgttttaagtttgactaagtttatagaaaaaataataacattttcaacccaagacaaatttattatgaaaatgtattcaattattgatttaatgaaactaatttggtatttataaatatattcaattatttgtctataaatattataaactaatttgactatatttcacatccgcagataaaaaattaagtattcggataactacacaacttatctgttataataaagggtacagaaaatacctatttccgtagtagaggtcgtggaacatgtctcgtattcagtttctttaccttcttcaacacagtactgaacatactcagaaatgtgaataatagcatcagaaatttgatcatgttctgtacttcattcaaagcagttaagccaacaggttatgtggaaggcataacaggaagatcaagctctatataatcgttaggagttccagtttgttgacctcttttctcttgaggttcaacaaacttctgcccagatagcaccactcatccaatagatcaataagttcggtaaccagagtatgacaggctattgtttttttttttttgaaatagcaagttttgacttttgaagggagaaagagagagggtacctctccgttcaaatttccaacgtgtatgctgtcctcaacagatttttcatcgtcccctgcgttcccatctgcagctaagcatttaaggcattctgatcactacaaaacaacttatactagtgtacaggaaacgcttcttttgctgaagggcagcaaaataaaacgtattaactaatggacacccgaagtattattttatgttataaaagatagtcgatataggagaacgacgactaccctttccgatcgcttcagtcattgatcactcaagacatgccagatgacgacataggaacacatgatatttgttaacgagtttcagccgaaacctacatccccggggctctgattatgggcgctcctccccaaccaatatagctcctggacttactagatgggatattatttgccaacccgaaaaccagaatggtttggggtacttaatctaaaaattcaaaataaatgccttttgagtaagtggttgtataagttaataaacgagaatggtgtttggcaagacttattgaagagaaaatatctttataataagtttataactcaagttgataggaaacaatgtgattctcatttttggtcaggacttatgaaagtaaaaatactttcttaagtatgcgttcttggattgtgaataatagagaacaaataagattttgggaagataaatggttaggaaacttggtctttagaaataaatatccatctttatatgctattgttagaaggagaagttcttctattgctag

SEQ ID NO: 72673 - DNA, 3359 bp, Oryza sativa
ggggagggggcgtcgcctcaagtacctgtaccaacgcaacgggttccttccaccagcgcctgtgcgaaaaggagctgggggagtgggaggtctcctagctgagggacacgctctctcgcagggggacgacgctgacggaaaaggagacggccatcgctaggggcacgggctgaagcaccgcattggtgatgaccttagccttgtacactccacacacacacacaatgatacaaaacgatcacatctctttggactgggtgacggctacaccacaaaagtacaaagcttctccccaagatctcgtctcgactctctcgatccagcgctgtcacagtgtcacgccaagcaaaacagtgcattcgacgacgaaatgcacacggatacacgtgtcacatatggcttcacgctaaacactcggtcaaggtcaagcataaagcaagaacagtcagaggtctccaatgtccaatctccattttccaccggcatgatgcaacaagcagcagcagcagccgaagcacacggctccggtcacccggcggcgtccatggctgacgacgggaaggaggaagcagtctcggcggcgtggcacgggtcggttcgcgccgcggtggaggggccgacgccggaccaggcgtgggcgctgctcggggacttctgctccctccaccggtgggtaccctcggtgcagacgtgccgaagggtggagggcgccgagggccagcccgggtgcgtccgctactgtgccggcccggtgaacaaggcggcggaggctgtggccgggtggtccaaggagaggctggtcgagttcgacccagtcgcgcggcggtacagctacgaggtggtggagaccaacaaggggttcggccggtacgcggccacgctccgggtggagcccgacccggccgggtgcgccgtcgcgtggtcgttcgaggccgacccggtgcggggctggtcgctggaagggttcgtggggttcctcgacgagctcgcgcgcggcgtcgccaggaggctcgaggaggagatcatgtcgcggaattagccggatgccaggatgacgctcttgctttgaaagattgcgagctctcctttgctgctttcgctgtgttctatgcacgtcgcacatccatcaccatgaaatagcaagaaaaaactcgtgcgatgggtttgatctccgtgaaaacggaatcgtccatttcccatttccccttccaaagtgttgccttcctctcgccacggaacaactttgtccacagcaagtcaactccgtttcgtccataacatccacccagggccgttcatggccatgtgccaattgatcaaccgtataggctcctcaaaattaagggtcccgaaattcccacatttcaatacaaaccaccgtgttttaatatattttcgattgtagttattgtatttttcaaaagttccacttttcttaacctactggatatttgttttctttgggttcgataaatgttagataataattatggtaaccataaataaatatagtttataacaacgatacaacacgtactcacatacttaaaaaaaacatactcacatactaaatattttatttttttacttggtaaagaaaattaaataaccagatcagaaagcacttattttttcctaccgacgccacaaccattgacgtaatttattatttagctgcaaaatttgctctcttgtttttaatattttctaaatatagagtatcattttatgtttcgcattgggcccgaattactatgttagcccagcatcctccacttttaactactcgcagcctcacaaagaaagatacgagctcgctagtgcatttctgctattctgggcaaaccataatgggatacacacagaagttagttgaatttttttaatttttaattttatttattaaaatatttacaaaaataattttttgtttaaaagttttaccaatctacacccctaactgcaatgggccgcacgccaatcagaatcctatttcaggccaacgataattggccatacgttgatcagaatacatgccaatggactcatatagtcatgtttatctgtttatatataatggacataattatgcaagatagtgtacctgttggcccaatggtaaaaaggcttgtgtcacttataacatctcatatgctgctcatatctgttgaaaagccgagaagagcgcggccaaaacctatacattctaggttatcttcagatggcttagaatcgagaatcatcatggaaaaaaaaactgtctgatgtcattggtggagaaatattttttactcctggttggtaatctcctttagtcccgggttttcaaccggaagtaggaatccagaacttaagatacccatctttagtcccggttgaaataaccggactaaagatcccggttggtaataaggtgttactaaccggaactaaagagagggtagcggtagtccagatggtctcattttctcttttttttcttttttattttctcccagcagtcctaatggtccattttctttttttttcttttctttttttattttctcccgaatcgagtggcatgcatatcccaaatcaaaccccaaatccccaaatcaaagtaacatcccaaatccatatcacaaatcttaaagttacttataaacacaactcaaatacatcacaaatcctaaaaaattacacacaaatcaaatacatcacagattatacatctcagatccatacaatgaatcacaaaattatacatctcagtgaatcacaaaatatcaaaaaaaaagagaaaacaacgccggctgccggctgccgccgcctgcggccccgccgggaggaaaggggaggatcgatctgtgtgaggaagtggttgcgattgtggaggagaggataagtgctagggattatatactacgtgttgaattttagttccggttggtaaataccaaccaagagcaaagatctagatgatctaaagtggtgatgtttagtcccagttgatcctcggcccgctgacatgcctgtgacagggaatgaaccgggactaaagatcatagaatggctgtggggttttcaaccggggctaaagatcatttttagtcccggttcgtttttgaaactgggactattgtggttttgggtcgacccagcaaagatcagttctccagcagtgtgtaaatatctgagaatagtacttatgtatacatatatatcttgtattaatctatcttgttatttttttaaaaaaaaagttgataactgacttataagaaacgggagatatctcctcgatcgaatgataatatatatatatatatatatatatatatatatatatatatatatatatatatatatatatatat

SEQ ID NO: 72674 - DNA, 1545 bp, Oryza sativa
ttttttacataaaacttaaaagaaaacttgattgggaacaaagacgggattctgttgtgcattcttttagatgcgagaggttataagtgtataaaaataagcacttggattgtctatgccacgtgattccgtcaggttttttcatacatgcattttgggttgcacttagttttttttcccatttttcagatattagattgcacttattgtcgcctggaaagaagttggctaatgatctactacgctgcagagttagctgaacacgatgaaagatgattgaacttactactcatcaacatggtgccttgaacccttttgcccaagaacagctacagtggttacatgaaaagaaataaatctgcaaccttagtttcatgttacaactattgcaaaacatttattgaaatttacacatgaagaatggaaaaaatataatatgcgcatgcttaattacattccatgggcagtttcactcttgtgttctatatataaaagttgaaaaaaatactaataacatcctgacgaagggagggcccaagcatagttatatgaatatttgtgactaaacttgggtatttaaaggacaccgaaatgataaactttgcagtaatcattagtcatatgaacagacagattttcgtgtctcggtggaattgaaatgttgagaacttaatgcccacctaattaccatgtgtttggcttcaatgccttggcactgccacttttattactcatccttgctacagttaagtatactagctagctaggagactagagtgatgatatatagttatagaggggaaaatttgtaaagagtggaaataaaccaacaaccaatttactcgggaaaacacttctggtccaaaaatggttcaattttagttggtatagatatgatataaaagaaaatacgttgtgaatggtaggacacgggaagaagtatgttgttagggatgaaggggcactaatcgattggccattatcaccagtagcaaagcaacttgaagttacagtcagcacacaacaaacaatcagtcacgtatgtaccgcatgttggatctgtctggattatctgtgctgccttggtccttggagatgctacgaaatcatcgtcacatccgattggcagaacagaagatgaaggcccaacccaacaccacatctcaaaagctcagcaggataaacattggaatatcgaaatgttttaccctattacactggttgcttctaaaaaaaagtgtggaacatcagtttgtgttaaaactgttccaaaaacacttcatgaataggaagatgatcttgtgtgcataccttccttaaggcgtcaatgtttagttccatacataaaaaaattaaaaaaaatacacaaaacatccagatgaatggccttactaaagcatattttaaagacacgaaactgacaaactttggagtaatcgataatttcatatatatggacagctgtcagctagagaaatttttgtgtcttcttgaaattgatatgtttagaacttggtgcagaacgaattaataattaccatgtgt

SEQ ID NO: 72675 - DNA, 1760 bp, Oryza sativa
tcagttttatgtcagtgtacgatccgagaccacaaataaacgctagatctacacgatgggcaatgaagtgcaatccccaagccgtgaccagcgcaatcagcatgcttcacaaccagatccatgaacctcactgcatatctaaactctacagtgtaaatcaaagttagggtgcttacgttggggcagtacttggagatggcagtgcagaggcccttaacaatgccggcgttgatgttgaagaggtcgtccctggtcatgccgggcttcctcggcacaccggccgggatgattacgacgtccgaaccctccaacgcctccccgagctgctcctccccgacgaagcctttcacctgcggaggagcagaatccaaaacccagcatcgtcacacggctagatccagccaggagagggatgcaggcgggtgggtggagacgtaccagcgccggcgagttgatgtgggagacatcggcggcgacgccgggggttccggcgatatcgtagagggagagggacgagacgagcgggttgagcttcatgaggagcgcgagcggctggccgatcccgcccgccgccccgaggatggccaccttccgctcagcggccgcggcggcggaggagtagtcgcggcggcggagcgcctgcgcggcgtatctcagcagcgacggcctcatctcggcgttggattcgtgcgtgcttcggctcaggtgtgcgtgtgtgtgtcgcggcggtgggtgggagtgagagcggcggatttaatagaggagaggtggaaggggtggatgggatctagagagagagagagagagagaggattcgtcgggggtatcgacgtctccgcccgccgcgccgaggcgattttttttttctgttgctgtgactgtgtggttatctggccgaggccacttgcgcactagagttcgtagtgacgcgcactacactggctggacctgccgcctgcaccaacgatggatttggcttgtgcctttcggaaggtgatttcggtgcagtatcttttcttcgagagagagtgacttctggagtgttccagaaacgttgctactttattgtactcgtattcatcatcgatgacgatctctctttggtttgctgttctttttctgccaggactaatacggtgtactcctatgttgtttgagcaatgttggcaaagtttgaaatgaggtcgattaatgctgtttgatgatttaatcaatgtcggaaacgtttggaattgggattaattaagtgatcacttaatcctgatttcctgtccatgtgcctccaggttcgttccccatcaaagctcttaatcataacttcacgcccggttcgttctccctttggattttaattttttagagttgcagtaagatgatgctacattttctatcgagcatatggtaagttggtaactggaagagcttactcattttcagttcagctttaccaggtcgaatgaaatggtgtattttagttgagcatacggtatagtgagtaagttggtagaggagctgtactactatactgccatcatactcactatatcagtatatcgccaccaacgacaacgaggaccagcagtcaaatgtgtccttgtttaccgatacagggacaccggacacccaccagtcaccacccctgttctcaagaacagttgagcctagctttcatcacagatatacaaaacttaatgcgatgcgaacattacataatcttgggcggtcagcactcgcagttagggcagtgaagaagaatattg

SEQ ID NO: 72676 - DNA, 5658 bp, Oryza sativa
  unsure (1)..(5658): unsure at all n locations
tttcgtaaagcccatttcacggttctgcaacaatcttcattggtggctccttacattgaggagcacttggctctagttcgtgccagaaacatcggtaagtccgatgcatggattacacggcatcacattgatactttctccgcttggctgcgacaacatctcatgggtaacgagacgattaaccaacaaccagccttcctagcgaggggaccatctggctcgatcacgacaatccaaggatatgaaatcaatgggtacacattctacacgagagcctaagacctgaagagcacgaaccagaacagtcctgttcgtattgatgccatgggacacgatggtacaactggcacgtattatagtaccatcgaggacatatgggaacttgactatggacctctcaaggtccctctgttccggtgccaatgggttaggttgcctggtggaggcgtaacgattgatgacagtgggatgacaacggttgaccttaacaaggttggatactcggacgaaccttttgtccttgccaatgatgtaacgcaagttttttacgtcaaggacatgtctagcaaaggaaaaaggggcaaagggcctgacgagccgaagcaccacatggttctcccaagaaaaagaaaaatcgtcggagtagaggacaagactgacgaggattacgatcagtttgatgggcaaccccctttcacggtgacgattgaccctagcatcctcctatcaaatgacgacattccttactcacgtagcgatcacaagaaagaaacaatagtgaggagaaaatatgtgcggtcaaccgtcaccggcgatgtattgccgtaattgttgtgtacacgatgtaaactattttggatgtattgaatatccatacaaatcaattgttgtatggcatatgttaattatgtatgatcattacaatttttatcaaattgaaatcatctatatgctagttatatatgattattagaatttttaaaagttttaaatcatgcatgaggtatttacatatgtaattagaatttttaacaatttaatatcatgcatatgctaattatatatgattattagaatttttattaattttaaatcatgcatgtggtatttacatatgttaattagaatttttaacaatttaatatcatgcatatgctaattatatatgattattagaatttttaacaattttaaatcattcgtgtgcttattacatattatccacttagtttactacatacaacaataatttttcgaaggttttgtcattaatttttcgactttaaataattgtaatgcattatttactattttagaaacacatatgtaatgaaattcgaaattcagtgctattatctttagtcccagttcttaaccctaaccgggtttaaaaagaatttggaaatagcgggaagatatctttgctcccggatgttctcaccaaccgggactaaagatctaggggtataaatattcccggtacgtcctcgtcttctccaccaacacttagaagtttttcctccaatcgatctcggcttctccttcgccgccactgcctagggaaaccccgcaccaacgccgccatcatctctcaccgtcgtctcgcggtcctcgtcgcctccaccgccgacgcatctcttgggtgagagccgcgctgcctctctctctcgatctcgatctctctctctctcgaaaccgccgctgcctatagctcattgccgacgctgccgcacgcggccgaccccgaccccgactccgcctcccgccgattccgaccccgacttcgacgcggctgccaccgctgacgacataacgttcacgcaactgccacggcgacgatgcgacacgccctgccacgccgccttgagctcgncacgccgtcgcgccacaccgncgcgacgccacgccgccgccgcggnatgccgccgggtcgcccgacgccgncggaacgcgcgccccgacaccgccggacacgccaccaccgggccgccacgacgccgttccgcttcgcgccactgtcgcgcgccccgacattgccgaacgtgaacgaatgtgaacgaacgtgattgaaaacgtgacgaacacgaacgaacgtgaacgaaacgtgaacgaacacttaacgaacgtgaacaaaacgtgaacgaatgtgaacgaaacgtgaacgaacgcgaacgaacgtgaacgaaacgcgaacgaacgtgaatgcacttgtactaaaagtgtgagaacgaacgcgagcatatatgattattatacgattattaaacttagcatataatatgattatatatatatagttgaaaacgtgaaatacaatatatgttcctttgcatttagactaatacattttcctggtaatgttgtagagaagacgtcgtcgtcgtccctcaagctgaagttgtagctagccatcgaaggaattcgcgcaggcaagtgatgtaaagaagtgattgttagagatttaatataagattattagagttttaatataagattattagattattagcatatgtgagtgttagattattagacttagcatatgtgagtgttagagattcgtgatagacttagcatattgtattagacttagcaaatgtgagtgtcagagattattatattattagacttagcaaatgtgagggttagagattattagattattagattgttagacttagcatatatatattattattacaattttaatataagattagtagcgatttaatataagactgttagacttagcatatatgattattacaattttaatataagattagtagcgatttaatataagattgttagacttagcatatatgattattacaattttaatataagattagtagagatttaatataagattgttagacttagcatatatgattattacaattttaatataagattagtagagatttaatataaaattgttcgacttagcatacatgattattacaattttaatataagtttagtaaagatttaatataagatcgttagacttagcatatatgattattacaattttaatataagattactagcgatttaatataagattagtggagttttaatattacgcttagcaaatatgacaaatgacttaccaaatatttcttgtatgaacagatggctgatcgcgatgaggaacatatactgtacgatacaatcgcagagggaagcagccagtattggaacgaagaagaggggaacgaggatccaaaccagtacttgaacgaggagaggaacatggagagggatgcggaggggaactaggaggggaacgaggaggaggaggctagtggaagtcatccctccgctggacagaagagggcacgcggacaacgaggtgccatgaagaagatagagggtcggcacatcataactgaggtggacgaagacggccgaccaagtgccccggcagaagcagccaagaattttgtatgccacagcggttgggttgtgagggataacgtgcctgtcagcatggtgtactggcgcagaacaagggcacgagggggtaatgacagctttgtctcggaatcagagaaagagatgctgtggaccacaatgctcgagacgttcacgctccctgcgggtacggagaacatagtgaaacagtggactcttaagaaaatggctaaacagttccagagcttcaagggagatctctacaagaaatacatcctgaagggactaataccgaacttcgacgtattcccaaagctaagagattattgggacgagtttgttgcttagaagacagggcaacaagggcaagcgatgatggttagaaacaaagaaaatgccaccaagaagaagtaccatcaccacttggggtgaggcggctatagcatcgcaatgccgaagtgggaggagatggaggcaagattgattgagaggggtatcgaaccggccaccgctaaatggccggatcgatcgaagttctggtactatactcacggtggaacgcttaacccagttgatggctcccttgtcttcagcgatcagatacgagggaaaggcgtgattccctggaagattggattcaaggaggacatccacacgtacaggagtcggatgaggagcaagagagataccgaggtgaagattgcaaatcttcagaacagggtatcgagttacgagctcagcatgcaagaggaggtggcaaggaagatggatgaatgcatggccgcacatcggtcccaggatccccagccgtacattcctcctgcaatggtcagcccattaggcaatcatagtagttgcgcctcaacggggtaggtaggatcacagagcatggacgccatgcaaacccaggacgaaaccacttgccccgttgatgagatcacgcaacggacaccatgtgagctacatattcccttcaagaacttatcaatcaaggtatgctcatagttttatgatttttgacttgtacattccgcaagttgctgcttaggttgattactaatagataacctctcatcacatgaaggtggcgtcgggaatggccatcccaacgaacatttcagggacttaccactgcaggccgattccagcaggatactcgagggtcgaagttgaactggtggaagccgcgtacaaggacctcgagttggactacctaggaggagacggtgagacgcatctatgaaacacaagccatgccattatactatggcgcaagcggtacatcatcctccttgggcgacaagcgacgtctcgtgcaccatctcctctggctccgccatctcctcctgcaccatctcctccggttcctccgccaagtcctcctgcaaaatctcctccggctcatccgccacctcctcctgcaccatctcctccggctcctccgcctcctccacctccaccgtgtcctcctgcacctcccaagacaaggtctcgccaagctccaccgtctacccgcacaagggcaacgaagaaggcgaaagttgacgccaccaaaaacaaggagccgtcgtacgattacagttaagaggagcttgatgcttatgtggcaggagaagtgaagaggcaactcaagcctcggagtcctgaaaagaagatacctattgacccgagcgtgaagaacttcttcaagggaatgcccacaacaaataaggaggcgttaaagatatcggactatgaccgaacacttcagaaagcctatcacaagaagtccaaaccagtcccttagcttggagaacaaccaaaccaagaggtcaagccgttggtgaccggcgaagattttggcataacggtgtaactgtggatcagctgattggaggcacaccaatcccgaaggcggaagtagcatacaagtttgagctcggtaaaccgcttgtcacgcctgagcagcagcagtccctaccgacacagatgtacaaattccatgaatggtacatggaaatgagcgccaagggtagagagatgttcggagcgaggattagaaactccgacttcttgcaaggaggagatgttctctggatccatttcaaggatgtcttcgatctgtaccatctacacgccctcgtcgtctctcttctgagcgcatggatttcgtaagtatctttgagttcgatttgtttcgttcaataactagctccttgcatatatgtaaacaataataatttcattttttcgttgtag

SEQ ID NO: 72677 - DNA, 779 bp, Oryza sativa
accatacttctaagataaagattttagatattatttatagctaaagtttttaaagtttgaccatagccttgtccgagaagtattaacaactcggagagagtaataagttatggtacatgcaaatgatacttggtaagttgggcaatgagtagatcattgaaaatagaatgctttgtatggagtgatttaatactcttggtccctccttaaggacaggaaaatttctctttacaaattacaattctgcacatttctcatggaaaatgtatatagtaatatacttttgatgtttttgaacattttcccatggaaagttggttctttgaatataattgtagagcctgagttttcactagcagaaaaggctgtcagctcatcactacgccagttcacttcaatttccctactaaatcatactgaaccggcagtgtattactaggcagttcatggcttgaatgggcagagccatgtatcactgccggttcaagccatgaatctgcaatgagagggggaagtatcattgtaggttcatgacatgaacctacagtacagtttctccatgaatcggtaacacaaactatggtccggactagcgtatctattgagtgttgaaccagtagcgatactcaaataatagtttaataaaaaaataatatgtttatacaaagtaacatgaaaacaaactttatatcaaaattatagagctcaatgagatctaaaaccatgccattgacaatgtttcacgttagatcgttacataccccgatatatggtataaa

SEQ ID NO: 72678 - DNA, 4052 bp, Oryza sativa
tttttattcatgtggaaattgctacggccaccaaagcttgtgtaccaggaagattacagatctacgctacgtgcacacagaaagtacacctaggttttgcgtttttgcttggtttaccctaatttcttactagcaaattcatgattaattcccatggcaagtttgaagtatgatctaccgcttctggaccgagacacaagattctcactttggcaagtgaagatgcgagctgttcttgcacaacaagaccttgatgatgcgctttctagatttgacaagaggacacaggattggtccgtcaatgagaagaaaagggatcgtaaggctatgtcatatattcatcttcaactatctaacaatgttttgcaggagatgcttaaggaggagacagccgttgggctgtggttgaagctggaacagatatgcatgaccaaggatctgaccagtgagatgcacctgaagcaaaagttatttttgcacaacttgcaagatgatgagtccgtgatggatcatctctccactttcaaggaaagtgttgctgaccttgagtctatggaggtaaagtatgatgaagaggatttaggccttattttattgtgttcattgcctagctcatatgcaaacttcagggatactattcttaattgccgtgatactctaactttgaaaaaagtttatgatgctttgcatgccaaagaaaagatgaagatggtaccctctaaaggttcaaattcacaagcagaaagcttggatgttcggggcaggcaacaggagaagaacagaaagaaccaatcaagagataaaagctcaagtagctaccatgggagatcaaagtccagaggcaggtataagtcatgcaaatactgcaagagagatggacatgatatctctgagtgttggaagctacaggacaaagacaaaagaaccggaaagtatataccaaaaggtaaagccgcagttgttactgatgagaagtctgatgtagaattgcttgttgcttatgctggttgtgcacaaactagtgaccagtggattcttgatactacatgcacctatcacatgtgcccgaatagggattggtttgccacctatgaagctatccaaggtggtactgttttgatgggtgataatacaccatgcaaggtagcaggtattggaacagttcagatcaagatgtttgatggctgtatcagaacattgtcagatgtgcggcatattccaaatttgaagagaagtctcatatctttatgtactcttgatcgcaaagggtacaaatattccggtggagacggaattttgaaggtaactaaaggctctcttgttgtgatgaaagctgatattaaatctgccaacctgtactatctgcggggtacaactatattaggtaatgttgcagcagtttctgattcattatctaattccgatgctactaatctttggcatatgcgttttgggcatatgagcgaaaatggtttggcagaattgagcaagcgaggattgctagatggacaaagcatcgggaagctcaaattttgtgagctttgcatctttggcaagcataaaagggtgaagttcaacacatctacacatactgctgaaggtattcttgattatgtgcattctaatttatgggggcatgctcgtaagacatctttcgaggtgctcgttacatgatgactatcgttgatgattattagcgaaaagtttggccttatttcttgaagcacaaatatcaagcttttgatgtgtttaaagagtggaaaacaatggttggaaagacaaactgaaaggaaggtgaaaatccttcgtactgacaatgggatggagttatgttctaagatatttaaatcatattgcaagtctgaaggcattgtgcgtcattacaccgttcctcacacacctcacaaaacagcgtagctgagcgtatgaacaggataattatatcaaaggcccgttgtatgttgtctaatgcaggtttgcctaaacagttttgggcggaagccgtttccactgcttgttatcttatcaatcgatcacccagttatgccattgataagaagactccaattgaggtatggtctggttcccccgcaaattattcagacctaagagtatttggttgtactgcttatgctcatgttaataatggtaaattggagcctagagctattaagtgcatttttcttggttatccatctggtgtgaaaggctataagttatggtgtcttgaaactaaaaaggttgtgattagaagaaatgttgtcttccatgaatcagttatgttacatgacaaaccttctactaatgttcctgttgagagtcaggagaaagcaagtgtgcaggtggagcacttgattagttcagggcatgcaccagaaaaagaagatgttgctattaaccaagatgcacctgtttttgaagattcagattcttctactgttcagtagtctccaaaacgttctattgcaaaagattagcccaaaagaaatactaaacctcctcaaagatatattgaagaagcgaatatagttgcttatgctttgagtgtggcggaagaaattgaaggtaataccgaaccttctacatattctgaggctattgtttctgatgattgcaatagatggataactactatgcatgatgagatggagtcacttgaaatgaatcatacttgggaattgatgaagttaccaaaggagaagaaacctatccgttgcaagtggatcttcaaaagaaaggaaggtatatctccaagtgatgaggcaaggtacaaagcaaggttagttgctaaaggttatagccagattccaggtattgattttaatgatgtcttttcccctgttgtgaagcatagttcaattcgcactttactcagtattgttgcaatgcatgattatgaactagagtaaatggatgttaaaactgcatttttacatagggagttagaagaggacatttttatggagcaacctgaaggttttgttgttcctagaaaagagaacctagtctgtaggttgaagaaatctctttataggttaaagcagtcacctagacaatggtataagagatttgactctttcatgctttctcagaagtttagaagatccaattataatagctgtgtttatctcaaagttgttgatggttcagctatatatttgcttcgttatgtcgatgatatgttgattgctgcaaaagacaaatcagagatagcaaagttgaaggcacaattgagtagtgaatttgagatgaaggatttgggtgcagcgaagaaaattctcggtatggaaattactagagaaagacattctgtcaagttatatcttagttagaaaggttatatcgaaaaaagtttttcgtcatttcaatatgcatgatgcaaaaccagtgagtactcctttagctgcacatttcagattatcttcagatttatgaccaaagtcagattatgatgttgagtacatgtctagagttccatattcaagtgcagttggttcacttatgtatgccatggtatgttctcgtcctggcttatcatatgcattgagtgttgtcagtagatacatggctaatcctggcaaagagcattggaaagttgttcaatggttcagatacctacgtggtacatctagtgcttgtttgcagtttgggatatctacagatggacttgttggttatgtggattcagattttgctggagatttggataggagaagatcgcttacaggttatattttcactattggaggatgtgccgttagttggaaggcaagtttgcaagccactgttgccttatctactactgaagcagagtatatggctatttctgaagcttgtaaagaagctatttggcttagaggtttgtacactgagctttgtggagttacgtcttgtgttgatatattttgtaatagtcaaagtgcaatatgccttacaaaggatcagatgtttcatgagagaacaaagcatattgatgtgagatatcactttattcgaggtgtgattgctgaaggtgatgtcaaggtatgcaagagaagtacgtatgataaccc

SEQ ID NO: 72679 - DNA, 6792 bp, Oryza sativa
gggggttgaatagtaggaaaaactaaaaaccaaaaaacttttagcggaaataaaagttaccctcaaatcaacgaaaatctcgacagtcctgtcgtcgccggtcggaccgtttgcacgccaccgatctaaccgccgccttgtcgccggttgaaccgcctccctgccgcgagtgtgaccgctatactcgatgaaacacaaatcgaaaaactctcaaagtagatgacaactttattgcttctctttgtgtttacaaagtgcaataacagcactccttacaaaaatctcgactaaactcgaaaccctaactaaaccatcaactcaattgctctccaaaacgataccgggaagtcttacgctccctctttatttataccgtaaaaatctcctactcaaagtaggtgtagaactcctattcacaataggactcgatcaatcccttaatttcttttttctccaaaactgcagccgcaccgaagtcgaactcctcctgccgcgatgctgttgcttgctgcatgaagccgactcggcttgcctatgcatggatcaagccttgccatcgaccaggacaccatccatccaaaccaatctcagctccacatgtatatgcatgcatgctagccaaccagctgcacacagtacacatacacactacatactagcatgcatgcacgcatcgatcacacatacatgcatgtactgcatactactactccaaatttcctcaaccaatttcattcacgaacaccgacgcttgtcctcatacctcgtgaagcccgttgcggatatctctcccacacgatatccatccatcgtatgccatctcgtatccaacttcgtcacccggtatccttaaccgtctggacctcaactcctccctgagtctagtcccgatccccaccgttgaccaaagttgatcttcaagaatcctgactctagtcaccttctcacatggtatcccgaccgcactagacctctgttcctccctgaacatattccggtcctcaccattgaccaaggctgacctcaagtcacctgcacacaatcagataaaccaaccgtttctgggcacagatatcacaacctgacccacattagtcacacgcactcacaccaacatccacacaaaccaattcattgaataaatcatttgtaaagccaattgttcatcacaaatattaatcttgacaatgatttcagtatatacttaatttgtctaccggtcaatacaattctttctactgtagtgtgggagcgtataagcgtatagaaaaagcacgagtgatatttgtatgtccagttgctcctctcatgaaaatctaccggactagtgtcgtcaatcagttaccaaaataaccaaaattgtttgcctctacaacgagtttttttctgttttctattgttttgaaatataggaaggtacagtttgtatgtattgattgagatacagagagtaaaaaattagaagagaaagtgggcagagcctgtaggccagttgaaaagaaaaatatgttaccctacattaaaagaagtatcgattcacgcagtgtacataaatacatctcaaccaatgcccctctttatgctcccctaccaagaatgcccaattctgagcttgtttgtgcttgttgcctatgctgcaactagttttttgttgttgttgttttcttttgttttgaatgttaggaaggtacagtttgtatatgtattgatagagagatcacacagaaaaaaattacaagagagagtgggcagagcctgatggcctagttgaaaagaaaaatatgttactcttccctagtccctacattacatctcagtcaatccccaatttatcttcccctactaagaatacccaattctgaaacctctaatccattacaaacatgaaaggttcgtttttagtatatatagatagtagtacctccgttttaggttataagactttctagcattacccacattcatatatatgtgttagaaagtcttataacctgaaacggaggaagtagaaaagaaaatggattgtgaatgggaggacatgggaagaagtctgtcactatggattctttagctctagttccttcgccattagaaccatcaaccaaacagtctctagctacagtccgcaggtacacaacgtacaacgagcctccatttcacaattttttgatacacaacgtgctcttatgtctgtgaaagtatacgtgtataaaatgaagcactcagattgtcaatgccgcatggttccgtcaggttttaattccatacttattggattgcagtcagattgttttctttttttgaattttcctgattcggatttcacaacaagttattgtggattacccagtaagaagctggccaatgtgtacatacttcaaataccaagttttgtttcatgatctactacactgtaaatttatcagagcaagatgaagatgattgaagttagtaccgagaaacattgctgctttcaaacatttttttcctagaccactggttactttttaaaaaaatgtggaacctcagttttatgttacaactgttccaaaaccctgtgtgaaatttagacaaaaagaatgtgaaaatataagagtttagcaagaaaaagttggtatgtataaccttttcctatctgatatgcatatcttctatgaggtgccactgttgcgttccatatgaaaaagctaataaaaatacagaaaagattccaactcaagtagctacctagcgtgggggaaaaaatgttggaatggaaacatgatctagacacgattgatttgcttcaacagacaactgttcttttctatgccctgaccaggactcttcttcttccccatccagggagacagtcgatcagaattacacagcaaccatggattaattactacatttctgaagtgtaggtaggaattatgataggaatgggaggatccaggaaggaaaacgacagccaccggttattttggtgagccatcaagcttcttggttagaaatgatctaaagtttcaggggaaattcaaggaaccttcgcaggtgtgtcatgcggctgaggctatggtaactacttgtttgaaatactcaaatcactatacactgcatgctgatcatcaattggaagatcataacaagagaagggagcgaggaaaaaccaaatggtggcaggtgttacgttgatgcaggctgggagaatgaattaactcgagttggaatcttgcttcatataccttagagcaaggataataatacatttgacctgttagctataagtttttttagttttctcttagcctacacatataatagttagttctttacgattaataaagggctcacttgtctttctcacggagtttcttggttcttgtgtccaagccggctgtaagtttacagcccacttttcttctctctcctctcttttctcctacacctcagcatttagccggcttatagcctactattatacttgctcttatagaaagaagagatatttttggagaacgaaaataactaccatgtgcttgtcttcagtgcatttggcactgccattttttagtactcatcctgcaggcttcaattgaggagctagctaggagcctaggagtgttgatatatagctacgtgttggaaagttgtttggagtgcagataaaaagacagacattccaacttctgatgaaaacacaatccaatttcttcgagagaaagactatcgcatcccaatatgatgatttgcttcaacacacaactgttgtatataaaccctgaccagggcacttcttccacacacagaaaatcgatcacagcgtcaaattcttaacgcaatcacgctagaatcatgaatgaattaagtactattacatttctgaagtttgggtaggaatgggaggatacaggaaggaaaactgcactgcactggatttcagtactactctccaaaactagctatcctaggatgagtcaccaggtaattaaattaaatgagccatcaaacttctaggtgtgaccatgtgaactgttttgggcgtgttcggaggagattgttctggctgcacagcgcagcggctgcaacacgctcagtaaatttagtgctgcttgcactgttggtaactaggtacagacagcttcagccccagatgagcatgtttgtcttcaatgccaaagcacatactagatttttccggaagacccacatcctttgtacaattagtagttcgatgcaagcattttcaacaacttttttcccatcctgtactcaccatatgcgtgtcaaactctcaaggtttccccccagccagaactatgaaatatccgattaacttttattgcatgctgcattagaaatgtgaggatacaggaagagatttatagcacactggtgtatccctaacagtagcaatataattaacatgtcacaagtcacaactccatccttatagctccttttcatcagatgctcccacacagattgtccgatccagactgcagccgcgattgcaacttcgcatttaaaatggcagtaggagatttttaagtagctgtccatatccactgctccatcaatctataacaccccaaaaataaaaagaaatgacatatcggttttcagcttcagcttatagaaaaaaaaaagaagttgggggcagaaattaagggaaaaacaatttacatatggactagtacactaagcaatcgtaggccgaggccctactaaggccctgtttgtttcagcttaagattgttgtaatctagattattaaatcagattactataagctggattatgataagctggcataaaataatctacgagttgtttgtttctctggattattagaggcatctaagggtagtgggtctttagccacttaataatctgaaaaaagctcctctagagaagattattggattatagtaatctcgtttatagattataataatctagcataataatctacttgtttgtttcagcttactcctaataatacagattataataatcctaagctgaatcaaatagggtcttagttgcatctccacctacaactttagaggtcaaccaaatcgtgcctcctcccctagatctcctacaccacagcgttactcaagagagaaggcggtagaaaggaaacaaggaggaagaggattgttgctcttgttataccagttgtttgagagcattttgatggtttaattcgtggttaaggatgcatacatataataagcggtttggtcgttctgattcggattgagttctgcgcacaagcagacttatatagttcctctgttattttttttatgattaggtggtcaaaacgattttcattttcaaaaaaaaaacatataactagaaaccttgttgatatcatcgaggccgagccattagtaaagtcatagttgttttagtttttttttcttaatatacagatagaccctagcgtttgtaaaaacctagctatttcaagtactgcgaattagggaatctaaatggcataataataatgtggtctctacatgaatgttataggtcttgtacggtagatttcaaatatgttaaggtctcttaggttatgtacatttaaaaattttgacaatttgaccctttgcaaaaactatttttacaaataaaccgctgccaaaacttatttcaaatctgacccttttgctcaacgccaaatcatatggcgctgaacttagacacctcaacgccaaatagcatggtggacaaaccatctttcgtcggtcggccgaattccacaatagtcccggatgcaataaaaaccggggctaaagatgatctttagtcccggttaaaaagggtaatgggcatatttgatctttagtcccggtttgtatcatctttagtcccggttcaaatgctgtcagggcctgtcaggccccctaggatctttagggactaaagatcgtaactttagtctaccaaccgggactaaagatctcggggatctttagccccggttggtaacaccaaccgggactaaagtcccacccctatatatatgtcttcttcctcctccagctgcccgagcaagcttcaaaatttcttcaaaaaagaggggaggtcatgccaaaatttctagtgaatttattttggtgaatacatacaaatctgaggtgcctaaaaggtttgcaacttcatcctccaatgttttttttttgtcatattacatttgcagctatgttttgcagacttttttgtctccaaaatttagttgtaagttgatgagggagaaaatttgtgtggggaagaaagaatatatagaaatttagttgatttgctaaagaaggttttataaaatagttgagagggaaaactatagtgaaagttaatcttgaatactagaaaacaaactaaaatgaaaattaaaagaagtaaaacacattaaaattagtttaaaactttagaaatagtaaataataattatttgctgtaatattttatgatttttgtatgaataaagatatgtcattattgtatgactgttgaaacagtttgtaattatcttataattattgtatgactgtcattgttgtaagaataattatttttgtacgattttttttgactcatgtagatggatcagcaatggatgtacgctgaccggtggtccaaagagtttattgacggcgtgcactattttttgagagtggccgaagctaacaggcaaaggggttttatttgttgtccatgtaataagtgtaagaatcagaaggagtattttgcatccagaactattcatttccacttgtttgagtcggggttcatgctaag

SEQ ID NO: 72680 - DNA, 912 bp, Oryza sativa
aactacgacaagtagcgtatcatattcctcaacaattttctctcgttcccatgatcaaccctgggaactttacgattatgcttcaatccaaaatggcccatttataatactccctccgtttctaaatgtttgacaccattgagtttttagcacatgtttaaccattcgtcttattcaaaaacttttgtgaaatatgtaaaactatatgtatacatataagtatatttaccaatgaatcaaatgatagaaaaataattaataattaattaatttttttgaataagataaacggtcaaacatatttaaaaaattcaacggcgtcaaatatttaaaaacatagggagtatatgtaggatcgtaaagggcctttcccaccccaaaagctagccattgaggtgacaggcttccccagttatatcttagctcatttgccctttcacaaccaaaagctattcaacaatctcccccttcacacattggtgtccctcggcccttcaccaccccttcaccgtgtatagaccccacagaacaggcccacggtccatcaggtatacgagccccgcagacacccacggtccatcagaccttcacactctgtgtccatcgggctagagatgttaacctagccaggctctgaaccacttgtaggatcgaacacaagcaaccaagcctaccagaggggggttgaatagtaggaaaaactaaaaaccaaaaaacttttagcggaaataaaagttaccctcaaatcaacgaaaatctcgacagtcctgtcgtcgccggtcggaccgtttgcacgccaccgatctaaccgccgccttgtcgccggttgaaccgcctccctgccgcgagtgtgaccgctatactcgatgaaacacaaatcgaaaaactctcaaagtagatgacaactttatt

SEQ ID NO: 72681 - DNA, 936 bp, Oryza sativa
gatcccctaattattttccattgttaaatatacttttatgtatacatatagttttacatatttcataaaagtttttaaataagacgaatagtcaaacatgtttacaaaaatcaacggcgtcaaacatttagggaaggagggagtaccacgcattcaataaactacatttttgcgatgtccgtcaaccaatcacatgatttttacttgtcatgtagtgaatatgccgtgttattattgtccaaaacaacgagaattattataaaaccggtgggagtatccaaacttatttttcagagtgtaacagccctatatgcttattacaagctcaactggctatcgacaacatgtcacgatagccattattagttcagtgtgcaagccgttcgtccgcaagctcgtgcagccccaccggcgaacacgcgaggatgacgcgtcccaacgcctccgcttcggccaccaccggcgcgcacgcaacccacgcccaccgctccacgccgccgccctccaccccgccccgccggagctcgtagaggacggcgcccgtcgccggcacggccgcattgtacacgtacccaccggcggtgttgccgcacaccccgatcgacggcgacgacgtctcctcctcgccgtcgtcgccgtgcgggaacagcctctcggacatctcgctcggcatcgtgtcgtgcgccgccgccgcgccatgggacagggagaggctgtcgccgtccacctcccatgatcggatgacgactcggctgtctgcatgcttcactccgaacaggatgatcttctcggcgccggcgcggccggcggcgaggccccatgtggagacggtggcgtcagggcggaggcgggaggtgggtccccactgctgcttcgccgggtcgaaccagctcgccgtccccgtggctctgtccgcgacgtacactctctgatccg

SEQ ID NO: 72682 - DNA, 1684 bp, Oryza sativa
agtcagctagacatgcttggttggacgtcttgttttggcgactttgctaccaaaccaagtacactcacctttttatctcaaaaacaaacaagtacactcattttgatgagtcttggcgtacgattcctagatagccctccctttccctttattttctctaaatggttttccttctttttgtgagttctcgtgttctttatcgagaatatttttcttcttttattcagatctttttatatcctttctttttgtgagggtttgtactttctttcctgaatatttgttccgttttctttttcttatttttgtggggacttgtgtggactttcttttaattatttcataatttttacgaggacttgtttggtctttccacctagttctgtcagcgttactttgatcattttttttcttgattttatttgtctggatctaaattttctcccgccacctcataccaccatatcttgctctaattgtttgacttaaggctaataagacgtgacaaaatataaataaaagaataaaaaatattttatgaatggaaattttatactttgttttttaaaatatggcgttccttaacttttcggtatatgtttgaagataaaaattgtaagtcatgctcactttaatgaaaatcaattcacaactgtcggatcgcacaaaaagaactaagctaaccagagggagcttgaatggttggagtagcaaaaattgtaacttttaacggaattaaaagtaacctttgttttgatggagatcggtttgaccggaatagatacgccggtctgaccgatgtagtagcttcgatctaaccgtccgatattgctatcgtcgcctgtcgccgcaaccgttctgaccgccgtggagtcgtcggtttgactgccgatgttccgcgggttagaaaactgcacctaggaaaataaaaatccaggatctctctttattacttttattcatgtttacaaaacacaacaacataaacacctgaaaccttaacttttctctaaactcaactcttacaaaattgatattggaaggtttcaactcctctaattatacccaaggtagatagcctaaagccacgaaccagcggcggattcatcgttggggctccacccccagttccagccggccatatatagcccatatgtaacaagtatctatccgcatccatccagtacgtgctctagtgagtcatcacgtagctggttagctagggaagcactactgcctgcctttggtcatatatatttatctaactggttgctttattgaaagtgcaaccaaataaaaaatgaaaaaaaagaacatggaaccatttttcatatatatatttacagccaactatagctatcatacctagtatatttttattctttattttgagttctttctcgtacaaatcagaaatttgattcacaatagattggttgtgcccctccgtcccataaaaaaccaattctaagtacgaatctgaatacacgcgtgtccagatttgttgtcaggattggtctttttagatggagtagtatagtttactagctttaggccctattgtttgagatttagagttttattttggtattttttgtgggcgtgcttgtcaaaccgctaaactttctgatttttcaaaacagatcttataaagaagtttcatcaaaaatcaaattttaaagtt

SEQ ID NO: 72683 - DNA, 1550 bp, Oryza sativa
acaaatcagaaatttgattcccaatagatttggttgtgcccctccgtcccataaaaaaccaattctaagtacgaatctgaatacacgcgtgtccagatttgttgtcaggattggtctttttagatggagtagtatagtttactagctttaggccctattgtttgagatttagagttttattttggtattttttgtgggcgtgcttgtcaaaccgctaaactttctgatttttcaaaacagatcttataaagaagtttcatcaaaaatcaaattttaaagtttataatagtcagcgcttaagtaatcatacgttaatagcttgtctgataagctagacgactgctctcccgaaactctcatttgaacaaagcaccccctctattttcatcctagattcgccactgccacgaacccaactttccgtacagtaaacaaattttacaaactccaatcacaccaaatttggacttaccaaatttgactccgcatccatacgcacacaatatctccatcgtatgccgtatggaatcttcaccaaccacgaggattgatttgtagtctaagcatcctgcaagatatcctaatcgtcagaatgttatcttctcccaagttgactcacgatccatcacaagcaacggtcccccgaaacatcaagacacacctacacatgaatgatacaagaaaccatattcgagcataaattgtctccaacttgactcagcattatcacaacaatattacatacgtataaaaatcatctagaagtcatagacatgaattaattacgagtatccaaataaacaacttaaacagaaaccaacatagagccgcccgaacaaactgttgggtcggttggtctaatggagtctgacgagcctagcctatccggtttgaccggtcacatatatagtcaacaacccacttcactaattgtctccaaatatcaaaacccaaatatgtcaaatgccaatcgttaatcacaaagtaataatcaatcacactttattttacaacaacaaaaaaaattcatttaaggatctttgagcatgacttataatcttttatgtttgcagaaaaattttgaataacacgtataatcaaacatattttaaaaagtcaatggcatcatatattgaaaaggaggtagtatatgtttaagtatcaatgctacaaaataaattatgatgcaaaaaaaaatcctaaaactaggtttcagtatttaaattttaaacattaagagggaaggaacagtggtatggtggtagagtcaatgacatcatatattgaaaaggaggtagtatatgtttaagtatcaatgctacaaaataaattatgatgcaaaaataatcctaaaactaggtttcagtatttaaattttaagcattaagagggaaggaacagtggtatggtggtagagttctatgtacatgattccacccaccttagtttatattcttgtgtccataaatattatgtatatgtagatgaggaattttactgtcattgagagttatatttcaagcacaacaaaagttttgagtgcaaatttt

SEQ ID NO: 72684 - DNA, 1237 bp, Oryza sativa
ttgcgatcattactcggcattccggttattatagcagaaggtgtcaaccgtgatcatggacacattgaggacgaatggctatttatgcgtgtatggatcctactcctccaatagtatgtggtggtcgcgttggacactggatggtataatactcggggtgtccacaatacctgcctataaaagaaggagctcactctcatttccaacacacaactttgagctgaattacaagaggctctattgtatcttttgtatattagaataaggtagagagtgaggggaagctctggaggagtgcccggaagtttggcgctcatccgacttctatctcgacgagtgtagctttctaggaggaattcgggaggagtaccagagctgtcggtacactctgctccgggttcggagaactccttctataaaataagcattcatattcatttcttatgttatttaattatttagtctgagtaagatatatttccatctttgcgggttcattgtttagtattcatactaagtgctctagtactagaattccagatagagaaggaagttcctacgcaagtattagagtagtaattaataacttagacgtggtgtataggttagagattacctttgtttgttgtgtatcccacggatttgtcagaggtaggcggcaggtggtgacagccctgaattctgtcccagtaatcctccacgttcggatacatcatagagctatagctggaataacgctggcataccagcaggggtcggtgcccgaagcgacagataggaaattacctttgcttagcgtagataattaacactcatagaaagtcctctctagcctgcctaccatcagttgttgtccttggatagtcttagccttaggtagattacacacgttccctgagttcgatatcctttatgggtcacccgaaggtgaagtgctacagcggtattccgtgcgcttgcggatttatccgtggtcgtaagaaataccaacatagagtatatggtagttagagtcatattaggatatgattgatttgtgtggactccttctatatttgtaatccttccttatctcttcccatgtactactatatatatcggcctctgaagctcaatataacacgtgcaatattcgcattatttctctcatctactattcaacatcaggtagcttggaatgaatgccataggatcctatacatcaccactacaccatccatcagccccagatagtatc

SEQ ID NO: 72685 - DNA, 2788 bp, Oryza sativa
aaaaaatgatttacctcagaagttaaggatatgccagtattttcggtctgtttaaacatgtgttagagacacgttcgtaatgacgtgagcgtgatgttaggtgcatgtacaatgctgtttgtgcacacctgccatatttaatcgaaaataacttatgatgacgatgagaggcacacgacctcatgccgctggtgctcctcccaatccccatcgtctccaacgccaccatatcccactcaacacgatcgccccgcctgcaacccaatcacacccacctccgtcttcctcttcccgccatttccaattcgagctcgcttcctcttccagccatttccagttctggggcggccactgcggccaccgttggtggcgcatcgagccgacgtacgcaaaagtccgcgcgcaatggccccgcgctgggcgcctgatgagttcacgacgcgacggcgacggcgacggcgagccccgaacaggagctgtccgcgtttgttgcctgcgatctcttgcgatcttgggaagatgataacgtcgtcttcttcgccataatgcggacaatctaaaagagaggcgagtttggcagatgggacgacacgagagaattgaagagaagggggaaaaattacacagaaggacccgtcgaatcagataaggtgatcgccactgacctgtggccaatagggtgtcgccacacactactacgagctatcaatgtcagataattgatagatactactccgtcccaatatgctttaatgcatcaccaatagcatcttcaaatttcacactctaaatatctatttcacaaacttgctagagaaactagagagcctaatttatctttaatttgcttacaccacacagatggattttcaaccccttgagggtgcgttctgttgtttcgtgcatgctacttgaataatcatatttttttaaaaaaacaaaaataaataatataagatatatcacttcataaatatgcactgttaaattcgacttctatgagtaataacaaaaataatcaattaaaccgaaactagctagttaacatatctccatacactaccactgaaaaggtcattggtgccggttgggaacgctacaaagatgacgatttttcaaaccgacgccaccaaggcggcactgattagaatactaatagatatacgaattgaaaaaaaaaatccaggtcgggtcaatttgagccgagcggatgcatcaaaggaaccaaaaaacatccaaaaatctacaacaatcaacaatcaacaacaacaacacatcagcagcacacaatcaacaatatgtccgcccaatctggcggaggggaacccgatgctgtcgcccatgggagcccgccgccgccgcccgctgctgcccccgcttgagagagagagagagagacgcgtcagaggaggagagggggggggggcgagtggataaagacgccacctcacctcccactcagcgttttatccccgtccaaaaaaaagaaaaaaaaagcccgtttcttggctcggctcgtttgataggttgtcggtttttctaaaaaaactggtacctttaatacactatagatgtcagtttttaattaaataacagctataatatataagatatcggcacctatagtgtaggtggcggttcttctgtaaaaccgacatctatagtgtattaaaggtaccggttttactttttttttcatcttttgaagggggaaaagcactatggatgtcagttttatctgttctggcacctatagcaccgacttatatgtggtagttatatttgttacaacgagtgaaaatcaaatttaatctaaacttgcgaagcagtttgctcgctgcaccgaagatcgctacgaagtttgctttctggtggagtttcatgcttctcagtggaatatttgctgcagtagaaaaggccttgaggtcatctcattgtatgtctaaaaaaacaaattcacactcctaattttcatgtagaaatagcgattgaagccagaggcttcaggaagaaaaaccacactggatcaaacactgggtcaagtatatctattggtggaagaaaatcctgttgaacgacaacacctacacgcactggatgaatagggtactgcaatacgtaccacacccagttgtacaactagagatatgcaatcatagatcaattaaagaaaagaatattcatatgaactatagtcgtttataaccgttgatcaaatttccgtacatgagtcgaacagttggattgtatgcatggtgatttccggatgaataatatctctagtagctcagatgggaacattagcccttgtttcaaacaataggaaggaatgaatatatcgttacttgttctatgaaactagttgacatgcaactgctattagctagttggcctccatttaaatttgacaatccaccgcgctctctcaggaaaatgctcatgcatgttttgtctattgtccaagcttgaaaatgtgtataatttcattttgaaaaactagtagacatccgcattataggcccatttcctgggccatttaggttttggcctatgtggcccatgagagttttgtgtgtatggttaataccacatttctaatttatattggcaaggttgtaaccaatttataagagctaatactttcatacgaagcgaggacaaaagtataagtgtagtgatatgtgtaaatgggtctgtccatcggatgggctgggctgcacagttttggaaggcattttttacataaaatggacaattttcgatacacgccaacctcatcaacctaaac

SEQ ID NO: 72686 - DNA, 3630 bp, Oryza sativa
aaagttaacggctactccatccatctcctgaccaagttggagtcggagtgcactcggccaccgtccgatgtggcccatttccaagtcggagaccgccttccagccgtccgatcgaccgaagccctataaatcgagtcatccagcgaggcctcctcttccgccgccatccacgctccctttccgaatcttcccacccaaatcctcttctcccatctgctctcctctgcttctccccatcatgccggctccacccatggcgcccgcggtggcgagccgcaagcgcgttgcggccgacgatccggagccccgctcctgctgcggatcctcccaggcgagcgggccgaagcggcggcggtacaacttcgggagcgccgacgactacgagcgcctcgacgtggtcggccagggcgcgttcggcgtggtggtcagggcgcgggatcgccgcaccggcaaggtcgtcgcgctcaagcggctcatcggggcggacgagggcggccgcttcgcccccaacttcgacgcgctcagggtggaggccgcctgtcagcacgcctgccgcggccaccccaacatcgtccagatcaaggacgtcgtcgccgacgccaagacaggtgacctcttcctcgtcctcgagttcgtcggaggcagcctccgggatgagttccccagggcccgcccggaggacatcgtccgcgccatgatgcggccgctcgtcgacgccgccaagaagatgcatgcctcgcgcgtcatccatcgagacatcaagccggagaacatccttgtcagcttctccggggagctcaagatctgtgacttcggggccgccacgctgatgaagcccgccgggaagccgtacgacctgtgccgccccggcacgctgccgtacacctcgccagagcagctcgccggcaaccgatgctacggccccgcggtggacatgtgggcgttggggtgcatcatgggcgagctcctcaccggcgcgccactgttcggaggcgacatgacggagaaagagctgctcgccgacctgtccgccaacctgggtgaccagctcaacgagctcttctatgacgtcctgccagagctgtcgccggcggcgcgcgaggtcctgtccgggctgctggcgttcgacccagagaagaggatgacggcggtggaggcgctggagcaccggtggttcgccgatgagcccaagaaagcagagttccctggcttcgtgcctctcttcggttagtctgtcagtgcagagtgttagtttcagattgtcagtctgcatgtaacttagaactgttagtctgcagtcttgtctttaaattagaactgatgattaggactgatgattgcattagcaaattggcattgcaatcagtgtaatcttattattccgattattcatctgtaagcataattatgtaaatcctattcaatttgtagaaagcaattcttatgtaaatcctattcaatttgtacaaagcaattcaaggccctatttgttcaataaaattatcagacatttttcagcttgatgagtcctgcttcatgagtgcttgtttgttaatcatcaggaaaagggaatagttttgtagtatgtgttgtatcttcagtacataccaggaataacaaaaacagagtcatctgtacaccttattgtcagtctgtaacttagcaatactggtagtattgtcttaggactgataatttcattagggcaatagcgcattggcaccggaatcagtgtaatcttctttttattattattcattgtaactttgtaagcataattgtgtaatcatattcatgttcagaaaacaaattgcagatagcaattcaaggccatctttgtttcagaaatcatcagctaattgagccctgcaacatgattgcttgtttgttaatttgtggattctgtgcttgactgaaagcatataccaggaaaaagaaaaacagagtgatctcaaaaaagaaaaaggaaaagtaaaaatagaagagagaggcgattaaggagagaggagattaatgttttctgacatataagcatccagagagagagctttgcaaagcgcacacaccgtgtcatctatgccaaaggagtatttaggttgtttcataaatagattcatttgctggaatcatttatgccaaaggagtatttaggttatttcagacaatagattcatttgtcggaatctgaatttttgtctgaaaaaattgagtaaagaggctctgtacactttcattcatcatacctggagcttttgtttaacaaaaaagaggggaaaagttatagtttttggtttggactcactctcagtaagtgacaacttggatttcctcaactatcggttcttgctggggtgcagtagtatattcctaaatgattcatgccttattttgcaatacctagaatcatatcaggacaacttttttttgtaggactgaacaccatcaacttcttcagatgacatggactgatgcattatgaaaaggaataggaacttccatcttgaatataacaagtgtagttcaaccaattatatttttagtttttgcctacagatacaccttagtatattggtctggcagcttggtatgcatggccactgcccacaggatcctgcacaccacctggtctgtctgtcaatttttaatttatcaatattgcattaagccattagcacattggcactgcaaccactgtaatcttattcttcagattattcattgtaagcatatttatataatcttattcatgttcaggaaattttggtgaagcaattcaagtccatcttttttttctcttcatacttccttatataattcctacatatataactgcagaaagaacagagtaatgtctggtgctgattttaaataaaaaaaaagcttgtcgaagaaacatctctatacccagtttgatatttctgataaaccaatcagtcgcaatgatcactgaagtttttgaaatttgtgaccaacctgatcatcgcttatgtgaacattgcagtgcagtcatttcagtataagccaaacacatgcagtgactaataaaacaaatacatatagcctgtcgatttatcataatctcacgcaaccctgcagtgcttaataaaaatggggatctttctaaatatttttgtggtctggcaatatgttgcaaaataatatcccgaaaaacataatgctgtaaaaaacagaaaatctgaaggaaaaaaaaaatctagcgtccactcccacgccgattctgaaggtggtgaggtgtactgtggaagcagcaaccacttctttctgaagaataagaataacaatttggatttttttttgacgcaaatggtagagagactctaccttataaccattgtattaatagcagtcaaagactgacaaagccaagaaatggcaaagaagagtacattcaggaaaggagaatcaagataaaagaaggaaaaagaaggggcaagaattgccaaaggtgaaaagagcaggaattaaaacaagaaatttaaaacatgaaaatcttaaaaaaaaaacttagaacaaaagaggagctgaggagctgaatagtaaacggaagtgaaaacacttcagagtatcttagctaagcttgtctgcccaagcgttgatatgcacgcgaag

SEQ ID NO: 72687 - DNA, 17339 bp, Oryza sativa
gacgagatgcataggcaaccaccttcccatcttgcatcaaaacacaacctaacccaagtttggatgcatcgcaatacacctggaaacccttctttggatcaggcaaaatcaaaataggagctgatatcaagcgattcttcaactcttgaaaactctgctcacattcttctgaccacttgtacttcacatctttctgaaacagtcgtgtcatgggcttagcaatcttggaaaaattctctataaacttccgataatatcctgcgaggcctaggaaactgcggatctctgaaactgtctttggttgtttccagttggttacggattccacattactaggatcgacggcaactcctcctgctgagatgacgtgaccaaggaactttacttcagacaaccagaattcacacttgctgaacttggcatacaattgatgttctcgtagcttctccaatgcaaggcgaagatgttcttcatgctcttctttggtcttagagtagataagaatgtcatcaataaagaccaccacgaacttgtctagatattccataaacaccttattcatcaagttcatgaagaaagcgggggcattggtaagtccaaaagacataacagtacattcgaacaacccgtacctagtggtaaaagctgtcttaggtatatcttcctctttgattctcaactggtgataccctgatcgaagatctatcttggagaaaacggtggcacctttaagctgatcaaacaaatcatcaattctgggtagcgggtacttattcttgatagtcacatcatttaatgcacgatagtccacacacatcctctgggtatggtctttcttttccacaaaaataaccggagctccccatggtgatgaactcggtctgatgtatcctttctgaagcaaatcatctacttgcctcttaacttctgccaactcattggctgccattctataaggtctcttatggatcggagttgttccaggtaccaaatcttttctgaactctatatcccttttaggtggcataccaggtaaatcatctgggaacacatcaggatacccccggactataggaatctcttccaaagttatctggttcagtcttgaccttaaaaactcagaagacaatgcatgaacagtcacaactcgaccatcattgctggtgagagttacttttctgttagcacagtctatcacacctttatgtctggctaaccagtccatccctagaatgacgtcaaggtctttggattctaacaatataagattggccagaaatggtaccccttgaatttctattctgacagaggggctacgttgcaaagagagtgcttgattacttggggtactaaccatcaaaggacatctaagatcttctacttccatcccatgatttcccgcaaaactcatagataagaatgaatgtgtagcaccagaatcgaaaagcactgttgcaggaactgagttaacaaggaacgtacccaaaatcacatctggagcatcttgagcttctgcagctgcaacatgattgacacgggcctttgatgctggtacagcagagttgctctgggcagggacaaccttcacgtgtcggggctttggacacttgtcagcataatgtcctgggtctccacagttgaaacataccacaggcttgctgccttgctccctcttggcaggttgttgctgtgtcgaagctgcaacaggacgtggagcttgattacggatgttgttgccagcattgttgttgaagaactgatgctgcggacgaacaacagacgaagaacctccatgtggcatagactggggtcctaaagtaagacgcggcttctgattattcccctgttgtgccttgaagtgagcaatccggcgtttcttctgctccatgcgattgtacttgtcctcctgatgaatagccttatccactaatttctggaaatcagaataatcttcagtcatgagtgggtaagaaagctcatcattaagtccttccaagaacttctcctgacgctcttcatcattgcgtacatcttccggagcataacgggcaagacgattgaattcgtgcaaatactccgtaacagagcgagatccttgagtgagtgacctgaattccttcttcttgagagacaccactcccgatggtatatgcgtcttccggaaagcagcggtgaattcaagccaagtgataggttcagcagtagtcctattcaggcggaagtgatcccaccattcagaggcagggccatgcaactggtgtgatgcaaatgagaccttctcctgatcagtgcactgaagcaaatccaacttcttctctatggcatgcaaccaatcaccagcttcaacaggattagtggtactagagaaaacaggcggccttacacgaagaaattctgctaacttattctgagggggtgcatggttatttccttggttctgctggttctgaagttgctgcatcatcatgttcataagctgagtctgttgagcaagaacttgagcaagggttggattctctccattgttattgttattggggttgttgagattgggaccattcctgttgctgcgagtgttcaccatctggcatggatagggcacaagaagagaaaccgggggaaaactacttaggacagagaattactttaacttttattgatcttaactgagtttcattattacaaactgaagactctcacaccactaaactcaccaacttcctaacactcaaaaagcaaacaaacgcatgtacttatatcccaccactgatgtaaatcacatgcaagacccacacacacacaagcaagcttaaaagaagcaaactaacacaacgatctaagacaacgacttaacaagttactcttgttcttccgagcatcgaaggtcgattgaaggctcgttcggctcgtcttcatcatcttgagttgctacccactcaatcttggaatggttgcgcttggattcttcttcttcatcactacttatgatgatgatcggaggatctgctggggcaacttctttctccaccacacggacctttggcgccaattgatagcgagggacaaatagagctctcttccttgcggtaagacgaatcctggccttctgcggtggtgcttctcccttcaatgcggctaattccttctccaaacgatccaccttgtcttctaacttgcaaatcttaccacgattccgatcttcacgatcttgagctgctaacacagtctctgcacgactttcatccatggcccacagcatctcaaccaaatgccttgtggtagcatcattctcaattccttcagtctccacggtcacttccctggggttggcgaggatggtagcgatactcagtgtcggccaactgatcactgtagcgatcacggagctctcctatggcgatccttgccacctcctgacatgcatggatgtagtttcttcctccagcttcgaacatcactgagggaatatcttcactattactgttcaaggtgactttgactcggcacttctcttcatgacgatcatgacgaatctgggcataaaaagggacagtcccaaatccaatgacaaaggacatcgtacgcaactcctggacaaaaccctcaacaccaaaaagatactcaggcttgtagcgcggcatctaaagacaagtgaaaggagggagttaagacatttatccaattaatagcacaagcttttggattaatttgaataaagtttagaaaatcaaagtaaaaggtaagtaaaataaagtaaaccaagcttgcaagataagttgaaacagttgaaaacgaggtcacaagttttgtatttttgaataacaggtttcaaaagaaatgaaatcaagttataaaatcaacttgctaaatttattttattgcagcaagattaaataaaacaacattgtaaaacttttgctagtaaaatgagccattagtacagtaatagatgtacagtactaataacactggaataaattttgaatgagaaccattaaaagagattatgaagtgcatgtgccattagtttggtttaattaaaagagaaagggaggagaacagttctacttttccagtatttttagagggcttctatgggtaaccatttggcataacctagggtcaagggggctctgataccaacttgtcacgcccggaatttctatccaaaattccaaacgcttacatgtgtgtaaaccctcgtccaggaatcagccgaggcacacaataacaaattgataatagagtacaattattactctaattaataagcgaataaaatgttattacagaggtagatagttcctctcaatcaataaaaatctaagcagcggaaaataaaaacggcgcggacgactccactccacaggcagcttgaccaaggctacacctaatcctccactccatcagcctcatagtagaactcttcctctgatgaatgattgcaaggtgagtatatgacatactcagcaagccacgcagcaaatatgcaaatgcacaggataacaaaggatggcataatagggctccatttgcaaaagcagcatttagcaaacatttggaaatttaaaacagttaagtattaattaagcaatattaatccaacgctatacaacataccctgttgtataagcccaaccattctggacaaccatcccggctgtacagttctatctccaaaccaggaatataccattccaaaccaggagctaatcaaattattaccaattataacatcattactatggtgagaagtgtgtaactaatcacgaaagacattgttcgacccgcccataaccgcgggcacggctattcgaatagttttactctgatcagaggtgtaccactgtacccacaagacacaaccccacatcatgtcaccatgtgcctcaataccaccgcggtacctcggaaaggagttgtgacaatacccctcgcataacacaatccactacagcgcacctttcctggatcataatcacccccttataaacaaggcatggactccccagcgacccccgtgggcttatcttcgccacttctcagtctggtgccccgcaatgaaccatgctatacaaaagataaagccgttgcccatgctggcttatggttggcacgataaatgtttcacaaccgaaactcgtgaaccggtccttaattgtcatgagcacgaccatcaaaaccatgtgctcacaacccaccattaccaggttttagttggcacattaattaatcaactaatcacaattaaccatcgtgaattatcattaagccatcattaaataacagtgaatcataagttatcccaatagtgagctaatgtttctaagcagggctaagcaattatacctaatatctagttgaaccaatataaataaagttcaaccagtcaaattattataacccaaggtatcaaggaataaagtaatcaagaacaagagggccataacaaagaataggttaattccacccaatgacattcgaaaataaatgcaatagttgaaaggaaacaatagctttaaataggatcaacatgctcaaagggttgtttgggatctgtgtgacttgccttgctggccttggaactcttcaaactcttctccggcgaaaacggactctccggaaacgacggaatctaagcagaaagaagcaaaatcaccaaaacagcacataaacaagcatgaacagtacatgtggatatttttaatgtgtagatctcaattttagaaaaatttagagacttgaaccaactaaattggagctaagatgaattagttatgaatttttaaagattaaatcggattaaaacacttaaatcggtttaaattgaattatgacgcaataatgaattatttttgaaaaggaaaagatggtttattgcgtcagcggctagggtttcggtggaccgggcgcacgggcgacggttcacgcgaacggacggccgagatcaaaccaatccaagatggacggccgagatcgatcgggtccacggcggctcacggaggacgaacttgatggcgtcagcgatgacgtcaccccggcggcggcggctcgggcggctgggccggctcgggcggcgcacgctcgccggcgaacgacggcgcgaggacgcaaacggaaggcaccaggacgaagcgggcggcacggcgaactcaccggcgaccaaaacgacggcggaagatcaacggatggcgacggcgacgaggaggaagcggcgaagctcttcgggtcgacggcggcgatgacgctccggcggtcttcggcgacggcgaaggggcggacgaggacggcgacgcgacggcgaacacgacggcggccttcccgagcgatggcgacggctggaacgacggcggcgcacggctggagcggcggcgaagctagggcacacggcgctagggcgactccggcgacgagaggcgaaggcgagggtggcggcgggtagaggagaccacggggaaccttttaaaggggctcggaggcgaaggcgaaggcccacggcgaccggcgacgaggaaggaaggttcgggaaagacgaatccgagacgaactcgaatccctcgatttccaaaccgatttagccaaagattccaaaggagaaaaggtagaggagatcccgaggatcatttcctctctattgatttggccggagaaggaaaggggcggccagattggaaggaaacagcggcggtggctcggcggcggcgcgctagggtttcggcccgaggaagacgacgggcctgacaggtgggacccacctgtcagcgaccgaacgcgcgcgcgcgggcggctgcgaactgggccgacttgggccggggagagagagagaaggttttgggccaactttcggcccaaagcccaaaagagaactttttaaaactttttcaatttaaattatttcttaaatgcaattctatttattaaaaatacttccttagctcaaataaatcccagaaaaatctaggaattatagaattaagcaaagtatttaatgaaattttatctggccccattttatattggaatttattattaaacttagattttcttttcaagacttttaaaataaattctagaaattccatttaaacaacaatttatattttttttgaatttttagggtgtgacacccgtccaccggtgccaccgacggcgacagtcggactcggcagctcttcgccgaatccacggggaggatagctgggtcggcctcctcgactcgctcgattacgacctccgccgcaagatcctcgaccaccgcgactttgagcaggatgttgctgcggcggcggatggacggacggcgtggctgacacgaccggcgacaccggtggatggacgggaacgcggacggatggacgacgcgactgacacgaccggtggcggattgacggggacgcggtggtggcgccaacggatggacggggacacgagcggcggcgtcggcggatagacggggcggcagacggacagacgaggacgaggagtgacgtcagtggacggagtggtacataacgaagaaaattcgcatcccagtggcatattctgaaaatagtacgaattggatggcatatcctgaagtggcaaattctgaaaaatctcgatccaaacccccctaatccatccatcgaatctcgttgctcgccggtcgccgccccgtctcctcgcttgccggttacaaggacgacctcgtcggggcggcggaaccctccagcctccgggctcgccgccgccgccaagctcgcatcccgcgccggccgccgagctcgccgcccaaccccaaccccaaatcaatcagatcaattcaactatccaagcctaagttgttggatctagaatccatggcgatcgtttacgcggtggtggcgcgtggcaccgtggttctcgccgagttctctgccgtctccgggaacgccggcgccgtcgcccgccgcatcctcgagaagcttccgcccgacgccgagtcgcgcctctgcttcgcgcaggaccgctacatcttccacgtcctccgctcccctccccccgccgccgccgatggcctcaccttcctctgcatggccaacgacaccttcggaagtacaaactctcttatacttactagtattactctactaatctatatgatctatggataggataagatggattcgttcattcatcttcttagtatgttcttcattcattcaagatggtaaactgtattgcttcattagctaatttaggcatttttgcatgtacttattcatttatgttcctttcatacaactattttactgttactactctattagtagcgagccagcgaaatccagacatactagtatgatagagcatcacttgttgtataattaattacaggacgaattccctttctttacctcgaggacatccaaatgaggttcatcaagaactatggcagaatcgcccataatgcgctcgcctatgccatgaacgatgagttctctagggtcctccatcagcaaatggagtacttctccagcaaccccagcgccgacacactcaaccgtctccgtggggaagtcagtgaggcaagtatcctatttatttattgccttccacacaatttcctttcatttttgctctacaatcaaatgctcattcttccaacttgcattgtgcagatacatactgtcatggttgacaacattgagaagattctcgacagaggtgagcgcatctcgctactcgtcgacaagacctccaccatgcaagacagtgctttccacttccgcaagcaatccaggaggctcaggagagctctttggatgaaaaatgccaagcttctgtaagtcaccctttctttctttctttcttgcttactactgtactatctatctcttctcttctttaccactcactgacagtacccattaactagtggtcagtcctgcactcaagttcatttgttacaagttactccctaatgacaagtcctgattgatgttataaggcccttcgagattggtacttagccatggacatttgttattccctttttttcctgccagttatagtttaccaaatcctgaattcagcctgaatgaatgtataatcacaaaagtttagagccaacaaagctgcaatttccttttctgaggccaagtctaaagagctttattcatcagtggaaataccattttgcgcgatagtatctcctaagaattcaggagtgcatgtttaaatgagcacactctgcacaatgatgaagctgcaatttctttgctagtccaaaattatgtaatcatgtgccttcggttggtcattattgttgaatagacatgttggataagtgtataactatatatcactcagtgacccttgttgaatggaataagctggtgtatcattgagtttgagaacaatgggctattgctattctgtttttgctggggtttgaaagaattggtgattaatagcaggcataacgaaatactactagtttttttttaaggatctagaaaactgtgtgtttggttgctgattgccatacattatatgtataagatccaaccctttatttattatgatgactctaagatctacagtactaataacatttttgacagcatctgacatattttgtcctgcgttgttgcagtgctgtgttgacagctgtcatagtacttctactttacttgatcatcgctgctttctgtggaggcctttctcttccatcgtgtagatcatgatccgctctacagatttacctcaattaaagcatcacaccatgtaacaacaatgcaagcctatcaatgccatgtgtcgtatctgttcagcacccaaagttacaagtgatgttttgagaaaatgatttggtgctgagttttcgttatcgggagggttgtgctccttcaagttaatatggaacggtttgtacaaaatgggatctatatgtacagtagtatgtcgtttgttgtttgtgttggctaagacttttctgtaccgttgtgcttgcacatgaattggatgttttgcctgatgatatgagtgctgtggtatgccctttccttaactaaagcgaatggcatgtaatattctcaagagaatatatgaatatggtttatgagtaatgttatcctgataaataaattttggaagaagggaaattctgcccaaaattaagtgttgattactacatggagtgtgatgaaatgatttgtagctccccgggatcagctggcgtgatgaatgttcaggtagtgggttggaatggcgtctctgaatctctgaaactttcagaatgctgaagtaatacaatacagagctgaaatttgggaggacatttagggtaacgacggaggagtctataattagtgcagggagttggtaatacattacattgatcgatcaggtagaaagcaaaatgaaaatggtgcagcatggtggattgcagatggcagagcgagcgagcagttagaaagaacgtcttttcttcacacacatatatacaagtatggattggaactcatcatttagtccttacatatacacccagcaacggtctcaggtcaatgataagagttgattattaaacagttagtggtatgatttgatgacccaaacaactacaactcctctgcaaatagagtaatatgtatatatacctacatagatagagggatagattgccaacaagatagatatagatcgatcgatcaatagtagcagcagtaggtaaattaaggaagcagcagaagagattgttaattaattaattaattaattaagcagaggcagcatgagcgggatttgtctctcggatcaatcttaaatatctgaagaagctaatgatgttggccttgagcaatacttatacaaatttgtctgaacatgaataagatttcgtatatatgcttcttatgaataatcagaagaacagaattacattgattgcaatgccgatgttctaatgcaatcatcaatcttaagacaagagtaccaatattacaaagttacagacagatcatatactagtaaatctgctaatgccgcggtggatgactctgattctattgcgttcttataacatcatcctgaaactactgcttttctgtttgcagcatcctgatacgtaaaagtgcagcaacaattgagaaacaaatatatgagttagaagtaagggtggtttctttgtaattagttttagcttggacaaatagatcatgacaggcgataaagtcataaaagatcactccctaatccctactgctcatcttgcctttgtagaacatcttgttttcttggttgggtattagacagaagtatttcattatcgaaaaagacagaagtatttaggagtactactgtactcaaagcaagagctggcagttgaggaaaaccaacttgtcagttactaaaggggcgtccaaagtccaaacaaaaaaaactaatattctcgctcgcgctctctctctctctctctcttttgtaaacgaaaatctgcacataggataaatggaagtctagaagccttttactctatttttttagacgaaaacttagattccagaaaatgtgtctatttcttaagtaacctaaatattccattggcatagattctgttttttttcctattcctttttcttttttcacatcatcgctctgttttaccttttacaggtatatgcttagaattcacaaactactagccaagtctctttttctgaaaattaacaaacaagcaatcatgctgcagcactcaattagctgataatttctgaaacaaagatggacttgaatggctttctacaaaattttctgaacatgaattggattatataaatatgcttgcgatggataatctgaagtataagatattaagattacactgactgcagttccaatgtgctaatggcctaatgcaatcatcactcctaagaagagtttagttcacaccaaaattggaagtttggttgaaattggaacgatgtgacagaaaagttggaagtttgtatgtgtaggaaagttttgatgtgatggaaaagttggaagtttgaagaaaaactttggaactaaacacggcgtaagttacagactgacagacagaataggtggtgtgcaggatcctgtgggttgtgagcctgtgaccatgtattccaagctgccagatcatggtactaattggatgaactacagtttttacattcaagaatcaagatggaagttcctgttcctgaccaaaatgcatcgctccatgtcgtctgaagaagctgatgatgttcagtgttatagccacttgttttatgcttcagttcactaaaagaatactgacctccaaactaactatgatcttaaggggcataacactttccagttaactatccttacaaaagaagtcctgatatgattctgaatattgcaaaacaggacacgaagtatttaaggatactactgtactccagaagaactgagagttgatgaaaactaaattgccacttactgaggagtccaaacaaacaaacaaaaaagaactaacacttctctctttttcgttaaacaaaggctccatatatgataaatgaaagtgtataaagtctgttactctattttcagacaaaaactcagattctgacaaatgagtctattgtctgaaacaacctaaactcagattctcccttctgtttttcctttttgagatcactctgtatttcattttcttggtatatgcttagaatcaaggtaagaatcctcaaatcgcaaaactatacccttttcctgaagattaacaaacaagcactcatgaagcaggactcaccaagctgaaaaaagtctgataattttattgaataaatagggccttgaattgctttgtacaaattgaataggatttacataagaattgctttatacaaattgaataagattacataaatatgcatactatgaataaatcggaataaaaagattacactgattgcaatgccaatttgctaatgcaatcatcagtcctaaacaagactaccaatcatcagtgctaatttaaagacaagactgcagactaacagttctagtaagttacatgcagactgacaatctgaaaccaacactctacactgacagactaaccgaagagaggcacgaagccagggaactgtcacgccctaaaaatcgactaaaattaaaaatgcatattttaaatcatttttagaaattaaattaaaagcctacaagctaaaccctaattttctaggaaaattttcaacataaaaatgagctagataaaattttattaaatactatgcttgctcctctattttctagaattttctgggaattatttgagcaagggaagtatttttaataattgaaacaacatttcacaaattgttttttttgaaaaagttcaaaaaaccccttctttggtcattgggccgaattcggcccaatactccctctctctccgcgcggccgaaccggcccatgccggcccaagccaagccgcccgccccctcctcctccagccgctgacatgtggggcccacatgtcagggccatcttcaacctccggccgccgccgccaagctgagcccgagccgccgtcttccacctccgatcctcctcaatccgagcccgaatcctccgggtttttgaggggttttgttcctctcgttctcctctttcttttcccccaagaatcgaagcgaatcgttgaggatttgatccgaatcgagttcgttttgattttatccctaaaaaccgagtttgatttcttcccgagtcgattcctctcgtttggagttcgatctcttcaatccgatgctatatatagcatcctctcgtcgtcctcttccgtttgccccctctctcgtcctctcccgtgcatcgtagcgccgtcgccacgtgcgccaagtccgccgccgccgccggccgtcttcggtcgcgtcgcgccgccgtctccgccgtcgccgccgcttgccgtcgccaccgttaggtgcacacggaggtgaggaacctcggccgccccttctccatcgccgccgaccaccggagctcgttcgccgccgtcgacccgagccgccgcgccgcctcttctcgtcgccggccgccgtcgtgcaccgtttgttgtcgtggtgagtaccatcgggttcatctcgatgtcctctacgcgtagatgccctccgattccgcggccgaccgtcctagctccggcgagctctccaacccgagccggccgccattgccgacgtcagcatgacgtcatcagggctgacgtcagcatgacgtcatcgtctctttttctttttcttttttccgattttctaatagattaaaactttggaaaatcataactaaataaccgtagatccgttttaggtggttcaagtttctaaatttttctaaaatcaagatctacatgttaaaagtatccacatgtactgtttatgcttgtttttgtactgttttgttgattttgtttatttgctttagtttccgacgttccggaggagagcgtttccgttgaggaaggttccgaagcgtttgcggaagcccaaggcaagtcacacagatcccaaacaaccctttgagcatgttgaacccgtttaaagctattattttatttcaactgtgcattgttttcaaatgtcatcgggtggtgaacctttcccagttaattaatggccgaagctgacttgattttcctatgggttataatttgattagcatgaaccttatatattggattggttcagctaaatgctatatataggtttgcttagccatgcttagaaacattagctaactaaaaggggttaaatataaactatattacataattattattaattaaggttatattcaatggtagctcacgatggtaaatcgtgtgatgttaattaattgataattaaaacctggttaaggtgggttgtgagcatatggttttgatggttgtgctcatgacaattaaggaccggttcgcgagctactgttgtgaaacatttatcgtgccaaccacaagccagcgtgggcaacggctttatcttttgtatagcgtgattcattatagtgcgccagactgtgaaacggcgagaagtccgtgggggtcgctggggagtccatgccttgtttataagggggtgattatgatccaggaaaggtgcgctgtaatgggttatgttgtgcaaggggtattgtcacgactcctttccgaggtaccgtggtggtattgaggcacatggtgacatgatgtggggttgtgtcttgtgggtacagtggtacacctctgatcagagtttaatctattcgaatagccgtacctgcggttatgggtgagttgagcaatgtttttcgtgattagtctcacactactcatcaatggtaatgatatgataattaatttaattcctggtttggaatggttaattcctgatttggaggtttcatttgttcaactggggttggttgttcaaatgtggttgggcctatgcaacacgggtgtgttgtatggtgtttatttaatattggttaattattcaactgttttactattctcttaaatatttgttaaatgctgttttctgcaaatgagctgttttatgccatcctttgttatcctgtgcacttgcatatttgctgtgtggcttgttgagtatgttatatgctcattcttgcaatattcattcatcagaagaggagtatttcagtgaaggtgaagatcaggaggattaggcttgttctcggttaagatgcctgtggagtggagtcgccatagctgttccgtagtttgttatagttttgttttccgctgcgtagaatgttatttgttttgagaggaactatctacctctgtaataattttaatttttcgaatattcgatagttaattatttgtactctattatcaatattgtcattgtgtgcctcggttgattcctggacgagggtttaacacacatgtaagcgtttggaattttggatagaaattccgggcgtgacaagttggtatcagagccaccttgaccttaggataagccaatggtaaaccttaagtagccttcaaaatattttgaaaaatatagaactgctcttctctattcttttataaattatttaagttggcagcacatgcaaggttatgcacaaaatttatttaattcaatttcttttcttttaaaaacaaaaagttgttcttttcaaaatgtttcttttctctttaccaaatcctattgattagtcggcactgtacatttattagggtatcgatttaatcatgttagcactagtactactcatctttcctatggtgatactgtaccgggcttataatagatcataattattatagttttattttaattatttgtcaaaaatatatttgtctctgtccaaaaagtaaaattctaaaaacatatttatataatagcttggtatgcgtcttatcttttattttcttcctttttggtcaaaatcagttaagtctagttggtgcagctaacttaaaatatgctttaattcctcttctatgtctctttagatgcctccccattcaccgagaaatttgatcgaggtgttaggattcgtcagggagctgaggttgatggcttttgaagtaggctatgaagttgctcctgagtatcgccagatttcccatgaccccgacgaagagaagtgtcgtgttcgtgtgacgttggctagtgatagcgaagaccttccgtcttttaagttcgaagctgggggaagatcgtactgccatgcttgtcaagaagcagctttggtggccattggagagttgcgtcaacgctttgaagaagagttggattcatcagctttccagtatcatcctcacaaacctcatggtcaagactatggaacctatatctgtcctgatggcgaagagagtgccactctgatgcatgcggtgcatatgcttagtgctatggatgcagtaagtgtggagcgagacaaagcagctcatgatagggaaaactggaatcaaggtaagatttgcaagttgaagagcaaggtgtaccgtctacagaaggaattagctgaacttaaaggagaaacgccgccgccaacacccaagcttcgcctcaccgcaagaaagagaacctgtccgccacctcgtctccagttagcttcgaagattcgcgtgatgggcgaagctgtgcccgatcatgctgaacctgtcatcgacatcataagtgatgaggaagaagaggaagaccctgaagaaagagagccagctactccagaggaagaagatccatcgcttcgttccgacgcaaggcggaagtagtcgctcagttagatcgttgccgtagttcgttgtgatagattgcttgtttaagtttgcttgtgagtgtgtgggttttagttgt

SEQ ID NO: 72688 - DNA, 3396 bp, Oryza sativa
catcaacctaaaccggatatgatcatatgacgatcctggttggaacacttaatggacaattatgatcatatgacgagaaccggatatagtcatatgatgatcctggctcgaacacttactgggcaattatgatcatatgataatcaagcagataacttaatatgatcatatgacgatcttggttggaacacttagtgggtaattatgattatatgacgatcctggttggaacacttaatggacaatttcgatacatgccattttctttcatagagaaccggatatgatcatttgacaatcctagttggaacacttaatggaaaattctgatacacgccattttctttcattttcttccatccccggacgccattttctttcatagagagaaccatatatgatcatatgatgatcctagttagaacacttagtggacgattttgatacgcgccattttctttcattttcttccatccccaaacgttcatcaacgtcatcaaatagagaaccggatatgatcatatgacgatcttgtttgacgatcctggttggaacacttccagcattgtctgatgaggtctaacgggagtttgtgagtccaactcagatgttttttttcttttcatacttgggtccatgttttttcgagtcctaattaattttgcgagctacgaggacatagaaaaggtttgctattggttgaccggccccttcataagggctgtcacaagttctagccaacagagtcgttctttaacataacatatctactttttaccgtaagttttgcactatctcatccatcttcagtagtttgcacttaagttatctgttctcctttggaagtgcaaatctctttgcaggtctgtcctgaaaacttttcgtttcgctcacacgataagtgtctatctccaatttatatatggtagccggtttttatctctttttcatcttgatcaggagttttttaacttcaagatggattatgactccatacacaccacaaggctcgtgaagaggatcctcgtgttggaggtaaaatacgaacactatgtgtcaagtcatgggagtgggtcaaagggcctagatcatatgttgtttgctttgagattattactacacatgccagaaagatgggtgagctaatttggccgaagaaatgacagatgtgtagtgtgtaattctcttccatggtattcctagttaatatttctatcaaccatagctatcaattaatgttaactagtatcctctccatcccaaattgatcatcatatatgtttatgcaccaagacaaaggagaatttaaatcgcatccatcaatacaccatgcaaacattctcccacaatgcgtgcatcaattaaaacactatgccaattataccctagcatacacacattctcccatgatgcattaattgtattatgataaaacccgtatccatgcggttatatgatgatcaatttaagaaattttggattccattatatgatgatcaatttgggaagaaggaagtacatgcatataacttttttcatcaacaccaagaaagatttaactgccacataaattgtatttaatgtaagtttatgatggggaagaatcagaaacaagcccctaaggccattcccaacccaagacactagacatagtttccataaactccacatcatcaagaaactagtactagacactactcttccaatgtaaacaccactattccatacttaaattgacggagcttggggctcctcaccgggagaccgcgcaggcccccctttgccggttcggccgggggccctgggtgagattctaagctcctggtctgtggaaagttcgcgagagtggaaacacacaagacacgggcgatgtatacaggttcgggccgctgagaagcgtaataccctactcctgtgttttggtggatctgtatatgaagaagctacaaagtgcgagccagcccccgattgttctgggatcctttttcctcccccctctctaagtgggcaaggtcctccttttatatctcaaggggataccacatgcaccatctctccctctctttcttttgtgtggggactcatcctctcttccctccaacttgacttctcttcattaatggacggagatttgtatggctgccgtccgaatgaccttctgatgggacggcccatacctacctccacttccgccggaagcaggcgcgacgtgggaacatggctgtctgctgacgacatgaccattgtcagaccggtctcaaatcggtcattcttgtccaccacgtgtcagtttaacaatctgcatgctcgcccttcttcatacaatatcttgcctgtaatggttaggatgaagcctggcatatatctgaccggaaccaacgtgccatctccaggagctaacacgccggctccggctagggacgagtgcttggaggctctcgtcctgacgggatggggcgaggcgtgcgtcagaccgcctgtcgccacctaacccacgatctgaccggtctgtgactggtcacagaccggatagacgagcgcgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgaggcgggagcggtccgaccccctcggggagataaagaggagggcgaacacatcaccctcgggcccgacgccccccgagggtgccaggccacgtaggcgattgtgtctgcctcaagcctctagtcatgatactcccggtcccatgtcaccgacataaatttaatgctacttatctcacatgatgtcttggatgttgtgtagaacccatctgttaggcaagacatggttttcttctctttcctcatttattcacttgccacatcctttttcattctaggtggcagcttatttaatgctatggacatcatcctaattattgggttaggaatagcctaagtatccctaaatgtctgcatgcatacatgcatacttaattctcatgtatagatgcaataatggtacacgccaaactaagggacaatggttatgtgatgataaatttggattttttttatttttggttatatgcttattaatatgaattggagaaagtactacttaacatcaattatgcgttggtgggagaactgtttcgagacaacctagaagaaacaagtttttgttatagtataaaaatgaaaatgcgcagtacgacaagaaaaaatattaatgtggcagaaccatggtcaacctaatttgatttcattcaactcagaattactctctctctctctctctatgtatcactcaagcacgcggggggggggggggggggg

SEQ ID NO: 72689 - DNA, 4287 bp, Oryza sativa
ggggggggggggttggtgcagcactgtagtagcaaatttttttctcaagctatattatagtaaattataatgttttcatgtattatcaccatcaatggttcaacataagtaacaatggagttaggttaataatatcgagtagaatacttccttttattttagtcatgaatatttagtgtctaggataatacattcagtcaaaattgtatgttttgaccataaaatttctgaaatacttaactaaaaaataaaataaatggtcgatttgtctggaaaattataatcatccttgagctttatcatgcctaatatgcttacttttttttgcatttctagtattaaccagagttttttttaaagaaattctccataaatgcacatctcatttttagtcatgcaacaatatttagataaaataaaagacagtaactatacatactatcctaccatggttacattgcatcacagcatgtatatatttttttctctccaacgacaactattatcacacaattcaaaacttatctttcaccggagttcttccaatgaatcaaattaacttgtaaagaattagaaaaggagaagaaaagatagaggagactgcaaactgcaatgtaactcatggacaaaaagaaaggacaaagacatgcgtgcatacagctgtactcataaataactgcagactgcaacataactcatgctgtgtttatgggccgctcgtgtgtctcctgtggtctggtttctgatgtagggggtacactaagctgggagaaggggggtgcccatacggtaagtaagggtgttaagcactaatttttcttttttagccgggtgcccaggaaccccgcaggctgtacttagcttcgagcctctcaagcactgatgcactcaccatctcaaattatcaatgcatcaaccgtacaacaatgaatccatgctattagaaagtttaggaagaaattgctataggaatgagaggcatcggtaagaaaagtagcactagatcaagaatatctctcagcgcagggataacctattgatgagcaatgattttagcttggaggtctgtgcgaagtatctcaaatgccaatgttagctgttctttcgctcaacagcctacagttgtctcttcaagttgcgctcactgtttccacccattttaaaatgctagaaaagtaaataatgacatcactagctcaaatataatcatggataccttatgtattcatcaaacgaaggtgtatattttccatttgagatttacgcgttatatttgtgaacataaattattgctcttttagattttgttttgttgaattttaggttgcatcatcgtgtcgagtgttggtttagttttagatttaattttttgttttgagtcaggtatttttaggtttgagtttgccgcttagtctgtactttgacggtagtatttcatgttagtgagtttaggtccaattttgtaagaatctgtttttgtcgggaccatggaaaattgaacatgttgttgtcggttttttgtttttatagtttgcataaatttatgtcggttagttttggagttacattgttagagtttgtctgtcttatcgtgcttgtttgtgcacctagattagattagagaagttatcctccatcgcgtcaaggcttaccttgctccacttggttggcccaatttagtgtcgatccgacgtaggttatgatgatagtctttatgttttacagtgaccaaattttggtttacataaacggtacattgtagttgagtcactatataacttttgtcttttacatttgagtctctgtaatattcatatttacttttgagtccctagtcgaagttcattgataagtaataattgaaaaaaagataaaaaagagaaaaggtaaaatggtgctaacaagccgcaccaataaaaggcaaaaaagggaaaagaataaaaaaagaaaaagaaaagaaaacaattatctttttagtatgtttggggagtgcaaagttgttctttgagttgtttctaggatttagtgttgtcgggtgcttacttgagctagagctcaatatagtattttcaactattattcaactttgtatttactgattagcacaaatgcttttccttgctactatatattatgcccccaagctacacatacatattttttgtcatcacagttttaaccttgcaattgttagatcacatcctcaaggtatcattatcaggcatcggttgtaccatccctacctttgctggtaagaacattgttagagcacggtaagacacttctatttgcgagttccatcacccttgttcttatgtattgtttactgttttctactaacaacggcaggttatatcactcatcgacacgagataatgttggatgggagacaaaccacagttggtatgtcaccttctacaattgaagttaatgtaagaattttggtgcaaaaagtgctaaattttcaaatcgagaaagcagagcaaaagcattgccacaatttattttaaataggtttatggttaacgatagagcatatcatgttacaatcgataatgataatggtaatgatagtgatgctacatttactcaaggtatgcatagttatgatgcgctaaatatgtccactacttacgctatattagagtatccaatagtgaaaacaattactaaaatatctttatcacaaaaaaatttgcttgttgttttaggtaacgacgaagaagagatgtgtgatgcttcacttatatccatgccacaactagtaaatgaacatgttaattctatgcttgaaccaccatatattgagtttaaacatgttattcacatttttagagagaatgaagagcttaaatcgttatcttcttcaaatacatggggctatattcaatttgaaaatctttgtcaattgaactgtttagagaagaatttagttgctagatctgaattgccacagccatctaatatgatttttaacgttattggaaattatgatagtaaaggataatataatatacatcgagtatatatttgttcaaatttgaatgtatttcgttttcatgatgagatgtattgtccggaggaccgcatccatataagtaattctctatctagattctctagatatttaaatgagttaagttgaatttcaagaatgggagtactgtggttttcccgagtataaaaatttcagaatccaaccatttgaccatgacgaagactacctcgcctgatgcttttgtagataaaaaaaaacatcaactggcacaaaaaggtgaaactgagaacggtttccaatcttgaaggggatgacgatgatggcatcactagctcagatataaccatgcataccttatgtattcaccaagcaaaggtgcattctttttatgtgagatttactttaacacagattatttcatgtcgtgggctaagctaaagggatggacgccctaaggctaaccctaggacgtcactaatcatatttattcattagcaatcaggttttgctaagattattttggcaatacaatttttccactagtttggtttgtggaaccccaaattagagtgcttaatcattgatttgcaaattaagttgtaatctatcgtgtttttacttgtgtttttcaattcgcaagcaggaattaggcttctcgatgaggtcaattgagtttcgatacgattgataactagagaagtcatggtgcttcgattgtggggtttggatcgtgtgtgtcaactatccgctaaatcaagaattatcaatagctatcgaaagctcgggacctagttccccatcagttacgtaattatttatcatcctggaacagctgccaccacatgcatgccaccacaacatgactacccccaatctgtgtttacccgtcatgatctcatatcatgttacccgtcttgttaggtgtgacatcctagcctaattagaatgaggcctgtgtagcccatgcgagctgtgcgtgcatatttactaccacctttctagtttagcaagtatggaactaacttataaggcctcagtccctccaaccatgccactcccgagttaacccttttacacgaagcgaggacgtaatgtgtagtaagtgggctcgtccgtcggatgggctggctacgcggttctggatggagggctattacattaggttattaagatgaaacaagttgagatgagataaacagtactattattattcttgtggaaacactaaaaagttgcgtgcagaataaaagtgtcatcgtcctgattcgattttcttcagtacagaactg

SEQ ID NO: 72690 - DNA, 702 bp, Oryza sativa
ctgcggagcggcggccgagagaggggagggaaggggaaaggaggcgacggtccacggctcaccccggggcgacggcggcgacggaggaggcggccggagcggaggtaggcggtggcgcggctcgggtcgacggggacggcggcgctccggctatcggcgaccgaaacagagaggtgaacgaggtcggcgaggatgcggtgaagccgaaggaggcggcgccgaggtgggaggcggtccggggcgacgacggtggtggaccggagctcggcggcgacggcggagagagagcgacgtcgcgagctcgaatccggcgaggaggaagggcggcgagaggtggaaccggacggaggaggtgcggggagggtttaaatagggttggaagggggagagagcggccagggaggaaggaaaccggcgtgggaggtcggccgccgtcaatggcgccagcgagatttgcgggggcaaatccacccgtttgaacacgagagagagaggaaaaatggggggaaagggagaggggatcacggggagtatttccccccactttattgcacgcggggatggcgggattcggcggatttggcggcggcggcggcgcgcggggtgggaggccgaatgggccgcgggggagaggagagagagaggggggacagagatgggccgggccggcccaagtgagggaaggggtacttttggggtttt

SEQ ID NO: 72691 - DNA, 4941 bp, Oryza sativa
cttactgctaaatcactggtggagaaaccatctttcgtcggtcggccgaattccacaatagtcccggttgcaataaaaaccgggactaaagacgttaaaaagggtaacgagcatatttgatctttagtcccagttggtaaagatcatctttagtcccggtttcgtaactttagtcccggttggtgttaccaaccgggactaaagtctcacccatatatatatatatatatatatatatatgtcttcttcctccttcagcccgagcaagcttcaaaattttttaaaaaaagaggggaggtcatgccaaaatttctagtgaatttattttggtgattatatacaaattggaggtgcctaaaaggttagcaacttcatcctccaatgtttttttgtcatattacatttggagcaatattttgcacattttttgtctccaaaattttgttgtaagttgatgagagagaaaatttgtgtggggaagaaagaacatatagaaatttagtttatttgctaataaaggttttataaaatagttgagaaggaaaatatagtgaaagttaatcttaaataatagaaaacaaactaaaatgaaaattaaaagaagtacaacacattaatattagtttaaaactttagaaatagtaaataagaattatttggtgtaatattttataatttttgtatgaataatgatacgtcattattgtatgactgttgaaagagtttgtaattattttatcattattgtatgactgtcattattgtacgaataattatttgagtatgatttttttttcatttcatgtagatggatcagtaatggatgtacgctgaccggcggtccaaagagtttactgacggcgtgcattattttttgagagtggccgaagctaataggcataagggttttatttgttgtccatgcaataagtgtaagaatcagaaggagtattctgcatccagaactattcatttccacttgtttaagtcggggttcatgctaagctataactgttggacatcccacggagagcaagtggttgaaatggaagaagatgaagtgaaagacgacaatattttggattttgctcagtacgctggatttgaaggaaatcaaacggatgaggaggaaagggatgctgatggtaacgacgttgcagatgatcttggtcagatgttgcaggacgccaaggaggactgtgaaagtgaaaagggggcccataaattggacaagatgttagaggaccacagaacgtcgttgtacccaggttgcgagcaggggcacaaaaaattggataccactctggagttcttgcaatggaagacaaaaaatggtgttagtgacaaggcatttggcgatttattgaaactcgtcaagaacattcttccggagggaaacaaattgcccgagacaacgtatgaggctaagaagatagtctgccctctaggactggaagttcagaagattcacgcatgtccgaatgattgtatcctatatcgcggtgaggagtacgagaacctagaagcatgccttgtttgtaaagcactaagatacaagattagacgagatgatccagaagaagttgacgggcagctaacgaagaagagaattcctgctaaggtgatgtggtatttccctataatactacggctaaggcgtttgttcagtaacaaagggaatgctagaatgatgcgttagcacgctgaagagcgtcaataggatgggatgctgagacaccccgccgatggttcgcagtggcgaaacatcgacagaaaatttaaagactttggaaagaacgcacgaaacatacggtttggtttaagtacggatggcatgaatccttttggagagatgagcagcggccatagcacttggcccgttacgatgtgtatctacaacctccccccttggctatgcatgaagaggaagtacataatgatgccgattattactcaaggccccaagcaacctggtaacgacatcgatgtgtacctaagaccactagtcgaagatcttaaactgctgtggaagaaggaaggagtccctgtgtgggacgaggacaaacaggaggagtttaacccacgagcgctgttgttcgtaaccatcaacgattagcctgcacttaccaatctttccgggcagtccaacaaggggtacaaggcttgcactcactgtatggatgaaacagaaagtacgtatcttaagcactgtaggaaggttgtgtacatgcgtcatcatcgattccttgctgcaaaccacctggtacggaagaaaggcaagcactttgaacataaggcggaccaccgtacgaagcctaaacatcgcagcgggaaaacagtgtttgctatggtgaaagatcttaaagtagtgtttggaaaggggcctggaagccagcctatagagagcgaagatggtcacgcggcgatgtggaaaaagaactctatattttgggacttaccctattgggaattcttggacgtcagccatgccatcgacatgatgcaccttactaagaacctttgcgtaaacctttttggcttcctaggtgtatacagaaagtcgaaagatacactggaagcacgtaatgatctgatgcatatggaacaacgcggcgaccttcaccaggaaccaaaggagaaaggaagccattacttgagtccagccagctacactcttagcaaggtagagaaggaaagtatgtttgaattcttggagagcataaacgtaccgtctggatactccatgaatatcaagcgaataataagcacgaaggagaagaagttcacaaacctaaagactcatgactgtcacgtgttgatgacacagctgctaccagttgtaataaggggtatccttccagacaatgtccgggcaacaataacaaagctatgtgcattcatgaacgcaatttcgcagaagatcatcgatccggatagattagaagcccttcagaatgatgtggtgcaatgtctcatcagttttgagttgatatttctaccttcatttttcaatataatgacgcatctgctttgtcaccttgtgaaagagatcagtattctcgggcctgtgtacctacacaacatgtttcctttcgagaggtacatgagcgttctgaagaagtatgttcgtaaccgtgctcgtccagaggcaagcatcgccaagggttatggaacaaaggaggtcatcgaattttgcgtagaatttattgaagatcttcgcccaatcggggtacctgaatcacgccatgaaggcagactacggggaaagggaactctcggaaggaaagcaataatgacggtagacaacaattattccgtaaggcccatttcacggttctacaacactcttcattggtagctccatacatcgaggagcacttggctttagttcgcgccaggaacatcggtaagtccgaagcatggattatacggcatcacattgatactttccccgcgtggctacgacaacatctcatgggtaacgagtcgatcaaccaacaacttgtcttcttggcgaggggaccgtctgggtcgatcacgacattccagggatatgagatcaatgggtatacattctacacgagagcccaagacatgatgagcacgaaccaaaacagcgttgttcgtgtcgatgccatgggacacgatggaacaactggctcgtattacggtgccatcgaggacatatgggaacttgactatggtcctctcaaggtccctctgttccagtgccaatgggttaggttgactggtggaggagtaatgattgatgacagtgggatgacaacggttgaccttaacaaggttggatactcggacgaaccttttgtccttgccaatgatgtaacgcaagtctttttcgtgaaggatgtgtctagaaaaggaaagaagggcagagggcctgacgagcctaagcgtcacgtggttctcccaggcaaaagaaaaatcgttggagtagaggacaagactgacaaggattatgatcagttggatgggcaaccccctttcacggtgacgattgaccctagcatgctcctatcaaatgaagacaccccttactcacgtagcgatcacaaggagggaacaatagtgaggagaaagtacgtgcggtcaaccgtcaccgccgatgtaaactattttggatgtattgattatccatataaatcaattgatgtatggcatatgttaattacgcacaattattagaggttttaacaagtttaaatcatgtatatgctagttatatgcgatacttacaatttttaaaagttttaaatcacgcaggtggcaatttcatatgttagttagagtttttaacatttaatttactatcattcatatgctaattataattgactagagaatttttaaaagtttcaaatcatgcatgtggcatttacatatgttaattagagtttttcacaatttaatttactatcatttatatgctaattatatatgactattcgaatttttaaaatttttaaatcatgcatgtggcatttacatatgttaattagagtttttaacaattaatttaatataattcctatgctaagtatatatgatgattacaatttttattaattttaaatcatgccgtatgtatatacatatgttaattagagtttttaccaatttaataatatcattcatatgctaagtatatatgattattagaatttttattaattttaaatcatatatttgcttattacgttttatccacttaatttattacagacaacaataagttttcgaagtaattgtcattaatctttgtactttaaataattgtaatgcattatcttctattttagaaacacatatgtaatggaaaataatattcagtgcgcttatcagtagtcccggttcttaaccctaaccgggtttaaaaagaatttggaaatagcgggaaaagatctttagtcccggttgagg

SEQ ID NO: 72692 - DNA, 3179 bp, Oryza sativa
ccgggactaaagatctagggctatatatattcccgatgcgcgccctcgtcttctccaccagcacttagaagtttttacccgatcgatctctctcggcttctccttcgccgccactgcctagggcatccccgcgccgacgccgccgccgtatctcgccgtcgtctcgcgctcgtcgtcgtcgccgccacctccgcctcctccgcccccgccgcatctctggggtgagagccgccgcgcgccgcctccctctcgatctctctctccgatctcgatctctctctctccctctcggttgccgccggccgacgagttttagacgccgacgccgacctcgtcacgacacgacgccgcgccacgacgacgccgcacaccgccgccgcgccacgccgatgccgcgcgcggcgccacgccgccgccgcgccacaccgccgtcctgctgccgccacaccgagaacgtgaacgagcgaacgaacgtgaacgagaacaaggtgaatgaacgttaacgagaacgagcgaacgaacatgaacgagccaacgaacgtgaatgagaacgagcgaacgaacgtgaacgagaacaaggtgaatgaacgtgaacgagaacgagcgaacgaacgtgaacgagccaacgaacgtgaatgagaacgggcaaacgaacatgaacaagaacaaggtgaatgaacgtgaacgagaacgttttcggacgaacgtgaacgagccaacgaacgtgaacatgaaatgcaattataggcaggttaatgaacgtgaacgaacaaacgtaggtgaatgaaacgtgaccttaacgagaacgcgaacgtgaacgatatcgtgaacgaaacgtgaacgtcaaatgcaatatatgttacttcgcgtttatcctaatacatcttttcgtatcttgcagaaaagacgttgtcggagtcgtccctcaagccggagtggtagagctagccctcgaaggaattcgcccaggcaagtgacgtaattatatatatatgattgttatatttgtaatgcaattaagattattagatttgtaattagagttaattagcatataagattgtgtagtgttctaatatacgacagttacacttagaatacatgactatttgagttttagtataagattattggagttttaatataagattattatatttgtaattagacttagtatataattattgactagctagggtcctataatatacgtcacctagacttagcatatatcactatttaaggtttagtataagattattagatttgtaattagacttagcatgtaagattgtgtagggttctaatatacgacagttacacttagcatacatggctatttttatcttagcatataagattatttgagttttaatataagattattatatttgtaattagacttagtatataattattgactagctaggttctataatatacgtcacttagtcttagcatatatcatcactatttgagttttagtataagattattatatttgtaattatacttagcatgtaagattgtgtagggttctaatatacgacagttacacttagcatacatggctatttttgttttagcatataagattatttgagttttaatataagattattatatttgtaattagacttagtatataattattgactagctagggtcctataatatacgtcacctagacttagcatatatcactatttgagttttagtataagattattagatttgtaattaaacttagcttctaagattgtgtagggttctaatatacgacagttacacttagcatacatgactgttcgtttagtcttagcatataagattatttgagttttaatataagattgttaaaacataaatgtctcatgacttagcagatgtttcctgtatgaacagagggctgatcgcgatgaggaacagatattgtatgatacaatcgcggagggaagcagccagtactggaacgaagaagaggggaacgaggatccaaaccagtatttgaacaaggaagggaacgtggagagggatgcggaggggaaccaggagaggcacgtggaaaggaatgtgaaggggaaccaggaggaggaggctagtgaaagtcaaccctccgttggacagaagagggcacgcaagcaacgaggtgccgcgaagaagcttgagggtcggcacatcataaccgaagtggaagaagatggacaacctagtgccccggcagaagccgccaagaactatgtacgtcacagcggttgggttgtgcgggataacgtgcctatcagtacggtgtactggcaaagaacaagggcacgcggagatcatgagagctttgtcccagattcggagaaagagatgctgtggaccacaatgctcgagacattcacccttcccgcgggtacagaggacaaagtgaaaaggtggactctgaagaaaatggcagaacagtttcagagcttcaagggagagctgtacaagaaatatatcctgaaggggcagacactgaacttcgacacattcccaaagctaagggatcactgagacgagttcgttgcatataagacaggtgaacaagggcaggcgatgatggaaagaaacaaagaaaatgccgccaagaagaagtaccatcaccacttggggtcaggcggctatagcgtcgcgatgccgaagtgggaggagatggaggctagcttgcttgagaggggtatcgaaccggccaccgctaattggccggaacgatcgaagttctggtactatgctcacggtggaacgctcaacccagctgatggctcactggtcttcggcgatcagatacaagaggctgcgcgtcgactaacagacgcagtggaaacctcttctcagggcacgttccgaccgaacagagagagggacgagctgtcactcgccctgcagactccagagcatccaggacgaccacgagggaaaggggtgattccttggaagattgggttcaaggacatccacacgtacaggagtcggatgaggagcaagagagataccgaggcgaagattgcagatcttgagtttagggtatcgagctacgagcttagcatgcaagaggaggtggcaaggaaggttgatgaacgcatggccgcaatcggtccaatgatccccagccgaccattcctcctgcaatggtgagcctgtcaggaaagggg

SEQ ID NO: 72693 - DNA, 610 bp, Oryza sativa
tggtaggaccgcgaggcgggtgtctacagtggtgtcgccatcagtaggactgccatgtgagaatctaaacataattataacttaatgcatgtgtgagtcttgccttcccgggtgcgccagaactcctctcactgctaggaattgtgtacgcctagagtgcatgaggatgtaaagttcatggagcgggtactgccaatgcgaggttatcgaaaagctttgccgtgacgcatctcatgtgttgggacaaggctcatgtgttgggcagtcgcggagtgcgggtaaagtgtacatccactgcagtgtgaataaaccaaatctattcgaatagccgtgctcgcggttattgagcaccgggacatgtattacacttggctagactctaaattcttaacttgtgtgggatgggatattgcatgatgatttctatactgatggagccacttcctgagaggcgggaaggtggacgtcctcaaaaaaccatgacgactcaatggcaggaagctatccttgggatcacaatggatggtggatagaaccatcattgtttaatatgaacactggtactaaaatttgatcagtctgtgctaggtcttaggtttgtgaaaagaat

SEQ ID NO: 72694 - DNA, 1542 bp, Oryza sativa
gtatgtgcacttggtatttcagctatgaattcatttgtactagactacttgatctagggaaatggtactgtttacacgattgattcctgttataaaaataggggtccacagagctggtatcagagccatacgactgtaggaaaagaccaaaaggcgccccaccccttttctaagttggccaaggaaaaattcccatttagtaatactttcaaaaataaaaacgctatgtttacaaaactctatacgattttcatcttactcttaactattttcttcacaaaacgagttttactcttagctgaccttgggtttttcttaaaattcgatggcagatcaggattcacccgctacctgggagatgggcgtaccccgctcagagggatacgtcattgagctacaccggttgatgaggtgtctgcgataccctagatttccgatctaccgagtgagatagagtggctttgtttgggaggctcaggtcgaggttcacacacgagttccttcagagtcagactacagcttcctgacatgccaccgtcgtgacttaccgaagaccgcgatgcaggatgcagcccgggaggccttcctccgacttagctctatccaccgagctgagttggcgagtactgagtttgctcaccacccgtttcgagaggagagcaactccgtctgcacggctcaggacacaccttgctgctacaacccgatagtgactcgactgtcacgatgggctgaggcagtagacgacttttacgaggaggctctgttagagatcaacgaccagcagaggcgtgtgggagagttagagaccgaggtgactgacctcacagtgcagcagcttcagctagaggaggagcaccaggcttggggtagtaagatagactcaatgaaggcatagctccaggtccacggcgaccggttccagcagttatctaaccagtacaatgatcgccgcgggatgatggatacacttgaggagcaggtgagagagagtcaggagcacgtcagccagctggaggagcagcttcgagcagccacggtcagcaccacaggagcttctacttccacagcagtagggtatgaccgctactccttcctcaccacaccgtacccaccagcgttccacactcttttgggagaggttggtatgctggctactgagtcagcaccttacttggtggacccgacagtgacacagccacctgccccggagattgtgcacactccactgatccctacaccttctccgcagctaggttcgagtttggagactccgatccaggtcgactccgagacagaggggaccgacaccgagcagagatcgagccagacatcactgatccttcagaggatgagacccctgttccccgcatcaccttcctcggacgccctcacaccctcagcactgcccgcaagagcacacgacccccgggcaagaagcccaagccagatccagaggccactacttctgagccgtggggactcaggtttgcctgtgccagcgaccaccctctacctgccccaggatcctgcggatggttg

SEQ ID NO: 72695 - DNA, 796 bp, Oryza sativa
atgaagcctggcatatatctggccggaaccaacgtgccatctccaggagctaacacgccggctccggctagggacgagtgcttggaggctctcgtcctgacgggatggggcgaggcgtgcgtcagaccgcctgtcgccacctaacccacgatctgaccggtctgtgactggtcacagaccggatagacgagcgcgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgaggcggaaccggtccgatcccctcggggagataaagaggagggcgaacacatcaccctcgggcccgacgccccccgagggtgccaggccacgtaggtgattgtgtctgcctcaagcctctagtcatgatactcccggtcccatgtcaccgacagtagcccccggcgttatgccagggcgatcgccctccccgagggaagcggtcgggcgtgacgccacttctaaggcctggtgacaggtggggccggtttaaaaatcgggacaagccggttcgtttttcctggagatatggtgatggcgcttcggtcggcgagcgtaattaacgcgcgcacgagatgttccatctcgactgccacagccgcatatccacctcatgcaccgcaaacgggcgaatgggattagtggaagcgtgggcgcgagaaacgagggggcaagatagtgggcgcgagaaacgaggagccgg

SEQ ID NO: 72696 - DNA, 3084 bp, Oryza sativa
tacgcttccgtttgttaaactctgaattgtatcaacttttggtgtaccttgcctcctgggacaaggaacaatacacgcacgtcaggaacgcctgttgggtgatttccggtcgtgacaagttggtatcagagcctcccttgaccctaggacgagccgtagatcccaagccttagcaatatttttgaaaattaaaaatcttttgttatttgtgaaaacccgctattctctctctgtcttgctgcttcatttatcgccaaaatctgatctctaaaatgctgtttttcttttgtttttgtttgtagatggccggcagcgtcacccgtcgtggtttggacatgactggcttcgtcctggagctgcggggcatgtgcgtggtcttggggtatccacatggagtggattaccaggccaggccgctcccggagcaggagggtgaggatgcagagcctcacgctgggtgggaggtcactgcagtgatcctctctggctctcccgagcggacttcgctggcagtcaccgcgggtggggattcttctcccgccgcttgccagaacgccgctctcctcgccatcggcaccctccaccagcgctacccggacgagttgcagcactcgccctatcgctaccaccctcgtcgcggaggagcccgcgacttcgccaccttccgagatgctagcttggaggatgacgctaccgtcgtgcatctggcacgcatggtggaggcatacgacgcggctcgtatcgacttccatcagatggtgcgtcgcgggatggttgagaacaacctgaagatcctggagctgcgtcaggagaacctgcagctcaagaaggacctcgacgcattggaggcgcagctgcaccagctcaagatcgcccagggagaggacagccgccccaagcgtcgccgcgtctgccgcagccagaagatcaccgcccggaagagcacctccaggcccgagcttgttcgtcagtccctggcgtggacttgcttcgtcgagacccctcgtgccgagcctgcgcccgtggttccccaggagggggaagcctccggcgttggtagcacggaggatgcgctgttgctcaccttccgccctggcccgtcgcagcggtagacgagcagttagtaggcttgcgcgtgtgtttttcctcgtttgtcttcttgggttgtgtggggcatggttatgccagtgtgtggcataactatgtcggagcctgtcttgttttatttgtttaagcaacttgaactctaatgaaccaattcaatatcagtaataaattcaagatttatagtagtcgtgggtggttagttttaatcgttagctctctctgtttgctggtgctgtgtggggttttcagatggtgacgaccaggagaaatgttagcaccggtgaaggcaaccaacccgaaggcagcaaccccaacccccaaggcaatccacctccaccaccaccaccagacaccaacgccattctcacccaaatcctcgcccagcaagccaacatgatgaccgctttcctccaccacctccaaaatccgccacaacagaatgctccaccaccacctccacaacactctaagctcgccgagttcctccgcatccgcccacccaccttctctagctccaacaatcccgtggatgcgttggattggttgcatgccgtggggaagaagctggacactgtgcagtgcagtgatgaagagaaagtcatcttcgccgcccatcagctgcaggggcccgcatctctatggtgggaccatttccaggctacgcagccagaggggcaaccgattacttgggcccgcttcaccgccgctttccggagaacccatgtgcccgccggagtcgtggctcttaagaagagggagttccgggagttgaagcaaggcaaccgctccgtgatggagtatttgcacgagttcaacagtctggcccggtacgctccggaggatgtgcgggaagatgaggagaagcaagagaagttcttggcgggaatggaccctgagctgtccgttcgcctagtctctggggactatccggacttccaacgtctggtggacaagagcatccgcttggaggccaagcacaaggagctggagacgcacaagcgccgcttggcgaacttccgcaatcagcagggcgctaaccagagggtccgctacaccaatccctatccagggggatcctcctcgcagcagcaacaacagcagcagcaacctcgctccgcgcctcgacctcaattcgtggtgcgcgtcccacagccgcagcagcagcagagtcagcaagggactcgtgtagcccgtcctcctacgccagttgtgcagcccgttcaaggccgcagggacgctcaaggtcagcagcgtttgtgcttcaactgcttcgagcccgggcactttgcggataaatgcccaaagccaaggcgtcagcaaggccaagcgcctccccgctccaacaacggtggcaaggacgtcattcggggtcgtgtgaaccacgtgacggccgaggacgtgctgacaactccagacgtcatcgttggtacgttcctcgttcattccatcccagctactattttgttcgactctggagcttcccactcgtttatatctgtgccattcgtggggaaaaatcagttgggggtagaaaggcttaggaaccctctactcatcaccacccctggaggggttatgacagcaaagtactatagccctgccgttcctatagaaattcaagggattccttttccctcggatctgattctgctagacaccaagaatttggatgtgattcttgggatgaattggttggctcaattccagggagtagtggattgcgcgagacgcactgtcactctgtaccgaggaccggaacaaccggttgttttctttgcacccccaacctctgtcagaagttcaaaactgcatcaaatagaactatcagaaatccccattgtcagagagttcggagatgtgtttccggaagaactacctggtatgccgcctaagcgagagattgagttccggatagatcttgctcctggaaccactcctctgcacaagcgaccctaccgtatggcagcaaatgaactg

SEQ ID NO: 72697 - DNA, 558 bp, Oryza sativa
aagaatatagaaatatcttttcctatacttctatcatacaaacatattatacataaatgctagttatatcattacttagctaataccttctttccgatgccctcctggtgctttgagaagccacccctattgtcgagttctttacgacaatccgtcatgaccatccaaccggggctaaatacggaggagtaccctccccaggaaattaacttaggcctatatacacgcgcggaggaatacccatactgagctgtcaccatcagtggcccacctcgcttccgcagcatataactccaaataatgatatccagtaatctaaacaccacacttaaattaccaaatacaactctaatatcatcatgacatagtcatcgtaaatacgatcattatgcccacatcattgcatctcccagataagctagcatcataataaatataacttggacatataataaaattagtattcatatactcggaaagtagtacaataccaaagtagtataaagaagaatattctacataaagtacaagtcttacaaaagaaggaaaagctactag

SEQ ID NO: 72698 - DNA, 12346 bp, Oryza sativa
tgatggattccatccaacgcagctcgtaataaaaatggaagaggtcaaggaaaggcactaccccaatttaggcctcgcaaagatgagagaagatgctcaaaaaggcgatggagttggggttaaactgaagcaaagaaaggccgtagaaattcaagacaagaagaagaaactcggaaggcggaggaagaaaaccacaagaaacataatgttcaattacaaccatgcggtgaaagatgggtttaggttctgtacctctagcctccctctgcatggtcccgcgaccggggagggcaccgtcgtcctgtagcttcttcatggatgcggtgttcgaggaagatttctcaaggtccattgctgccggaggatcgccggagaataggatgaaggaagtgagctagggtttttttttgtggggagcggagaagacgaagagtgctagaaggcaggagagttttcttgcaaacggacttcaaatggatccccaaaatccctttaagtaaacgtgcttccgatggtgcgtattccaaggaaaggagagagattgctgccggaaaattctgggtccgttgcgtggggtagtttttcagacttcaatttaaattcactcatggccgttgaacttcatgcggtgttgtcgatggctctttgtctctacagttttcacaccgagatcgaccagatgagagcgacaacaattccgacatcagaagttgcgatcgataacatgagctcatttaagcagaagtcgggggctactgtcaaggttacggataaggtataccctctatccttggctgtacgttatatactaatacggtatacccacgcgtatatggatagtttccgtattgtcgcgtcccaaaacgaccctaaatttcatcctcaaaattgtgctgagaataattaaaatcaatgtgaaagccttcaacaattaaaatgtgcacagataaaagtcaaatgaggcttggaggatttttgtatatttcctaaaagcctaaaacgtgtaaataaattttagtggaattttcagagcacaaataataattgaaaagaaataaacatagttaaaaaggtttataaaaagaaaatcttaaaagaagttcttttccccccccccttttctcttcttgggccggctcggcccaatccctccctctctctctctcttcccccacggcccatcggctcctccccgcgcgcgccgctgacgggcgggcccgcccgcctgccctcgctgacgggtggggcccacccgtcgtcttcctcctcccgccgcgcccgccgccgcgcccgtgccctagcgccgccgccgccgccaaatccgctcgctcccgccgtccccgcgcgcattaaagagaggggaatcactccccgtgattccctctcccgtttcccccgcttttccctctctctctccctcggattcgtccgatttccttcccgaaaccctcgccggcgcaatcaatggcggccggatcctccgcgaccgattcctccctctccggccgctctttcccttccccggcgctatttaaaccctccccgtgctccgctcttccgtttccgccgctcaccgctcgctctcgccgtcggattcgtgctcgcgccgtgctccgccctctccgccatcgccgccgagttccgttccgccgccgtcgccactccgggcttcctcccggctcggcgccacctccctcggcatcgccgcatccccgtcgaccccgtccgccgatccgcttcgcccgccgaccgtcggagcgtcgtcgtcatcgtcatcccgacccgctccgccgctttcctccgctccggccgccgttctcgtcgtcgtcgttgtcccggggtgagccgaggaccgccgttcgccttcccccttccctcctctctctcgggcgccgctccgccgcgccgatggtcgccggcggtgaccatcggggcgcgggcgcgccgctcccgtcggccgtgccggcgaggccgccttcgggcgcgccctcgcggctgccaggtgggcccggccgtccgccgcccgcgcccgcgggtgcggctgacgcgcgggacccacggcgccgaccgccgccagccgcgtgcgcccggtccaccgtggaccgtggggctgacgcgtgggccccacttcccgtggacccggcccgcgcgcccgctccctcggctgacgcaataaataggattttttttaattaaaaattaaatgaagaaattcgcaaatatccatttaaagagcatataaacttcaaatggccatatcttggccatttgaactcggaattggaccgttcaagtctctaatttttcctcaagatgtaaagaacccatttttgtgctttgtttctgctgttatatggagttatttagtgtttaagccttttcttttccgttggtcgtgtagacgttgcagcttcggaagatccgctcttcgtggaagtcgaagccgacgtttgggaaggcgagcaaggcaagacacatcatcttgatcatattgaatcccagtttataaaattatgttgatttaaattattgcattatcgctttatttaaattcccgcgttatcactgttttatttagccatgcctacttacctttgttatgaccttattattattgtttttgttattaataccttgttcacctagattaaacaaaactccaactagtggaccctctactcatagtaccactagtataattttaggtagatgcttcgcaatttaattaggtaacattaggtggttttataactttagactttgggaaatattcatatcacctggacactttggaatggttggtttattgtggaattggattcacaccatccccctttattcaaaatccccaaaatggttttaggctgggctcgaggtgcatggttttgatagtagcacctcggccatataaggaccggtcttcgggcctctgttgcaaagcactaccgtacttccacatgtctagtgggtaaggcttagtttgtggctcagtctagtcgtaaacagaagtacacggattggagatggatgaagtcgggggtcgatggacattctccagggcaaatgaaggctacacgagctgcggcccggtagtcgagatgtcgaatggcagagggttggtgccctgctgctaggggctcagtcctgcctgcctgtcccgggggttccggccgtaggcgggattgggtcggtactcttgtctatggctaggatgggttggaaactatgtcacgtctttcgtctgtataccgtggtggtatgtggcacgtggttgcacgtgagacagatgtgtcttgtgggtaaagatgtacacctctgatcagagtataatctattcgaatagccgagccctcggatatgggcaagccgagcaatgtacccaagttagtgttttaattcttaaaacctgcttaacaactaaaatatggaatggttggcctgggttggcttgggacgagctgggacccagggtcgggttgccagttcggtctgaatcataataggccttgggttaaggcaggttcgtgtgggttcacggccttgattaataacattgtatagttctagaatcgtgcttatcaaatagctttgagcaactaaacgtctttaaatgctgtttaccgcaaccctaaccctttatattataattcccttgtactcccttgcatttattttgcatctgcgggtgtgtcttgttgagtacggtggttgtactcagtcttgctcaatttttcccaagcccagatgaggagttcctggaagatgaaggctttggtgtctagctcgtgcctgccatcaagtgcctgtggtcgtcgccctagtcttccgctgtttctcgtttgtctttgtgtgttgggccttcgctgcccgtgtaataattatatttacgcttccgtttgttaaactctgaattgtatcaacttttggtgtaccttgcctcctgggacaaggaacaatacacgcacgtcaggaacgcctgttgggtgatttccggtcgtgacaagtatacattaaggaaatctatcacgtgataaggatggtatctacggatggaaggagttctactcggacaagactgggtctttaccatattgtgaggggtccgatatctccaagtcctactaagagatcaactgacccgcggtatatcagggaccccctgggcaggacctaaggtcatcgaatatcaccaccaacacacccaccacagcctacggagccggagcgtgcaggagccaagtcgtcgggtgtcgaggagatgatcctctctagcgggagatcgtgagatcccccttttgtgagttcggccgggggaaagggctcgcctctcgagattgcgtatccgccttgaatgctcctaaatcgcatgcgaacgccaagattacacaggttcgggccgctatcgagcgtaataccctactcctgtgtgtgggactagtggttgaatgttacaagggatcctaactccggagagcgttcttgctcttcgctttcctagagttcaggtctactgagtgtcgtcccctttctcggtaggcaaggtcctccttttatagttcaaggggataccacatgcaccgcctctactctactcttccatgggagggcgacccactttaccttgaccgggtcatgacccgtgccttcgcctggaggctaagcagcagtccgtccttgagcaggacacagcgccaccccccacctgacacggggaacagccctgtcattccctcataaatgggtgaagacttgtggtggtcgtcctctcacggagggaactccgaatgacactccgatgggacgggacatacctacctccactccgccggatacagaggcgacgtgggggcacggccacccgtccaatcggacgtgaccggcaataggccggtcacagactggtcccgcctgattgacgtgggttagtcaggcggcaccgcacgtctgcccctaccgcattaaacgcggtgagggacagttggggcgtcacgcattgatggctgttcagcctgggtcgcctccccgctcgctccccccaccaaatggcggttgggcgagggcctcggggcgaggcagcgcgagggcccgaggggcatgacgtggcaccccgaggccccccggccgcttctgccactcgcgaggtgcgggagtaaggccaagctgtagagccacgcggctagatgggaaggtaacttcccctcactttgtatacccccgggaccatatctccgacagtagcccccggtaccgcgtcgaacattggcccccaaaggacagtctgacgtggcgcctcacgacttcccgtgctgtggttgtgggcccggcggggaattcagagggttgtcggcgagcggccaggctggcgctttagccagaatggtgatttgaccaccattaaccacgctgatgctgggggtgcctagggcgcgaaaatcggggggtcggctagaccacgtccagaatcgtcacccacgccgcctcgactccctcacctgctaggcacgtgatgggaccgatggtgggcccgcctaaccgcgcccgtgaacatcgcacgccccgcgccgagtgtgccgatgacaggcgcactaaatgcggggcgcgggttcagtggggtggtgtgatgggtggacgcgagagtcgagaaggcaaccgcagacgcgggaatcgagggggcagccgcaagggcgtgaaacgaggaggcgagcgcgggcgaggcggggagctggggataaaagggcagggagggagagagttcgtctccttcctctcgccgactgctcacccgcatactcgctcctcaagccctaacgcttctctcgctccacgctgttccatacaccatactcctcgccgttttcccgccggctaccacgggccaagacgctggtgacgctgtgctcccggctttacgcatcacggcagagaggtaccttagcctcacccgcaagatcatgccggaggacgccgccgtgagggtgggggagtcgcaaccgcggccgcggtacccagagcgatccgtgcacctcctgtccttcgccatggtggggttgataccgccattttccatccacggatcgaggtccttgaccgcaaccagcgcgaacaggatgggcaccgccgggaacaggcgtagcaggcccgggagctagaggagcatgctcgggtgctagaggagcgtacccaggcactggagaagcgggcgtgcatgctagaccagcgtgagaccactttggccgcccacgagagaacggcggctgaggcggagtcctccctccgcctccatgaggaggccgcagccgatcgcaaccggaccaccctcaccgctgttaacgaccaactttggtaatatcagcatcggagatgaagatggatcgaagcggaatcgaagataagggttgttgcggaaacagagtaagaatcggctggagtccggatcggctacgattgggatcggctaagtctgagtcagactaggttaagtgatgtagccgattccaataatacgacttgcgtacgacaacgggttcgaattgatgtgcttcaagatgattgccacgcatggatagagtcctgggaaggcaattgtatctattaattaggatattttatgtaaattccttagagataaatgtgggcaaaagtctgccacaaagacttatggtatcttagagtttgttagggataagagtcgtgtccaatatggacatatcttataattcttgggtataaataggccccgagccctatgtaatggataacacacacgttcaatacaattttggcgcatcaccaccctttttgctttagttttatttcgacaagttcttgctttcgggttgagctgcatgggtttcgatcttcaacaaaaggtaaaacttgttatggcggtttgtgttctcgagattagtgcttccatccttatgatactctagtcttgtttacgtaattcgtcgagttatcatatatcttgcataatccttgacgatatcatcatctaacctacaatcggctaacatctgttaccagaaggcagccgattaggttaaataacgacgttggcttagattatatgagatatccaccactctatgaaacatccagcggcttgattgtctagatattgttcttcttttcatacttaatgctgtatcagttgagtttgatctattaagtcgtgcttagaatttcaatacatgctagatctatttgatcggctatgctatgaatatatatatataatctcattaataatatatatttcgatttaagtgatttatactgtctcggcaaggtgaccgatctatcccaatcacttgattcaagtatatatcgatataaggattatatattattgatgtctacagccgattgagtagatttagttctgatttgtttacttaacacttgccgatcgatttacatatgacatcggctcaaagataaatgatatgttattggcatttagccgatcggctatcatttatggatttaattacggtttctttgtctttgtttcttgttgattgcaggatcaaatcaactggcatgctcacacatctgaaggcgagttttggacctgcactggagttaagtagatctcccaggcctcgtgttttctgtcaacacgcttttggcacgcccagtgggaccgattagaagtcagaaggcagcttccctcatggctgagaaaccttgtcgcgactgagaaaatttcattttcccgaatgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacgggtccatcttcacaggcgctcaactggggtataagccaagactccacctaagacttcttctccaaagcttctcttactgaaggggggagaaagatagagcaagaatgagtacaaccacagtactcagcaagccacaccggagatgcataattaatgcaaggggtacaaggggataataatatagaggttaagttttgcagtaaacaacatttaaaagtcacttagttgcccaaagctattttgtaaacacgatcctaaagctacacagtattattaatcaaggtcgtgaacccacatgaacctgccttaacccaaggcctatgatgattcagaccgaactggcaacccgaccctgggtcccagctcgtcccaagccaacccaggccaaccattccacattttagttgttaagaaggttttaagaattaaaacactaacttgggtacattgctcggctagcccataaccgagggcgcggctattcgaatagattatactctgatcagaggtgtacaactttacccacaagacacatcttcctcacgtgcaaccacgtgccacataccaccacggtatacagacggaagacgtgacatagtttccaacccatcctagccatagacaagagtaccgacccaatcccacctatggccggaacctccgggacaggtaggcaggattgagcccctagcagcaggacaccagccctgtgccgtgacatctcgactaccgggccgcagctcgtgtagccttcatttatccttgagatgtccatcgacccccgacttcgtccatctccatccgtgtacttttgtttattaccaggctgagccacaaactaagccttacccactagacatgtggaagtacggtagtgctttgcaacagaggcccgaagaccggtccttatatggccgaggtgctactatcaaaaccatgcaccccgagcccagcctaaaaccatcttggggattttgaatagaaggagcggtgtgaatccaattccacaataatccaacaattccaaagtgtccagatgatatgaagattcccaaagtctagagttggaaaaccacctaatgttacctaattaaatagcgaagcatctacctaaaatcatactagtgataccatgagtagggtgtccactagttggggttttgtttattctagggtgaacaaggaaataataacaataacaatattaaggtcataacaaaggtaaataggcatggctaaataaagcagtgataacgcgggaatttaaataaagtgataatgcaataatttaaatcaacataattttacaaaataggattcaatatgttcaaagatgatgtgacttgccttgctcgctttcccaaacgccggcttcaacttccacgaagagcggatcttccgaagctgcagcgtctacacgaccaacagaaaagaaaaggcttttactctaataaactccaaatgacaagcaggaacaaagcacaaaaatgggttcttgacttcttaaggaaaaattagagatttgaacggtccaattccgagttcaaatggccaagttatggccatttgaagtttatatgctctttaaatgaatatttgcgaatttcttcatttaaattttaatttaaaattggatttattgcgtcagccgaggggaggagcgcgcggaccgggtccacgggagtggggcccatgcggcagcctcacggtccacggtggaccgggtgcacgcggcgtacgccggccggcgccgtggttcccacgcgtcagccgcacccgagggcgcgggcggctgacggccgggccccacatggcagccgcgggacgcgcccgaaggcggccacgccggcacaaccgacaggaggcggcgcacccgcgccccgatggtcgccgccggcgaccaccggcgcggcggagcggcgcccgagagaggggagggaagggggaagcgaaacagcggtccacggctcaccccgggtcgacggcgacgacgggaacagcgatcggagcggaggaaggcggcggcgtggctcgggtcgacggggacggcggcgttccggcggtcggcgggcgaaacggaggggtggacggggtcggcgaggttgcggcgaacccgaagaaggcgacgccgaagcgggagaaggtccggggcgacgacggcggcggaccggaactcggcggtgacggcgaacagagagagcgacggcgcgagctggattccggcggagagagagagcggcgagtggtggaaacggcagagggaggcacggggagtgtttatatagggttgggagggggagagagcggccggatgagggggaatcggccgcggaagatccggccgccattgatgcgccggcgaggtttagggggaaacgttttcgaacgaatccgagggagagagagagggaaaagtggggggaaagagggagggaatcacggggaatatttcccccctcttgattgcacacggggcggacgggagcggcgggattcgcagcggcggcggcgctagggcacaggcgaggcggcgggagcggcgggaggaaggggatgacgggtgggccccacccgtcagcgagggtggcgggcgggcccgtccgtcagcggcacgcgcgcgcggggaggaggccggatgggccgcgggggagaggagagagagggagggaggtgggccgagccagcccaagaggggaaagactttttagggtttttctttttataaaatcattttaactttttttatttcttcttaattattatttgtgctctgaaaattccactaaaatttgagggctccttttagaccaaggagaatttaacaaaaattctccgggccacatttgaatttttcttgtacgtattttagtgtttgccaatttcttttcgaattttaattaattctattattccttttagaaaatgatttttatttcgggatgaatttatcaggacgtgacaaaccaccactgtcaccgtcgtcggccagcctgagtaatgttaaggaaaagatccagaagctcggtttgactgacgtccatgaaggaaacgttgtgcccattgatccagagaagttcactcccgaacagaaggaagacttcaatgcaatgatgcaacaagcacaagatcaatttttaagttcattcatgcagactcgcaagggcacatttgttcagaagtacaaggtgaaggtggttcttgaggatcctgggatcggttcttctaaagagggagaaaagaaacaagttccagacggatcagcccagccgagtgacaaaggcgttacagatgggtcgacccaggagaaccagggtgactacttccatggagtacatggagttcaaggtgacggcactcagggaccacaagggggaaatcttaatcagaatgacaatgcattccaagattttttcaataactttcaagatcgagttgactatgttgtgtatagtgctttgattaatcaatctggagtgttgactaataccttgtcaaatataatgaaatcggtagccgatggttcaatagctgaacatcaggctgcaggcccagtttatttgcaagggggtacttttccaaattattgaactttgatcaccgatgttcatccacttactcagggaattcctcctgttgcatcatcagctcagccgatggcaccagcatcagctccagcacctgcagcgccgtcgtcggctccaggccaattaatcaatcgtcaattattggtaagagagcaatctcagcatcctagaccgaatgtgactcagctaacacaagaccagattgcatctaggtgtttctacctcctcagaatgctgttaattcagctcagcagcagccgattcagcaaacaccgcccaggcaacaggttgtgcagcctattcaacaaacatctccaatccagcaggtcgtgcaaccagttcagcagacgccagcaaggcgactggctttacagccgattcagcagacgccgttgagacagtaggtcgttcagccgattcagcagcaaggctcaatgaatgtgttgcctggatttgcaacacctggtggtcagcctgtgcagtacactacaaatcaggttgtcccggaacacctggttcatcatgtgcaaccagatggttcagtggtacctcaagttattcctgagcatttggcgcgtggtactcagccaaaccttcacaattaccaggggggcaatttgagttatgaatatcagcctccatcacctcaagttcagtaccaacaggcaggatcggttcaacctcaatttgttcatcaatacaatcagtttgagctgtcgcgtcccaaaacgactctaaaatacatcctcaaaattatgcatagaataagtaaaatccatgtgaaagcctccaacaattaaaatgtgcaaagttaaaagtcgaataaggcttggaggatttttgtatatttcctaaaagcctaaaatgcgtaaataaat

SEQ ID NO: 72699 - DNA, 2161 bp, Oryza sativa
  unsure (1)..(2161): unsure at all n locations
tttcaccaaatgttgtaaatatcccggtatagaatgaaagagtggtggcgggtatatcgaactcaaaaggagtggcgtcttttatttttcgtttttaagggggaatcggtatctatatcgaacttttttttccgtttttgagagggaatcggataggagtcgaacttttttttattatttttttcgctttttttttctttcatccgtttttttgatcggacaattatttttgggaatcagacaaattcattttttccccgatttttcttttaccgcgtcatatttggtttttcttttcttttttcgcacgttttcttccgcccggtttttttggatcggacaattttagtttttttcgccggtcttttctcgcccctttttctggataggacagatttgcagatttagtttttctttttttcgcacgttttcttttgcccggtttttttatcggacaattttggttttttttcgccggtttttttgcctcttttttctggacgttttctttcgctcagttttttagatcggataaatttggtttttttcgcccgatttttttgacggacaatggaagcacctcttatgttttaagtagtagagatagagatatgttaattttgattaatccagatcgaattaattaacatatttaaatatatgtaatgcatgccacgtactgcagattatnggacggtttggattatcatcagcacaaaaaaatgcctactgcagctctacttctccacaacaacgaaagcatgcgaatacactactgcgtcgatttagggacaaaattatccaaacctggaggtaacaagttttttttttcactattcaaattaagatgaaaattgagggtgacacttaatttgcacgtttacttcaagcaaatgtttatatatatgtaactaccccatctacacattatatatagttacttataatatgtgtttacgtcacttataaacattgttacatttacttttaaagaattatatatatatatatatatatatatatatatatatatatatatatatatatatatatatatataagatgaatacaatgaaaaaagacaatactagtaactattcaaatggagttgaaaaaaacaatgcaagcatcatctacacctgatcatcgacatgaaaggaacggccgtgaaacaggaaactaacatgactatagaattaacatactttagagcaacttgcatgttttgtgttctgaggaagaattaagtagtcactcgaattgttaattaatttttctagtaataaatagaaattaatccggtatgtagacaactaaagtttaaggaaaaaaatttaaattccagtcctcacaactgagaaaaattacagataatttatttagagtgtatatgcacttgtactagtaattaatttgcgtctgtcttttttttttttgaattgaaggcatgaagaaacacgtgagatgatactgaatgtctctgcaatgctgggtttggttgctgtcgtcgccgtcgtcggatgcattatgaagccccactttgaggcccagctagagaagcttgcccaagcttttgttttgttgtttctactggctctacttcaagcaatggtagaaatgcaaaaggaacgacggcaaaagagcctagaagatgatcatgctgatgattctgaagagagcaagaagaagctgaagccaacaaaaacttagaaacttttagtagaacaagttttacattgtgcaaccatgcatgcacataggatcaaaataattatgtatacaggccggggagtagtggattattccagcaatctacatttttgttttgagaaacacagtataaatataggcgctcacaacatgtataagttcacatctataaacatacacatatatacacaccataccccgttacaagatatacaactttttaccaacagtgattaagtaataaacccacggtttcaaaaacattgtaggtgattgtcaagttgatgataatgtagttggttattttatagtctcctatagtctttttctgatctccaataatataggttgttccgttacttgttgaaaacggaatacctaagtgcaacggattagttgacagacaaattttgattagctcgtattatatcatacactttccgttatcggt

SEQ ID NO: 72700 - DNA, 825 bp, Oryza sativa
  unsure (1)..(825): unsure at all n locations
catctagggtttctaggggagccatctatttctttttctctatttctctcactctattagggatccaacgtgtttggaactggtgagtttatatatgtccttggctaaaaattttccccgcactctgatctgtagtgcatacctcatgacaccacaacaacgacacggggtcgcttttacccttaaggcggacgccataggctcgagactgaggcggcgggacaccctaaaagtcgctgaccgccacattgttttcgcgacgccacggttaataaccatggtgcaacatcctccaatgtaataacaagattaacactgaattgactccacaatgctactatttgttttaaccattcaaaactgaaaaaaaaaacgttgtgccagaggcagtaaatatttacctcctcaatccaagttccaaactcggatcatgcctgatctttgaatactgtgcagaataggcagaagagctacaattccttttatgtgttagtccaaaccgttgaagaacatccctcacatataatcccctctttgcgaccggattgtagccttctccaatctgtcatttaaaacatcatgcacgtatatacgatcaaagggagtgtaatttgggcttattattaatttgatttgggatcgtatataccaatatatgtagttaaaattagggtataatttgttagcagtaatcttgtgtgccacggttagttagttgattagttatctgcatgtttccgttttttttctgaataaacgcatggggtaccgagctagaattcgccctatagtgaatcgantagttcatcaaanggggggcccacg

SEQ ID NO: 72701 - DNA, 1174 bp, Oryza sativa
  unsure (1)..(1174): unsure at all n locations
cctcggcccatcagggcccgatagtgaacgcgatatataataacaccttctcccacgcggctcactcctcacccttctcgcgaaaaccctaaccccgccgccgccgccgctcttggccacaaggtaggcggcgccgccgttgctcttcttgttcctccgcgtcagtgcgccggcggtcgctaatcgtgctgagaacgcttgttttccttgttgcagatcgtttcgtcgcagtcggtgttccggtcttttgagcgcggagatggcgtaagttcttgcaaccaacttcttcttggcctctgctagttccatgttttttctctctctatcctcgtagcattttggatctagcctgttcttgctgttgctgctgttggtagaacactgttattactgtgtaattgttgctgagccttggctgcgctactgctcgctcaagaatcgtttggtcttatcatgtttgagttgtccttgattggggaaattgtcatttggtttccatttcgatgggatcattgagtgaaaggatgtgggagtcatgagtgcgattgctcggatttctgctgtactggtatggggtcttggtgatttagaatttggcagctggtagtatagttggtggattcgttgtatgtgagccgtctagtttagcaaatacaatcatgattcatatcagatgatatgtgcctgttctgtactagcaccaaggagtgtagacggtaaattcacagccagattgaaaaaaaaagctcaattgcttatcaaactatgtttatatggaattgaattatccaacttaattgtcttgtttgcatccaagaagtactgaatttgtacagtgtcaccagtagtgagaaacaatgcattttttatattatgggtgctcaattcttgtataaatgtaacaccacgtacatgccaaagtatttggacctccattattgaaagagcagtcaaattagaagagaactaaaaataccttgtaaagtgtattactagtaattgttaatagatgggtatcctgcntctcggtctaaaaaacatctcacgtatttgtagcgagcctattcataaaaaaaagaggtctnncctcttttacagaaggtccctctnnngtcgncctgcgnccggtctttctcnncattnttggtgtgctaacaaaggggggtactttacc

SEQ ID NO: 72702 - DNA, 2042 bp, Oryza sativa
tcctgaggaaccacgggcgcgggctcggtacgaggggtctcgacgaagcaagtccatgccagggactgacgaacaagctcgggcctggaggtactcttgcgggcggtgatcttcaggctgcggcagacgcggcagcgcttgggcgacagacctctccctaggcgatcttgagctgacacagctgcgcctcccctgcgtctaggtccttcttcagctgcagattctcctgacgtagctccaggatcttcatgttgttctcgaccaacccacggcgcaccatctgatggaagtcgatacgagccacatcgtacgcctccacgatgcgcgctaggtgcatgatggtagcgtcatcctccgagctagcatccctgaaggtggcgtagtcgcgggctcctccgcgacgagggtggtagcggtagggcgagtgctgcaactgatccgggtagcgctggtgaagagtgccgatggtgaggagagcggcgttctggcaagcggcggggaaagaatctccacccggggtgactgccagcgaagtccgctcgggagagccagagaggatcactgcggtgacctcccaaccagcgtggggctctgcatggtcaccctcctgctccggaagcggcctggcctggtagtccactccatgtggataccccaggacaacgcacatgccccgcagctccaagacaaagccagtcatgtccaaaccacgacgggtgattgtggggtcccaaaaggactctaaaatacatcctcaaaattgtgcatagaataattaaaatccatgtgaaagcctccaacaattaaaatgtgcaaatttaaaagtcgaataaggcttggaggatttttgtatatttcctaaaagcctaaaatgcgtaaataaattttagtggaattttcagagcacaaataataattaagaagaaataaacaaagttaaaatggttttataaaaagaaaaaccctaaaaagtcctttttccccctccccctcttgggccggctcggcccacctccctccctctctctcctctcccccgcggcccaatcggcctcctccccgcgcgcgtgccgctgacgggcaggcccgcccgccaccctcgctgacgggtggggcccacccgtcatcccctaccttccgccgcccccgccgcctcgcccgtgccctagcgccgccgccgccgcgaatcccgccgctcccgtccgtcccgcgcgcaatcaagaggggggaaatattccccgtgattccctccctctttcccccccgtttttccctctctctctccctcggattcgttcgaaatctttccccctaaacctcgccggcgcatcattggcggccggatcttccgcggccgattcccccacatccggccgctctctccccctcccaaccctatataaacactccccgtgcctccctccgccgtttccgccactcgccgctctctctccccgtcggaatcgagttcgcaccgtcattctctctctccgccatcgccgccgagctccggtccaccgctgtcgtcgccccgggaccttctcccgcttcgacgttgccttcttcgggttcgccgcaacctcgccgacctcgtccacccctccgtttcgcccgccgaccgtcggaacgccgccgtccccgtcaacccgtgccgcgccgctgccttcctccgttccggtcgccgttcccgtcgtcgccgtcgacccggggtgagccgtggaccgcccatttcgtttcccccttccctcccctctctcggccgccgctccgccgtgcctatggccgccgccagcgaccataggggcgcgggcgcgccacctcccgtcgactgtgccggcgaggccgctttcgggcgcgccccgcggctgccatgtggggcccggccgtcagccgcccgcgtgtcacaccctaaaaattgaaaaaaatataaattgttgtttaaatggaatttctagaatttattttaaaagtcttgaaaagaaaatctaattttaattaataaattccaatataaaatggggccagataaaatttcattaaat

SEQ ID NO: 72703 - DNA, 1064 bp, Oryza sativa
aggggttgattagggtgtgaccaccccccaaaagggggaaaattgtggcacgacaaactcccaatttttccatcccagtgttccattttcaatcaaacttccaattgaagcgtaacttaacacaccggtacccaaagcataccacagattaattcctaaagattggacagacacgagcaactcagtcatacgcaaaccacaccaaatggcaaacagatcctcagcttcggatgatgatttgtattaaaagcagacgattttcagcacggtaaacataaatccagaggttcaattttgctcatatctcaatggctcgcacttaaaagaattcttatctcctagcaagacctagtctcaagcataaattaaagcaaaaggtacagaatgtcgagcacacgttctgggataaacaaaataagcccttgtttagttctagctttttcgtcacatcaaacgtttctacacacacaaacttataacttttccggcacatcattccaatttttttgaactttcaattttagcgtggaactaaacatagcctaactatttatgtgaataaaacagaaagaaacgcaagaatttataggcctggtttagttcttactcctgctgaatgaagaggactttcattgccttatgatatcgttgtctgcgtacacacccaggtctccagctccatccttcacagccttgctggccttcacagtgagcacgcgagggcgaagaagaagatgaaggcgcctccacgacggacatgtcggcgggggtggccacccgcggcatggtggaaccatcgccccggtagatccttgccaggcgagccaaagcgatgtgggccctttgggatcccaccatgacgcgtcgaagcgccacggccaccccgacgatcttggcgcgcacggcggcgaggacggtcgacttgccggtggcggtggcgaggcccctgctgcaaacggcagcgagggcggtccactttgcggcggtggcggaggcggcggttgcgaggcccctgctgcagacggcggcgagggcggtcgactttgggccggttgcggcggcgg

SEQ ID NO: 72704 - DNA, 1301 bp, Oryza sativa
  unsure (1)..(1301): unsure at all n locations
attctaaaatttttctttcggtcactactgcaataacaactttttctcacagccaaaacaggtttttttgggcagtcagcggcgccgccaacgacctaagattagtgaaaataataaacttttgctgatgagcagccggccgccagcgaaaatcaactttgacaagtggctaagggaaaaaggtcgcatatgaaaaagtgattttcgctgatggtagctagagagacccaccatcgagaatgtttttaggagaaaaaatattaaaaatcaggatccactatcactgtctcaaattcccaatccccaaatccacacgtcttggtcgatgaaaaagtcgacgtcgtcgatggcggtgtcgccaaatgggtggaagacgccctttcgggagccgccgagatcaccgctgccggttcaaagaaaggaggtcaggccagctcagatctggtcgggaaagatgaggaaggaggtcttggtcgatttctctaagccatttgtcttattatcgctaacctgtagccaccagcagattcagagatcccaaagaccagcaccactggaactagagctctcgatgcctaccaccactggatccacaagctagggactcccttgctctactactaccgccctcccctttcgccgtgtggttgagctcttctcgagtagggattgatggtggaggcagcactccccttcaaccgccatagacgaacttgtcatcaccggatcaggtgtcntgctcctccaccatcactactttctccttgccaccgctgagcccgccacggttcccctttccactgcgaagcctggccgttgttggtccttcctccaccatgaagtctcctccctatgctgccaccaccgagcccagccatggcttttcttgccgccgtcgccgccatcaagccatcgaagcaagagagggagaggagaggaaatggatgagggaggggatatctaggaagtggttgaggaagtggctgatggaaaagaaaaagagatagttgagggatgggataaggacgacttgatccacacgcccttctcctatgatctttttgttggtggtaacccttagactccgctagtaaaaatggattttcatatgtggggttatttttttcaagtagtgctcttaagactctgcttgtggaaatccatttttattggtgggaccaagttttcaggtctgtttttattttacaagcgaggttttttatggccgctagtgaaaataaatcttaagggtcatgaaagatccttattttttttaagtagtagtggctgcacacgtgcat

SEQ ID NO: 72705 - DNA, 6535 bp, Oryza sativa
ttataccccagttgagctgcctgtgggagtggagccggagcttcgctagattttattttccgctgcagttttcttcttggtgaggactaagtgcctcttaagtaagtatttatcgttttagttaatttgatgaatctgtatattaaattgtcagtttgtgtacctcggctgattcctggacgaggattttatgcacaaataagttcggaaattactagtgaatttccgggcgtgacaccagggctacacctaatcctccacaccatcagcatcattgtagaactcttcctctgatgaatgactgcaaggtgagtatatgacatactcagcaagccacgcagcaaatatgcaagtgcataaggataccaaaggatggcatagtagggtttcatttgcataaacaacatttaataaacatttcagaatttaataaaacagttaagtaataattaaacaatattaatccaacgctatacaacataccctgttatataggcccaaccattctgaacaaccatcccggctgcacagttctatctccaaaccaggaatataccattccaaaccaggagctaatcaaattattaccagttatagcatcttttattgtgatgagaggtgtgagactaatcacgaaagacattgttagacccgcccataaccgcgggcacggctattcgaatagttttactctgaccagaggtgtaccactgtacccacaagacacagccccacatcatgtcaccatgtgcctcaataccaccacggtacctcggaaaggagctgtgacaataccccttgcataacacaatccaccgcagcgcaccattcctggatcataatcacccccttataaacaaggcatggactccccagcgacccccgtgggattatctccgccacttctcagtctggtgctccgcaatgaaccatgctatacaaaaggtaaagccgttgcccacgatggcttgtggttggcacggttaatgtttcacaaccgaaactcgtgaaccggtccttaattgccatgctagctcacaacccaccattatcaagttttagttggcaagtaattaattaaccaatcacgattgaccatcgtgaactagcattaagccatcattaaataatgaatcataagttatcctaatagtgtgctaatgtttctaagcatggctaagcaatcacatctaatatctagtcgaaccaatatatatagcccaactagtcaagttaaaataacccaaggtatcaaggaataaaggaaccaataacaaaaagggctataacaaacaatagtttaattccacccaatgacattcgaaaataaatgcaatagttgaatgaaaacaatagctttaaacgggatcaacatgctcaaagggttgtttgggatctgtgtgacttgccttgctggccttggaactcttcaaattcttctcctgcgaaaacggactctccggaaacgtcagaatctaaacagaaaagagcaaaaacaccaaaacagcacataaacaagcatgaaaagtacatgtggatatttttaacatgtagatctcaattttagaaaaatttagagacttgaaccaactaaatcccgagctaagatgaattagttatgaatttttaaagattaaatcggattaaaacacttatatggattttaattgaattatgacgcaataacgaattatttttgaaaaggaaaaagggtttattgcgtcagcaactagggtttgcggtggaccgggcgcacagcagcggttcacgggaacggacggccgagatcgatcctatccaaaacgaacggccgagatcaagatccacggccgggccatggcagacggccacgatgacgtcagcggcgacgtcatctcctgcggcggctcgggagcacttgctcgccggcgaacgacggcgcgaggacgcgaacggagggcaccagcacatagagaacgtcgcggcgaactcaccgatgaccaaaacgacggcggaagatcaacggacggcggcggcgcgagtaaaaaggcggcggcactcttcggcttgacgacggcgacggtgctccggcggtcttcagcgacggcgaaggggcggacgaggacggcggtgacttggcgaccacgatggcgacctccccgagcgacgacgacgaccggaatggcggcggcgcacggctggagcgtcggcgacgacggcggctcgaggttacacggcgctagggcgcttccgacggcgagagacgaaggcgagggtggcggcgggtagaggagacaccggggatccttttatagcggcaaggaggcggcggcgaaggcccacggcgaccggcgacgcgaaggaaacaacggggtttggaggaaagagaccgatccgattcgaccccgaatccacgaatttccaaatgattttagccggtgattccaaaagagaaaaggtagaggagatctcgggaaacatttcccctcaatcgatttcaccggagaaggaaaggcgcggccgaatttggaaggagacggcggcggcgcggcgctagggtttcgggcggcggccgacgtgaggaagacgacgactccgacaagtgggccccacctgtcagtgaccggacgcgcgcgcgcggcggctgcggactggactgggccgactgggccgagggagagagagagaggtttttgggccgactttcggcccaaagccaatagagacttttaaaaacctttttcaatttaaattattcatgaaatgcaattccatttattaaaaatacttccttagctcaaataaatcccagaaaaatctaggaattatagaataaagcaaagtatttaatgaaattttatctggccccattttatataggaatttattaattaaaattagatcttctcttctaggcttttaaaataaactctaataattccatttttagggtgtgacatcccccgacggcccggtgcccgtagccccaaaccctcgggagggtcccgaggcccccgtgggaggaagagaggctctggcgggtggccccgaggcctataatcccgatatggcccgagatcctgtcacaccctaaaaatcctaaatatataaattgtagtttaattggaattattagaatttattttaaatagcctagaagagaagatctagttttaattaataaattccaatataaaatggggccagataaaatttcattaaatactttgcttaattctataattcctagatttttctgggatttatttgagctaaggaagtatttttaataaatggagttgcatttcatgaataatttaaattgaaaaaggtttttaaaagtcttcttttggctttgggccgaaagtcggcccaaaacccctctctctctctccctcggcccagtcggcccagtccggcagcagccgcccgcccgcgcgtccttttgctgacaggtggggcccacctgtcagtcttcgtcttcctcgcgccgctgccgccgcccgagccctagcgccgcgccgccatcatctccttccaaattcggccgcgcctttccgtttccggtgaaatcaacagaggggaaatgatcttcgggatctcctctaccttttctcttttggaatcgtcggctaaaatcgttcggaaatccgtggattcgatctcgaatcggcttcgtctctctccccgaaccctagaccttccttcgccgttgccggtcgccgtggcctccgacgctacctcctagcccctataaaaggacccccaagcccgccgctacccgccgccaccctcgccttcacctctcgtcgccggtagagccctagcatcgtgtagcctagcgccgccgtcgccgccgcagctccatccgtgcgccgccgtcgctccagtcgtcgtcgctgctcggggaggtcgccttcgtggtcaccaagccgtcaccgatctcgtccacccctccgccgtcgccgtaggtcgccggagcaccgccgtcgtcgttaagccgaaggttgccgccgcttcttcctcgacgccgttgatcttccgccgttgttttggtcaccggtaagttcgccgcattgccatctacgagttggtgtcctccgttcgcgtcgtcgcaccgtcgttcgccggcgagcttgccgcccgagccgccgccggtgatgacgtcatcgccgacgtcatcgttgtcgtccgtcgtagaccggtcgtagaccgttagatcttggccgttcgttgtggataggatcgatctcggccgttcgtttccgtgagctgccgccgtgcaccaggtccaccgtgaaccctagccgctgacgcaataattcccttttccttttcaaaaataattcattattgcatcataattcaattaaaatccatataagtgttttaatccgatttaatctttaaaaattcataactaattcatcttagctcggatttagttggttcaagtctctaaatttttctaaaattgagatctacatgttaaaaatatccacatatactgttcatgcttgtttatgttctgttttggggtttttgctcttttctgtttaggttccgacgttttcggagagtctgagtttgtaggagaagattttgaagagttccaaggccaccacggcacggcacacagatcccaaacaaccctttgagcatgttgatcccgtttaaagctattgtttctattcaactactgcatttattttcaaatgtcattgggtggaattaacctattgtttgttatagcccttttgttcttgattactttattccttgataccttgggttattataacttgactagttgggctatatatagtggttcagctagatattagatatgattgcttagccatgcttagaaacattagcacactattgggataacttgtgactcactattacttaatgatggcttaatgatagttcacaatggtcaatcgtgattggttaattaattacttgccaactaaaacttgataatggtgggttgtgagcacatggttttgagagttgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagggggtgattatgatccaggaacggtgcactgtggtggattgtgttgtgcaaggggtactgtcacagctcctttccgaggtaccgtggtggtattgaggcacatggtgacatgttgtggggctatgtcttgtgggtacagtggtacacctctggccagagtaaaactattcgaatagccgtgcccgcggttatgggcgggtctaacaatgtctttcgtgattagtttcacacttctcatcataataaaagatactataactggtaataatttgattagctcctggtttggaatggtatattcctggtgtggagatagaactgtgcagccaggatggttgttcagaatggttgggcctatgcaacagggtatgttgtatagcgttggattaatgttgtttaattattacctaactgttttattaaattctgaaatgtttcataaatgctgtttatgcaaatgaaaccctactatgccatcctttgttatcctgtgcacttgcatatttgctgcgtggcttgctgagtatgtcatatactcaccttgcaatcattcatcagaggaggagttctacagtgatgctgatggtgtggaggattaggtgtagccctggtcaagctgcctgtggagtggagtcgtctgcgccgtttatcttatttttttccactgcttggatctttattgattgagaggaactatctacctctgtaatgacattttattcgcttattaattagagtgataattgtactctattatcaatttgttattgtgtgcctcggctgattcctggacgagggttcacacacacgtaagcgtttggaattttggatagaaattccgggcgtgacagatcccccccgaggcccctgagtacgggcgccctaggccagctgcctctgacaacaaggaccggccccaccgaaaagtgcagcgacccgtctactttgtcagcgaggtactccgagacgcgaaaacccgatacccacaggcccagaagatgctttacgcagtcttaatggcctcgaggaaattgcgccactacttccaagcgcatcgggtttttgtcatgacgtcttaccctctcggccaaatcttgcacaatcaagagggtaccggtcgggtcgtaaagtgggccatcgagctcgctgagttcgacctacacttcgaaccacgacacgcgatcaaaagccaggttctggctgacttcatcgcggagtggaccccggtggacgaccatgttccgtccaatgttcccttcctccccggagacggaggaaacccaaacgccgacattcgcgccgggcactgggttatgcacttcgatggctccctcaaccttcaaggtgca

SEQ ID NO: 72706 - DNA, 1586 bp, Oryza sativa
  unsure (1)..(1586): unsure at all n locations
cccttggcttgctctctctctaacacttttgagccttgctttcttgtttcccctctcacccgtgttcgattcggatttggtgtgtgtgtgagagttgtggattcgagtttgggtgagtgcttgtttgttgacttcgtgaagatttgtgagcacttgcatcatctccgggagttctttgcttcatttgttactcttggaggttgaggactccaaagtggctaggtgtcgcccccgagccaccgatctacttgtggttggccgggaaaagtttgtgaaagtcggatctcacctncgaaagggaagagatacccttagtggaaggaagagtgcttagtgcaacctctagaggaaaagggttagctaagacccggctcttagtgagctcctcaacggagtgtagaatcccctcaaggattcaaactntgggaacatcttcgtgagcttcatctttggtgactttacttcctncctctccactagcttagcttgcttaagccgctataggtatagttgctgtttgtgctagcatattcttgtggtaggcaactagatctatgatttactttgctacttgggctgactccgaaaatttttggatatatccgaaaatttcggaaatatctgaaaaatactgcttccgcttttaattgaatttttgaattagcttattcaccccccctctaggcctaattgacactttcaatgtgtattgaactctagccttagtatccggcatgatctctgaacaccctgnacgttgtcttatctccaagcgnactcccggtccatcacggcaaatactctcccggtatcaattcacctacacatgaaacaaacaaagaaccatattctgagaccaagctatccccaacttgactcattgttagcaaacaacagtattacatacggatagtatccatctagaagtcatattcatgagataaactcagatatccaaacaaacaatccgaaaacgaaaccgacatagtgtcggccggtcagaccgcgggctggccggtctgaccacgcgtataccaccggtctgaccggcaaccactacccggtctgaccggtcacataaaataacaacacctgtaatttacctgcaaatgcaatcatctacaaaaccacttcgagaataatattccaaatatcaaaaccaataatctccaatgccaattgttcatcacaaaataataatcaaaaacacctttgattttacaagttcgtggcgccgctgccacccaccccagcacccgacgtcgctgctctccccaagcgccgacgcagcgtngncaccacccacccccagtggccgacgtcggtggtcttccccagcggtcgaccacaacggttgacgccaccggccggcaacaaccccaagccggcaactaacgaaccacctatggcgccggccagcaatgagcatgaactccttcccatggtgctggtgagctcaagcttcgtttcttcggccggaagcttcttcttcgggttgcaggactggcgtgggcgagcttggtccattcaccggcgagctccttcgggtcttccccgtgttacacggggagctcaatccccatggg

SEQ ID NO: 72707 - DNA, 1937 bp, Oryza sativa
  unsure (1)..(1937): unsure at all n locations
caagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaattccaaggaaacggtccttaggtgcaagagcgggaaaccgtacacccggtacgttccccggtccgcgattttggaaattcatttagttcgcaagcaccgacccaggtgtcgggttttccaagtcttttgtaaaacccaagttttacccaagatgtttttttcagattttaagtttgaaggcggccgtcgatactcgtgcagagtgcacgatttccgaggcgcaactgggtggttacaagggaacatggtataacaattaacaaaggaaggatcaaatgcaacaaattaggtaggtccgtcaatctgccttgcagacgggacaagcagattaagtgcgatcctatcaatgcataataatctttcaagcaacataattaagttcaaatataggctcaagatattcaaaggtggcttgccttgctcgagatctggagcttgatcctcgaaatcctcgcactgcgggtcttcgggctccgaaactatacgcaaaacgggacaactcaacaaacggcgaaaataaagccctattaatgacctctaagcgtgccattagatagatctcgagatttgaggaattttggaagttgaacggagtcaaacggacttacggttgggaagatattgaatttataagattattggatttttggtctaaaggaaaaggatttacttaaatcctttttttgaaaaagaaaagaaaagaaaagaaggagggggaaaattagacttccctcgggaggctagggcgcggcccgagagaaaaggggcggctcggccgagctaaatgggccggccggcccaacaaggcggcccaaagcgcgcgcgcggcgggggagaaaagagggagccggtggaccgggctcacctcgcgtggtcccgagtgggacccgcttgttggtgacacggttcaccgtgcggaacgcgcacgcggcgcccgctagggtttgggggaggnacccggtgcacgcgcgcggttcgcggaggacgcggatgcggcgggcccacgcgcagcctcacggctcgcggtggaccgcgcccgcgagtggggccgaggggagcggctgaccggggtcggctcgacccggtcttggccgagctggcgccgacgtggctgccacacgggccggcgggaggtagacgacgacgccggccggaacggacggcggacgacagcggcgagcggcggagcgaaccacggcgatacaggcgaaaacgagcacaccgggtggttgcacgggacgagagaagtcgagccaacggctcggattcgccgaagggagctcgacggcggcggattgcggcggcggcaaccggcggagagaaaagggtaaaacgtcgacgaggtcacgaggggccgattcctggcggcgagagcttctacgcggctacgggaatccgtcccttgcgccggattaggaggaaacgcatcgagggaggccggcgacgagaggcgcttccgagcttgggcggcgacggcggcgagcacacggcgagcggcggcaacggtcggggcggcgccggctagctacggggaggctactcgtgctactacccgagtctaaggggaggaggtggaacgaggaggaagaacggagggaggcactaccgtgcgggtgggcgcagtgacgagagccgacggcacgaaacgtgatcgtttcggcctctggccgaggaagaggagggggaggg

SEQ ID NO: 72708 - DNA, 817 bp, Oryza sativa
  unsure (1)..(817): unsure at all n locations
cgcatgtgnnnaaggatagaatatcaatcctttgaggccgccactatagnaatacctgaagcgttggctgcgctgcaggatcgacttctaggatggactccccttagcttcagcgccaatacgggcccatttgtgtgcatggcttttctagtttggggccacatttttcatcttctgtgtcacatattggaacctttcgttttgatatcgctccttaagaaaatactccagagtttttgcagaggtcccatttgaatcacacaatcacgactttctaattagaaattttacagtacttaagaaaatacatgagatacctaaattttacactaaaagatttggtacctcgagatacctagcacgtaaaggtatgaaattttatactttaaaatatggtatttccctgcactttttaaaggatgataaaattacccttctaatcaacttagctcgatcattttctgttaaaaacgtagctgtatcattaattatttagctcaacacaacctattgctctccatataaagtatattctctgcgtcaaaaataattaaatgacgttagttttcttttactatttctaggtgcaaatttaatcatgacttttttggaataaactcataaaatctaattatcttatgagattacgaaaatacctggnagtctatattttttatgttttcaaactaaagggatttaaaagatttgttgatcgtcaaactctggaaagtttggcttaaataaaaaattaaaaagagttatttttacctggaggaagatactcctgcctttttaaaaatttgagattctttgaact

SEQ ID NO: 72709 - DNA, 4429 bp, Oryza sativa
gaagcagcaagacagagagagactagacagttttcacaaataacaaaggatttttatttttgagaatagtgctaaggcttgggatctatggctcgtcctagggtcaaaggtggctctgataccaacttgtcacgaccggaaataacccaacgggcgttcctgacgtgcgtgcattaatccttgtcccaggaggcaaggtacaccaaaagttgatacaatttagagtttaacaagtggaagcgtaaatagttaacttattacatgggcagcgaaggcccagcacacacaaagacaaacgggaaacagcggaagactagggtgacgaccacaggcgcttgacggcaggcacgagctagacaccaaagccttcatcttccaggggctcctcttctggggttgggaaaaattgagcaagactgagtacaaccaccgtactcaacaagacacacccacaagtgcggaataaatgcaagggagtaaaaaggggtcatactataaagggttagggttgcagtaaacagcatttcaagagatttagtgtctcaaagctattttgtaaacacgattctagaactatacaatattattcatcaaggccgtgaacccacacgaacctgccttaacccaaggcctaagatgattcagaccgaactggcaacccgaccctgggtcccagctcgtcccaagccaacccaggccaacccttccacattttagttgttaagcaggttttaagaattgaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaatccaattccacaataaccagaccattccaaagtatccaggtgatatgaatatttcccaaagtctatagttgaaaaaccacctaatgttacctaattaaattgcgaagcatctacctaaaattaaactagtggtgccatgagtagagtgtccactagttgaggttttgtttattctagggtgaacaaggtaataataacaataacaataataataaggtcataacaaaggtaaataggcatggctagataaaacagtgataacgcgtgaatttaaataaagcgataatgcaataatttaaatcaacataattttacaaactgggattcaatatgttcaaagatgatgtgacttgccttgctcgctttcccaaacgtcggcttcaacttccacgaagagcggatcttccgaagctgcagcgtctacacgaccaacggaaaagaaaaggcttttactctaataaactccatataacagcagaaacaaagcacaaaaatgggtttttggcttcataaggaaaaattagagacttgaacggtccaattccgagttcaaatggccaagttatggctatttgaagtttatatgctctttaaatggatatttgcgaatttcttcatttaaattttaattaaaaatcggatttattgcgtcagccgggagagagggcgcgcggaccgggtccacgggagtggggcccacgcggcagcctcacggtccacggtggaccgggtgcacgcggcttgcgccggccggcgccgtgggtcccatgcgtcagccgcacccgagggagcgggcggctgacggccgggccccacctagcagccgcggccgaccggagctcggcggcgacggcggagagagaggacgacggcgcgggctcgattccgacggggagagaaagcggcgagtggcggaaacggaggagggaggcacggggagcgtttaaatagcgttgggagtgagagagggcggccggaggggaaggaaaccggcgcggcgatctcgggctccattgatgcgccggcgaagttcgcgggagtaaatccgaacgaatccgagggtgtgagagagagggaaaagtgggggaaagagggagggaatcacggggagtgatttccccctctttatggcgcgcggggacggcgggatgcggcggattcggcggcggcggcggcgctagggcacgggcgggcagcgggtgtggcgcgaggtaggggatgacgggtgggccccacccgtcagcgagggtggcgggcgggcccgcccctcagcggcgcgcgcgcgggggaagagccgatgggccgcgggggagaggagagagagggtgagaactgggccgagccggcccaagaagggaagggggaaaaagaagactttttagggtttttctttttataaaacctttttaactttgtttatttcttctcaattattatttgtgctctgaaaattccactaaaatttatttacgcattttaggcttttaggaaatatacaaaaatcctccaagccttatttgacttttaaatttgcacattttaattgttggaggctttcacatggattttaattattctcggcataatttcgaggatgtattttagagtcgttttgggacgcgacaaacctaccccccttaaacggaatctcgaccccgagattcggaagaactggcgaagagatcggggtgggctgccttcagctcgtcttcacgcttccaggtagcttcttcttcggcgtggttgttccactggaccttgcaaaaacggattacccggttcctggtcctgcgctccatggtgtccaggattttcactggcctctccacataggtcaaatcttcgcgaacttcaatttgctctgagtcggcctgctcggatggcactcgaagacatttcttgagttgcgacacatggaacacatcatgcacgttgcccaaggaggcgggcagctccagctggtaagcgactcctccgcgccgagcaatgatacggaaaggacccacataccgaggtgcgagcttcccctttgtctgaaacctgtgtacacctcgcaatggcgtgacccgaagatacacaaagtcatccactgcgaattccagatcacggcgtcggttatccgcataacttttctgccgagactgggccacctttagattatcccgaatggttctgactttagcttcagcttctctcaggatatcagtcccgaacacttggctttctccaacttggtcccacaatagtggtgtccggcatttgcgcccgtacaacgcttcataaggtgccatttgtatgctggcttgataactgttattgtaggagaactcggcataggggagactcttatcccaggtcttcccgaaatctaagacacatgcgcgaagcatatcttttaggatctgatttagacgctcggtctgtccatctgtctgcgggtgatacgcggtgctgaaatttaatcgggttcccaactcttcttggagcttcttccaaaagtgagaggtgaattggcttcccctatcagatacgattttcttgggaacgccatggagactcacgatcctagcgaagtagagctcggctagtttgttccctccataggtggtctttacaggaataaatcgagctaccttggttaatcgatccacaactacccatatagaatcatatccgccttgggtttttggaagtccggtgatgaaatccatcccaatttcatcccatttccattctggtacttggagaggttggagaagtccggccggtcgttggtgctctgccttgacacgctggcacacatcacatagggccacaaactctgcaatttcccgcttcatgctaacccaccattatttctccttcaagtctaagtacatctttgtactgcccgggtgaatggaataagggctctcgtgagcttcctgaagtatcagctgtttaagttctctgttatctggaacgcatacccgatttccgttccatagggttccgtgttcatcctctgtgaaaccagcggctttaccctgtttcatattcttgaggagtccatgcatgtccgggtcgttcttctgagcctcgcggatttgatcgagcaaggtgggcttggcttccagcg

SEQ ID NO: 72710 - DNA, 1433 bp, Oryza sativa
agtcaatagatcgcgggtaaaatacattcactcaggacatacctccagctggggaccaagatgtcaatcccgtaaatataagatgtgctccacatgactcgcatgcaattttgtccatttcaatgttcacccagcctcttcgagcacaagccagtgaactagcagcctgtaaaaattaagctattagtttcttctaaaacaaactggatttgtcattttcagtagcatttttttcctctttgcaatacgagacatcaaaatggccgaaaataactttatctaggtaccataaggtacatgctaagctggacatttcagaaagtgatgtactggttcaaaaattatcaaacatatgcctgatctggatttcagctgggcatttgggcaaacatgtcatttgccctatacattgtaattcttcatttagacatggatatgtaagcagctaggtataaagaacacatctaagttacaagatgtctcctgagcattaccaatatgcaaaaaaggactaaagagaaaatatatgagacaaaacttagtgttgtatgtggcatatggataaaaattatactccctccatttttatttacatgacattggttatttctattttgaactaagcgtcaaataaaaaaaacagaggtagtatatctttagcttcagacttccattaccaaccttatcatgtttctcagcattcacttatatacatcctctgagcgaaaaatgttattcttaattctaaactggtataaatgcaaaagggtaagattgagcggcttgccaattacaaattacaatcacagaaaataacaaaaaaggaccaactagagaagagaaatgacctttggcttagaagcccatgttgaagacttgaatgtggccagtcgccgaagcaagtctcctcgttcccatggtctacaagatggttgagagaaatccacggcagctccagcagcattagtactaagagaaggccgaggagcatgtggagcaatctgggatgatgattccactttggatattggctcaccacctaaccaatctatgctagctgcatttgtttgtgcaggtggtgatgatgcaccagccgaactgtaaataagagaggaatgagcttcagcatgcacatacaccagaatctatgtggagagcatacactgaaaacgctatactgttctgaaacaaatcctatcaatatatatcattggaacattttaattacaacccaaccatagtaaccaaataacgataaaaaatgatagtacaacagtttattctatctaaaaatggtaagcattccaaatttggcaaatatccaactagttgggctcaagatgagactacgtaagtaaatgaccacaaaaacatgtattttgacaccagtaaaaagaacatgtcatcagtgtgaagaaccacaacaggtgcaa

SEQ ID NO: 72711 - DNA, 1610 bp, Oryza sativa
gcctcacgccccgagccgccgcgccgccatcccgccgccccgcgcgcccacgcgccccgtcaccgctcgtcccgtcgccgtgcgcgttccatcgccgcctcgagcccgtgccacagtcgccgtcaccatcccatcaccgcgcgccgagcctcgcgccgccatcacgtcggcgcccgtcgcgtcaccgtcgtcgcatcaccgccctgagcccccgcgccgccgtcgtgtcaggccggccaccccttcccctctctttcttccccctctcccctataaatactccacaccccctctccatttcccccactccatctccctctttctcccctcttccctctccaccgagccaccgccttggtgccgccgcgccgccaccctcgcgccgctgcaccgccgccttcgtgccaccgcgccgtgcgccgtcatcgcaccgcccacgcaccgccgcaccgccgccttcgtgccgccgcgccgtgcgctgtcgtagcgccgtcgtcaccgccgccgccgtcgtcggtaagccgccgcctcctccccttgctcggtcgccgtcgccaaagagccgagagagagaggagggagaagaagccgggagggagagaaagagagaaaagaagaaagaaaggaaaaaggagagaaagaaagaaaagaaaaacggagagaaaagaaaggagggaaatgaaaagaaagaaaagaggagagaaaaagaaaagaaaaaataaataaataaatagaaattagagggagattagggaagtgagaaaatttaaaataattagaatttaattatagatcaattatagtcgtagaattgcaaaaatttaatataattatagattattttggtaatctctataggtgatcaattcattcacggtaggtactcggatttaattaataggaattttagacgtatattatatttaatcgtttagtcatagactaaattaaatcgtataatattataagataatttttggattccggccgatatttagctcgcgatagaaatttctaacaaattatatgaatataatactcgggtagattaaattaaaaactcatgataacaaaatatttatacccgcaaaaatagtttaggatgtataaatcgaaattgggtttgccctagttcgcgaatagtaaagttaatataaaagaatcgactttcgcattcgacttccatttggatttatttggatttttatttgaattctaaccgaattcaaatcaattttcacacgtaactatagagcccgagggagttgcggatccaagtgaaggccaagacacgcaagactttgagcaaggcaagtcatcactattcctttaacttgttgatcccaattgcgaaattattttgtttgcaaataaaattgcatgcaatgataaacatcctacttgtgattatgctatgccttgattattgtttacccttaaaatccttgtaaccatgtttacgtatgagtccctagtcaattatgacaattgcttagaaatgctattctagaatcatgcatattcatatttatcaaatgctaaatgtttgggcaattacctttgggaaggtaattgagatgcggcatgtggagacatgagcgccacattgc

SEQ ID NO: 72712 - DNA, 929 bp, Oryza sativa
  unsure (1)..(929): unsure at all n locations
tgttttgtttgttcacgtttagctgaggagggttcatgtgtatgtggaaaaggttgggttggttgaaaattcgcatgtgagcaatgccctgattgatctgtatgccataataattaaatccacccgagagataatctcgatatcctcatatacatgacatattattaatatacgaagtacacgtacgtactctttgaaagtctccatttattaatatgtgcatatgttagaataaattaccttgcaaggatacccggataagttatgcataactaatcaacaaataattgcacatatatattagtaagagatattattttggggatctttgatgatcgtcgatcacaccatcatgttagcttttatatatacatggactggaggtagctgcatatatagatcgtgtatgaataattaagatgaataatatttgttttagaagactagaagtagcagctaattaagatgactaattaattgctgatcgagattttgcagctgcagttcttgacttgctcttcttttttttttctctgaaacaaaaattaaaagcaggcagtcaggtcaggtctttgccgtgcttggacaggttacgagtgtacaaacacgtctagattcagacgaatgtttggatctcctatatccgcaggttgtttccgtataggacatggtatgtggtggatcctgccgagatttagtcaactactattaggtacagggtatctataaccctgacaattagggtttttatccatgagtaaacgggcaaacaagttaaattgccatccctagttccgacacatgcataaagtattaaatatagaaataacaataattacacagattacgtgtaaaattacaaatcttttaaggggtaccgagctcgaattcgcgcttagatgagagatgctcatccnngggggcccatc

SEQ ID NO: 72713 - DNA, 4774 bp, Oryza sativa
tgagttgcgacacatggaacacatcatgcacgttgcccaaagaggcgggcagctccagctggtaagcgacttctccgcgccgagcaatgatacggaaaggacccacgaaccgaggtgcgagcttcccttttgtctgaaacctgtgtacacctcgcaatggcgtgacccgaagatacacaaagtcatccattgcgaattccaggtcacggcgacggttatatgcataacttttctgccgggactgtgccaccttaagattatcccgaatggttctgaccttcgcttcagcttctctcaagatatcagtcccgaacacttggctttccccaacttggtcccacaagagcggtgtccggcatttgcgcccatacaacgcttcataaggtgccatttgtatactggcttggtagctgttattgtaggagaactcggcgtaggggagactcttatcccaggtcttcccgaaatctaggacacatgcgcgaagcatatcttctaggatctgatttagacactcggtctgtccatccgtctgcgggtgatatgcggtgctgaaatttaatcgggtacccagctcttcttggagcttcttccaaaagtgagaggtgaattggcttccccaatcagatacgattttcttgggaacgccatggagactcacgatcctagcgaagtagagctcggctaatttgttccctccataggtggtcttcacaggaataaatcgagctaccttggttaaccgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactgacccaccagtatttctccttcaagtctaagtacatcttcgtactgccagggtggatggaataaggactttcgtgggcttcctgaagtatcagctgtttaagttctctgttatctggaacgcatacccgatttccgttccatagggttccatgttcatcctctgtgaaaccagcggctttaccctgtttcatattcttgaggagtccatgcatgtccggatcattcttctgagcctcgcggatttgatcgagcaaggtgggcttggcttccaacgcagccaagaatccacggccaactatgcttaggttcagggcttccatctgttgattaagttcgggtgggatgccacggacgttaagagtgttgcaatggctttttcggcttagagcgtcggcgaccacgttggccttaccaggatgatagtgaattcccacatcataatccttgatgagttctagccatctcctttgccgaagattcagatccgactgggtgaagatgtatttcaaactcttatgatcagtatatatttcacagcgattcccaatgagatagtgccgccagatttttagagcatgcaccaccgcggctaattccaagtcatgggtagggtagttgccttcatgaggccgtagctggcgtgaggcataggccaccacatgaccgtcctgcatgagcacgcaccccaatccttggcgcgaagcgtcacaatacaccataaaatccttgcgagtatctggcaagattaacactggcgaggaacccagcttttctttgagagttttgaacgccttctcgcattgcgggttccacacaaatttctcttctttcttcaacaactgtgtcatggggagagcgattttggataagttctcgataaacctccggtagtatcctgccaaacctaagaaactgcggacttgagtgactgtcttgggttgcttccaatcggtgacggcggtcactgtttcggggtccacagcaactcctttagcagatatcacgtgccctaagaatttgacttcggacaaccagaactcacacttgctaagtttggcatacaattgatggtcccgcaactttcccaacaccagacggagatggtgccgatggtcttcctcggattgtgagtatatcaaaatgtcatcaatgaaaaccacaacaaacttatccaagtattccatgaacactttgttcattaagttcatgaagaaggcaggtgcattggttaaaccaaacgacatcaccgtgaattcatacagtccgtatcgtgtggtgaatgcggtcttcggaatatcttcttcacgaatacgtaattggtgatatccggaacgaagatcaatcttggagaatacagtggcacctttaagctgatcgaacagatcatcgatccggggaagagggtacttgtttttgatggtgacttcattgagagctctgtagtcaacgcacatcctcttcgtcttgtctttcttctccacaaaaatcacaggagcaccccagggggaagtactcggacgtatatacccctttcctttcaactcttccaattgtttctttacttcagccagttcatttgctgccatacggtagggtcgcttgtacagaggagtggttcctggagcaagatctatccggaactcaatctctcgcttgggcggcataccaggtagttcttccggaaatacgtctccgaactctctgactatggggatttctgacagccctatctgatgcagttctgaacttctgacagaggttgggggtgcaaagaaaacaaccggttgttccggccctcggtacagagtgacagtgcgtctcgcgcaatccactactccttggaattgagccaaccaattcatcccaaggatcacatccaagttcttggtgtctagcagaatcagatccgagggaaaaggaatccctgaatttctatagggacggcaggactaaaatactttgctgtcataacccctccaggggtggtgatgagcagagggttcctaagcctttctacccccaactgatttctccccacgaatggcacagatataaacgagtgggaggctccagagtcgaacaaaatggtagcagggatggaatgaatgaggaacgtaccaacgatgacgtctggagttgtcagcacgttctcggccgtcacgtggttcacacgaccccgaatgacatcgttaccaccattgttggagcggggaggcgctttgccttgctggcgcctcggctttgggcatttatccgcaaagtgcccgggctcgtagcagttgaagcacagacgctgcggaccttgagcgtccctgcggccttgaccaggctgcacagttggcgtaggaggacggggcgcacgagtcccttgttgattctgctgctgctgcggctgtgggacgcgcaccacgaattgaggtcgaggcgcggagcgaggttgctgctgctgttgttgctgctgcgaggaggatccccctggatagggattggtgtagcggaccctttggttagcaccctgttgattgcggaaattcgccaagcggcgcttgtgcgactccagttccttgtgcttggcttccaagcggatgctcttgtccaccagacgttggaaatccggatagtccccggagactagacggacggacagttcagggtccattcctgccaagaacttctcttgcttctcctcatcttcccgcacatcctccggggcataacgggccaggttgttgaactcatgcaaatactccatcacagagcggttgccttgcttcaactctcggaattcccttttcttaagggccacgactccggcgggtacatggattctccggaaagcggcggtgaagcgagcccaagtaataggctgcccctctggctgcgtagcctggaaatggtcccaccatagagatgcgggcccctgcagctggtgggcggcgaagatgactttctcctcatcgctgcactgcacagtgtctagctttttccccacggcatgcaaccaatccaacgcatccacggggttgttggaactagagaaggtgggtggacggatgcggaggaactcggcgagtttagagtgttggggaggtggtggtggagcattatgttgtggcggattttggaggtggtggaggaaagcagtcatcatgttggcctgctgggcgaggatttgggtgagaatagcgttggtatctggtggtggtggtggaggcggaggaggaggtgggggtgggctgccatggttgttgtggttgctgccctcaggttggttgccatcaccggtattagcacttctcctggtcatcaccatctgaaaaccccacacagaaccagcaaacagagagagagctgacaattaaagctaaccacccacgactaccttaattcttaaatttattactgctattaaattggttcattaaagttcaaattgcttagacaaataaaataaagacaggctccgacacagttatgccatacaccggcataaccatgccccacacaactccaacaagaagacaaacgagaaagaacacacgcgcaagcctactaactgctcgtctatcgctgcgacgggccaggacggaaggtgagcaacagcgcatcctccgtgctaccaacgccggaggcttccccctcctggggaaccacgggcgcgggctcggcacgaggggtctccacgaagcaggtccacgccagggactgacgaacaagctcgggcctggaggtgctcttgcgggcggtgatcttctggctgcggcagaccccgcggcgcttgggaccaccgacctcaccctgggcgaccttaagctgacacagctgcgcct

SEQ ID NO: 72714 - DNA, 764 bp, Oryza sativa
ccggcatgattgcactcgattgacacaacaaactaagctttttgcctgcaggtcgactctagaggatccccttttgcgtgggaactacacacaggggtgtgcctacgttatactaccggtgtcacaggacaccgggtagattattcaaatcctatataaattacactatattaattaatatattagtcaataattagatagttagtatgtattggacccccggtaatttttgttctgggttcgccactgactacacaggcctaagttttctcgtgaagcaacaaatcctgaattcctgtattacttaatccaagagatctccacgtaaatatgtctatcttttttaactcaccatgttgatcagccgccattcttgatctatcaagaaccttgtcatcaggatgtcctacttggagctcttgacgattgtttgccataccaccttagtacagtacaggtccttgaggtgtctttgtactgaacattacccagtacagatgcatgatcttcctagctacacggaccctgcagcctgtatcccggtcatgtcgtcgatcttgtatttgctttcaaaaaactgtatatacatacatgcatgcacagacttacattgtgaatatactgtgcatgatcttgtatctttgtattggagaagactgccataccatgcacaggattgattgattagcttggttttttttttcctagcttaattgccattgaattaatttcaccatattattgcaataaatccgatcttctga

SEQ ID NO: 72715 - DNA, 23168 bp, Oryza sativa
gaccattcctgttgctgcgagtgttcaccatctggcatggatagggcacaagaagagaaaccgggggaaaactacttaggacagagaattactttaacttttattgatcttaactgagtttcattattacaaactgaagactctcacaccactaaactcaccaacttcctaacactcaaaaagcaaacaaacgcatgtacttatatcccaccactgatgtaaatcacatgcaagacccacacacacacaagcaagcttaaaagaagcaaactaacacaacgatctaagacaacgacttaacaagctactcttgttcttccgagcatcgaaggtcgattgaaggctcgttcggctcgtcttcatcatcttgagttgctacccactcaatcttggaatggttgcgcttggattcttcttcttcatcactacttatgatgatgatcggaggatctgctggggcaacttctttctccaccacacggacctttggcgccaattgatagcgagggacaaatagagctctcttccttgcggtaagacgaatcctggccttctgcggcggtgcttctcccttcaatgcggctagttccttctccaaacgatccaccttgtcttctagctcgcaaatcttaccacgattccgatcttcacgatcttgagctgctaacacagtctccgcacgactttcatccatagcccatagcatctcaaccaaatgtcttgtggtagcatcattctcaattccttcagtctcaaggtaactgccacggtcacttccctgcggttgacgaggatggtaacgatactcagtgtcggccaactgatcactgtagcgatcacggagctctcctatggcgatccttgccacttcctgacatgcatggatgtagttccttcctccagcttcgaacatcactgatgggatatcttcactgttactgttcaaggtaactttgactcggcacttctcttcatgacgatcatgacgaatctaggcataaaaaggggcagtcccaaatccaatgacaaaggacatagtacgcaactcctggacaaaaccctcaacaccaaacaagtactcaggcttgtagcgcggcatctaaagacaagtgaaaggagggagttaaaacatttatccaattaatagcacaagtttttggattaattttgaataaagtttgaaaatcaaagcaaaaggtaagtaaataaagtaaaccaaacttgcaagatgagttgaaatagttgaaaatgaggtcacaagttttgtacttttgaataacaagtttcaaaagaaataaaagaaagttataaaatcaacttgctaaatttattttattgcagtaagattaaatgaaacatcattgtaaaacttttgctggaaaatgagccattagtacagtaatagatgtacagtactaataacactggaataaattttgaatgagaaccattaaaagagattatgaagtgcatgtgccattagtttggtttaattaaaagagaaagagaggagaacagttctacttttccaatatttttagaaggcttctatgggtaaccatttggcataacctagggtcaaaggggctctgataccaacttgtcacgcctggaatttctatccaaaattccaaacgcttacatgtgtgtgaaccctcgtccaggaatcagccgaggcacacaataacaaattgataatagagtacagttattactctaattattaagcgtataaaatgtcattacggaggtagatagttcctctcaatcaataaagatctaagcagcagaaaataaaataaacggcgcagacggctccactccacaggcagcttgaccaaggctacacctaatcctccactccatcagcctcaatgaagaactcttcttctgatgaatgattgcaaggagagtatatgacatactcagcaagccacgcagcaaatatgcaagtgcacaggataacaaaggagggcataatagggtttcatttgcaaaggcagcatttagcaaacatttgagaatttaataaaacagttaagtaattaaacaatattaatccaacgctatacaacataccctgttgcataggcccaaccattctgaacaaccatcccggctgcacagttctatctccaaaccaggaatataccattccaaaccaggagctaatcaaattattaccaatttaagcatctcttactaaggtgagaagtgtgaaactaatcacgaaagacattgttcgacccgcccataaccgcgggcacggctattcgaatagttttactctgatcagagctgtaccactgtacccacaagacacaaccccacatcatgtcaccatgtgcctcaataccaccacggtacctcggaaaggagttatgacaatacccctcatacaacacaatccactgcagcgcaccttcctggatcataatcacccccttataaacaaggcatggactccccagcgacccccgtgggcttatctccgccacttctcagtctagtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcattaagccatcatgaaataatagtgaatcataagttatcccaatagtgagctaatgtttctaagcagggctaagcaattatatctaatatctagttgaaccaataaataaagctcaactagtcaagttataataacccaaggtatcaaggaataaagtaatcaagaacaaaagggctataacaaacaataggttaaatccacccaatgacattcgaaaataaatgcaatatttgaatagaaacaatagctttaaataggatcaatatgctcaaagggttgtttgggatctgtgtgacttgccttgctggccttggaactcttcaaactcttctccggcgaaaacggactctccggaaacgacggaatctaagcaaaaagaagcaaaatcaccaaaacagcacataaacaagcatgaacagtacatgtggatatttttaatgtgtagatctcaattttagaaaaatttagagacttgaaccaactaaattggagctaagatgaattagttatgaatttttaaagattaaatcagattaaaacacttaaatcggtttaaattgaattatgacgcaataatgaattatttttgaaaagaaaaaggggatttattgcgtcagcgggctagggtttcggtggaccgggcgcacgggcggcggttcacgcgaacggacggccgagattcgatccaatccaaacggacggccgagatcgatcgggtccacggcggttcacggcggacgaccttgatgacgtcagcaatgacgtcaccgacggcggcggcggcttggcggagcggacggctcgggcggcgcacgctcgccggcgaacggcggcgctaggacacaaacgaagggcaccaacgggtagcggacggcacggcgaactcaccgacgaccaaaacgacggcggagaagcaacggacggcgccggcgacgaagaggaaacggcggagttcttcggcttgacgacggcgacgatgctccggcggtctccgacgatggcgaagcggcggacgaggacggcgacgacttggcgaccacgatgacgtccttcccgagcgacggcgacggctgaatcgacggcggcacacggctggagcggcggcggcggcggcggcgcaaggttgcacggcgctagagcgactccgacgacgagaggcgaaggcgagggtggcggcgggtagaggagacaccggggaggcttttaaaggggctcggaggcgaaggcgaaggcccacggctgccggcgacgaggaaggaaagctcgggcttgaaggaaagaggccgatccgaattgaactcgattccacgaacttccaaaacgaattagctgatgattccaaaggagaaaaggtagaggagatcccggagagtgtttcccctctattgatttggccggaaacggaaaggggcggccggattggaaggaaacagcggcggcggctcggtggcggcgcgctagggtttcggcccgaggaagacgatgggcctgacaggtgggacccacctgtcagcgtccaaacgcgcgcgcgcgcgggcggctgcggactgggccgacttgggccggggagagagagagaaggttttgggccgactttcagcccaaagccaaaagaagactttttaaaacctttttcaatttaaattatttcttaaatgcaattccatttattaaaaatactttcttagctcaattaaaccccggaaaaatctaggaattataaaattaagcaaagtatttaatgaaattttatctggccccattttatattggaatttattaattaaaattatattttcttttcaagacttttaaaataaattctagaaattccatttaaacaacaatttatatttttttgaatttttagggtgtgacaaacctaccccccttaaacagaatctcgtcctcgagattcggaagaactggcgaacagatacggatgagctgacttcaattcatcttctcgttcccaagttgactcttcttccgagtgattactccactggactttgcaaaaacggataactcgattcctggtttttctctcatttgtttccaagatacggattggtttctccacataggtcagatcctcttggacttctatctgttcaagattagcttcttcggtaggtacccttaaacactttttcaattgcgacacatggaacacattatggactcctgccaaagattgaggtaactctaactgataagcaacctctcctcttctactgacaatcttataaggtcccacaaaacgcagtgccaattttcctttggtatgaaaacgatgaactccccgtagaggcgtgacacgaagatacacataatctccttcttcaaaactcaaatctctgcggcgattgtcggcataactcttatgacgagactgagccacacgcaatctttcttgaatgattttcaccttttcttctgcttcccttaggatatccgtcccgaaaacctgacgttctcccgtttgatcccacaaaagcggagtgcggcacttccgaccatacagtgcttcgtaaggagccatctgaagactagcttgataactgttgttgtatgaaaattctgcataaggtagattcttatcccaacttccaccgaagtctaaagcacaagctctcaacatgtcttccaaaatctgattcaccctttcggtttgtccgtctgtctgcggatgataagcagtactaaagttcagcttagaacccatctcttcctgaagtttcttccaaaaatttgaagtaaactgactgcctcgatcggacactattttcttagggacgccatgcaaacacacaatccttgccatatacaattccgccaaccgactcccggaatatgttgtctttactgggatgaaatgagccactttggtaagtctgtcgactatcacccaaatagagtcatggcccgatgatgttctgggtaaaccagtgataaaatccataccgatttcttcccatttccattcaggaatcttcaaaggctgcaacaaaccggcgggtttctgatgttctgccttgactcgctgacaaacatcacatactgctacatattctgcgatttcacgcttcatacatgcccaccaaaatctttccttgagatcctggtacatcttggtactaccagggtgaatggagtataaagtatcatgagcttctttcagaattgcatcttttaaatctttgttgttggggacgcagattctctcacccaaccatacagttccttgctcatcttccaagaaaccaatagcttttcctcttctcatattcttcttgatttcttgaatatcatgatcattaatttgggcttctctaacttgatcaattagagtgggcttcgcttctaaggctgcaacgaaacctctactgacaattcccaaatttaatctttcaaattccttgcataattccaatggcaactgtcgtccttccgtagcattgcaatagcctttcctgctaagagcgtctgctacaacattagcctttcctgagtgataatgaattcccatgtcataattcctaattaattccaaccatctcctttgtctcatgttcacatccggctgagtaaagatatactttaaactcttgtgatcggtgtacacctctgtacgagtaccgaaaagataatgaccccaaatcttcaacgcatgaactactgcagctaactcaagttcatgagtagggtagttcttctcatgcggacgtaactgacgagatgcataggcaaccaccttcccatcttgcatcagaacacaacctaacccaagtttggatgcatcgcaatacacttgaaaacccttctttggatcaggtaaaatcaaaataggagctgatatcaagcgattcttcaactcttgaaaactctgctcacattcttccgaccacttgtacttcacatctttctgaagcagtcgtgtcatgggcttagcaatcttggaaaaattttctataaacctccgataataacctgcgaggcctaggaaactgcgaatctctgaaactgtctttggttgtttccagttggttatggattccacattactaggatcgacggcaactcctccggctgagatgacgtgaccaaggaacttcacttcagacaaccaaaattcacacttgctaaacttagcatacagttgatgttctcgtagcttctctagtgcaaggcgaagatgttcttcatgttcttctttggttcgggagtagataagaatatcatcaataaagaccaccacgaacttgtctagatattccataaacaccatattcatcaagttcatgaagaaagcaggagcattggtaagtccaaaagacataacagtacattcgaacaacccatacctagtggtaaaagctgtcttaggtatatcttcctctttgattctcaactgatgataccctgatcgaagatctatcttggagaaaacggtggcacctttaagctgatcaaacaaatcatcaattctgggtagcggatacttattcttgataatcacatcatttagggcacgatagtccacacacatcctctgggtatggtctttcttttccacaaaaataaccggagctccccatggagatgaactcggtctgatgtatcctttctgaagcaaatcgtctacttgccttttgacttctgccaactcattggctggcattctataaggtctcttatggatcggagttgttcccggtaccaaatctattctgaactctatatcccttttaggcggcataccaggtaaatcatcggggaacacatcgggatactcccggactataggaatctcttccaaagttatttggttcagtcttgaccttaaagactcagaagacaatgcatgaacagttacaactcgaccatcattgctggtgagaattacttttctgttagcacagtctatcacacctttatatctggctaaccagtccatccctaggatgacatcaaggtctttggattctaacaggataagattggccagaaatggtacttcttgaatttctattctgacagaggtttcgttgcagccttagaagcgaagcccactctaattgatcaagttagagaagcccaaattaatgatcatgatattcaagaaattaagaagaatatgagaagaggaaaagctattggtttcttggaggatgagcacggaactgtatggttgggtgagagaatctgtgtccccgacaacaaagatttaaaagatgcaattctgaaagaagctcatgatactttatactccattcaccctggtagtactaagatgtaccaggatctcaaggaaaggttttggtgggcaagtatgaagcgtgaaattgcagaatacgtagcagtatgtgatgtttgtcagcgagtcaaggcagaacatcagaaacccgccggtttgttgcagcctttgaagattcctgaatggaaatgggaagaaatcggtatggattttatcactggtttgcccaaaacgtcattaggccatgactctatttgggtgatagtcgacagacttaccaaagtggcacatttcattccggtaaaaacaacctattccggaagtcgcttagcagaattgtatatggcaaggattgtgtgtttgcatggcgtccctaagaagatagtgtctgatcgaggcagtcagtttacttcaaatttttggaagaaacttcaggaagagatgggttctaagctgaactttagtactgcttatcatccgcagacagacggacaaactgaaagggtgaatcagattttggaagacatgttgagagcttgtgctttagatttcggtggaagttgggataagaatctaccttatgcagaattttcatacaacaacagttatcaagctagtcttcagatggctccgtacgaagcactgtatggtcggaagtgccgcactccgcttttgtgggatcaagcgggagaacgtcaggttttcgggacggatatcctaagggaagcagaagaaaaggtgaaaatcattcaagaaagattgcgagtggcccagtctcgtcataagagttatgccgataatcgccgcagagatttgagttttgaagaaggagattatgtgtatcttcgtgtcacgcctcttcgaggagttcatcattttcacaccaacggaaaattggcaccgcgttttgtaggaccttataagattgtcagtcgaagaggagaggttgcttatcagttggagttacctcaatctttggcaggagtccataatgtgttccatgtgtcgcaactgaaaaagtgtttaagggtacctaccgaagaagctaatcatgaacagatagaagttcaagaggatctgacctatgttgagaaaccaatccgtattttggaaatagatgagagaagaaccagaaatcgagttatctgcttttgcaaagtccaatggagtaatcactcggaagaagaatcaacttgggaacgagaagatgaattgaagtcagctcatccgcatttgttcgccagttcttccgaatctcgaggacgagattctgtttaaggggggtaggtttgtcacaccctgaaaattcaaaatatataaattgttgtttaaatggaatttttagaatttattttaaaagcctagaagagaagatttaattttaattaataaattccaatataaaatggggccaaataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaagtggcccaagtcctttctctctctcctcggcccagtccggcccagtccgccgccgcgcgcgcgcgtccgcccgctgacaggtggggcccacctgtcagggtcgtcgtcaacctccggccgccgccgcccgaaaccctagtttcgcgccgccgctgttcccttccaaatccggccgttcctttccttcttcggccgaatcaaaagaggggaaatgatcctcgagatctcctctaccttttctcctttggaaacatcggctaattcgttttggaagttcgtggaatcgagttcgattcggatcggcctctttccttcgaaccctaaaccttccttctcgtcgccagctgccgtgggccttcgccgtcgcctccgagcccctttaaaaggttccccggtgtctcctctacccgtcgccgccttcgccttcgcctctcgtcgtcggaaacgccctagcgccgtgtgccctagcgtcgccgtcgccgccgtcgctccagccgtgcgcccccgccgttccagtcattgtcgtcgctcgggaagaccgccgtcggggtcgccaagtcgtcgccgtcctcgtccgccgcttcgccaccgccaaagaccaccagagcaccgtcgccgtcgtcaagccgaagagcgccgccgtttcaacctcgtcgccgtcgccgtccgttggtcttccgccgtcgctttggtcgccggtgagatcgccgtgctgtccgctacccgttggtgccctccgttcgtgctgaagcaccgccgttcgccggcgagcgtgcgccgtccgagccgtccgagccgccgccgccggtggtgacgtcatcgccgaggtcatcggggccgttcgctgtgagccggtcgtggaccgttcgatctcggccgtccgttttagatcaagtcgatctcggccgtccgttcgcgtgaaccgccgccgtgcgcccggtccaccgaaaccctagcccgctgacgcaataatccttcttttccttttcaaaaataattcattattgcgtcataattcaattaaaatcttcaaaaattcataagtaattcatcttagctccgatttagttggttcaagtctctaaatttttctaaaattgagatctacatgctaaaaatatccacatgtactgttcatgtttgtttatgtgctgttttggtgattttgcttctttctgtttagattccgtcgtttacggagagtccgtttttgcagaagaagaatttgaagagttccaaggccagcaaggcaagccaaacagatcccaaacaaccctttgagcatgttgatcccgtttaaagctactgtttcttttcaactattgcatttattttcgaatgtcattgggtggaattaacctattgtttgttatagcccttttgttcttgattactttattccttgataccttgggttattataatttgactagttgagctttatttatattggttcaactagatattagatataattgcttagccctgcttagaaacattagctcacttttgggataacttatgaatcactattacttaatgatggcttaataatagttcacgatggtcaatcgtgattggttaattaattaatgtgccaactaaaacctgataatggtgggttgtgagcacatggttttgatggtcgtgctcatgacaattaaggaccggttcatgagtttcggttgtgaaacattaaccgtgccagccacaagccagcatgggcaacggctttaccttttgtatagcatggttcattgcggggcaccagactgagaagtggcggagataagcccacgggggtcgctggggagtccatgccttgtttataagggggtgattatgatccaggaaggtgcgctgcggtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtccttcgtgattagtctcacacttctcaccatagtaaatgatgctataattggtaataatctgattagctcctggtttggaatggtatattcctggtttggagatagaactgtgcagccgggatggttgttcagaatggttgggcctatgcaaccgggtatgttgtatagcgttggattaacattgtctaatacttaactgttttattaaattctgaaatgtttgctaaatgctgcttctgcaaatgaaaccctattatgccatcctttgttatcctgtgcacttgcatatttgctgcgtggcttgctgagtatgtcatatactcaccttgcaatcattcatcagaggaagagttctacagtgaagctgatggtgtggaggattaggtgtagccttggtcaagctgcctgtggagtggagcggtctgcgccgtttattttattttccgctgcttagatctttattgattgagaggaactatctacctctgtaatgacattttattcgcttattaattagagtaataattgtactctattatcaatttgttattgtgtgcctcggctgattcctggatgagggttcacacacatgtaagcgtttggaattttggatagaaattccgggcgtgacagcacgcctcctctcgaagccgcagctcctccgcgcgacgagccaccaaagcctctgcggctattgacagaaaacacgaggcctgggagatctgcttaactccagtgcaggtccaaaactcgccttcggatgtgtgagcgtgccagttgatttgatcctgcaatcaacaagaaacaaagacaaagaaaccgaaattaaatccataaatgatagccgatcggctaaatgccgatgacgtatcatttatctttgagccgatgtcatatgtaaatcgatcggcaagtgttaagtaaacaaatcagaactaaatctactcgatcggctgtagacatcaataatatataatccttatatcgatatatacttgaatcaagtgattgggatagatcggtcaccttgccgagacagtataaatcacttaaatcgaaatatatattattaatgagattatatatatatatattcatagcatagccgatgaaatagatctagcatgtatcggctaataccccgataccacttcgtattaagatattaaagcaagtagaatataccaaacagaagcctaatatacttaaatgcaacaagatcttaacataaagggcagatctaacatgtcaaacgatcatataggataaaagcagttagatcaggtaagatcggctgaaactccgatactaccctaatcggcaaccagtaggcaggctagatattgaaattctaagcacgacttaatagatcaaactcaactgatacagcattaagtatgaaaagaagaacaatatctagacaatcaagccgctggatgtttcatagagtggtggatatctcatataatctaagccaacgtcgttatttaacctaatcggctgccttctggtaacagatgttagccgattgtaggttagatgatgatatcgtcaaggattatgcaagatatatgataactcgacgaattacgtaaacaagactagagtatcataaggatggaagcactaatctcaagaacacaaaccgccataacaagttttacctcttgttgaagatcgaaaccgatgcagctcaacccgaaagcaagaactcgttgaaataaaactaaagcaaaaagggtggcgatgcgccgaaattgtattgaacgtgtgtgttatccattacatagggctcggggcctatttatacccgagaattataagatatgtccatattggacacgactcttatccctaacaaactctaagataccataagtttttgcggcagacttttgcccacatttatctctaaggaatttacataaaatatcctaattaatagatacaattgccttcccaggactctatccatgcgtggcaatcatcttgaagcacatcaattcgaacccgatgtcgtacacaagtcatattatcggaatcggctgtatcacttaacacagtctgactcagacttagccgatctcaatcgtagccgatccggactccagctgattcttactctgtttccgcaacaacccttatcttcgattccgcttcgatccattttcatctcccatgctgatattaccaaatttggtcgttaacacatgccccccaagtccgggatatttgataatgttccggatttgccgtgtatcgactccgagcaagtttcgcactctaccgttttcccaaccgttactctagtgctttaaatactaaccgttatccccgagaaatctcacaccgtgacttccgttttcaccgcttaagcgaaactttaccctctctctctctggcgattcctccaatgcgcaaggcaattcccaggcgactccatccccagccagatctccgcctgcgacgatgtcaacctccgcgagcccatctgccgcaccatcggccaaatacgctgaggtaagtccccatcggctagatcccccttttcatcattagatcggttttctctcgcctcatactgctttctttttctcggttactttgaacttgtagcatctctccaatttagtcgcagttccaagcttgtcacatgaaaaccactactttctcggcccagtcggcaaccctgaccccactgagttcatcatcggtgaaaccaataggattcctttcagactatccaatccagatctaggtcattggaagaacacctttaaatcttggccgtctctagaaaaaacttcacccgagaaaagttggattacatggttcaagcgtatgtcagctagcaaacgagttcactggaacgaaatcggaatcggccaagcacttgacctaaccatagcaaactcagccaaagaagaacctctaatggcagctgcttcttacttttggtccaacactatcaatgccttcttattcaaccaagggccgatgaccctaactctcatagtcatcattatgatcacgggtctagatgtcacttcatcggctaaccccatgagtctgaacacaaaaaaccaatatgacttcaagaccaagagtataggaggttggtcaggttatgttgcagcatacatgggccaaggttcagttacccctcgagaacatgtagcctttttgctaatgtggttagagaaatttctcttttgtggatcaagctgtggtcctacaaccaactggcagtttgtagccgaagccttggaagcaaataaacaatttcctttaggcaaaatcctcctcggctacttgtaccaaatgctgaataatgcttcggctaagttatctgtcggctcggtagtcggagcaggtggaccatggtggctgctacagacttggttgaatctaatatgtcatgaaagtcgtcaatcgaccatccgtcacagaagctgaatttccaagattagagccgatcatagaagatgacgaagaatgcactcatcgccgatgtatgtcatatggagaatacgcatccacaccggccgatgctggagcaaagttatcagccgaactgctcaaagattggttctgcagtttctatgaaggctttcaaaaagatgctcgagtttggtttccctatgaagattcagcaaacctcgagctcccatcagatttcagatttgaagacattaatcatgaaagattccaaacatccagagaagtcttcatagctgcaatcagcccatgcattcttccagtcggcatccatcaaggaagaaacgtccaagcctcttacgaattctatcatccaatgagttcagctagacagcttggactgggccaacttccaatcggcttattctttgccgataagatccaatgccgaggagagatttcatcaactttaatgatggatcggctgctcaaccttcaaggacctccactgggtagcattgaaaacatagagctagtaatgtttaggagcaaaaactttgatagatggtggggtgaatagaagttgcatctattccaccaaccagcttcaatgtacatgacagacctctttccagatgttgtccctcaagtaagcctttgactttacttgatttcatttgaataactgcttagccgatttatcttaactaatcttttctttgatttctagacaacagaatcctctcctcctcgtcaaagcaacagtggcagggatatcacctacgccccaggcttaattcctaatggaggtgggccatctcctcctgtcatcggctatgatgcccccaagacttcagctcttcttcaagggcttatcagagaaccagccgatgccggtaagaaaaggaaaaccagatcatcggctgtagatactttagccccagctccaaagaagaagatcaaaaagaaagctaaaccagctgatgatctgcctgccctagatccatctattaaacaagctctggatgaagaagaaatcggagaggatgttgatcaagctgtagccgaaataagcgatactgaaagaacaccatcggcttcacctaagcaggtccctcaaactccttctgctccaactcattttacaagagtaagaaaccttctataaccacttttgtaatcatctcactttatggccgattgctcacatacttggtaactgcagaaaaggaaggctgctgtgaagaagaaatcggctccaatgacatctaaaccagctccactggtacaataaccttaattctttcattagttaatctcagccgattttatataacacttgtctattttcaacctccttcccctcctattcaacaagcatcaagcgatcggaccccatcagctgtagggagtcatcacatagaagaagaagttcaaccaactgctccagctatcccagtaaatttcttataaccaacatatgcagatcggctatgcctatttgatctctaactctctttaaatcatcactgcaggtcttagccgatcttttcttttttgatatcagagattatcttgatgaagagacagaggttgacaacactagcaaggctctagctcctttgtctgatgatgtgaagaaaactcttgaagatatctctcatcggctagagacatcatcactagatagcctagtagtcgactgtggatcaattaggactcggcttcacgaagtttacgctcaaatcctcgatgagttagccgatatccttactacagctgtttatcttgagcaacatcaatttaagctggaaaaggccaagctgagattagccgagcatcaagagcgcaaagacattgaagcaacaatccaggccaatcggcaatttgttcatgaagaaaaagccaagctcgatcaattatctaaaggcccgatcaaatccaatattgaccggcttgaagctcgcaagatcgaactcttagcacaacttcaagaatgcaatgctgaactggatctagagcacaagaggttagccgatctcccacagtctatcgaagaacaaaaagcaaggttaaaatcagctatcaagaatgttgctaatatgaccaaatctttgaaggtcattcctggaaccgacgctcaagatgcccaagccatagaagaagtagaacagattaggcaaagagctatatcggctatccagcgatacttatctgaataatctttgtgtaatatgacttggaattttgtaatcggctaagacattcggattaatatgatgtgtaagctttgctcaaaaatctcaaaaattttgcactgtattgtgatatatatatatgcccccctagttttacaatgtcaagagcattgataaaaatacgaaacaactaagggcgatataacaatatcggccattgtatatcagcaaaccacgactgattacaatagaaccactaagggcgatataacaatatcggccattgtacatcggcaaaccacaaccgattacaataaaacaactaagggcgatattacaatatcggccatctcaaggcgatgcaaatacatcggctatcatgtatcggcaatactagccgatcatgcgttaacccaaacacttggataatatttcttcaaatatttgccattaagcgctcgcccataaacttctccatcgagtccttgcaacatgtatgctccttgagacacaaccttatgtatttggaacggcccttcctaatttggtgaccacttgccaaatttgctatcccgggttccaatcggcaaaatcaatttccacacaagctcaccttccaaaaaagtcttaggcaccactttcttattataatgccgagcaacacgttccttatccctagtaacttttgcaagtgctcgcaatcgcgactgaaccaaatcctctcgttcatcggtcataagattatagtactcattggctgtcaaatcactttgcaactctgttcttcttgagccgattcgaacttcccatggtaaaacagcttcatgtccataaacaagcttataaggaggaacttggattgatccatgacaagccatccgataagaccacaatgcttcggctaaacgagtatgccattgccgaggataatcagaaatcttccttttaatcaacttgatcaaacttttgttagatgcctcggcttgcccattagcttgtgcataatacggtgaagaattcaacaactttatacccatactatcggcaaactgaacaaacttatcagacacaaagattgaaccttgatcaatcgtaatagtctgaggagtaccaaatcggtagattatatgttcttggacaaactgtattgcatccccagaatcagccttcttcaaaggaatcgcctctacccatttgatgaaataatcagttgccaccaatataaacttatgtcctttactcgatggtggattaatcatgccgatcatatcaattccccatcctctgaatggccatggtttaatgatgggattcatagccgacgccggcgctcgctgaattgctccaaatttctgacaatcttgacaacctttgtaatatctgaaacaatcttctaacatcgtcggccaaaaataccccgcacgccgaagtaaccacttcatcttatgagccgattgatgagtaccacaaattccttcatgaacttcgccgattgcaactttagcctgataagcactcagacacttaagcaatactccatcaatcgttcgataataaagctcatcatccaataaagtatatttcaacgctttatatcttaacttcctataagccgactgggatggattttgtaaatattgatgcacatcatatctccaatcatcggccgtcatggcagcaacttcaatctgaacatccttgatcatcggcttatatcccgatgccccttgagctaaatcatagacctcaatattctgctctcgagatacatgcttcaaagttactagccgaaactccttcatcagtttttggcacttctcattataaactatcaacgtatcattcttacactcatattctcatgccaactgactgattactaacaaagaatcccccatgatttcaacagcatcggcttcaacctccttgagcaattgcaaccctttaagtactgcctcatactcagccttattattagtcgcataaggtttgatagtataagcaaactcaaaacatgccccccgaggcgaaattatcctttgtgtagacgttcgaatcctccacgacgccctcaaaataatagcttgggttctccatcttcaattggctgtatatcagaatcggatacttttaaaaaatctccatcccaaacttttccagataaacaatcaaggccatccatctcccaaagagctaaatcggcacaagcaacattgactgacctgtcggctggtacgatctctatcttgttgccttgccattgaatcaagcattggtgcatggtcgaaggaatacaacaattagcatgaatccaatcccttccaagcaacaagctataagaacccttcccatcgatgacaaagaatgttgtagggatggttttactgccgactgtcaactccacgttcagaacccctttggtttctgatggattgccaccaaagtctttaagcaccatgtttgtcttgatgaggttttcggcgttcctacccaatttcttgaatgtagcataaggcatcaagtttactgcagccccaccatctaccatcatcttaggcatcggcttcccattgacataaccgtttatatacaatggtttaagatgccgattctctgtcccctcaggtttctcgaacactgcttgttctggtgacaaccaacttagccgattcctcttccaccttgtctacatcggcttgatcaatcccaaattcggctggcaatgtaaaaaccatgttaattggtgccactacaacactcttcccttttgccaacctctttgcctcatcggctacaacatcatcggctataggaatctgattcttaacacgcaattcctgtcttggttttgctttcttcagccgatggttaatttcttgttcaacctcctgaaggcgctccctgttcctcaatctttgaacccttctcttctgattcttcatgaaaataccagaaggacaccattgatttgtcctgactacgtcatcctcctggccacgaccttgattcactgggcccaatctttgacgaacagacactctttcctgcctcagccgattactcctattatatgactgacttgagctctcaatgatatcattgcacccaaggtagttttcgatagacggcaacctcatcccttcattccagcagaatctaaagaactcacaaccccaatgaggatcaaaaccatcatcgtgttcttcataatgcttctcctgctgcttctcatacttcctctgatatttgttgattatcttagccgaattcacttgaaaaccctttgcacggacgctatcggctgattggccagctgtatgtaccatattaacaggaaaaggattaccatcgaccttcattggcctcttcgaatcatcaaacttgatttttcctccctcaatatccgtttggatctgctgcctgaagaccttgcagtcattagtcgtatgagacccagaattatgccacttacaatacctctttttgcccaactcttcagccgatggaattgtatgtccagcaggaagttgaatctgtttttctcgaactagcaaatcaaatatcttatcagccttagttatgtcaaagtcatacctctcctcttttcctgagtttttcacccattggtaaggtataacctttttgctcctaacccactcagctgcagctatttcagaatcatcatcctcaccatccgatccatacatataaggataaacatgattaatcttcctagagttcttcctagcttccgcgaacctttgttgatgcaaacctaccttctgtgtaaggtacgacaagctttcggaatcttcagatgagaatttttccttgatcggagcaatcatcccttaaaaagccaaatcggctaactgggcatcagtcaagctcaagctgtaacacttattcctcatttccctgaacctttgaatatactcatgtaccggctcatcatgcttttgcttgattgacatgagatcagacagtttcatctcgtgaatcctactatagaaataactatgaaactgcttttctaaatcggcccaactgttaatcgacccatgtggcagcgaagaaaaccaagtaaaagccaacccagccaatgacaaccggaataacctaaccctcaaagcatctacagccgatgcctcaccacactgagctaaaaatcggctaatgtgctcataagtcgatgtagtgtcttgtcctgaaaactttgagaaatcaggtactttgaaccagttaggtaaaggaactctttcaaaccattcaggatatggttgtcggtacaaatttccagtctcctttggtttaagcccaaattgctccctcattacatcacctatcacatcagcccatggtcgctgctgaggtgttgcttgagattgttgtggtgtgggctcatgtcacgaccggaaataacccaacgggtgttccttacgtgcgtgtattattccttgtcccaggaggcaaggtacaccaaaagttaatacaattcagagtttaacaagcggaagcgtaaatagttaatttattacatgggcagcgaaggcccagcacacacagagacaaacgagaaacagcggaagactaggacgacgaccacaggcgcttgacggcaggcacgagctagacaccaaagccttcatcttctaggggctcctcttctggggttgggaaaaattgagcaagactgagtacaaccaccgtactcaacaagacacacccacaagtgcagaataaatgcaagggagtacaaaggagttatactataaagggttagggtttgcagtaaacagcatttaaaggtacttagttgctcaaagctattttgtaaacacgattctagaactataccatattatttatcatggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctatggccggaacccccgggacaggcaggtaggactgagcccctagcagcaggacaccagccctgtgccatgacatctcgactaccgggccgcagctcgtgtagccttcatttgccctggagatgtccatcgacccccgacttcttccatctccatccgtgtacttttgtttataaccagactgactcacaaactaagccttacccactagacatgtggaagtacggtagtgctttgcaacagaggcccgaagaccggtccttgtatggccgaggtgctactatcaaaaccatgcaccccgagcccagcctaaaaccattttgggattttgaatagaaggagcggtgtgaagccaattccacaataaccaaaccattccaaagtgtccaggtgatatgaatattcccaaagtctagagttgtaaaaccgcctaatgttacctaattaaattgcgaagcatctacctaaaattatactagtggtactatgagtagagtgtccactagttggggttttgtttattctagggtgaacaaggtaataataacaacaacaataataataaggtcataacaaaggtaaataggcatggctagataaaacagtgataacgcgggaatttaaataaagcggtaatgcaataatttaaatcaacataattttacaaactgggattcaatatgttcaaagatga

SEQ ID NO: 72716 - DNA, 1878 bp, Oryza sativa
  unsure (1)..(1878): unsure at all n locations
ccgccgcccaccgtgccatcgnctatacatacccaccccccacccacctccttgtaagttgcaacctcccgcctcacccgccgccattgacgaccaccgcgctcgtcccatcccatgcctgcggccgtgaccgcgaggttgtgaggagaagagagtcccaagagaggaggatcgatgcggcagcggcaggccggcgagcaggaggcggagctgttcgtccagtggaggccctgcgacaagaagcggtcctagtcgcccgccgccgctcgcccactcggcggcgtcgtcgatctgagagggacaggggaagaggaagaagcagaggaggaggaggatgagcgtgtcgggcgggaggacgcgggtggggaggtacgagctcgggaggacgctcggcgagggcaccttcgccaaggtcaagttcgcccgcaacgcggactccggcgagaatgtcgccatcaagatcctcgacaaggacaaggtcctcaagcacaagatgatcgcccaggtcagctcacccatactattttctatccccccaatcgattctcgatttggagaggtctccatggatttcttcccatgatgatagtactggtcgaatttctcgccttcttgtttttttttaatcatatcatacgctgttcttgagtgaatttcgtggacaatttcaattcctatacgtacgagtcccaaatcatgaacagtttgtactactgctgttttgtttcctctcacgacaagacgtgatgattttgttttaaccagaaacagtaaacattactaattactactagcgttcttgctgcaaaaaaaaaaaggtttggtatcgttccaaaattgcgttcttactttcaaaattgcaacagcctagactttgacgtgaggttagcacgggcgcctcgtgcagtgttcgttggaacttgtgctgagttagttattattaatgtgcatcaactttggcttagcttctgactttttgtgggggagttctgactttgatgtgtgtttgtggtttgtgtggtggtgtttgcagataaagcgcgagatctccaccatgaagctcatcaggcaccccaacgtcatccggatgcatgaggtttactaatctccaatcattaatctcagctcatcttgcccatggaaaaattttgtaactgatgataagtccaccaatgaaatcgactaatcataagcagagctcgtgattttggttcgaaattttcgaaatttcgggtctaccagtgggtcctggttggatgtgattcccagtcttgaattgtggattttttttttaattttgtaaaatttgttcgaattcagctagagcctgttcaaaattcattttttttctggtttgaaacttctgaaaaattttggtcccccccagattttttttttctaggccgagattgtgaaccctgctaattaagttaagatatggttctcaaggctttgagcaatctgaaattatgaaaaaccagggtaaattaaattggtcaaggatgacataatgaacaagttgttccttcacatgaaaagttgcaattagagatcgttctggaaggaaattcctgtgacactaaactatgtgttatctgaaactttcctagctcttgctttctgatattttccttttgttgtcttggctttatgtcgatctccacttagtggttttgttttcttctctgaaggtgatggccagcaagaccaaaatatacatagtgatggagcttgtcacccgtggtgaacttttcgacaagattgtgagtgcttggccttttctatcgacatctgaattactccttatgctatgcacacatgttcaattngccataaatcctcgtataggctttcgcgtgggaaggctgaaagaggatt

SEQ ID NO: 72717 - DNA, 659 bp, Oryza sativa
catggcctgccagatttgagtgcaatcaactttcagacatcttccaacatcttcacgctttggccagttcaacaaggtatggttcaagttcaatcagataaagcacccaagacacaaaatacacttcaagattaactaactattcactaagtagaaaatccatcgttgatgtcgcagtcatgcgatggctgctgctgcacccacagcttcacagcatctcccacggccagaagtgaggtcttgaagaacacctccagataactcagattcttgtagatggcttcagctggcgttgccccttcgaacctcacagccacaaaggtgcatacaagcacctgcatgcctgcaaagccaagtgatatagtcgactgtcgacgcctagtcttttcgaggtaacttgcgagcattttcccaataaggattctgtgattaaaaaaggaggagagttaggcctggtttacggtgtgtttagttcacatcaaaattggaaatttgattgaaattagaacgatgtgacagaaaagttgaaagtttgtgtatgtaggaaagttttgatgtgatggagaagatgaaagtttgaagaaaaatttgaaaactaaggcttggtttagttcccaagtttttcttcaaacttcaaacttttccatcacatcaaaact

SEQ ID NO: 72718 - DNA, 704 bp, Oryza sativa
  unsure (1)..(704): unsure at all n locations
cttgcctcttgaagcctatgtgaaagctcatgtaattttgcagttgcaaaaatgtacaactttcaggtgacaaaaaatggcatagggatgtacaaaataaacattaagaggaaaaggtttcgtgtttagaactttaaaaccaagcaatcaaaaacattttcttcctcgaagatccaacaacaaagctctgcatcaagaaacattccattggttgacagaaacaaaattaagctagataagcactgattccacgcacaatttacatgatcattacatcgtccatcacacaggcactcatgcatcgattacacataggagtattgattcgtgtgactagcttaatgaatttgattagccgatgatctggtccaggacgccgatgttcttgaggccgaggacgacgccgacgcccatgatgtggccgacggcgccgcaagccagcgtgtcggcgagcgtgaacccggcggggcataactgcgataaaaagtataagctccagggacctgggcagaattctcaaaaaaatttggaccatttctcgattgtgcgtgtcatccttgtttcatatggcttangatggaggtattgtgtgcgtatgggatgccgagtcgcatttggaaggagttcaaatttggtggaatttgttttgtaaatttgtttcttgtcgagaaggttnctagggtgataggacttctagatgaggt

SEQ ID NO: 72719 - DNA, 5777 bp, Oryza sativa
  unsure (1)..(5777): unsure at all n locations
gtttgcactggttttgacaatagttgaactagccaactaggcctttatgcgcaagcatttacagtatatgcctatgggctttcagtttcagcgaagagtaagcattaacggggttcggttggtgggcatatatcaggactgcatgtctgtatatacagccatacatgtcaattgaatacctggattcctatctctcccaaaaaaaaattgtattggttaaaattttggtacgccaaccgtgtttgaattggttataagttgttcgtatctaattcgacgtgaatgtaaaacaacaattatacacccctcccaacctaacccaatcgactcacgccatcccgatgccccgtctcgcacacccctccctcgaccggcgtatttttttctttccctttttttcattttctttttcccctaatcatccttatcttctcccgatccttccaatctcctctcttctctcttttttttcttccaaatttctttccgcaaattataattatttaaggtgtgtatgcgatatgtttgctactttccaaatgctttccatctatagtaaaagaaaatttcactaattgataaaatttcaatctttgatagatgaggtgtagctaaatacacatgcatcaacttatggaatagccacctatcactactggagagggagagactcccgagtgtcaaaaacactcggcaatgcatgaaaaacactctgtaacagtgttacctagcgcaacactccgtaatcttcgcctgggagtgatttctccttcccgtgcatagttggcgtgtgtcctaggtggatacaccccgtaacagtgtgataattgccgtgtgctctaggcactcggtaacattttcaccccaccgtccaacagaattccacgtgcaacggcgacagagacggaacggtcacggcacagttgcgtagtggagagaaagttaccgtgtgtttttcaatcggacacacccggtaaaccttctcttgttatcgggtgttgacatcgcatgacacacgttaactttccaagaaacacacaccaacagtgccctcgttaccgtgtgttcagtttaggacactgtaatgtgacacacaggaactctacttgagggcaaactaaaatgggtttgctgattcatttatattatttacttccatcagaatagtaggatcctaataacacatcacagatgatcacaaatacaatggtagaatggatttcaatgcattgacatccacgtacaattaatcagtttggcaacaatctaatatgaaacaatagcaatgtcaatctcatcagctacatctgagatgtaatttgaatattaattcttaagcttagataaccaaagaggtagtgcaactagaaaagagttgacgaatggcattgcaggcagtccgacaacaccttaaataatatgcagatgagccagttgactagcagatcctgagatttcaaataaagaggtaagattaattaggtaggtcagctttactttaaaacaacattttatgtacatgtatctaaaacagtgatagcacatttatatgaaatagcattagcagaaagtttatataaatgatctatgcaaataaaaaaactacctgaacttattcatgctttcttcaagaattgtttaggtttattacaaaattcaggtatagcaaaagtaattgatattggaaacttttattgatatggcacatgccaagaagcgctatgcacccaagtgactggtcaagtgctcatagaagttctttctttatactagccaagtgcccatgtattgcactgaaatccaaataaatgattgcacatgttcaaaatagggggaaatgcaaaattgaaatcaaacctctcttatagaacttcatgattcctggtatataatgttatttaggataaaaatgattatgatcctaactcaaacaattcttgctcatctatcaaaaagtttatcttactatcaacaatttatgggatttgtacaaacaaactcatcaatttgctagcaccaaaattgtaaatcatgtaatcagatgacatgagttaattagggttacccctactaatttttctgtgttattttctcatattcagaaatccaatggtatgagaagaatcaattaagagaatatacaatagtaaattcaatattcagacattgtagtaaacggaactttgcttgtagtacctgctttggtgttggtcatttacattctttatttgtcactcttcacctagtagacagagcaccaattgattgagaatctactgccttggctatcccaatgcttgtcattgtcctgaaatgaatacacagagtgaccttaggtgggtaaaattgttgtggcttatgtcagcaaatcccctgttttactcacgcgagactgtggctatcctataactctgaccttttcagacgagaaacagtttactgaaaaacagagcaaaacgagataacagagtttttgtgctgcgcaatacttgcagttttttcgtcactcctctttatctatttattatcctccttataaactggagtttgttacatgcatatgaccacgtaaacactcgatccatacattgcgccatcccacaacagaatcaagataggtcaccgatctgaaaatgcagctaactgaaaaaaaaaactaactgaaaactaactatgcaggaactagtctaagcaacaacttaaaatacgaatcacaagattacaaatttagtcaacagcttattccatgataattaagttgggcctgttaatttatgatttaactaagaaaaaggaaacatgccaacctgagagagagaaatggctccctggctttgcagcgagtagaatgtctgaggtggtgcctatgatggcttgaaatggagccgagctagattggttcagtactggaacaaacattgcaatgacttcttggaacatgcctccaatcttctgaaaaaagggaataataatttcacacaagtaaattttaggcatctctaaatcaaactacagatatatgtacagttggttcatactccatatgattttagttgtgttgtactggctggctcatggaagcaatcctcaagaaaaggaattgcatcatatagataaaacaagaattttatctccacttaattccagtaacttgcacaaaagcacaattgtttcttctcactaacactaataaaatgaaaaaaaattgataattgtaaatagctacactttgtcattatgaaagatgaaaaaaatagtttcattatcagaaatatgtttaaaccctgaaaacaaatgagcactgaagaaaggtgctataaaaaagtactcctacacgacaaattgaatataagtatatcttacaagtagttactagctacacgagaaatcaaatctgagctccaagttctccaccagaaaccaaaatgcgtagttctatatttagagggaaaaaataatattctagaaaaaagccctttgcagctgtccaggtgaaaagtaaaatgcttctcttcacaaatcaaatccacaagggcccttctccatgcgtgcaggagggaagaaagagacatggggtgggaagagagagatcataccatggagaggtagcttgcctgtaagtcttgcccgggtccttcttcacctaacttctgtattaacctataaaaaatccccaattagaaaaatcttgaataaaccagataacttagggaatagcccagatattatagatctgggacaaaggagcttgtgggaaggaattgacctgaggagggcagcgcggcccctggccatcgtcgcgccggagcaactgccatgggtgaggtggcnnnnnnnnnnnnnnnnnnnnnnnnnnnnccggcagtctggtatccccattgctccggcgagtagggcaaaggagaggatgttgcggagggagggctagagctggagcagcaggaagagggggagagccgcaagtacggcggcagcaccgaagtggggaacatgacctccagacgtggcggcagggctcgtaagtggaatattcgggggagtatggagcaggtggcgctggatctagctgacccgcgtttgtcggcgtcagagccggtggatccgttgctccggcgaggagttcaaggggaggaggagcgggaggatttggacgcgccgacgcggagaaagggaaaagggatgtgtgaaaggtgttactctgggaggaggataaggttggagaggcgccctagtaagataaagatggggaaattgcattcccgcgcgcgccactagaaattgtaaattttgggagagattttcttttcgtttgtacattaagcaaataattttctatttgttataactggtttctttctacatcaaaaatattcattgataaccatcaaattgaagaaacatctccgttttttaattgaaactaccatgatttttctgaaattgaaatttgaatgctacctagttttttaagctaactgaacacgaatttggaccggtttatgtcaaactctgatggagtttcattaaaagcaccgagacaagcatcccccatgagttttgagaaaataaaatagttttacgaaaaaataaatttcagtttaaatgtgatgaaatttgaaaataaataaaggaaaattgtaggaatgtgtggaaatgtttggggaaatggtgggccggcggagtggagcggggtagcagcggcggtggacgagcgcgcggcaggcggcagctagcggcggcgagcgagcgcgcaataggagcagccgcggcgggcggctagcgagagtggcgtgcaccccacggcgacgacgatggcgacgcaagctcccatgtcagctgatctctccggcggcggcggtagcggcgtcgggctagcggctgggctcgccgggcaagtggcggctgtgccgtcctgagagtgagaagacgaggtgggcgggcgcttccgacgcttcttctcgtaggcgatgccgcgcaccttggcctggctgtcacagacctcgcggaggtagaggcggacaacgcgggcgccgaacgggttggcctcggggtggcctccgtgctcgtcgaaggcggtgcggaggcggccgacgagcacgtcgaggctgccccacgcctggcggagcgggcacggccatggcgccggcgatgaggggtggctccggcggccacacgctcgtccaccgcggccaccgccacgctcaactctgccggccgctgtcctcgccatctaagagagaaaagagagagagagaaaagagagagatgaggagagagacaggagatagagctgacatgtgggcccaagggcatttttgacatttcacgcgatttctctctcctccctaaccggaaaatattattttaattggcgcggtgtccactggcaaattatcacgtttatggagtgttttccccaaaagtgagtttggccaatgtcctagggctaaaaccacacataacaagtgtcctgtagcaaaatttgccattaatataatgtataaaatatatttaatataggatttaataaaattaatttggtagatgttatttttttataaacttgatcaaacttaaaaaaaatgagttcaaaaaatcaaaacaacttacgttctactccctctatcccaaataagtgcagccacgagtttctgtgtccaattttaatcgtccatcttatttaattttttttttaaaaaaactaaaaaaacataagtcacgcataatgtactagtaatgttttataatctaataacaatagaaatattaatcataaa

SEQ ID NO: 72720 - DNA, 699 bp, Oryza sativa
aaaataattaataatcacttaaatttttctgtataagatgaacggtcaaacatgtttaattataaaagtcaacggcgtcaaatatttagggacggagggagtatataagaagacaaaataaaatctgtccttcttcgatcacttttggtgcaaattgggcccctgtcgaaatcaaatcaacctatatggagaaccaaataaatttgtctacaaggcatcgcatatcttcgctgtctagccatttgcagctataaaacagctcgatatcagctgaacagatatctgcattcattcactgaatttcgtagggtttcagtattctcatgtgcaaaaacgcatagtacagatatcatcgtatcgaatgtaccaaacaaaacgtgtcgccacatttttggaagacgacgatgcagcgtagttcgtcacgcaaaggtttgcagattaaggtggtgattgaatatcctgaagatgaacattaagcatttcacgtaaaacgtggagttaataacgtgtgattaattaagttttaattattacaaacttgaaaaatggattaatatgatattttagaacaactttcatatagaaagttttcgcacggaacacacttgttagcagtttgaaaagcgtgccattttatttcaaaggtaatcacctactttcatcacatatctgtgcagacaccttgtcaccatgtgcaga

SEQ ID NO: 72721 - DNA, 31299 bp, Oryza sativa
gggactaaagttaccatctttagtcccggttggtgttaccaaccgggactaaagatcccggggggcctgacaagccctgacagcatttgaatcgggactaaagatgatattaagtcccggttggtgttaccaaccgggactaaaaatcaaatatgcccgttaccctttttaaccgggactaaagatcatctttagccctggtttttattgcaaccgggactattgtggaattcggccgaccgacgaacgatggtttctccactagtgaatactcttagtaccagtttttactcttataatgtatattgaacacatcagtaaacatattactacacggtggcgacaagatcatggctatatcaagaggaaggtggtaattgttttactcgcagaccacaaaatatcagtttttactcttataatgtgtattgaacacatcagtaaacatattactacacggcggctatgacatcatggactatatcgagaggaagatagtaattgttttactcacagaccatgaaatctaaataatattggtaaaagaattactagcgttgtaagctggtagtaattcttttatgaccatctaaatatagcatcatacgatgtggaggcattcatgcgagtaaatttgttactttagaatgagcagatgtgggaggctaggagtaaatgaaaactccacggagtaaattcgttacttttgagacgtgcggagatactaacaaatattttactaaaacgcgaaaagagaaaaactatagagaaggaatgaataagagaaaaatctggatggttaatattttaccaggcccattgataaagcatatataagatggaaaagagaaaaaagaaacacggaaggtggggtggtaaaaaacgaaaaaaaccgaaccgagaaaaggtgggatgcggaggaaaggtggggtgataaaaaatggaaaaacagcaaggagaaggcgttgtacggcgctcgaattattattcgtggaatagcgctaccgtatattatatacaaattttaaaccctccaaatacttactccctcctagggagaatcaaaccagtttgattctttttgcgacaaaaggagtatatgtgtgaatagtggaagtactcccttcatacctaggggtggacatcaggctcgctcgttgggataacaagctagctcgactcggctcattatcataatgaaccaaaaggctggctcgactagttcgttagctcgtttagctcatgagccagaggaagaccaaacgtggcatgccgtgaggagggagaaggtgagctcccagggacaaatgacagagggcagtgtcaaaataacttggttttcaaagttcatactttgtcttaaaataaattgatttctaccatgttacctaatcttgatcgaatcgagaagttttatcacttcaatactccttaccttccccaccaatactattttgaattaatgtgggacattttgatctttcgtactcttcactaaagttttctcgagatgtgagtgttacacttattttgggactgaggagcagtataagcatttatatattattttttggaacaaaagcaatgatgtatgtgtggtgaaacctatggagaaaaccggcggactatttcttaaatcatatttctcataaataaaaaacactattaaaatttgagaggtatccaaatcacccctcaatccctagtcctaggggctctactctacagtccccatcgacgattacgaaacatgagaaaaatcgaaaacacttagcatcacgtgtctaatgcacgcgaaatatcaaatgcttcacctagtgggtcccacctagccatttattcccacctaccgcaatgaatatcatggaaattgaatctagacaacttataactttattcgagataagacataaaacatataaactagaatgaaatgagagacaagtctcttaccccatgcatatagccaatgcaccgaaggcaaagaaggagggggactcgagcaggccaatggagagacctcacgaggggaatttcatgcaaagatgccgagacttttaaggttgtgttcgggagagcctcttctcaactttcctctctcgtttttcgcgtgcataattttcaaactactaaacggtgtgttttttaaaaaaaagtttctatacgaaagttgtttaaaaaatcatgtttatctatttttgaaaaaaatagctaatacttaattaatcacacgctaatggaccgctccgtattccgtgcgcacagttcccggttgggaaagctggcttcgaacacagcctaagtcaagaagcattatgtcattgacatttttttttcaattatatgttgaacacaaaacaacatgcacaccatgctcatacacctctaagtggcatctcttattacacaaaccaggtacaaatccctggcctcattaataaattctcatcgaaaatgaactttgtttaaccttttgggatttatataccttcctaacaatcgaaaaaaggcttaaaacctaattaaacatattggtatacacacagaaaaaagattacatccaaatgctgaacatcatgcatcctgtgaatataccaacaaaaacactaaattactttacggtgtcactcttcaagttctgttcccaaaataaaaaaaataggaacactaagggttgttttcatctttggtgtcggctgatggagttagcttaggagacagccgtggtctcttgttttgattttcggtgacggttgacggagctagcatcagagacggccgtggtctcttaaacctgttccttatctcggacagcacactcgggtagctctgtatcagattatagtactccttagtcgttgccacctcggcgaaattttgtgtattcgataggaatacaagacaggacgttcttagcttcggatatgatctcgtctccgccagctccagtgttgatgtcaccgtgtccgtggtgatgtcagcgcagagcgtgtcctcgcacaaatccttcaacgtatccactccgtatcgatcggcggtgacgagcaggtgctgcaattcgaagatccaggaggactgatcgtctgtgtcttttacacaggtgggcaggtcgttgcagtagatgtagtggagcatgtgcttgaaggtggaggcgctcatgtcggagatggtgatgcactccatcttgctctcggccatggagccaagtagctctgccctaaacacctccgactgacgcgccattatgaggcggtgcgcgtggaaactcttgccgtcgacgtcgaagcagacgtcggtgaggtctcgaccgtttgacatggtggcaaggcagtgggctaacaacgagtacggcgaccgcggcgacgagggaacaaagacaacccagcacaacgccgccaggatgccgccttttacacagttggccaagaggtgatccctcgaggctaccagtttgcagctagcagctaggttgctcccggcgacgggcggcggcagcttaggactgctacctgcagcggcggacggcgacatcaccgatctggcgaacggcggaagaacaggcgacttggtatcgtccaagagtgccatgtcaatgaacaccttgtgcgctctcgccaacgactgagctcggtcgctgtttaccgtcacggccagaatcatcatcacctttctctcacccagtaatgacggcacgaaaagagatgcttcgcatgtgtagccattgccgatttcgcaggtctccttgactatgcgcccgacgggccggcgtatcgccgccccgtcaacccggaacatgaagtggcggttgtcgccgcaagagacgagcttacacggcgagctgctgctcgccattggtggagaaagagcggcggcggcggtggcggtggcggaggaggaggggtggtcggcaaaggtggaggcggcgattcggtggcacggcgtgtatgcagaagcagtagcgtgcaaactgggaaatcccgatggattatattgcgatccatctgttcagagttcaactggacttagatttggtcaaatgtatcggggttccagacgatatacagaagaaggttcacgtaaggaagcacacaaagaactacgagatttattttggtaaagaaggagcaatattggcatgtgctattggcaattgcaacgtctacaaaatctttcttaagagcgtgaatagtatctttgacaaccattactacgtaccatataaactatctccgcgctgcatacatctctatctctactctactattataaaaattaaaaatacttccgctccgctagaattttggtacgtcatccgtgtttgaatcggttttaattttattgttcggtcgaatccttcctttctttacttacgccaaagtgtccatcttatccgagacacatgcgaattaatttgggcccgtaccttttcacgtgccccttgccacacgtagcaattgggctcgtgcctgagtgagttttccacacgcgcctttatgtgccactgtgattgggcccataacgacctcgcgtgcgtgattttccgcatgcacgattgggcccacgatgccgtcgtgtacttgatttgcccttgctgcatgttcgattgggaccgcgtcgtcctcgctcgcgatttaaaaattggagatgcttttttgtcaaagctatgatacgtcatccgtatccgattctgttcacacgtaacattcattgaaaagtcacgactcgcgagcaaactgcagaaaaaagttcatgtgatgtggataccaagcgaatgaaactcgcagagtccgcgtggatatcacatacgtcattgctcagatcatccgattttattcgtattacacaacacgattccttggacatgttagcatgatttcaagtcagtctctgtacatgctcatacgcactaccagggataccgttacagtaatctataaggatcaattttacttttgaaaaggacatgccaaccggaataaagatgatcgaagttgctgattctatccgccattaattcctgcccaaattgagataaaattggacgcaaatcgagcttgtatttgaatgcctcactgtttggcttatgcttcttcctataattcaaattttaaattggaatggattcacaataattctgaattttatcctatttagaatttaattttgaatttgacttttaggttttttatcgtactattttacgacatttgcttttgagttactaaaaaacatgtatataaaagatttgctcacacataatcttttatttagtaataagtgattcggattttcatacgaaataatgggctgtgattatttatccacccacacatatgtacaaattaaatgagctctatccattgcaatgcacgggcatcttttctagtatatctagataactatcattgcatatgctcacatgggcttgttaattgttatattctacaaaagacagcttaatttttgaccaacgtagaaagtaaggcaccacatcttgaaagacattaaaagataagcaaacgattgagcgcaaccactacattgactaactccgacacgtacaaaagctagtttttgaacgagtgtcagccaccatctttgctcttctgatagatcaacgaaacaaaactaacaccaccaaacaaatcagcaacccgaccctaatgctgacactatcaattggattgtagcaactcgaaaaatcaatctcctaggtcacattgggttaatttctggcaaacaacatagacataaaaaaagagatagaaaaagatcctgaacaatctacgtccagaaatattgtggaagataaaccctatacaagtttatagaccttacctctaaagattttattcaaaataaaccttaaatcttacaagaaccagatgagagatggattattttccccaatgcatccaacacaatgtggggaaaggaggagaggggggggggacccgagtggccggtggagaaaatcctcacaaggtgaatcaccgcgtgcgacgacaactctttagtcactaagcattacgacctagacaatcttttcagttacatgattacacaccacttttcatgcaccatactcacaaatccactgcttcccctccaactctgttgaccccatctcctctagattaggtgacctcgacaaataacaatggagttagggtcaaggttttgggagtggggttggggagagggaaaaagagggcaagttctccaggcttagacgaatagccatgggagttagcatcccgactgtgggcggtggagcagacatgcgacaaggtggtagcaacatcacggaagacggggttcggcagccggcagtgtacctatgttggcggtggcgaaggagctatcaaaggtgagaaagatgattgggtgggggacctgccatctgcacggggatagggagggctcgccagcgccattgccaccttctggtcagccggcaaggccaggaggtggcgcatggggtggtggaggtgttggcaacttttttgacaagttgacaagcacgatcgcagcaccttaagccttgcggtgatcctagagtcgccaaccacctcgatctagtgaagagctaaacctagatgggttttgataactaaaccgactagcggagccgatttctagataactacccgtctcgtgggcaaaacggaaggttttcaagacaaacctacaaagagatgtcgcactctcgcagcggcggcggacggtttacggcgcaaaccgacaaagatggacaaactaagagaaaactaaaagcaatatgaaaaacgattcgattgattgattgtagattttttttttacaatgaaccggccatgtcccttatataggagttggtcttgccctctacagtcccttctccatgtccaagttggggtagaaaccaaaggaaatccaaaacatgccttcctgagcaaggaaacttcgagacccgacgaaacacagtcggacttggacctgctggttagaccggccacacaccgccggtctgaccggccctcaaccggcggtctaaccgcccaacacacggcggtcagaccggcccactcggaggaaaccggtagacttccaaattttggcaatctttcctatcttaatcctaagtgccaaatttgggtgtaaacacatgcccccctgcctttttgatgaacaacgtgaatctaaaagcatagaacatgtttttgatcttaggacgataacccaattaccggccatagtacctcctaagcgtcttgccaaacgctcgggaagtatttcttcaagtatttgccgttgattgctcactgaaaacgctccccttgaagtgtctccaaaaagtatgcgtttcctcgaacaaatccgcacactcgataaggaccctcccaactaggagaccacttaccgaactccttggatcgagtacccaaaggcaaaattgtcttccaaaccaagtctccaacttgaaacaactttgctttcaccctcttgttgtacgccttggccaccctcttcttctctttctctatctcttccaatgccttcaagcgcttgtcgatgacttcatcaaggttgtctcccatcaatgtcttgtaatcttcacttgacaaatcatcttgcttgatataacgaagagaaccaagatttacctccaccggtaaaacggcttcttgaccataaaccaactcaaaaggagtgactttagtagcaccatgtttagatatcctatgcgcccacaattcttcggaaagcacctcatgccacctctttgggtgttcctcaatcttcttcttcactaacttcaacaatgtcttattactcgactcggcttgtccattagcctgagcgtagtaaggagaagaactcaacaatttaataccataagattcggtaaaactcttcacttccttagacataaaagaagcaccttggttcgtagttaatgtttgtggaataccgaatctatggataatatgcttcaaaataaaatcaattacctccgtatgagtcatattcttcaaaggcatggcttcggcccacttggtgaagtaattcgtagcaactagcacgaacctatgcccctatgatgacgaaggataaatttgaccaatgaaatccaaagcccatcatcggaacggccatggtttgattatgggattcaacacggcggcgggcgccaattgaacattgccgaaccgttgacaagcctcgcatcctctataatatttgaagcaatcatcaatcatcttcggccaatagaaccccgctctcctaagtaaccaattcatcttgtgggccgattgatgagttccacaaattccttcatgtacctctcccatagccactttagattgatcttcatctaagtacttcaacaagacaccatctatatttcggcgatacaaatctccatcaagcaatgtatatttgaatgcttgccaccgaattttctgatcaaccttaagtgtaggatctttcaaatattgaatcaaaggaattctccaatcttcttctgtttcctgggcacaaacgtccgaattcacaattaattcggcctctaaattgattgaaacgtgccccccagcgctctgcccagaaccggtcagaccggccacacagggccggtcagaccgctcggggttgccggttagaccaacggcatgaggccggtcagaccgcccctggtcactggtcagaccggccatgcaatgccggtcagactgcccctggtctccagttttgccaatttcgcacaaagatttaaaatcaagcaccggttcttctaataccagaaataatccctttttcacattatagccagatgcttgttgtgccaagtcatttgctctagaattatcatgcctagaaatatatctaatagcaaaattttcaaaattggcaataatatctaaacatgaatcgaggtacctatttagtgatccgtccaagcatttgtagactccggcgacttgttgtaccaccaattccgaatcaccaaaagcctccacgtatttagctccaaccatctccataacttgtaagccgaataataaagcattgtattcggcttgattatttgtacaataatactccaaacgaaccgatgcttcataacacatgccattaggtgaaaacaaaactacccctatgccttgaccttccttgcaagaagaaccatcaaaataaatcttccaagatataacttcaactaagcagaccttttcctcataagcaatatctacatgatggtccactataaaatcacatacaatttggcctttcatagatttcaatggttcataagccaaatcatattctatcaaagcatatgcccacttgccaattctcccacttagaattggcctttgaaacatgtgtttaataacatcggcttgacaagcaactatgcatgtactagataacaagtaatgcctcaatttggtacaagcatagtataagcataaacaaagtctctctataaagacatacctcgtttcggcatccaaaagacggcagctcaaatatgtaatgatatattccttgccatcttcctcttgcgtcaaaacggcaccaatgactttgtcctcggaggcaatatataaccgaaaaggctttccggctttaggcgctcacacaacgggtggggtagacaaatacctcttcaactcttcaaacgcctcttgttgttttgccctccaagtaaaatcggctttttttttcaagcgaagtacaggaacaaaagcatcgattttacccgctaggttagaaataaaccttctcaaataattcaccttacctagcaacttttgtacttccttcttgcatgtcggcgctttgaaatcacgaatcttctctatcttcttaggatcaatctcaactcctctctcatgcaccatgaatcctaagaacttcctcgccgacacaccaaaagcacatttaagtgggttcatcttcaaaccataccggcgcatcctctcaaaagctaacctcaaatcggctatgtgtccttccataccatccgatttgacaacaatatcatcaatgtagatctctaggataatacctaacaaatcatgaaagatcaaattcattgccctttgatatgttgcaccggtattcttcaacccaaaagtcatgacaacccactcaaacaaaccaacaaatcctgggcacctaaaagccgtcttgtacatatcctcttccgccataaagatttgattgtagccggcattaccatctagaaagctaatcaccttatgacccgaggtatcattaatcatcacgtcggctataggcataggatactcatttttgggagtggctttatttaaatctctaaaatctatgcaaactctattcttaccactccccttcttctccaccgggactatgctagaaacacactccgcataacgacatggcctaataaaccccgtcttcaacaaccgatcaatctcctatttgactcggtcatatagcaaaggattaaaacgacgaggtgtttgtttataaggccaaaaacccggtttaattggaagctgatgctcaacaagctcacggctaagacccggcatctcatgatattcccatgcaaagcaatcaacatattctttaagtagctcgattatctcaaccttataatcggctctcatatttttgtttacaaaagtcggccttggtttggttccatcacctatgtctacttcctccaatggatcggccgatgtaaacccttgtccaagcttctccacttcatcaaaattttcaacggcttcaccaatatcgttctttgtagaccaatattcttgcaccctcttttgtaaccactctaaattagcctctttactcattatacaaacttatatggcttagccgtgctacactagccggctttacagagataggtacaaatttgccatcggagatactaataaaatcatagctagaaagatccctccccgataagcattggatattcccatgacgccactcaaaagtagcatcggccattgcaacctcggccgatgtatccgcttgaacaatttcaacatcatcgccgtcccattgaattaaacattgatgcaaggtagaaggcacacaacaattggcatgaatccaacaacgacccaaaataacattgtagttaccttgcacatcgacgatgaagaaaacggttggtagcgtcttgtttcccacggtgagctccgccgaaaagatacccttcgcctcctttggttcaccattgaagccattgagaatcatgttggtcttcttcaactcatcatcctcacgccccaacttcttgaataatgagtacggcatcaagttcatggcggcacctccatccactagcatcctagagaccagtttcccatcaacatggcctttgagatagagaggcttcatgtgatggtttgactcatcgggcttctcaaaaaccgcgtctttaggacctaatgagaattgagcaacctcggcttcatccatagcacaaaactccatagacaacatacataccatgttgatatccatgtcttcttttggagatgattcacctttatcaaccaattgctcctccttctcttctacatcaaccggcttttccttctctatggatttacgcctccataccggtggtggtcgaaactcattgaatcttttatctctttgttcttcggcctttttctctcttatttcatgagctccaagacgttgcaaccttctctttcgagtagccatcaaatccttaggcatccatctaggattcggctctgttccaggaggtaaataatgccccctattaattttgtttgaagacgatgaagccctcacatcgccctttgcaattctcctgtcaaaccggcactggagcccggtcagaccggccgtagaccatcgatcagaccggccagatgcgccggtcagaccgacacttggcgcacggtcagaccagcctgaggcgtcggtcggaccgctgtcgggccggcggttggaccagccacatggctgcggtcagaccggccagagggcccggtcagactagccgactgcgatgagctggtatcggcttcagattttctatttgaggacactccaactccatctccagaaggtattggcacatcatgagaccccactttgatggtaattacttccgaagtccttgcctccaccttgatgtgctttcctttccttctttcttcatcagcccgatttttaccataaaaccggccgttgtttggtgaagacaaacgctcatgaattggcctccttagtccttcccacccttggttgaattgcattggaggcatatgattgaacattggcggcgttgccccccatggcatgtaataaggataaggataacccggcggcggcattggataagaaccccatgacatatcttgtggatgatgatatggaggtgaatgcgactgtcttggtgaatgaccaaatcgctccctaggaggtaatcttggtctttttcctttattgcgagctctcaaaccaccttccttctcatacttttttcaaaagcatgtcaaaagtcactttggtcttcctaggggctttagaagttgaagctccactcttattctccttccaaatgccaacctccggcttctttggcactatcatcttaggccttggtttgccaatgaccactccttttcccttagtagattcggcttgctccgaccgaatcaacacttttttattattgaaattaattgtattcaccggaaaaggatcatgatcaagcttcatcttggagccatcggtgaacttcaatcgtccttcatctatggccgattgaacctgtcgtcgaaacacattgcaatcattagtagaatgagaatgagaatcatgccatttacaatatgctcgacgtttgaactcttcttgagatggtatgacatggcctttaggtaatctaatttgtttttcttgtaaaagataatcaaaaattttatcacacttggccacataaaaactatatttaacctcactttgtcgatctttgcgaggagtcggcattaggttagagcaaacaaaaggcttgtttttattagtacatgaccactcggcaacatatatatcatgataaccctcttcctcactatcactagcctcagggtaatcaatcgcattaacattgggctttttgtcatatgatctaacaagttttttattatccttaacccggctttcctgagccagagccctttgcataagttgactaacatcaagaaattgttggccatctagtctttctctaagaggagcaattaaaccattaaaagcaagaccagccaaatctctatcagttatattcaaggtataacatcggtttctaacatccctaaatctcttaatataatcaatgactggctcattatacttttccttaaccgatgttaaatcacataacctaagctcagtttctccagtatagaaataatcatgaaatttctcttctaattgagcgcaagtatgaatagaatttgccggtaaagaagtaaaccatgtaaaagcattaccagacaaagataaagaaaacaagcgcaatttaaaagtatcactattagcctcaccacattgtgccaaaaattgacctacatgctcccatgtggtttcactatcctcaccactaaacttggtaaattcgggaactctataattacggggaaatggcacattatcataatagtcaggatacggctttttgtaaaccctagcacgattcctagtttcaatcccgaatctattcctaataatctcactaattatatcctccatattattaggcccatgttgatttggcggtggattaggtggtctaataggttgtgtttgtggcgcaatatgattatattggccttgtctagtatcgggaggataccccctagcaacatcattataagcattaggaacatgtgggggaacttggggactacttgtagcactagatacaggaggatcaaatgttctaagatgatacaaataaccaacattagtcattggatctattccctgtatcggaacaattgcgccggtctgaccggcccagggcccggtctgactggcatccagaggtgcggtcggactggcctgagtgccggtctgaccgccggggtaatacccggtctgaccggccgtttggccggtcggaccgacggctaagtcctggtctgaccggtcgtcaggcccggtcagaccggccgtgtgcgccgttccatcggttttactacccgtttgatctataggaggttggttagcagtggtagaggctttatcctttgacatgtaatcagccataagagggccgaatttaacccttaaaaacttatcaaatttaccctcaaaagttgcatctaacttatctttaaaagcaatcatagatgaatctattgtagatgctacttgttgttggatagattgtgttacctcatcattacttaccaagtcgggggcaagcttaggacgtggcccgggcttgatgatcacgccttgaggagtcctagtgcttgccctcatcaacgcctcccgtgtgagttcgttgatgtactcctccatagctttgcggtcctctccttcgatatcctccaatgtgaccggtatcacattggatggctccacctccgtcttggatggcggcttcgtcatggcgaaatcgaagttgagttgacgatgaacggatctcgtccccagtggagtcgccaaaaatcgtgttggcaacttttttgacaagttgacaagcacgatcgtagcaccttaagccttgcggtgatcctagagtcgccaaccacctcgatctagcaaagagctaaacctagatgggttttgataactaaaccgactagcggagccgatttatagataactacctgtctcgtgggcaaaacggaaagttttcaggacaaatctacaaagagatgtcgcactctcgtagcggcagcggacggtttacggtgcaaaccgacaaagatggacaaactaagagaaaactaaaagcaatatgaaaaacgatttgattgattgattgtagatttttttattacaatgaaccggccatgtcccttatataggggttggtcttgccctctacaggccctactccacgtccaagtcggggtagaaaccaaaggaaacccgaaacatgccttcccgagcaagaaaacttcgagacccaacgaaacacagtcggactcggacctgccggtcagatcagccacacaccgccggtctgaccggccctcaaccggtggtctgaccgcccaacacacggcagtcagaccggcccactcggaggaaaccggtagacttccaaattttggcaatctttcctatcttaatcctaagtgccaaatttgggtgtaaacaggaggagcatgagggcgaggtgaccatgtggaagggaagaagggattagggttgggaattgttgcacaaatctcaaagcgtataaccgtctaaaattcgtaaggtttcgtaaggtttttaggtgtgttttctatcaaatccatataggcagtccctttctttaatctaccatctaaacttacatccaaaatatagagtacttttaatttatcatgtaaatgttgtagccatttaagttaattattacttttattttgctatagtattaagctagattaattaacattgtggtttagcaaaacattagaaccatattacatgtggactatgtgccaaaactcttatattttttaaaactttaaccataatatgtgggttttttaaatttattttacctctaaagcagttgggatttatacaccttcctaaggatgggaaaaaacaaaaaaaaactaaaaatcttgatagaaataaacactactaaaaaaatgacatcagtgctgaaaatagacccgacataaaacttttggcactaatgataccctcccccctgccaaaaaatcagtgttgggtctctgcccggcacatatgggcctagacgcacataggcaaaatctggatagaatcatgtgacaggtaatttctaaacccaacactgatatggacaaaatttaggctatggaaaaagtacaaaaatatttttaatactcttactatccttactcatgtatctacaaagccacaaccactattacctattttcgcaagtcgtatataattcgtgtcatggcaaggattcaaacttgagacttctacctcgtattcagtttccttaccaactcacttacacatcaatcctgttagcaaatggtattttcccttttaagcctttctaaacccagatttgaatcatgaatttgagtataaaaacacaaataaaaatgttgtcaactaccaaattatagatcttgttgagagctacaattttcatataaactgtcgtaatccgaatttgtctgaaaaagttatgttcatatggtcaagcttatcactgcctggtcataataatacccagcatgaccagtattctaaaagcccggcactgatgtccttttccgctaaaagtagagtcaactcgttccaaacgggaaaacccgacactgatgtgttactcatcgatatcggttagtgacaagacccgacactgatatgtcaccgaacaatcacagccagatggttgtaagacccggtatcgatgtcttcttatcagtgttgtgtgaagtaggtgcataatgcgaactcgttctttgggctgaaaagcatggtcagtgctggattttgtcgatccggcactgatgagaggggcattgattgtaacaccctaggtatccttttacctacaatgctatacactatggaataaaaaccaccaaatcctaaatccattaagaattttgacagagtctcccctctaaatccattaagaattttgacagagtctcccctgtaaatatggatttccacggctggtagttaatatattaaactattaataatattattcccacagtgcgatccatccatataatccatggaaataaactaatagatatctaaacgattattacaagaccaaaccatgatatagtttaagtgtcattatgtacctaagtaatatagtttgatagtgtgtagataaatgtgtatataagagtgctacttcccgcccttgcatgccgatctcaatgtgtacctaaaaccaaacaaacacaatagtgagtacaaaaatactcagcaggtataatatggaagtagaaaacacatatacacatgattggaaatagagaatgagcaaaaagttttccttctttgaaaagaaatagcaaggttaaaggaattagtagttcccatcccgagcatacatgaaataaagtagtattttccatcccgtacagttgcgaatacatcctaacaattgccggcaagaccgaataagcgtgatcagcgcttacccacatgaacatgaataaaaccagatagcatatacatgactcgcatggaacatgattaattgaaaccggaaataaggaaacaaattgaaaccatattgcacatccatgacaactatggaacttgaattatttactgagaactagcatacggaatattaaaacaaggataacgtcgtaaacataaaatacacttgaaatctaaatggcatgaacaacagtctgaatataagcagccacttatcacatagaaatataacggaaataaatagatagagccatcaatccataaatcacacaattagtttgtcatgtacttgcatttaaccttgacggtaacccgacgaaccaccttccacaccagatctctccacacatatggagcaaaactacgaataaaccactgtattcaactaatgatagttacaaaggatatttactaaaaatcaaaatctagaacatataaactttttacctatttgtattaaacaacctatagtagttccattactgctttatgcataactcgcaaaccgtctaacggaatctggcaaccaatacaactttggtcatctagttaaaaactgtctacaacttttatgttgggtgaaaaatcaggttacgcttctgtaggtctcagattaaggaaacacgaattctccctatttccagacccgacagtagtactttttttgttgtttctgctaaaccgtttatcggaatcaagggaaactagcgccgttagaaagatatcaacgatgactacaaactttatttaggacaactaacctgaatcctgatgatttaataccagatttgaaaatacggtttccggcccgtaaacaaaaacctcaaaaattgcacgagcggctatcgaatcactttctatttgaatcttatagttctagggagtaaacaaaaataccgttacagcgaggatactaaacaaaagtaccgttacagcgaggatactagaacggcctttaccttcccttcttcctcctgttctcctgatcctctgcactctgaaccttctcctctctgtccgatgcagcagcagccagcagcagaccatgcagcagcaaccgcatggaaccattagtagcagcaacaaacaaccaaagctgtagccatagatcagatcgacaacagcaggagctcactgggaagaagcaaaacggaaaggaaccatcggttgcgatggatgacgacggttttgcggtctctggcaatggccgtggtggcggcgcaaagacggcggctgcaaccagatgacagcagcagtggcaagagcgcaggtgcggtggcggctagggctggctgtagcgatctctcctttattccttttttctttttttttatataaagaaaaaatgcctgtgcgttgcaatgggtaaagttggttttttttacaagccgagtaataaaataaaatattgggatcacaatacattataattaaaaagtagcccattccgtgcctgtaaaatggtggagttatcctcctatcaaattcggctgaatctttctcgatctcccaaaattgatcgagtgcttttaatctactcgatctcctctttctgtttgtctactcgatcttctctttcagtttttttcaaaatcagagctaaccaaactcacccatcgaccattatcaactacggttaaatatagattaaattcaacaaattaaatccaaaattgaaataggaaatcatggggaacatgatgataaaggtgtgggaaatcgatttttataatcaattgaaggaggaaatatatgggatatgggaggtagcctagctgcagcttaggcttgcggattggataggaggagatcggaaaaaaaacggaactgacccactaaaaaattggaaaaaaatacatgtggagaagggaaaaaccgggccaaaaaaagctaaaaaagcaaaaacatcttaaatttttataataggtaaagatgagactaaaaaggagatctaacgcccacatcatttcaatccacaagacatcattcggactccgattactataaatttatagtccatgttgcattactcgacgagctctacgcatccacggttcctgatcgcctattcgaaacagtttaaaagttgaacttttacgtgtatattctaatatttttcaaaatacattaatttgaaactcgggtattacattgatgtgctgctccatggtagtgaaatgattacattcaaatgctgtgcatcacgttttatgtagatatatgccaacaagacctctaagtactaacatgatggcactctctaagttttctatgtactaatctatgctttctataaagttacaagcccactaagtcaggcaactatatatgccactttatcaccctctagcaataattacatatttaatcatgcaagaatacaacataatttacaatttaattaattatacaaatcaaaatgcaagcatatccaatcaccacccctcatatcatttgcataatattttaacaaaactatctatcacatttacaatatttaacatatattgatcaatatgtttcacactaaagcacgtgtatcatttgactgataaaccctaatgtttcaactttttttctttttactcctagcttgattgtaaaaaaaaagttaatattggaaatttcttagtaattcccgctgcaaaacgtgggaaatcacctagtactaatatataaaataggccacatcaccatccaacactagtggagaaacctttttttactcccggttggtaacccctttagtcccgggtttccaactgggagtaggaatccgggactaaagatctggttgaaataatggggaccaaagatctatctttagtaccggttggtagcaaaaaccgggactaaatatagggatctttagtcctagttggtaaagagagggtagcggcagtctagatggcccccttttcttttttgtttcttttttgttttctcccaaatcgagtggcatgcacatcccaaaccaaacgctaaatctccaaatcaaagtaacatctcaaatccacatcacaaatcttaaagttacttatacgcacaaatcaaatacatcacaaatcctaaaaaaattacacacaaatcaaaaacatcacatattatacatctcaaatccatacaatgaatcataaaattatacatctcagtgattcacaaaataaaaaaaagaaagagaaaacaagctccaagcacagcgccactactactgctactactcagtgcaccgtgtttgcagctgcgcgcgcatgtgctccccctgcaaccgcacgtttgcaccacacgccgcgcgtccgcgtggcctcctccgtctccaggggagggaggagaaaggggagaagggggaggagaggggaggaggaaggggaggcgaggatcggctgtgacctgtgaggaagtggttgtgattgtggaggagaggataagggttagggattatatactacgtgttgaattttagtcccggtaataccaaccgagagcaaagatctaaattatctttaggatgactaaagtggtgatctttagtcccgattggtgtcaccaactaggactaaagatcctcgccccctgacatgcctctaacagagaatgaatcgggactaaaaaccatctttagactaaagatcatataatggctgtggggttttcaaccggggctaaagatcatttttagtcccggttctttttggaactagactattgtggttttgggtcgacctagtaaagatcaattctccagtagtgcaagtatcctacatgacctataccacaatgagataagactctctatttgctagtcctatataggacacagaccacaacaacaaaactagcacagacctctaactcagtaacaacgacgaaagtagcataacgataatatattagacaactggaataacatttttatggggtttataatatacacacaacaaagctataagttttctttaaaagaaaacccgtggcaacgtatgggcattatggtagttcattctgaaattaattaacatgataacaactgtaattaagggttgttttgatctttggtatcggtcgatgggaatttcggagttagccgtggtttcttaaacctgtcccgtatctccgtcagcacgtccgggtagctctgcaccacctcgtagcactcgtcgttggtcgccaccgagtaaatctgcgtgttggacaggaactcgaggcacgaccccctcagcttcgggtacgaccccttctccgtcagcgccagcgtcgaggcgaccgtgtccatgttgatcccggcgcacagcgtgtcctcgcacgcctgcctcagcgcctccaccccgtacgcgtcggccgcgacgagcagccgctgcagctcggcgatcctcgtgacatggtctgcctcgccgtcatcgtcgtcaccgtcgccggtggccggtggcggtagctggttgcagtagatgtagtggagcatgtgcttgaaggtggtggcgctgatgccgtcgatggtgacgactgcggtctccgtcttggtctcggcgtcatcggagccgaacagcaagctcctgaacacctccgactgcgccgccatcaccaggcggtgcgcgttgaacctctcgccatcgacgtcgaagcatacgtcggtgagagtactgtccttcttgttcgacatggcggcgagacggtggcctagcgagtccagccataggcaaggtggcaactccgggagaaagagcacggagcacaccgccaccaggacgccatcctgcacgcagttctcctcgaggtaatccttggagacgagcaacccgcaccctccttggttgctcccggcggcggcctggatagccatggatctcgtaggcggctgcagggccaccgacctggcattgtcgacgaggacgagatcgaccaccaccttgtgcacgtctcggtagcgtgggccggacacacccacggagaaggcgaccagctttctccgcccgatcagcagcctgaagaacgcctcacacctgtacgcgccgctgtcgccgatggcgcacgtcgtgcacagcgtacggccggcgacggcgggtcgcctcgcgcccgcgtagtcgacccggaacgtgacgtgccgaccgtcgccggaagagaggagcttgcacagtgggctgtcgttgataacggctacaccttgatcggtggtgctggcagctgccattggtgacgtcgagaaaggagagtaggtggaacagtagggggtggtcgggggtgggagtgaaggcgtcgatgtggttcgggttggttggcacagcatctatactatgcagaggcggcaaacgagaaatccgattggttatatttcggtccttatatttagagttcggtttggaattatatctgtttatctattcggtttcaagaagagacacagaaacgtattgcaaaactatgtatgtagggcaacccagtgtgtatatagtagtagtcgtcgtccagggggccggtttgattttggttaggaggcaaatgttgacaaccgcagtatacattccttctagatatcagagcaggaacaataattttgacaactattaccatattaactcttcactgtatctcttctctatctctatctctatctctatctctactattataaaattaaatatgtttttaccggtactttggtacgtcatccgtgtatgggtcggttttatgtccgtttgcttttagaaatacaaattcgtatttgagtcggtttttaagttcgttcgcttttgaaaatacagagaaatcgtataagaaatctctttaaaaaactcgcatgctaacttgagacgatcggactctaattgcagctcatgattttgtaacaaaatatatatccaaacgaatttaacacaatgcatttcatattaactaaaccatatatctctatctcttctctactattataaaaattgaaggtgtttttgccgatattttggtagatcacccgtgtttgaataggttttaatttaatgtttctatccaagcaaattaattgggctgccttgaaaaaaaaacgtgtccgattccccgtaaagagggtgaaaaaaccgtccgtaataaaagtaaaaacagagcgaaaaagtcccccaaaagaaaagtctgattccccgagaacggcgaaaaaaagtcgttccttaataaaacaaaagattcatttttttatgcagcaataaaaaaggcagttaagcagtccgtgaaaaaaatccatccaaataaaaaggcaaaaataaacaaaaaaaaagccttcaaaagagaacagaacgtttccgtcgtaatctttacctattataaaaattaaataattttatactcatcgaatttttgtccgttatcccttcgttccaacaagccgtcttgttcgttactcggttcccgaccacgcgcaggtatgtgatcggccgcatccggctctgtttatgacgcgtacaatgcgttagacagctcaaccaagtaccatgtaactaaggtttatcctcttatttaacatataagtgtgttcacgggtgttaggacaaaactcaacgagtactgtatgtgtattgtctctgtattcaaatgtgatcaactgtgagcaatgtttacatatttatacaaaggtatataagagaaaattactttattgtgagcaatgtttacatatttatacaaaggtatataagagaaaattactttattgcccctagttctatagtgaatctagagtggctggccggtgggctagcccttgggcagagaaaatactatgacaaatttatactgtagcatcgatggtgcaacaggatggcagagggaatccaagccgttggctccatcgttccaacggttataatgtgctccaactgataaagttgtagtcgttactacaacaacaccggatctcacttcttcaagacggctttcagatgctgcacctggccactgactatccacttaattaatgcaaggggtcttgctatcggtgaccagctcttcttcacaaacacggaacgtcggcagatgcttctaggtgagccccatggacctgctcgacagttgagatggtttttttaatttaggcaagattcgatttgtacaacggtgtctctgttaatctatctttatctttaccatactataatggagcaatttaggtagacatgctagaccctcaccgtttgattgtgaaatccaatggcccagatcagttcaacgatcctcctagagtctcagtgaaatcattcgtgccaccaactaatcccacacatacgcccctccctctggtgctaaccacgcctccaaccctccacaacctacacatagatggccaaataggctgctcggcccgaccatgcccagccgtgagatcagtcatgccgacatggtccgacctacacgccgaatcgggctgtgtccgttcgtgggatgcacgacctaacaggggtggatttaatgtagaaatgatgagggccttggacccttgtcaaaattacactccttaggtatatcggtatatccctagtagtatgacctatgggcccccactttaattgggaggaaggacctcagtccccaagtttttgttcctttcatcgcaatcgcgcacgcgtggaggggtcgaacggccgctccctttctctaattctcccagattccatcaactggcaaatccgcaaattatggatcagggaagggaatagaaagcgaacccaccattcgtcgcgcttccccgcatgccacacagttcgtcttcacctgaatcgccgctttctgccttcgtcgaccgctcatcatcgtcagcgcctcagcctcagcagcgctgctcgttctctcctctctgcctccctggtacgtactcatccccttgaccctctcctccctttcgtgctatcaatagttataggggatggatccataagtctccctcctcatgtgctctatctaattagcattcccatgatttggttggtgagataatgaacaatttttttattaaaaatccagcagctatgaacaccaccggaggaagttctagtgcaaatgcatctagcccaatactgagaaaaatctggactctggagtgcctcaaccaattcatatggacaagtttcctcggatacagtaaaaggaatagaatggcagttatcatcccaacatgaagacataagaaaatattagatacaatctctaatgacgtgattgtcgattgtttccataaaatgaaacaccgtcgtgaaaagggtaaaaaggatgccatgtactatatttataaatcttatttcttatctatatatactagtttcagtaatatttatatggcttgtgttaacttatgttgtttctatatacaattgacattatttgaaaggcctatctatatattactattaaaaataatgtaatatctcagagtttttagaagctgcaataaggtgagtttcacttggctttctaactattctatgagttatatagatgcatgcccccagtcattttttatcctgcgtccgccccgcgacctaataagatgggttgtgccgtgccggaggcacgaaagcccatcgtactcgtctttagaataagtctattttgccttccaaatctctttgggtcgtgccatataggctagaataagtctattttgccctcaactatttgcacatgccttatatggctgacaataagtctatagttcctccctcatccattttcctccgatcattggaccgtgccatgctgggccagcccaccatgctgaggcagaggccgaggcatgacccaacggtcaggccgggttggcacgggcccaacatgtgccgtgcctggaccggggcaaaaccccataccatgggccgggccatcgggcattcgggcctaggcgttttggccatctataccctgcagcccgttccccccaactcccgtcgtcgctgccctccagctcccatggcctatgctttccatcgctgcaggctaccccagtcgctgttgcgccctccaccttcactgcaccgttctcggaagccctaatgggcgattagtcacgccccccgcacggcccgcagtcagttgactcctctagtctctcctatctactacatatatatacgtatataaagtatatatgtatgtatacatattgtatatatttattatttttttaatatgtatatatttttatatacaaagtttgtatagttatatataaactttgtatatgtatatatacaaaatataccaattttgtatacgtatatatacaaagtttgtaaatgcaatataaactttgtatactcatttgtatacgtgtgtattaaaaaaccgaaaaaactgaaaaagatatggaaagaaaaaacagaaaaaagaaacgtgcgccaaaaaagaaaaggaaaccggactaaaaatatacgaaaagaaaaaaaaaacagaaaagaagaaaaccgttcgttaaaaaaaaaaaagggagaaaccgcgtgctggccgcgtccccctctccgcgcgggggaggacgcgcgcggctgagcgctcgttagtcttttcagcgggtttgccccaggatatggtactggtggcgctggacaaagcagacagcgattcgcgacggcaagcagtacatgtggttggtcgttgcatgcgtggctactgttagaataaatgggctggcccgatttttctattaaattgcaaaggcccataataaatattaaggataataatactaccctgggaattaaacgaggagtatctcaatttaaatagggagttattggaggctccctgttgaccggttgaggtgtggatcggaaagccacacgcgcgcgcgcctagcctgtgctgcttctgtctgcttccccggttttgatcgcttgcacgcacgagagatcggaacgagcagggcattcagaaccacaccattgcctgagatctgcaccgggtaggcgggtgatcaagtttttggggagtgcttccgcacgactgctctcgtcttctgttcgtcgacgttcgtcatcgaccgtacgtctgcatcaccatgtctgcctcacttgcacctagaaatggcgcatcgagagctggtgcacagaacaacaacaccaacggaggcagttatgcctcacaatccagcggagggactttcacagggtataatcctctactgctatttcagtttttgatatttctgttagtcgcaatgcaattgcgttctatgtatgaagatgatgtttactctaccttaagcatgctcctgtttatatttgattttatcactagatcacctcatattgttcatgtcatgattattgtcttaatattttggattaaaatatgctgatatatgactatatttccaacaatccaaaaacctgataggtcattttcggtagttgggtttgctgctgcactgaaaccacatgcttttgatggttctaattataagaggtggaaagcacgtacactactgtggttgacagcgatgcaatgtttctatgtttcacggggcaaacgaagtgaaccacctgtctctcctgaggaagaggttaagttcgaggcttcggattgcctgttccgtggagcattgatcagtgtactcgctgacaatatagtggacgtgtatatgcacatgccttcagggaaggacatgtgggatgcacttgaggccaagttcggagtttctgacgccggcagtgagctgtatgtcatggagcaattctatgactacaagatggtcgatgaccgttctgtagtagaacaagctcatgagattcagatgctggctaaggaacttgagaacaacaactgtgagttgccggacaagtttgtggtgggtggtattattgccaaattgccaccttggtcggactttgccacttttctaaagcacaagagacaagagttcagtgtttctgatctcattggctttttgggtgttgaagagaaggctagggcaaaggacaaccggggcaaaaaggttgagggaggttctagtgccattatggtacagaagaaccctcatgcatcccacaacaacaaaaaagtcatgcctgatgtcaaacccaaggctacaaccaattttaagaagaaaggcaagggaaaggcaaagggagactgcttcgtgtgtggcaagtctaggcattgggccaagtactgtcctgagcgcaaagacataaagtctgccaacatggtcattagcgagggcggaggaacatcggggtacggtaaattattacctatagttctctctgttttttcattcacctgattggtaggttgatactggtgctaatattcatgtatgtgctgatattttcctgttttcttcttatcaggtcgggagaggttcctccttgttcatggtgttggtacggtcgatctgaagtttacttcgggaaagaccgtgcagctgaagaacgtgcagcatgtcccttcaataaagaagaatctagttagcggctctctactgtgtagagaaggttttagacttgtgtttgaatccaataaatgtgtcgtatctaaatatggaacttttattggaaaaagttatgacagcggaggcttgttccgcttttctttggatgacatgtgtaataataataatgttgtgaaccatattagcgagaatgatgagtccaatgtgtggcattcgcgactctgtcatgtgaatttcggttgtatgacgcgcttggctgacatgagtttaatttcaaaattcactttggtcaaaggtttcaagtgccatacttgtgtttaatcgaaacaacatcacaagcctcacaaggcatctgaggcgagggatttggcacctctagaacttgttcattctgatttgtgcgaaatgaatggcgtgtggactaaagggggaaagaaatatttcattacactgatagatgattgcactagattttgttatgtgtatctattgaaaacaaatgatgaagcattgcattacttttaagacttataaagttgaggtagaaaaccaacttgaaaggaaaatcaaacggttgaggtccgatagaggtggggagtattttttcaatgagtttacatccttttgcgaagagtttggaattattcatgagagtacgcctccctattcaccccaatcaaatggggtagccgaaagaaagaaccgtactctaactaagatggtgaatgccatgttagacactgcggggctttccaaggaatggtggggtgaggcagttttgactgcacgtcatgtcctgaataaaattccaatgaagcataaggaagtaacaccattcgaggagtgggaaaggaagaaactaaatctctcatacctacgaacatggagctgtttggccaaggtaaatgtacctatagccaaaaatgtaatcttggaccgaatactgttgattgtgtgttccttggttatgctattcacagcatgggttatagattcttaatagtaaattctagagtacccgacatgcgtgttggtacaattattgagtccagagatgctacattctttgagaatgaatttcccatgaaaaatacacctagcacttctagtcaaaaaactgtcataccccatgagcactttgcaccgatagaacacaatgatcaaacgcttgagggaaatcctgaggaggataacattgtagatactcgtaagagtaagagacaaagggttgcaaaatcctttggagatgactacattgtatacctcgtggatgacactccaagaaccatagaagaggcatattcatctcctgacgctgactactggaaggaagcagtacgcagtaagatggactcgattatgtctaatggtacttgggaagtcgttgagcgttcatatgggtgcaaccctgtaggatgcaaatgggttttcaagaaaaagtttaggcttgatggtacaattgaaaagtacaaggcaaggcttgtggccaagagttatacccaaaaagaaggcgatgatttttttcgacacctactcaccagttgcccgtttgaccacgattcgagtactacttgctctggcagcctctcatggtcttctcgttcatcagatggacgttaagacagctgtcctaaacggagagctggaggaggagatctatatggatcaaccagacgggtatgtactagaaggttaggagggaatggtgtgtaaactgttgatattcttgtatggccttaagcaagcacctaagcaatgacatgagaagtttgacaccacacttacatctgctggctttgttgtgaacgaaggtgacaaatgtgtgtactatcgctatggtgggggagaaggagtgatcttgtgcttatatgtcgatgacatattgatctttgggaccagcctcaatgtgattgaggaggtcaggactttctgtctaagacttttgaaatgaaggatttgggagagactaatgttattcttaacattaagctactgagaggagatgagggtgggattacacttgtgcaatcccacaatgtggacaaggttttgagtcgctttggatacagtgactgcaagccagctattactccttatgatcccagcgtgctattaaggaaaaaccgaagaatagcaagggattaactgagatactcccagatcattggtttattgatgtacttggcttgtgcaacgaggcctgacatctcatttgctgtaagcaagctgagccggtttgtctcaaacccaggagatgatcattggcaggctctggaaagagtaatgcgctatctaaagggcactataagctatggaattaactataacgggtacccaaaagtactggaatggtatagtggctcaaactggatatctgatgatgatgagataaaagccacaagtggatatgtgttcacacttggaggtggcgctatttcctggaagtcttgtaagcagaccat

SEQ ID NO: 72722 - DNA, 1049 bp, Oryza sativa
ctaaaaaataactaattacataaattgcgactaatttacgagacgaatcttttaagcctaattgtttcatgatttgataatatggtgctacagtaaacatttgctaataacgaattaattaggcttaatatattcatctcacaatttacagacagattatgtaatttgttttattattagactacgtttaatactttaaatatgtgcccgtatatctgatgtgatactccaaaactttccacccctaatctaaacacccctctattactccagtcaccatgcagggcatggggcagctgctcaaggtatgcatgtctgactagattactgtgcgtgtgatgagtataaacttgacatgaacattcatgcaatattttattgctactgtgagcatttgaaatgaaagatttggcaaaggtcctgatttcaacttttttttcttcaaacttttatttttttcatcacatcgaactttctacgcacacaaacttctaacttttccgtcacatcatttcaatttctttaaactttcaattttgatgtgtaactaaacacagccaaaggattttgagtagatttaaattttctggtcttttttctagatacacctaagattcatagaaaacatgcatgacagaaaattttttattggatcgtgttcctactcaaattcatagaaaaataagcaagagattaaacccttatgaaaactttcttctaattcaatttgtcagtgatgcaaccaaggcacctcttctcgttttttctgtgtttttaattaatattgtagagttgatgaaacacactcatgctagtacttcaactctgtgtgttttcggtgttttgatatggataaaagaaaatttacgataatagtgtgggttacacatctttttcctattgggaatgattacttcaattcgattttatatgtcccatgtccttgtgggctcttaggtgctgattcttgccattggtgtccttgcgggcacatgtttaggacgaaggttataccatttccatcacctatagtgccgacttaattatat

SEQ ID NO: 72723 - DNA, 1092 bp, Oryza sativa
tgcgttatttccgagacaaataagcttctcgtcgacttgttaattaattagatctcgatcttgatttggagtggatcgatcatatcatggcgctactacgctgcatgctcacgaggacgaggtttattatccccaaatcgtcagccaccctccgaccagcgccgccgccgccggccgggctcctcgccgccctcggctgctctccggcggcggccggtcctctccgcggtctcgccactctctcgggtcatcagctgtacgtacgtacgtagaacgtagttcgatcatcaccggcctaaaattactatcgcttaaaaaaacgtgaatattaaagaataacctaatatcaaataatttaaaatgggtgaggcttcaaactcaggtcatctagcccaccaccttatggagctagctgaaagatccatgggtctcaattctaccgcttgatctgcagtttacatgcaattatattcatgcaagctagcttgattgattattactccacgcgttataagtgtctgcgcgtttgtactgtgtttctgaaaacataacaatgtaagacgcaactattattcttcatgtttggtaatacaagacgtgcatttatacatcaaaataattatcatatcttcttctaaatttggtttttttaatccttcaccctcaagataattttattggatacatacatcgtatttagtaattatttcttggtttttacgttagaggtagttacaccttatatttaggattgagtgagtacatacttccttcatttcatattataagactttctagcattgtccatattcatatatatatatatatatatatatatatatatatatatatatatatatatatatatatatatatatatatatgttaatgaatctagacatatatgtgtccctagattcattaatatctatagaaatatgggcaatgctagaaagtcttataacctgaaatggaggcagtacaagccatcgatcgacgattttatcatatcttttggtatatggtatatgaatatagtatatctcattttataatgggttatttagattcatgccactattaattttacag

SEQ ID NO: 72724 - DNA, 11625 bp, Oryza sativa
ttttttttacttacagaactgccagggtaatagagggagtagtcaccgaaatataaatgcttattttaagaatgacgactattttatttagcaaaaaaaaccccaagagaaacgggatgttcagatttaaaaagtcacgtagcaaattaaacaaatcaatttttttataactctccaactaacggaaatatttctcaatgttcattgacatgtggcccccaccaggccaccaacatctcctccgttacatttgttatggttgccgagtgatgtacaatagctctttgtaaatatcagacgccgtcacgttttccgctacttttctgtttccgccgcatgggattcgctcctgcgccgtcccctccacagcaaatgcacggacgccaaaagaaacagccgttccccaccaatgaaacgtgctgtactgagggacgggggactcacattcgctagtgtaatactccaatatcctggtgttccccagtgttctaaatgaacactccgtaacagaagttgttgcagagtgttcccctgaaacacccggtaatttacggagtgatagaagcacactacataaactttctgctcatacccgggagtgtctcccatcctggtagtgtatgtaaggctatgaaaagatgtacatgaagcattcttcatgtgatgatgcatgaagcgagcgtaatcgggctcaaatgatataaatgatttccgagtatgttttgccattgttttatttgtcttatttcagtttgtcgtttaaattggcagggtttttttttatcaatcgtaaaaattgtcttcacctgttgcaatcactaaatagaagcagggtgacaaaggagtaaggggtagcgactgacgtgacttttgaaaaacacagggatgataaggttaagtccttcaaagtcctaagacatgcaatgaaataactatttaacaaattttaatcaaaagtatatgtaaaaaaaaggtacatgccttacatcatgggacgaagggagtatagttttgtatgggtgcttgcctcgcagttgcgggagccaccagctagtttaatgaatatattaaaacgaataaaacagcctgttataatggcttctctaagttcatgtctttaaaccaacagttgagcataaataattactgtatggcctacattagattgtgagcagaataaaatgaaaaagggtattaactgcttttttttagacatataacatcgtttactctccgatacaaagattaccacttgacttatcagaaaagactttccaagtgttatttgtttaatttacttgttttattattaacgttattttaatatagccttttcatttacactatattttaatacacatgaaacattatgtaccacgaagaaagtataagtgctactccctccgagctgataatacttgtcgttttagataaagatgaggtcaaactttagaatctttgattataaattatttttaaaatatttatctttcaaatatggtgattacgtgcatagattagtcttaaaaagtattttaataaaattatatatttgttaatatttttatacatattataatagaaaataacggtcaaagttgtttttggagaccgtgctcttgtccaaacgacaagtgttatcaacctcagagagaacatttggattaaaagtcacggaatattcagtttgaaaaaggttggccagcaaaagtacggcacggctacaccaaaattttttgtgatcaaccccggaaacatcgattgtggctatcattgcgtaatcacggccgcaatagcggaataaccccggagtacagacgtgtcaggccttgaatgctgtcaagtgtgatcgaaaagttttttttgtcgccatgcataaagagatacaggtggtgaggcaacatccgtctacaatgcaacgataaacacccaaaggctcaaaacttattataaaccataacggttaatagctataaaaagttctgtatatagaatttatatatttttcttaggaacttaaaatgtaaggctgaaaaaaagcaacgttaaaaatatattaaaattaaaaattaaattttataatataaggttagactttggcttattccttttagaacaaaggatgaggctcccatctgccatctgccatttagccaaagtattttttttcactcgagtgtatatccacatgttccatacatgccacttaaaagttatcaaaaaatttaaaacaaattaatataataggtcaatatatgatatattattccacaaacatataaatttattaagttcgatttaaataattaaaaaaaactggctataaaatgttaaatttgaacttacatgcatgtggaatgatatattcatatatacatgttaatctatcgtacactactacaaactcgatttttcatagtatcaccctatttttttctctagtggttatacgtggaaaccaccagcgaaaatgaatcttcacttgcggccgggttaagagagccgctagcaaaaattatagatattttcgctggcggatcacttaaataaccgccagcaattttcgctagcgaatgcttaggagcactgcctaagaatttattttcgagatataaatcctacccacctctcttcgcctctcccacccaaccaactttctctgcctctcccacctccagcctccctcctctctctccgtctttctcgatattcctccggcctccctcctctctccaccgctgtcggctactgtcgctttcgtcgtcgccgctgcatctgtcctcgggaaggcgagagtgaggaggacggatccgcagccgtcggagggcggggagcgtggatcagctgccgccgggccgcggggcctcgtcgtcagtagcgtcgcagatctcgtcgtcacaaccgtcaccgctgggccacggggagcgcggagccgccgccgccgggccgcggggagcgcagagctgatgcagccaggccacggacagtggtgctcggctggtggtcggtcgacgacggcgacaatgagcggtagcggcttaaaatttctatggatttgtgtttggattttctgtcgatttgtgcaactatccaatccggttaatgtgtttaaagatgggaatggaaattgctgtgattttgaatggaaagtttttactgtaaattgttgatgtaaatttctgtggatctgtggattaaggagtggatttgggaataatttgaacgccacgttgatggagcggtgtcgctccgtcatttttttttagccttgtccagtattaagactggcggctgatatagtgtaccgcccgtgaaaattcagctaccgccaatcactggcctttagtcgctgacggcgctgttggacgccagcaaaaattcattttggccgccggcaaaaaacgatttttctagtagcgctaccaaatctttctacaaaattgatgaatttttagaactagctgggtagcacgcgcaattgcgcggctagcacccaaacaaaatcattttttttatgattttacttcaaatttattgaatagttatctcgttgtctttaaaactttgaaagattaaacattttcatccccgtgtttctaattatatagtttttaaaagtcacaccagttgctaccccttacttctgtcatctccttttttatttgcttgctcgatctaccattatttctattcattctccttggaacctttaaaaattggagcttatagtttttatagtttattgtcaaacgatgctactatgctcctctacggctcgtccgccgcctactcttcattgtcattgggattctaaaaatcaaacataactatcattggaattcattttttattttctagaagtctcgccaaccgtcggcggctctacaactttacacctatacaccccgctcgttgcttctcctttttattatcattgagattttaaaaaacgaatatatcaatggggtttatttctttactttctagaagtcccggcaaccgtcttacccatttgcttcacggcctgtctgtcgtcccctcttttaattgttattaggattatatttggtgttttattaacagcttttatatgttgtatcaaccgccacctttctactcctttctatgccttttacataatttatctcgtcatgtgttttagatgatcttttcttccaatattctttattttttatcaccaattttagctatttataaattgtattcctaattaaaatcttttttctttttctaatttcagaatttattttattgtttcaaattttaattaatatcgtattgtgttctttaaatatttttattttttattttcaattttatttgtttcaaaattgtattcctacttaaactctcttttactttttctaatttttaatattattttattttttattctaaattttaattaatctcgtattgggttcttaaatgtattcttctttcaatattacttattaatttcagttacttttaaattgtattcctacttgaactcttcttttgttttcttttttgctaatttcggattttatttttatttttattccggatattaattaatcttgtattgggctcttatatggactcttctttcattattccttatttttaattcctaatttcggttatttttaaattgtatgcttacttggactctccttttattttataatgtcagattttattttatttttaattctaaattttgattaatctcgtattgagttcttatatggactcttcttttccttttctccgattaatgtgggaatttctagccccacagcgaacgtggtgcctcctttcaaggctgttttaatagataatagatagatagatagatatgcatggaacaagtatatacccacgcgagtgaaaaaaaaaacacttccaactctttatttctgttcttgctcacagttttcatgctctcactgtcatagtgtcatgattccctcaagataataatacacttaagaaaatgatatcagtgccaatattaatttgaactagttagcaatatatttattttttctgcaccactcgagagcaatatgctgcagacgtgacctgccaagtaggcatcctcaaccacgaacactgtaatgatgataagaccatgcaatctgccgatacgcatcccgtgagtccgctcgcaactggcgaccgagcggagggatgtatcacgacgctggtcggatgtgcctgtgcgcgcaactgacaacgcaaatggaccggggtgaaaacctcggactactgatcggtgcattgcatctcgttcgacgttttattaataacctcagtcaacagtgcgcactctgcagtctcagaaactgaggagatgctttgtagtctgtagtctgtacacttggccgccttttgtctctggcaggggcgtgatccgaacacaagttgcattgcacctgtgtgcatcattacatcggtccatcccccttgcagcaacccaaccctgccggccggttctagggacggtatctggtaggcttgcccgcttcctcattctgcctatatatacgcgtccgcccgcgccggataagcaacaaaaacttcattttagttcagggtatcacggtatcattacctaaacttcattttagtccatggcgttcatgagttcagctagcgaagaggaatccgctggtctcaaggcccccacggtaatctcccctcctgagtcctccaatatacacgctacgtgcaatcgtgcacagcacagtgcagaccacacacgtacgcctgaaatggaattaactgtttaattatcgactaatctttgaaactcacgcacgcctgaaatggcatgtactaacgaatgggccaacaatctactagtcttgcaactcattctttgaaactcactcacgtacgtcgtcatttcttcgtctaatctttgaaactcactcacgtcgtcatttcttcgtctatggattgtcaggatgcgcgcgtgattcgtcagcgctatgaaggcgacgggccgatactctcggacgacgcgctactgccagctgatccaggcgcggccgccggcgcagcggcggaacaacagcagcagcaggatgaggcacggagcgtgcggtgcgagtgctgcggggtggcggaggactgcaccccgacgtacatcggccgcgtgcgggagcggttcgacggcaggtgggtgtgcggcatatgcgcggaggcggtgagcgagctgcggaggcgcgacccggcgctggcggtgcgcgaggccgtggcgtcccacgcggcgctgtgcgccgagttcaacgccaccgtgcgcgtcaacccggcgctctgcctcgtgcgcggcatgcgcgacatcgtcaggatcagctgccgcggccggagcggtgactccgcctcgccgtctgcagctcccggcggcggcgccggcgccaggatcggcaggacacgaagttgcgcgctgccgtacgtttgatcgcgtcgcaggttgccacgtaagcgatacgtgcgtgacagaccgacgacagccagtatcgcgccagatgttctctgatgaatgatgctactaacagtctaattaacacgaagtacagtctactgatcgacgtgaacttaagttgtgaattgtgatagcctatatatatatcgggattagaccattgaaccgctttcaggttaactcaaaagtatctctaattaatattgtaaggttactggcggtctggcggatcgtgaaatcgtgatatatatcgacaaaagacatcttgatagctcaagtgcgtgtcaccaatgtaataattagtttgtcaacatctcgatcgatcggtatgtcagataacaataattttgtagattctcgttaaccatagaatgatgtttagtctttgaggacgtactaggtattaaaagataccaaacatgatccattaatctctgaaaatcggatgagctaaggaaagtcggtaccagtaagcatcccttcccacctgtaccactatctttttttgttcaagggggaaaagactactttctttagtctcttgaccgatcgatagcagctccggttgcgtgcaacaaccaccccacaatgagatctgacagccggctagctgtcgccgtcggggcaatagattcgggcgagggcagcagtggaaggcctcctcgagcctgtagacgaattggaaacaagcacgacgaggaggaggccacgatgataagctcaacgcgtcggatgccacggccttatggacggcggcgaactcggaggaggtgggctgatgggggccggaatccattcctaatacttcccgacctcctcgaagactgtgggaacaggcggcgactgcgttcgggtcatgatggcgcccttcctagttccctcctgatggcgcccttcctagttccctcctgatggtgccattgcttcctccctcttttccagtctattcttggcaatgtcgctcctcgttcatcctcttcgatccgctctcgctgccaccgcctcctccctactcccaacgacgttgtctcccctttgctctctcactcgggcgcgctgcctccccttcacccccaccaccaaggccatcatgcagtagcaaccgcggattcaggacctacctagacacttccaatggcggccggggttgtggcagctgtcgaagaggagaaagggatgcatcctggcatccattagatattttttgcagctgtctatgacagacaggtccactttttgtttacttcccatgacagacagggcccacttgtcggatccatcttcctcgtttcctcttcttcgtcagctgatctaccaagctacccagggccaggcctaggccaatgccataggtgggaaatcctttcatctcttgcaccacgcacatccttatccaactattttttattctctttccactcttcctaatctcatcatctatcaatcccaaagccataatctcgagcgttcggcgagttccatagtgccactgtctgtgtctcttctctaaccctataacccacctgcacaggatagcactctagtgcaccgcctcaccctacatatatccatgcatgattggaagtagagtatgcaaaaaagtataaaagcatggcaacttcgcttggttgagcaattggactacaggccggagaaacgaaacgaactgcaaggaagagcggcggcatggtgacctcatatctgtctccaccacaatgagaggagggaggagacaagacaacaaatggtgacgcctacgacgaatggaatcaaccgagaaaggagcgttgtgacctcgatgcaacggacgaatggatgatacttcgatttccaatcacactcctaacagattgacggccatatgtgaatggtatttggtagtacctcctcaagaatgataaaaatgttcttattaatacatgctatatctataatagtattctaggtagttttttttcctaatcaaactagtatgattttgtaagaagatactacctagctgtttattaagattttggagtctatatatatcacacagtttttttaagtttcaacctttgaacaaggatccaatgtatatgagcaactactactacttttgggcctcaatttgaccggaccaacccaatagtgctcacatgggctgcaaagaaaaaaatcataacggaccatatttagttttttttttatcatcttgtagttacgaccataactatagcgtaattgcactaaggttacaaccgtaactagtaactagaatgcagtattttggctatgtaagcctgtaaccaacgttgttggcttgctcagttggtgaagtaatatgtacagtattattgtagctcgatctcaatgcaatcctacaatcaagaaatcgaaaatttcgtagcacgaatctcaacacaatcctatgataagaaatcgatatgtttctaataaataatcttgcggcaggtttatagcgaaaccgtttggagaaagttgtagcatgaactcaacacaatcctacaataaggaaatctacaaatttctaacaaaaagaaatttgcaatagatttatagcaaaactgttttgtaattggcagtcatttgacatgcaacctctaaaatatttgcctataacattttttaaggaaaggtcgtcgaaataaatttcattatctattatatactaaaagttcattaaacttcgtacaaacactcttaagctgccatgtggcatcctataatcaatcgctcttgagccaccacatgccactctaataaaacagaaaaaaatttgaccatcaattttcatttaaattggtggacccactaattttgatcggtagatttatctttgcatgaaaacataatctccgtccgtccaacgtaccaatgtacgtatgatccctccgcggcttacgtactgacccccgtttccttttttttcttttttttcatccccataaaaattgaaataaaaaaaattatgggcctaaaaagcccatcaatctactagatatagctagctcttcctctatcctctcctaataaatagtccattaaacatcatatataaatttctaaccatccatatagcactcttaaattagagaaaatctaaaaagaaataaaacatttgaccatcaatttactttattttaggttattagatatatctttttcttaagaaaagcatcccaaacctccctcgtgctcataaatgtttctaaaccactccgtgacacttctaaattagaaaaaaccataaaagtttaagaacaaaccatccaatcattgatttcaccttaaatcgacgaacatatcatataggttgttattagacttatattttaagaaaaactaccaaacctcctatattttaagaaaaactaccaaacctcctttcctccctccacgcccctacaatgttaaagacttaaagtatattaaacatcctataaatatttctaagccactacgggtttttcttaagttaaaaaaatcatacaaaattataagaaaaaacaaaacatccgattgttggtttcgacttaaacatccaacacattattttagatcattaaataaaatatttttttaaaagaaaaaagcattccaccctccctgtccccatgcggtgtgcgtcgttcgaatttctcttatttttctatttatgacaagagaaaagataattgaaattaaaattatctttatgggaaaaaccacaaatggacctccacatatcaggtctagccagttgtcccactgccccttttcttctctttctcctcttgctagcacttataggaacaatataaataaaataataataaccttttaagtcatacaacttatgatatgtttaaactattatatttttttagtgaaatcaatacttcaatatctatattgactatatttaaatgctaacaaaaaaatatatattctggacccacatccattctgaggcctccactaaataaaaaaatattaaaattcgttactaaaaatcaaaatatcccatcttaatttttaataaagccggtagacccattacttatatcccattagacaactaacaactttctatcaacttaattaatttctctcaacatgtatatgggactatttaccaatacaatttcatttggatgcttttatcaataaatgatcgttttaggagaccacattatatatatgatttatgaagtcactaataaattagagaaaaatctttgaatgatatcaatttttatgtcataatgcgtaccccatctagtgttaatttgttatagacaacattttaaagattaaaacgtgctcagttgaacatcataatggaatcttagcagtgaaacaaccataatgtgtccttaccaatatagtgagtcaattccatatggaaattaaagaccatgttcatttatttctttttggtaaaacttgctatgctacatcgtaaattcttaacttttagcgtagaatagtctagcaatgtgtatttattattgttaacagcggaatttgaattatatgacctctattttaatatttcttactcatttgaagagagataatttagaatatatgacttttacccatgttaggttgtaggctcaacccacatatatttttaacccaaattgaagagatcaaatcatttcaaagatgcttcatagagtggaattctccaaaattttaaaaaatggctagaaaaaagaattcaaaatttatgtagttttttaaaaataatcgttgggtttaaaacccattctaaatataaatattcaaatattttagtaggactaatagaatgaccatatctaaaatttcaaatagaatgtaacagaaaaattggactttttggcagggataagatatccccgtggggagtcgaaatactcaaaattttctcatagaaactacatctattgtttcgacataatattttcttataaattgaaaactatacagtttcaagtaattttactttagaatttatgtgctgcaagggtaattagaagaaaaccataaccaatgtttctagcacattaaataagttcaattataatttggatatggtaaaagaatattttaatataaagtcacccatacatgaacattcgtaattatattaaaga

SEQ ID NO: 72725 - DNA, 10299 bp, Oryza sativa
gcgtcagcggagggtagggggcgcgcggccggggtccacggggagtggggccccggcgggcaacctcaaggtccacggtggaccgggggcacgcggctcacagtggccggcgccatgggtcgccacgcgtcagccgcacccgcgggcgcggacggctgacggccgggccccacctggcagccgcggggcgcgcccgaaggcggcctcgccggcacggccgacgggaggcggcgcgcccgcgccccgatggtcaccgccggcgaccaccggcgcggcggggtggcgcccgagagagaggagagaagagggaagcgaagcggcggtcctcggctcaccccgggtcgacggcggcgacaaaaacggcgaccgaagcggcgagaggcggcggtgcggttcggatcgacgaggacggcggcgctccgacggtcggcaggcgaaacgaaggggtggacgaggttgacggggacgcggcgaagccgaaggaggtgacgccgagacgggaggagatccggggcgacgacggcggcgaatcggagctcggcggcgacggcggagagagaggacaacggcgcgagctcgaatccgacggggagagaaagtggcgagtggcggaaacggaggagggaggcacggggagcgtttaaatagcgttgggagtgagagagggcggccggaggggaaggaaaccggcgcggcgatctcgggctccattgatgcgccggcgaagttcgcgggagtaaatccgaacgaatccgagggagagagagagggaaaagtgggggaaagagggagggaatcacggggagtgatttccccctctttatggcgcgcggggacggcgggatgcggcggattcggcggcggcggcggcgctagggcacgggcgggcggcgggtgcggcgcgaggtaggggatgacgggtgggccccacccgtcagcgagggtggcgggcgggccctcccgtcagcggcgcgcgcgcgggggaaggccgatgggccgcgggggagaggagagagagggagggagctgggccgagccggcccaagaagggaaggggggaaaagaagactttttagggtttttctttttataaaaccattttaactttgtttatttcttctcaattattatttgtgctctgaaaattccagtaaaatttatttacgcattttaggcttttaggaaatatacaaaaatcctccaagccttatttgacttttaaatttgcacattttaattgttggaggctttcacatggattttaattattctcggcataatttcgaggatgtattttagagtcgttttgggacgcgacaactgacccgcaaatggatgcatacgtctgcgaggtgcgatgcatggaacgccgcttcgacggactcgagctctgtcacatgccccggcgcgacaatgcagtcgctgacgagttgtcacgcatcgcgtcggcatgagccccactccccccggggaccttcgaggaaaggctcgcgcagccatcggcacgggtggaccccccgagggaccccgacgccacggcctccgccccgacccctaacgacccgcggccctcggggcccgagggggtcgaccccaacccccctcgtcaggtcgtttggttgactgacatttgggcgtatctcgataataatactcttcctgaggatcacgcagaagctgagaagctcacgcgtgtctctaagcgatacgtgctcatagaagggaccctctaccggcgtgccgccaacgggatactcttgaagtgtatttctcgggagcaatggggtcgagctcatctctaacgctcatcagggtgagtgtggggcccattcggccttacgtatattggtcagtaaagccttccaacaaggtttttactggccgactgcgttgcaagatgcccaagaatgggtccggcgatgcaaggcgtgccagttccatgccaagcaaacccatcagccggccgaagacttgcaggcatcccgctctcttgcctttcgcggtctgggggctacacatcctaggacccttcaaagcggcccgaggcgtatatcagcacctgtacgtcgccatcgacaagttcaccaagtggcgcaaatcttactgtaacaccctgaaaatttgaccaataaaaacaaaactctaaaaatacgggccttcgaaaacttttaaattaattgcatcatgccgatcttattcgcctattttatttggatttgatttcgaagttcattaatcgtgagtaaagtatagttaattaggaataaaccctagaagtaaattggtaaaataaatataacttaaaataaagactaggtgtggatagaaataaataaaatattatcgcgatcatatttgtatcaattaaatttaaatgcgatggaataagaattaaccctaattaaaaattcaaataaattatataaataaaatatgagtaatattaatcaagggtgaattcattagttgagataacacaaatattgagaaaaattcatacatgcaaaaattagaaattgtggaaccaaatttatataagaaatagactaaaatgagagaaataggaaaaagacactgttcattgcactctaggtgctcgatgtggttctgtagccctgcccctcctccatcgcctgtccctagccgccccgagccgtgccgacgtcaccatcgccgcctgccgtcgcgtcaccgtcatgtgcattgttgctgtggtggcttgttgagtacgattggtactcacccttgcaatatacaaacttaatcagcggtcggagatgaaccttcggaggatccctatgcttactaccaggatggtgatgaagaccatggccctcagtaggtcttagttacggtcgttgcctgtggcaatggcgtgccgctgccttaactccgctgccttacctacttctgtttttggaatgtattccggaccacttggtccgatgatttaagactatgcctgcgggcttatgatgtaataattcgttctagacactcgtgtatgtgcacttggtatttcagctatgaattcgtgtgtaccagactacttgatccagggaaatggtactgtttacacgattgatttctgttataaaaacgggggtccacacttacccaatcggtgcccaaccgtatcattacagataacgacacccagttcaccagtgaacttttcggcgactattgcgacgacatgggcatcaagctgtgctttgcctcgcctacccaccccaagagcaacggccaagtcgagcgagccaacgccgaaatcttcaaaggactcaagaccaagacgtacaacgtcctgaagaagcacggggattcatggctcgaggaactgcccgccgggctgtgggcgaatcggaccactcgaagtcgcgccccgggggaaacaccctttttcctggtgcatggcaccgaggcggtcctaccttcggagctttccctgggtttgccacgcgtcacgctgtacgatgaggccaaccaggatgatctttgccacgacgacctcgactatttagaagagcggagaaggtgcgcggccctgcgagcggtgcgctaccagcaaagcctgtggcgctaccatcacgccacgtccgggcccgatcactgcaagtcggcgatctcgtcttgcgccgcgtacagtcgcgcttggggctgagcaagctctcatcaatgtgggaagggccatacaaagtgatcggcgttccccagctgggctccgttcggctaaccacggaggacggcacggcgttgcctaacccctagaatatcaaacacctccgccgtttctatccatagagtcgcgcgtcttttgctttcttggaactcaggccaagccccacgctaccactgttaaatatgttgtatcttttgtcacgaccagaattaacccaacgggcgttccttacgtgcgtgtattattccttgtcccaggaggcaaggtacaccaaaagttgatacatttcagagtttatcaagcggaagcgtaaatagttaatttattacatgggcggcgaaggcccagcacacacaaagacaaacgggaaacagcagaagactagggcgacgaccacaggcgcttgacggcaggcacgagctagacaccaaagccttcatcttccaggggctcctcttctgggtttgggaaaaattgagcaagactgagtacaaccaccgtactcaacaagacacacccacaagtgcaggataaatgcaagggagtacaagggggttataatataaagggttagggtttgcagcaaacagcattaaaagacacttagttgctcaaagctattttgtaaacacgattccagagctatacaatattattaatcaaggccgtgaacccacatgaaccagccttaacccaaggcctacgatgattcagaccgaactggcgacccgaccatgggtcccagctcgtcccaagccaacccaggccaaccattccatattttaattgttaagcaagttttaagaattaaaacactaacttgggtacattgctcggcttgcccataactgagggcgcggctattcgaatagattatactctgatcagaggtgtacatctgtcacgcccggaatttctatccaaaattccaaacgcttacatgtgtgtgaaccctcgtcgaggaatcagccgaggcacacaataacaaattgataatagagtacaattattactctaattaataagcgaataaaatgtcattacagaggtagatagtttctctcaaacaataaagatctaagcagcggaaaaaaaagataaacggcgcagacggctccactccacaggcagcttgaccaaggctacacctaatcctccacacctcagcctcattgaagaactcctcctctgatgaatgattgcaaggtgagtatatgacatactcagcaagccacgcagcaaatatgcaagtgcacaggataacaaaggatggcatagtagggtttcatttgcaaaagcagcatttagcaaacatttcagaatttaataaaccagttaagtattaaacaatattaatccaacgctatacaacataccctgttgtataggcccaaccattctgaacaaccatcccggttgcgcagttctatctccaaaccatgaatataccatcccaaaccaggagctactcagattattaccaatgatagcatcctctactatggtgagaggtgtgggactaatcacgaaaaacattgttaaacccgcccataaccgcgggcacggctattcgaatagttttactctgatcagaggtgtaccactgtacccacaagacacagcctcaacatcatgtctaccatgcgtcgcgatactggaaagtacccgaatagaggctgtgacaataccctttgtacaacacaactcaccacagtgcaccattcctggatcataatcacccccttataaaacaaggcatggactccccagcgacccccgtgggcttatctccgccacttctcagtctggtgctccgcaatgaatcatgctatacaaaaggtaaagccgttgcccacgctggcttgtggttggcacggttaatgtttcacaatagtagctcgcgaaccggtccttaattgtcatgagcacgactctcaaaaccatgtgctcacaacccaccattaatcatattttaattcccaattaattatcataacacgattaaccatcgtgagctaccattaaatataaccataaataataatgtagtacatatgattcatcccattagtgagctaatgtttctaagcatggctaagcaattatatctaacatctagttgaaccaatatatataaagctcaactagtcaaattataatatcccaaggtatcaaggaatagagtaatcaatgcaaacaggccataacaaaggaataggttcacaccacccggtgacattcgaaaataaatgcacagttgaaataaatagaaaatttaaatataggatcaacatgctcaaaggattgtgtttaggatctgtgtgacttgccttgcaataatcggtcttcaattatcttcttgaatacttccggcgcactcgcgaaccttcgcaacgacggaaacgacaagctaacacgcaaaacaaagaaaaagactaataaaaaccaaataaacagtacataaaaagtaaacaaacatgtagatcataattttaagtgaattatgagacttgaacgcctcattctgacttcaaatgaatttaatatgaattttacaagattaaatctaattaaagcccatttaaaaagaattaaataaatttaattcaatttatggaccattttaatatgtagatctttattttatacaacttttgcaacttgaaccacattaaactgagttcaaatgaattagttatgaatttttaaagattaaatcggattaaaacacttatattgattttaattgaactatgacgcaataatgaattatttttgaaaaggaaaagaaggattattgcgtcagcggctagggtttgcggtggaccgggtgcacggcagcggttcacgcgaacggacggccgagatcgacttgatccaaacggacggccgagatcgatcggtccacgaccggctcacgggagacggggacgatgacgtcagcgacgaagtcacctccggcggcggctcggcggctctacggcacaaacggagggcaccaagacgtagatcacggcgcggcgaactcaccgatgaccaaaacgtcggcggaagaccaacggacggcggcggcgtcgaggaaaaggcggcggagaagatcgggtcgacggcggcgacggtgctccggcggtcttcagcgacggcgaaacggtggacggggacggcggcgacttggcgatcccgacggtggccttcccgagtgacgacgacgaccatagcgacggcggcgcacggctggacgaacggcggcgacggcggcgcaaaagctcagaggctagggcgctacacacgacggcgggcgaaggcgaaagaggcggcgggtagaggagagctcgggggtccttttaaaggggctagcgagcggcgacggaggcccacggcgaccggcggcgagaaggaaaggtcggattggagggagaaaagtcaatccgaatcgaactcaaatccaccggtttccaaagaaaattagccgatgattacaaaagagaaaaggaagaggagatcgaggagattatttcccctctatcgatttcaccggagaaggaaagacgcggccgaatttggaaggagacggcggcggcttgcgctagggtttcgggcggcagcggcgcgaggaggaagacaggcctgacagacgggccccacctgtcagcgagcgaaggcgcgcgcaaactgggccgacttgggccaactggccggggagggagaaaaggaaagagagaggttttgggccggctttcggcccaaagccaaaagaagactttttaaaacctttttcaatttaaattattcatgaaatgcaattccatttattaaaaatacttccttagctcaaataaatcctagaaaaatctaggaattatagaattaagcaaagtatttaacaaaattttatctagcccaattttatattgagatttaacaaattaaaattagatcttctcttctaggcttttaaaatcatttctaataattcctttttaaacaacagtttataatttaaggatttttaaacaagaaaagctcttaacaaatataattagatcattaatgatcaaataattactgaactgttctttgtaccatttaggaattgagctctgaaaaatccgagaaaatttcagagagttgacttaatcatggagaatttaataaaaattaaatccatccatgctttatatttaggaaattttatttcccacatttaacttcacttgtaaattaaagaacacttaatataaattctattattaatttattaaataatttataaaccctgaaacaaaaatcaggatgtgacacctggtcaagctgcttgtggagtggaaccgtctgcgccgtttatcttattttccgctgcttagatctttattgattgagaggaactatctacctctgtaatgacattttattcgcttattaattggagtaataattgtactctattatcaatttgttattgtgtgcctcggctgattcctagacgagggttcacacacatgtaagcatttggaattttggatagaaattccgggcgtgacaggggacgaggggccatcgctagtcaagggggcccctggtcccttctcatagccaggctcgcaacgcgggtcgccctcgtcgcgctcaactataagagcggcactcaccgcgtgggggtcgcggccaagtagagcagcaacggtttccctagccccagggctactaggatgggggggaggtgaggtaagctttcagctgattgagagcttgcttcgcttcctccgtccacacaaacggcccgaggcgtttgaggagtttgaataggggcagcgccctctctcccagcctcgatatgaatcgacttagggcgaccatgcatcccgtgacgcactgcacatccctaagtttgctggggggtgcatcctctctatcgcgcgtattttctctcctcgggagaagactagaaaaccgagtttgcccgccggcacaccaaacacacacttttcggggttcagtttcatgcgcgttgacctaaggctgtcgaaagtctcagccaagtcctgtaataacgtctcctggtggcgcgtctttaccaccaggtcatcgacatacgcctctacattgcgccttatttgattactcaaagtaatgcgagtcatgcgctgaaaagtaggacctgcgttcttaagaccaaaaggcatagttgtataacaaaaggtgcctacaggagtaatgaaagcagttttttcctcatcttccctagccatgcggatctggtgatacccagagtaggcatccaaaaaagacaaaaggtcgcaccccgcagtggagtcgactatctgatctatgcatggtaaagggaagggatccttagggcataccttgttgaggtccatgtagtcgatgcacatccggagcttgccgttggccttcgggacgaccaccgggtttgccagccactctgggtggatgacctctcggatgaagccggcctccaggagccgcgtcacctcctctcggatgaaggcttgccgctccggggcttggcgtcgtacattctgccggatgggtcgcgcatccggccgcacggcgaggcggtgctcaatcacctccctagggaccccgggcatatccgacggcttccacacgaagacatcggagtttgcccgcatgaaggagacgagcgcgctttcctatttggcgtccaaggtaccgccaatcttggcggtcttggacggatcatcgccaaggggaatctccttgactggcacctcgttggccgaggcaaggtgcttcttggaggcgttggacgcagaggcctccgggacctgcggctccatggctgccgccaggttgtcggcgcgatgctccgcgcaggcgagagcgaccttgacatcgccaaagacgatgatggggccgctggggccgggcatcttcatttagaggtaggcgtagtgggtggcggccatgaacttcaccaacgcaagtctgcccaggaccgcgttgtagggcagattgaggtctgccacgtcgaagtcgatccgctcggtgcggaagttggtggagtcgccgaaggtcaccgggagctcaacgtgacctagaggccacgtgtgacccggggttacgccgatgatcggcagtgacggctggagcttcattctcggggccttgagcgcgtcaaaggcagccaaggagatgatgctgaggctggtccccccatcgaccaggacacgcttcatcttgacgttgtggatggtcggggagaccacgaggaccaacttccctccccgagtgagcaccgtcggatggtcgctctggtcgaaggtgagctttacctctgaccagcgcgccttccgtgccgccttatgagtcgggacggcggccagaagctcacgcctcatggccttgaagccacggcgggaggtgtgagcacaagctcccccgtcgagggtggcgatggtcccctgaggtatctggaattccagatcctcactatcatcgccgtcgtcggcaggggccttcttcttggcctcccctcgccggtcattggtgggggtcgcgggtgctttgccctcccgtcaactctgccgcttctcctcatcggctttccgaaaccgctcgtccaagttcttgac

SEQ ID NO: 72726 - DNA, 2735 bp, Oryza sativa
  unsure (1)..(2735): unsure at all n locations
cgagggcgcccctggcaaccagactggggccctttgattcgcaggatagaaaaaacacagggaataaaaaaaacacagaattaaagtagtaggtttctcaaatcctataggaattagcgaacacaagaaaaacaataggagtctttgatagtgctataggaaaaataaagaaaagttcacaaagaggcacatctcttgctatttttcctatgaaatggaaagcataggattggagtttcctttcttttctataaatcaaagggacatgtagaaaaaagatccatagaaatttgaatcctatgaaaatccttttccaattctatgaatcaaagggagtttgatcatcaagtaatttgacgaacgaactagactttcatctgatctcatcttatctagtcatctctgattctctaatcaagtgtgtatactgtatgtatgtatgtatgtatgtatgtatgtatacgacatatgtctttttctttattttgtttataaaacaggaactcaggaaggcttttatttcctcaattgctttaattcctcatcacttcatcacttctagaaacagaaagtatgattcaggtgctgaaaaacgtaggaagagacaggctagatgcagcagctcaatctcgatattaattatgaagatataatttaagatttcattccaagaaacactagaaggatgatgcttttcacttttcagtacaacatgagatcagtagtactaccttttctcttttagcattaatatttgtataaaataacacatattaaagttatatagttgattgaaagtatgctttgtttatattagttatataaaattttcaaaatttaggatccaattagcatttcgttcggtggccccaaatatctggagacggccttgccgccgatcgatatatcgtcgcggatggcactatggcagagacgtcggtcagctcggcaaggggcgattcaattcaacaaaataaccgncggcaccccgtacgcgtgcacggtgcacatgcacgagatcatctactactagctgtttgcaccgggtccgactttgatcgacgtcccctgacatactccatccgtcctataatataagaaattttaattttttttcttgcactgtttgaccaaattatgcaaatataaaaaataaaaagttgtgcttaaaatactttggataataaataagtcccaaataaaataaacaataattctaaattttttttaataagacgaatggtcaaacagtataaacaaaaagtcaaaataccttacattatgagacgaagggagaatatatgagcggcttgcacagccgcaccagccggcatctcagcgaattgcatcgcattggttcacctccatcggcacacatccacacgaccaaaaaatagcacatcatccgccgcccacgacccgagctctgctaccgccaactgtgggagaaactctgcccacgggctccccttgccgcggccgctacccctcccgtcgaattgaaagaggaagaagatgttgagggagaggggagaactggatctaggaggaggggagagctaggacatgagataagaaagaaaaagagagaggtattcctctattcctctcacgctagttcggctccatgtgtgacctcgctcccgcctcgctgtctctgctggagaagtcccaggggcagaccgcagaccgcgacgagaagcaatggcagggcggcgagaacgtggcgagccacccgacgtagcggcagttgcaggactcgcctgaggcgtgtgcgcccgccgtgccggcggccgtcgaaagaaccgttccttgggccccgtcgtggtcgcacaccttcaccaccatcaccgccgccgctgccgccgccgtctccgtcggagcagcatcatcacgaactgggggaaaaagcgggggattgggagatgaagtgggtggggaggcgatgcgtcgaggagaacaaaggggtagttggggaacatattccttggcctgggatatcaatgctaactcttggtaacttgcattgtgccaaaacagataacgcccactgtgtataagctgtgtttagattccaactttttcatcacatcaaatgtttggacacatgtatggagcatcaaatgtgaacaaaaagaaaaattaattgcacagtccaactataaatcgtgagacgaatcttttaagtctaattacatcgtgattaaccataagtgctacagtaacatacatgtgctaatgacggatcaattacgctcaaaagattcatctcacagtttacagtcgaaatcagtaatttgttttgttattagtctacgtttaatacttaaaatatgtgtctgtgtacataaaagaaaattagccaaatttttacagcatctaaacacggcgatagtagggaataacagaagacacagaaggatggctttgcattgctactgccctaagcggagtaggcggagagcgaaagaggaaagggtgggtggagacggagcaagcactggtggagaaaccatctttggtcggtcggccgaaatccacaataatcccggatccatttaaaaccggatctttagtcctgattggtgctacaacggtcatatgtgatctttaatcccaggtggtataaatcatccttaggtccaggtgtagagatgtcagacgttgcaagggcccccggaatttaaatnnngnnnnnnnnnaaangnagaaagagtgagcgttcgagggttttt

SEQ ID NO: 72727 - DNA, 15584 bp, Oryza sativa
gtgaacaaggcggcgcgcatgccatgaagtttgacatgccgacgcggccaccggcctcctctgtctccgcgccatcggcaaggtaggctctcaagaacttgcagctgccgctaccgaagccttgtcccaccgatggagggatgacctacttgtactgctgcctcagggcctcgcagacgagcaggctccagaagccatcgtcggcatgtgaccttgcgaagcccaagaggaggaggcactcttggctgtccatgatcctccatgacgactacggctgcaagccgtcgacgatgtcttggactaggaggaagttgagggagaagtggctgtcgtcaatggccggtgctgacaccggtgattgtgcaaacgaagtgatgttttcggggttatagtagtaaccagcgatggtgggggcgtggagggaatggaagcggtggaggaatccagcatcagcggcaacgatgcggtgccattgcttgcacgtggaggcgatacgatgagggagacggtggaagcgatgctcaggagagctcgacgaggtcgtcggggatgtccatagttggctagctagttttttgcaaaaaattagcgatcaaatctggtttttccctgatcaaattattaggtgtgttattgtctacgactctgtgcattagaaatttagagtccgttttgcattggaaaattgacactgtagttatattgtttttctggttactacgagaaagtagtatttatcatacgatcatctaataaactagcaaatacctgtgcgttgcaacaggtaaaagaaagattataataaacattagatgattgagttttaattcgtgatctaagctaacatttttgtatttaattctttaatgaaacattgcatttgatttcatattgcgcgcaagagtgtaccttggtggaagaaactttttcaagaaaagtgacatataaaataactttgtttaaaaaaccaaccggttcatcaagggcctgttcgtaagtgcttattgatcatattctagatgcaaattgtttacttattaacatgatgaattgcctatccatagcaacgggtgaatgcaattagggtttgggggtggtagcggctgagaacgatcgtgcctgtgagcaagagcgagagggtggagctgacatacttcttaagggcaccaacgaaacaaggatccaggatgcagagggcgacaacatctacaacagccagagtaggggacaacttctatcacgatgatgttgagcaggtcagtagcccttctcccccactcccacctttcccgcagccacacgcgcacatgaatgccttctctcctctagcgtcgccgccggccgcagctgagccttgcacggctggcgagaaggtgcgaataccgaacagcaccggtgagctccccctccccctttactcctcctcaagccagcggttgcaagatgaccctaccctgctgtcttccccatctatggtggcttcctgctgctggatccaccaccttcgactgccgatgccggcccaccaccctccgtcatccctgcagcgacgatggtaccgctacttgcgtcgccgccctcccgagtccacagcctaccatgggtcctcccgcgctcatggcaatccctctaagccctagggaaaatccccttttctacctctctgccccttccccaccaccaccattgtctcgccagagctagagaaggaggtcatcataaatatttgtgccgataagatagttcaatggatgaaccaatgattaatgacgttgttttaattaagagtgtcctatatggagaagtaaaatttactagcaatcagataattatccaatgctcagatttaatcgaacagttcatacaacacatattctctcatctaatggctgttgtaatactgatgatatggctgcactaaatcacagctaatgaggatagtgaagttgcatttatcccctagtgggttttggtgattaatgatgaataaggttaagggactaatgtgtttattgagatattcaggtaattagtcccaaggtgaacttaggtgatcaatagatgcttggagaccccctacaacattccttcaaagcggatttgaagctcaaaggtcaataggatagtttattttttgaaatcgagttttaggaaaaaccgtactattaagagaggttccaggtgtggttctgagatataaaaagtgctcttagtgggtttgtagtgatagaatatttttgggagccatttttgcaaatgggtccagaccggacagagaaggttggccggaagttccggtccctggacctggaacttctggaccctgcatcgggtgaaattttcctaagtgttggccgaaagttctgagggtcaggaacttctggacctcttccagttcaaaaatgtgagtaacggctagatgaagtcacctagccgttatatatatccagatcgcacccagctcaccttttggccatttcacttcagttctttcatgccttaagttgttctaacctctcccaagatccctttgcttcctccactcaaatctagagccgttcttgtgagattgagagaatatatgagagtgtaggagtgatttggagaaggtttgaagactagttgtgtttgagcactttggatatcttgtgggctatcacttgggcttattacttttggagatcttcttctagacggttaggtgtcgcccgtgagcttccaaagatcttgtggattttccgggaaagtttgtgaaggttttccttacctccggaaggaaacgaggtgagtaaagattcttatgctgagatttcagaggttctccttggtagagcaacttgcacttgtggtcttttctagaatgatttgtgagttggatcttggtggtcactcaaattctagaaaatgacctacattaccagggattaggctttcagtgatgaactctagtgatgaaaccctcacttctcactagtaagtggttgtatagtgacaaattattttgttgtcaccattggacggatatctagtgacaaactgttttgccatcacaattcctcctattactagtgagaaaatgtgtttttatcacaaaagatgtaaacaatgatgacccagttgtgagaatttcgggtctggtcactattctattaaaaaacagtgataaactaccctgtaatcactaatcatatcaatcgtgaggagtgaatggtgatgaattagagtgctctcactatcttgaagataccttgtggcaacaaagttgaatcgttgagacaagtacctgtgatgaataaaagtattcactgtttggttctagtagttattaagttaagtacaccatcactaacctccttttcatccctctctaccgctttgactgttcaacagtcaggctcacgcagagcaggcagcaccgcagcagcacccggcggccgaaggcatgagccttggcacgatggaaggattgcaggccaagacgctgaggctgctattgaaggtagagctgctgcaacatcaggccccgtagtggtggctacaggagctctgcgacctcgatccgacggcaggtgcacggcgaactcgatacggtgcggcggggtcgtggcgagatccatcctgcattcgagttgcgtcgagctcaatccaaagcttcagagggaggttgagcagtggtagtgggacgcggcacgatcggagcacgagtggtggacgcaggcgcaccccgagcttactgacggcagaaccagcagtggtaagttccatttcatctgcttggtgctgccggctactatatcttgatgctttgttgattagtaccatggattggctggatctatgtgagccaagccaaaacaatagattcgagtgggagttgcagtactgcagtggtatggaaaaggggaagtcagttcagtcaaaaaaacaaaaggggaaaaccgagagggaaacatagggtaaggtgaggaacgtgggagaaatactcctgagcagatggatacacagatgtgtccagatccctatcctctttatctgaaaaaagctattatccaacatggtcagctgttcaaggagtatggattatatatctgaccgtgacttacagagttgcaacagggcccaatacttagtagtacatgctagtttctactaatcagtcaaataggcctcaatatggattagttacatttcataatctgcaagaaattaatttacttagtatattgtattaaacataggcaattaatgtcctcaatatcaaagaattgtatttcaggccaacatatttttgctgtgtttgtgtaaatttgcagtaacatgaatatagtttataaattaactgtcatctacatcttcttcagtttggatgtcactttcatcatctgtatctgtatactcagcgccatcactttcagaatcttcctcttcttcttcttcctcttcaaacagatcatcttcagaatgtgttactggttctgcttcaatgggttcacattcgactccatctttactgagaaccgtagggaagtcaccatcatcaattgtagtgtaattcaatgcagccgtgatatgctcattctcttggcatgcttcagaactagacttatttgataaagttggatcattttcttcttcttcttctgtaggaggaaagtcatacaaatcacgtggcttcgtcttgactacaacaaaccatttagggtctctagtatctttgacataatatacttgctcagcttgtgttgccaaaatatatggctcatcaattggcactgtacgggaagtattaattaaggtaaatctatgcttgtcctcttttactccccttttagtgtgtacatcccaccattcacatttaaacaatatgacactaaaagtaccatatgttagcttgataatatctgtcaagacaccaaaatagtctttgcttccactggcttcatcacctttaacaaagactacactgttttgtgattgaaccaacttgtctcggtccctggtgttaaatctccatccattaatcatataacttgtgtaatgggttactcgagcatcaggacctcttgctagagcaaacaactcttctgatatatctggagatcctttggaatgtttctcaaatatctggaagaatgtttatacaggttacaaatagttgtaaaatgtaaaaaaaatacttttattatggcgtgtacatacatgattcttgaaccatacaaaaaattctttgtcatggcgcttttccacacctttactgttctggatgctaagttggtctttgtaaatgctgcaagacatgtacatgtacgttaaattttgacagcatttacatattagaaaatgagagtaagtagtagttgtttactttgcgtattctgatatttcttcataattctttagaacatatatccgagctttctccaactcattcatatccatctggcagtatttgttaccaaggagtggcctgccaacagtaccaaatatctgaaattttgtactgctgttgtcactctgcacgtcctcgattcgacttggtcgattgattcttgtttcaactccttgaaggtacatagaacaaaaatttacacattcttgcaaaatattcttgtttcaactccttgcaggattcttgtttgatccttcagggcgagctttgttttttacaaaagacttcaaccttcgcaaaaacctttcaatgggatacatccaccgatactggacaggtccaccagcaatagcttcctgggctaaatggattggtagatgcaacattacatcaaagaatgaaggggggaaaatcatctctaacttacagagggtaacagcaattgatgatgcaagcttcttgagaatttcagtatctaatttcttggaacaaatttctctaaaaaagctacatagctcaattatagcctcacaaacatcagcaggcagaactccacgaatagaaaatggaaggtatctgtgtaaaaatacatgacaatcatgacacttcatccctgatattttagcttttgttgcatccacatagtgtgaaatttttgaagagtatccatctggcacttttatttctctaaggaactcacaaaatgctttcttctcagctagtgtcattgtatagcatgcaggacgaaataagatcttcccatcaccagttggaggtgcatgaagttcaggtcgtattttcatgagttccaaatcaaaccgggatttaatattgtcctttttcttcccatccagatttaacaaggtacccacaatactatcgcaaacattcttttcaatgtgcatgacatctagattatgtcttatcgataacgtacaccaatatggcagctggaaaaatatactttttttcttccaaactccatataatgtgcttgagcgttttctcttattgttatgtttcccaaatttcacctgaatgcataaagtgatgtcaacaataatatactactcatattcttatactcaaagtaataccaaataaggcatagaatagcaaatagtataataatttactttcagattgaccagataggatacaagcataaatatatcataattagtagagtacctgattgaaattttgatattgacgcataatgtcatctcctgacaacgcttttggggcgctacgtctttccttttggccatcaaaagattttgcattgctcctccacgaatgtcttgttggcaagaagcgacgatgtcccatatagcagtatttgtgtccattaacgagcctatgggaccaagtgtccatgtgacaagaaggacatgcatattttcctttcgtgctcatgcctgataaattaccatatgcagggaaatcattgattgtccaaagcagcattccccgtagcttaaaagaggactttgcatgagcatcataggctggcacgccttcccatagctgtatcaattcatcaatcaatggctgcaagtatacatctatgtcatttccaggtgctttaggcccagggataagcattgacattatcatataagaatctttcatgcacatccaagttggtaagttatatatagcaataacaactggccatatgctatatgatgagctcatatttccaaaaggattgaatccatcactagcaaggcctagcctaacattccgtgcgtccaatgcgaatgattcaaaattcttgtcaaagttcttccattcattagaatctactggatgtctcatatatccatcatcaactagcttctctttgtgccatcgcatatgaacagctatttttgaacacatgtacatacgctttaatcttgggatcaaaggaaagtaccataaaaccttctgcggaactttcctagcttttctcctccttgacttgcgagcactattttctccatcctctttccatcttgaaattccacaaacagggcatgtttcagctttagcatattcacctctgaaaagaatgcagtcattcaaacatgtatcaatctttatataatctaacaccaaattattatcacaagaccacgataccctatggcagagacatgattttgctagatgtctagcatctaatatagcatatgcttattaattttttttagataatgagcatatgcttattaatgaaccagctcacgagctgagccaagctaagcttttagtattagctttgttaatgttaatgagctggcttattagttttccatgcagggaggtgccaacccacatcaacaattaatgtgcatgtgtgtatcattttttttcactccacaggttattgattcattaaacaattgccatatttgtttacgagagcttgttaacaaatgctggtgaacaaatattttggatcagcacaaacaaactaatttgttatgcacgcacgcataaatcggccagcaaaacatactttccctccaaaagtaattgccagcaaaattttactcccgccaaattgacagagttacctcactatataaggctgcccatctagtacaatccattcgcatctagagttctcgatccctgcgcacacttgcagtcaaaggtaaagaaacaaatctactatggctctttgctattctcgcaatcctataggatccattcggcattccccattttttattcactgcatagccctagagtacatccatctttgagagattacacccaccactgccgggacacaatcacacaaccaccatctccaaatcactgcagtcctatggatcttctggcggcgctggtgccgcaacatctacatattgatgatagcgtggtgtcgcagggatatgacctgccccttctggcgtccactctctccgtcttgtttttctgcatttatgatttgtgttaatttcctaattagatgcaacttaatatccatttttaattgggattctctttcttagttaatttggttctcaatcttatagtatatcggtgttttgtggggatttctatcttagtcaatttggtttgtaatcctgtagtagatctgtttgtactcatttcttattttgtaggtcaaaatggtttcccaagttcgtccatccgtgaaccagatggagacttcggatgatgctgctcgacaagtcataaccaatactaggaatgagggacggatgggaccaaccggaaacacaggtatttaacatatttaccttcacttcattaatctattccttcacaagcaaataaattaaaatacttcttccttcaattaggtctcaaacgtaggaaaggtaggggtctcaccattaatggaacacttgcaaaactgagagcaaggggtgtgccactagacattcaatttgctgcacagtttggaaaagtctatggtaggcacgcaagtgtctttaaaagtgaggtcactgtctgtgtgcgacaagaggtcccccttaaggtgaagaagtggaaagtcattgaaaaagcttttcctggaaccatgtcatcaatttggaatttattgaaggtatgtcatctggttggagttcttgaattttcggacacattagcatatttcatttgtacatttttgttttctttttgctgtcatgattttgtacattgtttgttcatatgatctactatcattctgtaggcaaaattccctgagatctcaatggcagactaccaatgtgtaatgacacaagttgagcgaaagtacaatgtaagacgccacaaactgtacaagacctattgcacaacaaaaacagtgtcctagtcatgttgcgccagaggactggcagtggttgattgataacttatggagtgatgagcaattccaggtacttgtttaattttctttacaattaatacaatatgattcataattcattattcttatgagattattatgtttttttagaaacggagcaaacataattccattaacagatcaaagcaagagatgaaatcacatgttggaacaaagtctatagtgcaaatagcacatgaactggtaaggaatattgtcattcacttatatctttaaactatatgtttgacatgtcttgtatatataaattataaggcttcttttgtatgtgatataattgcagagaaacctagtgacaggtgaatggcctagtgctatagatgtttggaaggcaacttatttgaagaatggaacatggtccgttcctaatggcgaagaaattctggtaaacaaaaatgtctgttacctacattttactgcatgagtttttttaatatggacttacatattttctttgatttgtttagaacaatctgcagacagtagctgaaacaaaccaggaaaggattgcagctgctcaaatcccaatggttgaacactttgcattagtccttggcagaaagccaaaccactcgcatggagttggtattagtgcaatcaatgagggagctcaagagaggtacagagttaatgcacaagcagaagctgcacaacagcaagccaatgaagcacatcaacaagctgctgctttgctagaagaagttcaaaaattgacagtagaaaacttgcaattaaagggcgagttgcagtctcagcgtgaagagttgaattctcagaaaagaaccgtagaggaacaaagtggtcacatggagtgtttgttggcccagaaacttgaggaaagaatgaaagcaatgtgggcacgcatgggtggcactggtggtgcttcatcttcaagtgtcccaaacaattaagtaagatttcttacgtcatacatgattactaattcaatctagtggtcattcgattaatgttatttttaaattatatgtaggaagttccaagttgacaaagactggcgtcgtggagttgctacaaagttctgtccatctaggcgagcatcctagagtccgtgtcccaagtttcatttgttgcttaggtgttcagttatcaatttagttatggtcttagttaaaatgctctttgtatgagcactttgttatcattcattaataaaggatagtttcctctagtgtgaggaacccttctgtcacaccccaatccggcaccgccgtacaatggcacctgacaggagcgtgtcgtaggaaaaacggcgtgaaccgcttcctacgaaaccgcgatctcagtaccagtcccaggacatagtgctggtacccacggtgacaaatatgaatcattgcaatccttaaaataaatagaggacttaattaccttaacttagttgcagctcagaacagcccgagaatgcaatcgacgatgcggacgaggaaacaccaacaacaacagcagcagcggaaccaacgaactaacacccaacaccacaggcgacggctgggaactaggacgaaaccctaatcttcactttacttcatcttcaactttagggcggaggaactatatatatttatatagagcaagggtgagtactttcgtactcagcaagtcacgggaatttaggtgtctgatgcaagcttggaagagaggcaaggttgttttgcaaatcctttgtttgaaaccacttttgaaatcactaagtgatttatttctttctaagtgtgggccgaaaagagacttgcgtctcgattcgactttaagagatgcttttcaacaactcaaatggtaatgtaccgaccacccgggtcagatcattacttctcggctcccagagccatttcacttgattaagcgtctcccagagcctttttcctttttctcggactcccaaagtcctgctgcccagcagcacaacaatccgcttctactcgggaagcctagtctatgatgcccgcagacatcccgaatcacacagattcgtttctgaccactcaggtcatccatcggccacattggctgattctggttatgattcccacaccataataacttttcacaaagcacaggcaaacaaatctaagcaacgggaaccacctcacatccgcccatgaccgtgggcacggctattcgaacagttagttaacctcttcagaggggtacccccaagatacgaacttattccgaacacccgtcggtgtcggaggttcgcaacaaagcctttcccaagccgacctagggatacctcatgccacatagaaggatcaaatcctcacataaatttaggccattttagttttcacaaatcaaactccaaccacctcgatcggtaattcagcaagcttctcttccttgcttaccaggaacccggtttggctccaaccgaccccgccccggcgttcccaactattggcatgcgaggtttccctgaaccgactagttacttagccagggtgtcccattccaccttgtggttgcactttgattatgttcgatgagtttcccacaggaatcggtccttatatgcgaatacgggacagtgccacataggcacaactcccgcatcgcgagttttcacaatttattttattttcaaacacaccgacaccacatgtcgggttttcaaggcttctcaaacccatttcccaaattatcgacaatcaacggtgtatgtggagtagttggtatacgcgctcagagagccggataccgaagtaccacaagggtggagcgacaaggaatcagggtagtacggcctgcaggaatttgtgtgactactgggtaggtccgtcggtttgacatgcaaaccgaggccaagcatgttataggtgtgattctaatagttcaagttgcaaacaaaataataatgatttttcaattataggagatattgatcaaagggtgacttgccttgctaaaggtcttcgcgaagcttcatgaatcttcgagaaaaccacaatcgacgaaaatccggtaaccgcaactatacgcaaacaatcgaaaacctaaacaaaagaccaaaataaagatcctatttagactaaataatagtgccattatatagatctcaattttatggaattactggaagttgaacggagtcaaacggagttacggattgggagatatggatttcggaggtttaattggaatatttggaataggagaaatggtttatggaatttatagaaataatattctcaagaatattattgacagtcactgacgtgcgggaccaaagaaaatgattcatggaattttgggaataaggaattgatttgtgaaaaagggaaaaggatttattaatccctttggataagaaaaggaaggagggataggaaccagactttcccgagtagcttggcgcggcccgagaggatttgcgcggctcagccgagcttattgggccggtgcgggctacggggaggcagcccaagagaggggcgcggggagagagagggggaaggggagccgggtggaccgggctcacctcgcggggtcccgagtgggcccgcttgtcagtgaggcggtgcacggtggaagcggcgcacgcgggagcgggcgctaggttttcggagggagactgatctcaactggcctcggtttttccgtggttcgggcgcggcgcgccgggtggacgaatggcggtgggcctacgtgcagccgcatggcttgccatggacagcgcgcacgggagggaagacggagggagggggcaactgactggcttggcccggtcaaagccgaggtggcgccgacgtggcgcctacgtggcagccacgcgggccggcgggaggaggaagaaggggagtccgagatggacggcggacggcggccaagttcaccggagctcgtcgcgacgattcgagagagagggagtacacccggaacgatgggacggacgagaggaagtgaaccaccggatcggattcgctggaggaaggcgcacaccggtggcgagaaaagggggaaacttcatcggagcaacgggggttcgattaaaaggggtggaagcatatccttggttcaaggaatccagttccggcgacggatgggacaaaggagtaccaaggagggccggcgacgagcggtggcctccgggagtggacggcaatggccgcgaggccatgccaggcggcggcggggctcggggcgatgtccacgcgcgttcgggagtgccaccgagctatcacgcagactagagggggcgagggagagcgaggaaggggaacgggaggaggcactgccgagccgggacgggcgctgtgacgagcggccgacggcgcgggagcaacctctccgacctcgggccggggaaggggaagatgacggcgcccggagtcctcttctcgcgtccttcacacgcaccggtctccctggtgcttcggcgacggatggtaagggcgactgcagggcaggggcgacaaggcgcgattgtggcgacgagagaaacgagtgagggagatgggaggggctcgggtttttataggtggcgatgttggtttgggagaaccgaccttgggtcgttcaaggagaggagctgtcggtcgggcgtggtcaaggtggtggcaggcggtgacgctgatggtggtcgggcaaaacgaaaaaggaggaggagaaagggagctctgctccttgctgtttcgggaaaagttgaaggaggagagggagtaagtgaggggggctgcctctctcggctttggaagatagcggcgtggagcgccagagcggcagcgcacgacgcaggcgacgccagggcttgacgcgccggcaaccgagcagtcggccacgcgcgagcgcgcgggaacgagcgaagccggtgcaggttttgggcggcgacggcgggaagcggcgtcgacgcgagagagagaaaacgagagagagggagatccttctctcggcgatggctcgtgcagcgcacgtgagggagatggcaaaggggagagatgggctggagagtggatccggcccattcaaaacagggagaaggcaaaaatagacttttacagagaagactgaattggagcttggatttgaatcgagatttgaattcaaattgcatatttgaactcagcgaaatacggaggagccaaggaatggattcaaggtggactcggacattttggaatcgggacaggtatttggcgaggattcaaaggaggcgattgaatttcggagacttgagtcggaattggaattttgaggtgggcgattttgatggcgacgagggggaacaaagatggagattgaattgagatcttggcacaacttagactcgcacacaaataacggaatttttgaaattaggattttgctgaattagtttttaacgtctcacaaaaagcggagcgttacacctttttagtttaggtgatatttcaattgagttctgaagtgctctattccgagcatactgtaatcattcatgaataaaggggtgctcagttatgaatgtttgaacttgccattgctctatcgagatttcatcattagattttgtcattgttcacatgctgaatattgtcataaaagacgtgttgtttgtggcaagactttagtcacatatataaaacttgcatctggatatttaattttttagtgataaaagttttccttacagcaatacccttttttctccactgatgcattacttcatatgtgataaaggtattgtcacatatacatattagcttggtcactactacatttgtaaagaatgaccagttttcgcaacaaataacacgtcatttcaccacaatatatcttacttcttgtggtttttacttctcaatataaactaatatcttatcacaaaaaccctatcatatgtgagaaaagttattagcaaaggtatatttgtgatgatgagttatcggtaattagtaatatgtagtgacgagcaaaccagcactaaccgtcgacaatattgtgagaaaaaaattccatcactacacgttcacatatgtgagggcactattgtcactagtgtctcctgtaattgtgaccacgataccatctctaatgtactgcttattagttgcgataggattatcacaaacagagccattatctgtgatgaaaaaaaaaatcatcactatgctacttgtgacgccagtagtggtgacaacatagtgacgaccccaaaattcgtcacaagggggtaattgtgatgagaaacagccttttagtgatgaagtttttcatcacaaaagacatgatcccttgtggtgctagaagtgttgggttgaaggccatgcacatcttctgggttctttgcataggtgaggcaagtggttaatcgagacc

SEQ ID NO: 72728 - DNA, 1320 bp, Oryza sativa
  unsure (1)..(1320): unsure at all n locations
aaaacngtttcactcttcatctccagcaaccgatcttcgttcccccaccaaattggtgaccgacctgttggttgattttatcggctaaataccaattagctaaggaaagaataaattccacttgtccgattcctaaagagatagagttagtttttgtgattggtaaaaactaatttctaacaaaatttcgagataacccccgagcccccaccaatgcgcctatataaagagatgaagggcagaggagggacgccgagctctctacctaaaccctaaatcgcctgatcagcttagcgttggaaggggttcgtgaggtgatgacggtgaaagaattggcgtatcaagaagaaaaggagaaaaaaaatcgaagaagaagaaagaggaaaaacactgatggcatctcaagtagtagattaagtttccgcattgaagcagaggtgattaactgattatgtataggctaaatcattgagatgtaatttagatctccaacacaaccatgaggaagagcatgtccgaatctgcgaggcaaggcttcgattcacttgttatctcttgttgcctggaacctcttaaagaagcggaaatgcccacgtattcgacggtattttcgtgtcatttcaagcccactcgatcagcactatccttcaagagaggctctcatctttttggatcgaagctagggctcgacacctcggcgtcctcttggccctagctcctggtggaccctacttggcctctttctgctttggagttcattttcactaagtatccctccttgcttttgtgtttagcttggtttatatttttcgtttttgtctttgctgctagtaagaggccagatgcatgtaaactatattgtttccttcgtctaatatatcgacgcgcaagtgtttaggaaaaaaaagttaggattagaaggttttatgtgtaaaatgaaaaggtttctaaatgtcgttacctttcggattatacaatgttcgggttatattaacatttcaatggatgagttcttattggatattagtcaatatttttcttcccatcatgacattttttaagatccggtatatcagttagatgacatgagatgattgctctttagtctttaatttgttcccaatgcaaatgtgacaagtctacggacaacgatggcgtgtccgctgagttctttatacaaaagaagcagagctctattattattagagttattttatatctcaagtgccgtgataattggtattaacataacctacgtaccaatcgaatggtggagatattacagttaaaaaattaaaattaacattagaagacgcctgg

SEQ ID NO: 72729 - DNA, 6069 bp, Oryza sativa
tgggttgcttccaattagtgacggcggtcaccgtttcggggtccacagcaactcctttagcggatatcacgtgccctaagaatttgacttcggacaaccagaactcacacttgctaagcttggcatacaattgatgttcccgcaactttcccaacaccagacggagatgctgctgatggtcttcctctgattgtgagtacatcaggatgtcgtcaataaagaccaccacaaacttatccaagttttccatgaacactttgtccattaagttcatgaagaaggcaggagcattggtcagaccgaacgacatcaccgtgaattcatacagtccataacgcgaggtgaatgcggtcttcggaatatcttcttcacggatacgcaattggtgatatccggaacgaagatcaattttagaaaagacagtggcacctttaagctgatcgaagagatcatcgatccggggaagagggtacttgtttttgatagtaacttcattgagagctctgtagtcaacgcacatccgctttgtcttgtctttcttctccacaaaaatcacgggagcactctagggggaagtgctcggccgtatataccccttttcttttaactcttccaactatttcttgacttcggccagttcatttgctgccatacggtagggtcgcttgtacagaggagtggttcctggagcaagatctatccggaactcaatctctcgcttgggcggcataccgagtagttcttccggaaacacgtctccgaactctctgacgatggggatttctgacagtcctatctgatgaagttctgaactactgacagaggttgggggcgcaaagaaaacaaccggttgttccggccctcggtacagagtgacagtgcgtcttgcgcaatccactactccttggaattgagccaaccatttcatcccaaggatcacatccaagttcttggtgtccagaagaatcaaatctgagggaaaaaggattccctggatttctataggaacggcagggctataatactttgctgtcataacccctccaggggtggtgatgagcagagggttcctaagcctttctacccccaactgatttctccccacgaatggcacagatataaacgagtgggaagctccagagtcgaacaaaatggtagcagggatggaatgaatgaggaacgtacccacgataacgcctggagttgtcagcatatcctcggcagtcacgtggttcacacgaccccgaatgacatccttaccaccgttgttggggcggggaggcgcttggccttgctggcgcctcggctttgggcatttatccgcaaagtgcccgggctcgaagtagttgaagcacagacgctgctgaccatgaacgtctctgcggccttgtccaggctgcacggctggcgtaggaggacggggcgcacgggtcccttgctggctctgctgttgctgcggctgtgggacgcgcaccacgaattgaggtcggagcgcggagcgtggttgctgctgctgctgctacgaggaggatccccctggatagggattggtgtagcggatcctttggttagccccctgttgattgcggaaatttgccaagcgacgcttgtgtgactccagttccttgtgcttggcttccaagcggatgctcttgtccgccaaacgctggaaatccggataatccccggagaccatatgcacggacagctcagggtccattcctgccaagaacttctcctgcttctcctcatcttcacgaacatcctccggggcgtaccgggccaggttgttaaactcatgcaaatactccatcacagagcagttgccttgcttcaactctcggaattcccttttcttaagggtcatgactccggcgggcacatgggtcctccggaaagcggcggtgaagcgggcccaagtaataggctgtccttctggctgcgtagcctagaagtggtcccaccatagagatgcgggcccctgcagttggtgagcggcaaagatgactttctcctcatcgttgcactgcacggtgtctaactttttccccacggcatgcaaccaatccaaagcatccacggggttattggagctagagaaggtaggcggacggatgcggaggaactcggcaagtttagaatgttgcgggggtggtggtggaggtggagcattatgctgtggcggattttggatgtgatggaggaaagcagccatcatgttggcctgctgggcgaggatttgggtgaggatagagttggtgtctggtggtggtggtggaggcgggtgaggaggtggaggtgggctgccatggttgttgtagttgctgccttcggggtgactgccttcaccggtagcagcacttctcctggttgtcaccatctgaaactcccacacagaaccggcaaacagagagagctgactattaaaactaaccacccacgactaccataattcttgaatttatttctgctattaaattggtttattaaggttcaagttgcttaagcaaataaaataaagacaggccccgacacagttataccacacaccggtataaccatgccccacacgactctagcagaaaaacaaacgagaagaacacccgcgcaagcctactaactgctcgtctacttctgcgacgggccagcgcggaaggtgagcagcagtgcatcctccgtgctaccaacgccagaggctccctcatcctgagaaaccaagggcgcgggctcgtcacgaggggtctcgacgaagcaggtccatgccaaggactgacgaacaagctcgggcctggaggtactcttgcgggcggtgatcttcaggctgcggcagacgcggcagcgcttggggcgacagacctctccctaggcgatcttgagctgacacagctgcgcctcccctgcgtctaggtccttcttcagctgcagattctcctgacgtagctccaggatcttcatgttgttctcgaccatcccacggcgcaccatctgatggaagtcgatacgagccgcgtcgtacgcctccaccatgcgcgccaggtgcacgatggtagcgtcatcctccgagctagcatcccggaaggtggcgaagtcgcgggctcctccgcagcgagggtggtagcggtagggcgagtgctgcaactcgtccgggtagcgctggtgaagagtgccgatggcgaggagagcggcgttctggcaagcggcggggaaggaatctccacccgcggtgactgccagcgaagtccgctcgggagagccagtgaggatcactgcagtaacctcccacgcagcgtggggctctgcatcgtcaccctcctgctccggaagcggcctggcctggtagtccactccaggcggataccccaggacaacgcacatgccccgtagctccaaaacgaagccagtcaggtccaaaccacgatggttgatgctgccggccatctacaaacaaaaacaaaagagaatagcaacattttaaagatcagattttgacgataaatgaagcagcgggacagagagagactagaggattttcacaaataagaaaggaattttatttcgaaaatattgctaaggcttgggatctaaagctcgtcctagggtcaagggggctctgataccaacttgtcacgaccagaaataacccaacgggcgttccttacgtgcgtgcattattccttgtcccaggaggcaaggtacaccaaaagttgatacaattcagagtttaataagcggaagcgtaaataattaatttattacatgggcggcgaaagcccaacacacacaaagacaaacgggaaacagcggaagactagggcgatgaccacaggcgcttgacggcaggcacgagctaaacaccaaagccttcatcatccaggggctcctcttctgggtttgggaaaaattgagcaagactgagtacaaccaccgtactcaacaagacacacccataagtgcagaataaatgcaagggagtacaagggggttataatataagggttaggatttgcagtaaacagcattaaaagacacttagttgctcaaagctattttataaatacgatcctagagctataccagattattaataagggccgtgaacccacacgaacctgccttaacccaaggcctacgatgattcagaccgaagtggcaacccgaccctgggtcccagctcgtcccaagccaacccaggccaaccattccacgttttagttgttaagcaggttttaagaattaaaacactaacttgggtacattgctcggcttgcccataaccgagggcgcggctattcgaacagattatactctgatcagaggtgtacatcacgtgtaaccatgtgccacataccaccacggtatacggacggaagacgtgacatagtttccaacccatcctagccatagacaagagtaccgacccaaccccacctacggccggaaccccccggacaggtaggcaggactgagcccctagcagcaggacaccagccctgtgccatgacatctcgactaccgggccgcagctcgtgtagccgtcatttgtcctagagatgtccatcgacccccgacttcgtccatctccatccatgtacttttgtttgtaaccagactgagccacaaactaagcattacccactagacatgtggaagtacggtagtgctttgcaacagaggcccgaagactgatccttatatggccgaggtgctactatcaaaaccagggaccccaagcccagcctaaaaccattttgaggattttgaatagaggggggggtgtgaatccaattccacaataatccaaccattccgtagtgtccaggtgatgagaatattcccatagtctagagttgtaaaaccacctaatgttgcctaattaaccagcgaagcatctacctaaattcatactagtggtaccatgagtagagtgtccactagttgaggttttgtttattctagggtgaacaaggtaataataacaataacaataataaggtcataacaaaggtaaataggcatggctagataaaacagtgataacgcgggaatttaaataaagcgataatgcaataatttaaatcaaaataattttataaactgggattcaatatgttcaaggatgatgtgacttgccttgctcgctttcccaaacgtcggcttcaacctacacgaagagcggatcttccaaagctgcagcgtctacacaaccaacggaaaataaaagggcttttactctaataaactccatataacaagcagtaacaaagcactaaaatgggttcttgacttcttaaggaaaaattagagacttgaatggtccaattccgagttcaaatggccaagttatggccatttgaagtttatatgttctttaaataaatatttgcgattttcttcatttaaaatttaatttaaaaagggtttattgcgtcagccgaggggaggggcgcgcggaccgggtccacgggagtggggcccacgcggcagcctcacggtccacggtggaccgggcgcacgcgggctcgcaccggccggcgccgtgggtcccacgcgtcagccgcacccgcgggcgcgggcggctgatggccgggccccacctggcagccgcggggcgcgcccgaaggcggcctcgccggcacggccgacgggaggcggcgcacccgcgccccgatggtcgccgccggcgaccaacggcgcggcggagcggcccccgagagagaggagggaagggggaagcgaacggagcggtccacggctcaccacgggacgacgagggcggcggaaacgacgagcggagcggaggaagacggcggcgcggctcgggtcgacgaggacggcggcgttccggcggtcggcgggcgaaacggaggagcggacgaggtcggcgaggacgcggcgaagccgaagggggcgatgccgaagcgggaggaggtccggggcgacgacggcggcgaaccggagctcggcggcgacggcggagagaaggtgcgacggcgcgggctcgattccgacggggagagtgagcggcgagaggcggaaacggaggagcggagcacggggaacgattatata

SEQ ID NO: 72730 - DNA, 12089 bp, Oryza sativa
aagtcagctgagatgcatggccggcgcgtacacacacagtaatcgatacacgagactgcgagatcgaggtcgaaagattttttttttttcaagatttcttacgtagattgtgcagacggtgccggcggagtctccctcgatgagcttgatctcgacgtcgatctggacgtagaggtacttctccctggagcggaagcaggagccctgcgactggtcgagggagagcgccagcgcctcggagtcgccatccatgaagaagtaggtgcggctcgcgccccagatgagctcgatctcatcgaagatgcccgccgtgctccggtccacggccgcgaggaaggctaggcacaggatcagcaagctgcatagctttgaggagctagaagcaagcggcattggcgccatcgatgcctgcctgcttctagctagctagccctgcagctagccgggctaggatcttagtttgaagtgtgtggctgcttgttgtttccacggtagaagggtcagcggtttgtgtgtatatatagcagaggtaatggaatgagattggagacgaaggtggtgaggaaaatgagggcggcaaggcaagtgaggaatcgaatgtcaggctggccgagacgaggggaaaccaagtctacccttggaatccaatccctcgtcctgttagctagtgctagtacactggaactgtgcacaggtgatcattggtgttagtctccgtttctacgtatataagcattttacaagtgcaggtcgtctcatcatgcgagtttgatcgatctgtgcacatggaagcacgatagattatactgaggttgaggaggatcagggggtacctagctagatggagaactgaactaagatttgtttcttatgtcaaaggtagggaagccttagatctcggtaaactgttatcttattatgctgccgaccttgctacagctatatacacgtacagtacacaacttaaaattcagatttgcttcttgtcaaacaaatttgagggtcatagtttagggcttcgctatacatgccaatatgccatactagtactgcaccgagctgtatatctcactatgctacgttaattgatctctggaactgaaagagtactgtttgacttccctgatggatctctcactgcacggcgagtaaggttggacgaagagtgactcgcaaagattcaagcagtgctcctcgcacgcaagcccaagcttagtttctctcctactgggcatcgggaaaaatgcagatcacaccgcttaaaaaacacgcttacaggagcagttctatatcaggaatgcgttttcgcaagaacatcaaggcatctttcggctcggttggttggttctaaaatatccctccgcggcttagagaagcgcgcgacacggtttccatcggccaatcacaaactcatatcaacggagcgcgcgcgagatatttaccgtctcggtcggagggacgaggtggtgaccttctcggttttctcacgcagggccccgcgcctcgcggttcgcatgtgcgaagtgcgaacgagcaggagcagcctcccggcagcgttgcatcgcagccaagctagctagaaacctagaagcaggcagccggctcgttcagttccagccttccaggtaacatgcatggggtcagcaccaaggaatagcagacgtgcgctaatttactagccagggcatacatataatctttcacgatgtggtcggttctaattgataaattaaattagtagcgagcccagcgacatgcattggtacggttctgacgttctgtcattagatcggtgtttctcgctcttccattttacggcgccagtaacaagtcttcagtggaaacatacttgaggtaggtagctagcaccatccaacaaaaaactcaatggaaaaagaaaaaggaagaaggaaatctgcttctgttttgaagctggacgaaacgtgtgtccctgactttttttgtactacgagtttattcaagttgacccgatcgactatccattgcctggccggtagtactctctactactactagctagacatacgtacgcgtaggcgtagacctgtaaaacgaagcaacttgtggagatggttaaaggtgacttgacaaaccaaaagaaacaagatacaagtgggagtatatagtagaggcgtgagcccccttcttatgcgtttcgtttggatcaggcttaatttgcagtggagatagagaacgtagatagaagtatacgtgttgtaatactgaaacttcactctttgtacatatgtactgacgtatgatcagagttcagattttcgaaatgtttttttctattttacttgcaactgatttttagactcctatatttttagactcctatctttcactattttatctgtatgatcttaggttcgtgttcttgtatccaacttacagatacactcagttatattgcaattacacttaattatagtgcactaaaattatatttttagaatagttttctttttctagatttatgatttttgacgtgattgtctttttttggttatttcatttaaaacggactatctccattggataaaaattctgcaagatttgaagttataaatctatcacaactaggccgtgtttagttcccctctaccaacttcaaacttccaactttccatcacatcaaaaacttttctacacacataaacttccaaacttttctttcaaactttcaactttttccaccaactaaacacaaccctagttagtcccttattttttttcccacgtaggacgaaaccgtttccgagactaccgaaggagtccatttgcgatagtgggaggagattcaactagtggtaagacatgagggttacaaaatagacttattcccaatccggttgatccacaggcaaaacgacgccatcaggcccaaaactggggccttctccggcccgattagctaggctggccgtagtgctgtaagtaggcctattaagccaggcccagttactcctactcgcctcgacgccgcctgctcgcttcggcgcggcggcgccccacctcccctcctccgacacgacggcgcggcgcccttctgcggtcgacgcctccgtcctccaccctccctctcctccatcttcccgccatcctcaactacaagacgacactgcggtggcgatcgcatcgatccctctacctcatcacgacccggcgggggcgaccgagcggcggcggcggcagcggcgacggcggccggatcatgggactaggaagggaggtgtggggggtggttccgccccggcgaccgaggtcgaagcggcgctgttctgagcaggtgacccaagaacgtacgcccattttcttgaactcggtcaaaagaaaggtgccgattatattggttaaatctagccttgatttctttaattcgaactccgttgtggcacgcaagatgtgtggtctgaatgtgtatgtaatgcggctcagttacttgttttgtttggacgatgcttaatgagcttaaggattacgctagctgtttactggtaataattaccttgccaggttcttttagtatattttaatttcgctttcatgcatataggtcattaactgcgcaaataattaggttcatggatgatacctctgtggacgcaagtagttcaaggacaatggacatataagctctgggactgggagttggagccattgtctaagtgatgcttttagaagatctactcaagcagatatatggctatcacgtcacgtgcagagattcttccaaatgtgctaatgaattagcatttcacttcatagaagcactgacaaagaatcttcaactcttccacaagatagactggtacaacatggatgtatttactttcaagaagtgcaaattactgaatgttaacagttcatatctagtatataatgcatgctttgacataacagggataatatggtgacatgataaaattgattaatttcaagctgatgcttttccagtgtgctttcatggatcatgctctacttcaaataatggaacgctttgctcaagccagtccaaataagcaaaacccttcttcgttgtttcacttgtacatatagctctttgctatcttgcaaaaggatttctagatcctgatattaaatctacatggcagtccaattcatgatttgcatattccaattcatgccatgaatatggttcttgtatcaatcttgtagtgcggtgtatttgcaactttcaagaagtcttatcctccttaaacatgtcctgggtactttttgacagcctaaactctatttgctgggttattctagataagtatttgttttttttggtactttctaggttccatagttccacccatgcaacaaattgaatgctatagctgtcattgtggggctgtgggcacctaaacttaatttctgatttactgtcatcccatgacccctctatcaacctccagaatatgttactgtggcctttgctacttaagtgcattttataatttctaaattgaatgtctcaggaaaatgtctggaacatgccaggtgttatggttttcattgtgcaacacataattggtttaatagtttctaaatatgattgtgcacttaaccatctgttgattcaacttgccagcataaatagttccaactgaaacgcagtttatgctcaaaacgaatgaccaaacatggggtgaattcttttgtcgaactatcctatcttggtctacaggtaccaaatccttaccattgctcatgtgatatgcccccatcagcatacatttaaaccagcatgatgtttaattaattaatcactattgttattgttgatgaatctattgatgatgtgcaggctgtttataactcaaaccggtgcgctaaacttgtgaagtaaaactgcttggactactaacagctaaagtttcaaaggcatcctgcaaaaggacctattggtctgaactttgaagggtatttttcaaacatttttgttcgtttgttcacaacttcacatgaatatacccaagttctttttgcatgtagtatttggatgttacaagcatgtccacattttcggtgctgcaaacaaccagacagggtccctgtggttgctggtgttgtacagaattgctgaacacatcatttactttgctggctgtcaatctgtcatgtatttggatatacacccgtatatctagataaagttagaaattacttggaagaaagcactaacttagtactcgtatatgccatttgtgacagccttttttttctttcacgggaaacggggactttgtatttttattattatactcctgttctgtaccgtgtacagtgcattgtataagaggacttttaaatacagccgattcggctgtgctgtgctccttaaataattcattaattaattcattgttgtattcgctggtactactagctgccatcttttgaattggcatcttgtacactgctagtactccactactattgcctgttgcttgtaaccattgcctaccacacatacatcttctttacatctgtgtcttcttcaacaaccagacctccattactccacaaagctgctttctccccctccttccctaggtatcctcaatggaagctgcttcctagatccagccccaatccacccttccttccaagtccccatatccacaaatcaacacaccatgtcttcttgttcttcctcctctccccagaaagccatagatgctagttatcaactatcaactccatggatcttgttcttcccagcttcaaagcccctccaacaccaaagttcagatctgtcctccttcccttcacctagctctatattagaagcttgtgagggctaagatggccatggaggacaatgaatcaggggcaagatgaactctaagatggctggccatggatgaagattgaagctgctattggtctatgaatcaaggtaaagagaatcccttcatcttaagtagagatatgcaccatgttgctggctttagtttcaaaagaagttcaccgagggaggtccgtttatgcttgtccatcttctgctttggattggaagcgagaacggcgaattacaaaagaatttgcagcaaaaatctctcgatatctttgcctgcgccgcagccaccgaaatctcttccttgccgggccggcccagctgagctcgatccgccccccccccccccccccacaatatcttccagagacatccattccccggctcgatgagattctacgtcgcatacataaaccacagtctaaaccctaagtgaacccctcgtcccattcgactcgccacgcccccgcctccgccgccgcctccgcctcgtcttcctccgcgtcggcgatggcgaggagaggtgactcttgtctcttgccgccgtgggttcgccgcggttgagttgtatctagcctaacgtgcgcttcgttttgcaggggatgatgaactggatcagacgtatcatcttctgtatcgcccgcgcgcgatctggggccgccgtccccgccccaacggtggccgacgccgccctcgccccatccaagggttgttccgcgtgagccatccggcggtgaaccctacagccgagcccatcaggcggcaggtacgcctctccccttcccttacttcccctctctcccctcacttatttccccgatgggatgcaatcctatgcgaatcctgacctgtgatctgtctgattatgctgttctcttcaaatggtatgcccttgtcctgaaaatgctgaaaagtacaccatcacttatgttttgaaattcaattttgctattaaggaactgttgatatggtaatcttcacaccaacttgaaattatcatccattagcgtatttctgaacttagctgtttattaagggaactgttgatgtcgtcatcttcagaccaacttgaaattatcatccattagcgtagttctagaatttgctgtttaaaggaacttttcggaccaacttgaaattatcatcgattagcatgaaatttgagaagctaatgttgcttgtgcctgaaaatggagaaacaacttgaatgcctgaaacttactctaatttgtttgcttagctgtaaacatggagaatctaatatcgcgttgcctgaaaatgcttattagggccagttcttttttttgttgtacctactagattatcgtgggcattacagctggtatatccacgaccttctcctccttaatctttagttctcttctgaaattgcctgaaagcacaaaattactgatgtaagttctgaatgttgctgtggcagggatgcattgtatgctcattgtgtatcttgattttttttttatttatcttcttgtaatgaagagtgagccttttatcattgcatctttgcagttcctggagcagctggattaccctttaccaactatcactggttctgctctgttggatgagacaaacctgattcttcatgatttttacaagaatatatctgacatcaggtctcagatctacaaccagcaaggtctgtgacttgcaaagatgaatgttgtcaaggaacaagctctatgggaagaagctgaagagctcgtatgcatttccaagaagatcttcgattccactaatcttgataagaagctgctttaccccttccctagttggtttaactcaaggtatgatgttatgatgttgttttgtgtttttttgttgttttgaatttggttagcattgattaacaggggagctgatgattgtttttgttttttctagggagactaggaagaagaattatctagatcttacatcttgggttagtttgcttgagacgtatgctaatgagaggagtgctagccctgaagctgatggtgaggcatatgatgtgggtcttcttgatgacaagactggagacgccagtgctgatcttgactatgaaaagagtgcctgctctggagagacaagtgatgctgcctttgatgaagagagtgctagccctggagacgctaccaaagaggctgatattgatgaaccgattgctatcctggggacgccaatggtggcaagatctgtagagtggaggcctatggcttgagttcttcagtgaaggaaaagtacttggataaatgcttcctaacgttgtcatatattcctgatattgtcatgtgtcatctaggtatcatctaggaaagtacttggataaatgcttcctaacgttgtcatatattcctgatattgtcatgtctcatctaggagaagttcagaagcccctgaggcaatctaacatcggctacttatgccgtgataaaagactttgcatggaagtattatctatttcagaatcttgtatgcaatcaaacaactactacttattatggtcttatggataccttgcttgcttatcttatctacagctacggtcattgtttcgttatccaaaaatgtttacagctgaagccgcttgaatggccatgctgctactgcgctgtgaacgtggcgtggcacatgttttgtaaaacatgaccatatggagtgggctatccaggtttgcaaaaccaccggtaaccgtgctcttaccgcggggtactgtggtaaccttcttaaattcaaataaatttaaaaagtaatttgaaattttgataaattttacatagttttgtacgttttgccgcagctaccgtgtagtaaccgtgggaaaccctggtgctgcccccgctgcaccgtacattcccgttcgtcctcaccgtcgcaatttcttcttcgcagcctcagccacctcggtttggtgagcgcggccgtctgttaatagccccccgcaggaaggacatcgtgttagtgcactcttcattcaggattggggaaataaggtagaaagatgaatgtgcaattctggcactttggggatctgtcacaggactaaaattgaatccaaattaagtagggtgttaatcgtattggacttggcgtccggaagatgtttggctgtgttctttggacaattttcgtaacatcactttctcgattttctatgcacgtttttgcaaactgttaaacgttgtgttttttttaaaaaatatttctatagaaaagttgctttaaaaaatatattatctattttttatttttataatacttaattaatcatacgctaataaggtattttgcttttcacgtggaaggaatgagttcccaacataaggaattaggtattgttgttggtggtgaactctggtagttgataatggtatttagactggactgctttcgttagttgaaaaaaaatgcagaaaagcattcccttggtttagcagccccatcttctcgattatacttatactctctccgtccaaaaaaaaaaactcaatttagaaggggataactaatcaaccaaaatttgaattttcaatctagaatttggagttgattttgacgtttttgtttgtagtttatttctcagcatttgcttttatatcgctaagaacacgtattttatttataaattattttcgtttgtaaatatgccgtttggcttattcgggtttcttctgtactttgttaaatcctttagtacttcgatggtccaggagtgtatggttcttttagcttctagaaagttttagtactgcatgaagtgtttcaaggtgtcagatttctgttactatattccaacagctaacaatcgtgttaaccttccacaatgaggatggagaatttataaatccatgatataagttaagtttttttagtgtacttattttcaaattttaatgcttgagaaaattcaccttttgtcgttgaaatgatttatgagttacttcctccgttttatattataagtcgctttgaattttttcttaatcaaacttaaaaatgatcaaatttgtaaaaaaatatagcaacatttttaacacaaaataaatatattattaaaatatattcaatgttacatttaattgaactaatttagtgttatagatgtgctttaatcattcaatgtgtatatatatatatatatagcttcagttataactgttggatgcactttccaagttcaagtaaattgtcaatgaaaggcttaaatggatgtatagaactcaatgcatgtgaaagggcatggaataattttcgcgtctcaaatgaataacagacaaacgatcatcaaatgctcatcatcataaccaagcagccctctatactgaaatttaagtgaggtgcagtcattatttataaagccaactgtaaggtgcatatagtaatctgttcttttcccacgtaatgggtggtttatgtttcttgatgttctctgtaaattttgctgctttggctgtaaatgttctttgtcataattcacatcatgtagtaatctgggtccagtggatccactgtctgtggttaggcttagtcaatctcttggggccaagatcactcatacccattttactttgaatgaatttggtggtttttgaggcagtttgtcggtgtatttgtattgtaaactgagtggaaatcagcagtgtttcatctgcggatcaattacaaagttttcaaggaaaattgatgttatggtctgccaagtataaaaaaaacatgtggtatctcttactatcgaaatccgtgcaagttatcgagcgattagcgatgccacgtggcacagcgtggttcgtgcgtgcgctccaaaacgcgaaaagaactaaaatataaaagacaatcttacgttggagtataatgaaaaagtgcaaagccacctgatttctccgaaagggccacgactcttcgtcttccttgattgactcttcttcttctctgtatatatattcattctccatcattcctctttcctctcgtcattgtctcacattccttcttgccgttccaccatccacattcaccggcaccaaacaccaccatcaacatccaccggcaatacatctgatccaccgagggataaagaagcaacgacctccagccggtacctctgcggcaagcacatcctgcgccgtgcgcgacaacacaacgacgaggaggaaccttcgaggcggtggcctccggccggtagctctgcggcgagcaggtccggcgacaccaggacgaggttagtgaactgaatcacatgtattagtgaacacgaggacgaggtcaggtacacgatcgcctgcattaccttgcacgatcacgaaagcccccaaattagcccagatccagtagtattttgcattttgatcgattgatttataccgaatcaaagaacatcaacaccagcctactgcaacttgccctgatcctgatgatgtgcacgatggacaacaagatatactatatctgttacttctctgacactatataggagtattagactatttgttataatataagtcactgggaacggaagcaatcggaaagaaatcttacgtccagccacgtcttattctgtcacctaaatctccaatgacaacttagtagagaggacatatggatgtgttccttttgatttctgtttgatctttgctaacaagtcaagctttcgtgtactcctaataaattaactcatagtatattacgatgaccaccattccaaactaactgttttcaattaaactttttaaaagttattcaaaatacattgatttatatagtggtactatacaatgtagctgtagcctccacttctgatccaaacaaacccttaattgacaaacctaggtacttacatgtaattatactaacttcaatcccgtaaatcaattagtcacaaagtctaatcttttcctctaaataatttgcagcaagttacagcaaattttactttctatttagaaaagctatagcacaaccaatcagctgtgaataacatttcgtgtagtatggatatttaccagaaaaaaaaacattgtctattctttttagtatttttcatcattgtacattgatcatctgcaatgatattagtaaatgtttattttacaggggataaaagaataaggaaaagaaaaggagataaacaggagcaagacactgaagctaggaagtacaaaaaggtaaaaaacaataacgagctggaaaattttatatatatatgtgtatatatatatatatatgtgtatatatatatatatatgtgtgtgtc

SEQ ID NO: 72731 - DNA, 1296 bp, Oryza sativa
  unsure (1)..(1296): unsure at all n locations
catatgccgcgctaacaaagagccatacttggcatgaaaaagaaaaaggaaaaaagagtagtcataacagaaagagatttgaaggaaaaacctaggatccaacgggcaacgggcaacggcaacggtgctgtatctgtgggtgcaccggcccacgtgcagttgcagcggggcgctaaatggcacagcaggggggcaatttggtcacgagaataataataaaattgtaaaaggaattaaagaaagcccagtggatatgaaaggacctggcttgttgtggggcccattcgtgtggttctactagtacttctcctgggcctttcgctttgcgagagagaaagccacgtggcgggggaagcctgggctgccgacaccccgcccacatgtcgtncaaccgcccgctcacacgcgccgcgcatgtgcctgcctacgctacgtgacggcgacgtcgacgacggcgaggcggaagggaaaacgcttgggacgcgctgcgcacacgcagtcacgcacaaaattcaggccttgttcttggtacgttgtcacattggatatacatatacacatttaaaatattaaatgtattctactaacaaaataaattagatttctaaaagaaccagattaagctaattaattcgtcattctcaaatgtttactgtagcaccacattgtcaaatcatggtgcaattaggcttaaaagattcgtatcgcaatttacacttaatctatgtaatttgtttttttctatatttaatactccatatatgtgtctaaacattcaatctgacagcgtgaaattttttattttgagaactaaacacggcctcaatcgtgcactcgtatatatccgtccttaaaaataactcaaccataggtgcttgtccggacttcttttttcttttttctttgaaacacacatgcacgcctacaatacgcacacacttgtttttatgaacgtacacacatgtacgtcctatttttagaatattttctaaaggctgaattggtatatattgagatttgacaaaatcatcgtggacatctcattattaatggatatgtcttatatcactgaaagaataattattgccatgaatatgtcatagtctagactcgaaatcatgctccattagctatagtctaatgaatacatccttccttgtgttactccctccgttgaaaattagttttgttctttagtcaaactatcatgagcttagccaaaatctttagaaaaatatttatgggtaccgagctcgaattcgcccatagtaagtcgaactcaaaanntcgnccacg

SEQ ID NO: 72732 - DNA, 3192 bp, Oryza sativa
  unsure (1)..(3192): unsure at all n locations
atttgtttgtgaatttcagtaaacctattcacccccctctaggctacatctctgtgcgttcagatagttatataggatttatagatataataatggctcgaattgtcataatttgaactgatgtgaaaaatacaatagttttcccagaatggtacacaatacagtatgttgtcaccatagaaacaaaatcacaatagcaaaagggatactataagaaatacaatctatggtgatcaccggtacaaatacgacatatttggtggtcatatatatgagtctaactactgttggtgcctccatttcagataagctgcccaaccaaagataatcaggaagggccaaaatgagtgcagaaagtttcgaagtatcttcctgcccaaaatccaccacaccttaaacccaatccttccctgtaagagcacggccatgcggatctgtgtcttcattgacgtatgcccgtgcaataacccaacggaacacatgaggcagataagcaaggcagtcttgtgagcaactggtgccaggacaacgtataaacctaatgcaaatgcagctagcaagcacctgattgatagccagaccaagctattggccgagttaaggtgctccaagcggatgctgtagtcaactttggtcattcctgaatacacgaggctaaatgtagccaacaaggagtagacgaatgcaaatgtgatggccaagacgaatgcatcgaaaccgtagcttccgacgaatgtcggcgtgccgccattggtgtgatcatctgctctataacctccaggcaatgtaaaagctgctgcgaatgccacagttgcaatgagtgtggagcagacggccataacttgtgtagactccgtaattgtctttgaatcttcttgttcatcgtcatctttttcaactattttagaatctctttcctcacggaccgttcggcaaatgcacttctcttgacgatggtcaagggaagggttagcatgatgtgcattcgcaagatgtagtgacctctttatccaaattcgttgatgctgtaataagcacaagcatgcatgagcatcaagaagtacataccaaatttgtgcaaaaagaacatgcattttccgcgcgggggtggggggggggggggtgggnanaggggattgttattaccgatccatgaagaagcccttctggtatcagcttccttgatatatctagaggtgttagaccctccttgttcagacaatcaacttttactactgggttcatcaatagacataaaacagcatgcagatccccatcttgtatagccaagtgtagggcggtgtttccatcgttgtcctgcaaattcataattttagctgccagccttcttctcctgcgaacaaacattatgattgtgtgtcttccgttctcaacagcaatatgcagaaatgttcttccctgggcattgcgcaaggtggcacaattggggctcttattgagcagtatgttgatcgtgccatcattaccctctgctgcagcgacatggatggggaaagaacccttgtcgtcaggctgatacgctgaggattcatcagcatccatcaacataccagtcagagtcaagctatctcccctggttttcctaggatagaggaaccggtccaaacaaagagtgtatatgtctatgtggcgcatgatggagaacaatatcttgtggtaatatggaatcttcgtgggtggttctatcgatacagcaaaatggagaggtgtccggccgtgtgagtcaccttttccagtaaggtccctgttccaattcaaaagcattccggtcgcatctgcatgcatttggaactttctttaatatctttttttaagagtgggcaaaagttgtgcctcctatattgatataataggagaaaattatacaaagatatgtatagggcttgtcaaaaccacatgcccagaaaaaaaaaaaagaccctaagtgatatcttcgaaaattccaaacacctgacactagtaaaataccatcataggtgccgcttgggaaccggctataggtgccagttttccaaccggcacctattggtcggcaccaataaaaacaaccgacccctataccaaaatagaaccggcacctataagtttgcacgagccaaaaaaaaaaagagccgactcgaatcgagccggaactcacaatcatcgtcactactccatccccaaacccccacaaatcacgaatcacaaatcacatatcacagatcacagatgaaacatattcagaaataaaatcatccacaaatcacaaaaaaatctaaaagaactataaaatcatccaacaaatccatcgggcgccgctggcgccaccgccttcgctggaccgccgcccgaccgtccccgacgtccaccacctcccctccgtccagatctagcggaggggagggcacggccgccgccagccgcctccgccgaggtccgccgccagccgctgtgccgcctccgccgaggtccgctgcctcctctccggccggatttggcggaggggagggcgcggccgccgcaaccgccttcaccggaccaccgcccggccgtccccaaggtccaccacctcccctccagctagatccggcggaggggagggcgcgccgttgccagccaccgccacgcctacctcgacgggccaccgccgggccgccgagagagagagagagagagggatagagggaggcgagagagagaggcgagagagcaagagcgagagagagacgtgagcgactcggtcggatggatggataaggcggatggataaggacgggcggatggatatggccggctcggctccatataggtgctatttttttatacaaaaccgacacctataatttatttaaggtgccagtttttaaaaaccggcacttataatttaggtgtcggttttgtataaaaaccggcacctatactataataccggtttttctttaaaaccgatacctataattgcttaaaggtgtcgattttatgtgtttttagcctacgggggagaggaaagcattataggtgctggttttaactattccggcacctacagtgccgatctctatgagcttatttctagtaatgtgaacttccttaatctcatacgagtaaatctcataaaattacatatgctttgatcaaatgatcataaatctataatttaaggaatgtataataaaactagaaatttacaac

SEQ ID NO: 72733 - DNA, 2763 bp, Oryza sativa
aggtgcggggagggtttaaatagggttggaagggggagagagcagccggcgagatttgcgggggcaaatccacccgtttgaacgcaagagagagagggaaaaatggggggaaagggagaggggatcacggggagtatttccccccactttattgcacgcggggacggcgggatgcggcggatttggcggcggcggcgtcgcttggcgcgggcggagcggcgggagtgggggaggacggggatgatgggtgggccccacccgtcagcgagggtggcgggtgggcccgcccgtcagcggcgcgcgcgcggggagggaggccgaatgggccgcgggggagaggagagagagaggggggagagagatgggccgggccggcccaaggaagggaagggggacttttagggtttttctttttataaaactttttcaactttgtttatttcttaataattattatttgtgctctgaaaattccactaaaatttatttacgcattttaggcttttaggaaatatacaaaaatcctctaagccttgtttgacttttactttgcacattttattttttggaggctttcacacggattttaattattctaggcgtaatttaaaggatatattttagggtcgttttgggcgtgacacaccacaagtggcagcaatgttccgaagagggggaggaagttctcctctgtacccgggacccgccggaaggcgatgagcccagcggtaagcttctctttcgtccttgagtacgtagtcagaacgacttaacctcacatcatattatcttactcaggacttgggtgcgtctccaccgcctcagcgaaagcagaggttggtgacggtcggcgagaagtaagtaaatgtttttgaggtttttttattctcaaagttttgatcacctagcctcatggagaaaaaatcttcgcaggatggcactggtgaaagcggcgcacagtggggctgatgctgcttctagtgcgccccctgtggcgacctcgacggaagtcatggccagtactaaggaccaggaggcggcgccatgtagtcctatcgctcgcctcgtgcccgtccggcctctgtccgccgacaccctcacctgggggcagctccaggctaagatggagtgcatccttcaagcgggcgcccgcggcgtgggccgcgagatcgaggaggccagtgcagcggcgtcgtcggcaaatcattgtgccgatcagctggcatgtgatctggcggagtcccgcgaggacctccaaaagatgaaggagctggtagctggcaacgagacgtagcggcgtggactcgagcaccgtatgtcggagctcgagggccatctgacagccatccgaggttcgctgcggacatcgttcaccggcgtgcaccaactcgccggggagttcggtgtcacaacttcgatcccagcgcatcccgacgagtggttgctgacatcgtcgctcacggaactggctaaggcgatggaggagatcccctccagccacacggctaggcttggtgaggagacgtctaacggtatttacactggggcgtgccatgtccttgcgtttatgaggctagcgcatcgcgacttagaccttaaagaggctttggatcggggggccgccgatgacgcgcgtaaggacacgatggaggaagtcagtgacttgggggagttcgtcctccccctttttcaagagtaggatttttattttcctctgtactcctttatctacatgttgtaaaactttctgtgggttcgaactgcttttatttaaacagttgtttccctgtttccttagcatgtgatcccgagtacctttgtcattgtagatatgttgaagtcgaggatgtccagcagtgcgggcagcccgatacgtcagtagtcattccggcgctcacgcttgagcctcacgtgccggaggtggaaatcgatcaaagcccgtccgtggagacgaacatggtgatgacgtccttaggtttgtgtcttgatttccttcgctcctcgtgttcggattgacttaattagctgtgttctcgaaagagaagagtagcttgacttaatcttttctgtgttgggcaaatttcaagaacgtgttggcagaccgagatcgtcgaatccagtattggaagaccaaactcgaggtggccgaactcgaaaggaccatcgtggaggcgaagaaggaccaggccatggaaactctccgaggtcgcgaggtgtggttcaactcgtacctcaagggttgctgcacggccatggcggaagtttgcagggagctccgagttccccgcggagatcccatggagtccgctgctggttatatctcgtggatgaagggggcctacgcacagctctaagggattggcaagcgcatcgacgaggccctgaagcaggagtgtcgtcgagcgagccgctacgccgggggacatgtgctggcttgcatccaagataaccgctcgcagttgcacctcgagttccttcgtgaagggttctctcgttctcggaggacatccgtggagattgacggtcttgcgcagttgatggcgtcgcttgccgagaaggttttctgctccatgtattggcgttggccgtcctagtagcttttgtatcctgtagaaaaacatctcaaggaagcatgtaatatactaagttttcttattttgggtatgttgtgtatgagtgttttctcgttctgcgactttgattagtcatttgagccatacactctccctatcccccagccttgtctgatgaactactgtacca

SEQ ID NO: 72734 - DNA, 1283 bp, Oryza sativa
agttggcgcgcgcgattccacgaaggtaatttttttttccctatattgccccagccaccatttcatttatgctcagaaaatcttgttttggggtgttgttgacccttttcactccagttgaaaaccttcggcccccccctatgcccataattggtagtatatttccaaaggttcgcggcgtgattcacgaaacattatttttgccacgaatgcacgcaacaccctccaatatgtccaaaaataatgtttggggctttttcaactttttcattccagtctaaaccatcgcacccacttatggcaatatgggcattacttcacaaaagttcgccgcgcgaatcacgaagtgagtttttgccacgaacgcacccaacacacaccaatatgtccaaaaatcatgttttggtgctttttggactttttcattccgttgaaaaacaacgcacccacgtgtgccaatatatggcaatattgacattaattgacaaaagttcgccgcgcgaatcacgaagtaattttttgccacgaacgcacccaacacactccaatatgtccaaaaatcatgttttggtgctttttgaactttttcattccggtgaaaaacatcgcacccacctatggcaatattggcagtaattgacaaaagtttgccgcgcgaatcacgaagtgattttttgccacgaacgcacccaacacactccaatatgtccagaaatcatgttttggtgctttttgaactttttcattccggtgaaaagcatcgcacacacgtgtgccaatatatggcaatattggcattaattgacaaaagttcgccacgcgaatcacgaagtgattttttgccacgaacgcacccaacacactccaatatgtccaaaaatcatgttttggtgctttttgaactttttcattccggtgaaaaacatcgcacccacctatggcaatattggcagtgattgacaaaagttcgccgcgcgaatcacgaagtgatttttttccacgaatgcaccaaccacactccaatatgtccaaaaatcatgttttggtgctttttgaactttttcattccggtgaaaagcatcgccaacacgtgtgccaatatatggcaatattggcattaattgacaaaagttccccgcgcgaatcacgaagtgactttttgccacgaatgcacccaacacactccaatatgtccaaaaatcatgttttggtgcttgttgaactttttcattccggtgaaaaacatcgcacccacctatgccaatattggcagtaattgacaa

SEQ ID NO: 72735 - DNA, 5315 bp, Oryza sativa
cggaggacataatctccgatcgaaagtgtacgtgctctgatgcgcttctcgtgatattggagaagggcctactagtagctgcctgctctgacggcaactctttctcgatgttcctcgagtagattcacatcgtcacttcgctgctcctcctgctcctcgtcggagtacttctgcactcgtgtgctctgatgtcgtagctccgtggggagcatagcctctgagccgtacacgaggaagaagggtgtctcctcattggattagttaattcagtcatttgaaattaaattataaagataatcatttatgattcagctgacagaagcttgatattagctcaaatctagatgcatacagatttggcataatactgggaatcttgacagtatttaattaaatctagactagaccactggtattaagaatgctttgtattatttacaaggcaactttaagtaacatgcttatatttctaaaagtctatttggtctctaaagtttagagatatttggacacacttattttgtgagatgtgtggatatttataaagattattaagctaatttagattaagctatgtccacacataggggagcaataaccatggaaaaggtccaaaataatctcttattgcatagtcgacgatgcagttggattttgtagcatgttatgattcagtcatatgtttaagaaaatttccctgaactaagagtggtaaatagcgctcataaaccactcaaaattatactatgctataagttgtgcactaattaaacacagttttctattctagtaacaacatgtgttttcacatatggttgtgaaagatatgtcccagggtctaattattaagctgagcatttgctcatggctccatactctaaaggctagtaaaattaagtttaactaagatatgttctagctagcacatgtgtaaattagagccttattaagatcctggatgaggggaacttaattttcaatcaatacccactaagttaagcttgagtttatttgcgtaccatagtgttgtctcagtgacgcttgtgacacattgtcttggggaggtattttatttagtaaactcgtcagttagtctcaaaatcaaggggagaatgttggatgattttcttggctaatgccggttagctaggaagaataaaatcccactggttttcctatcctaacaagaaaccaaagaagagaaatctgttttgtgtgatcggtacaaaatagattcgaatttagcttgagaaaaaaccctgagccccaccgatgtcgctatataaagaaagagaaggagggaggcaaattaacaacctaactctatctaaccctaaaccctaagtcaatcgtccgatcgattaggcactggaaggggttcgtgaggcatctctagaagaagaagaaagcagaagaacaatggcttcatttttaggtcagtaaatcaattaatttccgcataagtagaaggtgatcatgtctaggctaagatttaaccaattaagtgttttaaactccaacacatttatcataaatgacatatttgcaatggcatggatcgaattaacccaaaaaagcattccaagttatttggctttggtgtatgtcaaaatatataactttaagtagaacaaaccaaacaagcaacccatcgttttgctcaggcttatgcttataagccaaattctaaattttaaagcttaattttagagttgattttgtgcccttttcatcatagtttatatatttatttttaaattgctaataacatgtacataaaaatttcacctacaaattaattttttagttaataatatgtggtacggataataagcataaaatgatggggccgaaaatcccagccgactcttaaattttttgtttggcaatgatcaattaatgccacaccaaaataattggcagtgggccggggccgaggccgggccaggccctagttctttcaccgtggaacggttctctagccagctggcaaggactccatgaccaagagtccaggagcaaagcaacgagcacgtcatggagtagactaaactcgtggcgtcgacaggtatccatggtggtggtggcagctggctggggctggcatccatggcaaagacagcggaacctccatgagccatggcaaggtaggtggataggtctgctcccgctcccacccttctgggccatacttgtgctggcccagcacgaacagacccatcaaaaagcaagcaacagcttcgactcaacaagcggcgaccatgaccctagaaggcatcgaccttgaagtgcaagccgaagccgagatggggacgatgcgtcagaacatgaacaagttacaagacatgcttcgccaaatgcaactgcagcatcaagcctatgaagcggcaaaacaagtcaagccagccccatcggccccccacccgacttcgacagcgatggtcaccacccaaggtttcggccatgctgcacaaccccatgctccgccggcttcggccatgtacggacaagtctatcaagctccgctgtacgttgccaaagccgctccgaccgttacagtgcaaccggccccttacaccttcacgatgcccgttcagccggcagtgacacaagtacaaccggcgaagcatgtcgaagcacagcacgccgccatagaagcatctttgaccttacaagctcagttccaagctttccttcaacagctcaatcaaccccacacaatttcgaaaccaaccccatcggcgaatgccgttggaagcaagtcaaggtgccccggtctggcagccgtcaattcggtgcaatgcaccaagcgaatcagtcaagccagggggctccgacctggcaaccgataagtcaattcggcgcggcaatcaatcaaccaagtcaagggacaatagcctggtagcaagcactgagcttcgaacagaacaccatgacccaagcatcaacaactgatgtttatgggataatcaccggtttcggctccacacagcaagcgaaccagtcgaatcagggcgtggcctggatccaagcaccacagttcgacctaggcatggtgacacaggtagtttcagccaacatgcaaggagcactgttcagaaccggaccctagccgaaagcgatggcccaaccacgggtgcaggcgatgacttcgccattcgccatcccataaccgagcttgaactcatctttccaaggtgcaacgatgagaggcgggggcgaaaagaggccaccgttaagttgggtgctcaagaatcatcccatcccaccccaattcaagtacccacccgttgcaatatactcgcgtgaatcagacccaagtgagttcttgtcaatctacgagtccgcaatcgaagtggctcacggcaatgacaataccaaggcgaaggtaatacatgttgcgcttgacgggatcgcccgctcttggtatttcaatttgctatctaatattatatactcatgggagcaactctgtgaagtctttgttcttaacttctgaggcacctatgaggagccgaaaacgcagcaagacctcttcggcatttgctagaagacggagaaacaacaaggagtacattcgacacttctcgcaagcacgctgccaagtgcaagacatcacagaggcgtccgtcatcaatgctgcttcggcagggctccttccaagcgacctcacaagaagaatagcaaggaaagagccccagaccatcgagcgcttgtttcgcatcatcgacggccatgcacgtggcgaagaggacacaaagcgaaggctggagatacaagccgactatgacaaggccgccgcttccgctgcagctgcgcaagcggtgatgcaagcagctgaagccatgccgctggcgaatcgccaagtgcagccgacgaagaaggtgctgcccccaagacccagccaagctcccatgacgtgtaaaaagaccagagccgaacgtggaaaggttgtgagtggcagtcgaagaggtgtagaccctccacaaggtgcttgacacacaccaggacaccaatcaccagcaaccctttcgcaagaaggccaagaaggatctctactgcatgttccacgggcgctctttgcactccaccgagcaatgccgaaacattcggcagcaaggcaaccaacaggagccaagaccacagcaagtgaaggccgaagaggtgccctgtgaacctgttcaggacataatccctcaggccgaacaacagcaagacatcccgcaaagtgttatccaagtgataacaagagcagatccaccctcacagctgtgaagctgcaaagaaaaacgcagcttcgggcggtgcacaacagagaaacgccgagggggtcttgttcctacaccaagacccgctgatcatttcggcagagatagctagatttaaagtacgtcgaatccttgtggatggcggcagttcggcatatgtcatcttcgccgaagcatacactaggatggggttcctgaccttggctctctctcaggcgctcactttgcttcacggctttgggggcgaagcggtgcaagtcctaggccaagttcacttagctccggcgttcggcgcgggtcccaacagacacgagcagatgattctcttcggtgtcattgatatttcgtacaactacaacgccatcttcggcaccgccacgttgaacaagtttgaagctatcgcgcaccacaactacctcaagctgaagatgcctggtccggccggggtaatcgtagtcaaggggctgcagtctttggccgtgctagggagcgaaacaacagtgataagtagagaagtagacaatgtacaagctgaagatggtgagcgagcaagaatcgtgccgaagccgtccccacatggcaaggtgatcaaggtccaagttgacgaggctgaaccaacaaaggtggtttccctaggcggcgatataagtgaagaagaaacgaataacatcttggccgtgctcaagaaaaacatcaacatcttcgtctggggatcaaacgaggttgtgggcgtttggcccgacctcatcatacaccatctagtagtaaagctatatgcaagccaaagaagtagaagctacgcaaaatgtcgatagaccgccaacaggcagtgaagacagaagtctaaaagctgctcaaggctggtgtgattcgggagatcaaccacccggagtggttggcgaacccagtgttagtcaagaagtccaatggcaagtggcggatgtgtgttgatttcacggatctgaacaaggcttgttcgaaagatgacttcccactcccaaggattgatcaattggttgattcgaccgtgggctgtgtacttatgag

SEQ ID NO: 72736 - DNA, 48200 bp, Oryza sativa
gcgtttgctcagggtccttgataaggattgaacccctgaaaacggaagtatgcttgaaggtcatcatgctattgctgcatcatgttgttgaagttggcgaactgagcatcagcagattgttgccattcttgcgtttgagctatgtgttccgtgaggttgtactggatctctctcgtctgcatatcaagggtgtccattctcctagtgatttcacccaagtcccaacgagaggaacttgagcgacattcacttggagatggaggcacaccacttgatctgggaggttgattgtccccccattggatgtcatgaggcgcatgccacaggtccacactggcacttacccaggttgagactctgatactgtgacgtggagcttgggtccatctgggtgcgtccccagttggctcccaacctacctcatacatctgcacggctgttgaggattatgaactttctcgttcgttccttgtcatgttgcacgtctccctgtatgctccacctgcatgagattcttttatgttctgcaggggaatggttagttcatggcagttgtacaaatgataccccgtatttggcaacgggatttcatttgtacaatcggggaataagtaaatcaaagatttatttactccatgtttcagaatgtgcccttgcactaaataagcctcatcaatacacggacaagcggctgagataaaagcaatttggtcgctaacgacccctagcccttttgctatccgagtaatcagagaagtgcactcaacaggagcagagaactttatactttctaaccattgccttatcatacatttcacaggagcaattttgatctttctaaccatggcaaatatgataatcaattcatctcccctaatgggcctcagatcacctctaggaaacaaggtcatagcaatccatttgtgcatgagcctaagtgtaggattatggatatcattcgttctagctttcttgcaaattggagcaccagaaatgtcttcccaaaacttatttttctcgaacccataaattcctttctggagatcgattttacaggaatcgtgaaaaccaagaagtgtacttaagcttttccatgtaagtgtgtactttttatggaaaaagcgaaaggaaattccatcttctatttctttcaaagtgcacagaaattgcaaagtaagcagacgagaaccaggctcatctaccacagcaaatctctgccaaccaacaactttccaaacagtacgaaattcaacatccatacctatctttttagcagctccggtgagtattcttgcgtgtgagcatactcccggtcgctcagcatgtagtaggcttgtctctcccgatcactgacaaagtcgaggtcggtgtcgtttaggagtcgttgcggagcttcagtgtcttccatcgagacatctgctgatgaacgagtactagactcgtcataacgacttgatgaagaaccggaccccttgaacagacgagacagtcgcctcctcattctgcacaacggagcaagaatggactaactcggcgggggttaggaatgacaagaatttcacccgccggttagtttcaccaaagcaacttgtatatatgcaactaagtgtttgaatttgagggaaactatcaaagcttgaatgaacttgagagcaaactttggagagggaatgaaaatgtgtcgaaatggggtggaattccctctctcggccggttggcttaagtagtgcacccaaaaaccgacctatggggcccactagcagttgcctcaaagaaggaggcagtcgaccgttggcctggctagttcggccgaacaagtgggttcggccgaacccacagtgggcccaagcggccccactttcggtcgttgggttccaacggtcagtgtggtcgtggcacagcgaattttcattgaaaattttattttggtttgctctgaaaaattcatttaaagaatttcctccaaattcaaaaatcctaaatgcaactttgaaattcaaacatgtgattatgcaaaaattcaaattgttgaaagcaaatatgcggatacataccaaattacctgttggcgaagatcacgtcatttaaagtccggcgtacaagactgtacctccatctagttcagttagtggattttccacccgtatcaggaggtgatggagcgggtgtctttggcttctccctccacaccttctttggttttggtgcagacggtggcttcttctaagccggcttctcttgcttcttagtcggtatgggtggttttaccggcgtcttccaataacggttcctgggcattgttgtgtccttctccaggaaattctgcatgaatttcaccaggctgtccgttttgggtggctccacttcgacctcttgaatattctgtcggttcggcccgtactttattctgaccatggagcattgttccgtcctcggttgaaactcaaaatatatggtgcaaacatcgtaacaaggtttacagtacatatttttcctcatgtgtcttggttcatctaacccatcgtgtgggtctaaaactaaaaaccgacacatataacaacttataagtgccgatctattaaaaaccgacactattagaaaaaccagaacttatatactagataaagtgtcgagccgaaccacatgcaaccgagctctcacccttatcctcttgtccccctcgcctgtctcctatcatcgctgtcacccctctctcgccatctctgtctccttggcacggcaagcggcagagctgcctcccttcacctaagccagcgaggggtagcctagaacccccaccagcctccaccagattcggttgttgcggatacttttctcgctagttgcgttgcctccacctcctcttaaccaagctagagagtgttggcctagatatccctgttagccttcgccagatccaatcaccatcgatggtggggaacgggacgctccaagcatcggctttagtttgaactgatgcatcgaactgagctaggtttatttctttcattcgtggaacctcaaaggtgtgccaattcctaaaccaacaccgaccttcttcccatcagtcctgctaatagggtcctggttgtgaaattcggcacctaagtaggattcccaaccagcagccatcgggtgagttacactgcaactacaatgtaattacattgtaactaacaatataagtacattataactatattgtaacctctatagaacttatttatgaagttacataaaattctttaatacttgtatatatacaggttatataaaagttataatgcaattacagtatagttacagtataattatattaccattataatataatagcatttgaaacatttccactaaaagacttgtggttgtttttttagatagtctcttcaaattattcgtggtaatctattgacaccaaatttaacttcaatatatggaaaaatttgctacaggacattgttcttcctatctttattcccattcttcttcctttcatcacagcaaagcggtgaacggctggtggcattagccggtccgcctcgaccaagacgtttagaaccaccagccagacaaaggcgggttgttgttggtattatgaaaaaagtgagttttgctgccgtggagctcacgccgctcgaagatgtctctgctttctctacaaagacgtcggtggctcgcctcgccttgcgtgacaccacgcaaaccaccccgaccatgtacaccagcagcgcgtcggcgacggagagcgtcacggctagcaacagcccgagccagctttgtcatctacccaccgttgcacaaaaaacgccccaccgtggccgaaccgtccaggctcgggccagccgccggcctcgatatggagcaaggacatgacgttctcctttggcaacatcctggcggcgatagagcacttcaacgacgcgtactgcatcggcaaggggagcttcgggactgtgtaccgcgccgacctcgacggcgggcgcgtcgtcgccgtgaagcggctcgacgcgtcggagaccggcgacgcgtgctgcggcagttgatgccggtgagcgtcatgacgtagaacgtcggcaccgaggggatgcggcgcatcagtgtgaacgagaagccggccgccgtgttgctgctgttgggcgcaccgagggccatgaaaagcgtcgcgttgctgtcgaacaagaagaacagagaaagagaggaagaagaatagagaaagagagattgacaagtgggcccatgggcaaacttgtctttaaccaaagtttctctctccgttttcatcaaaaataataaaatattgggaggagtgtccagcagctaattaccacttttttacagtgtccacgagcaaatacacgatcttcgagtgtctcacagtaaagaccacaatctttgagtgtcctgtagcaaattttgcctcaatatattcatggtagtatgtcacacctggagttttcccctttcccatagttccaattcaccaataaatcgtctaaagaaattactttggttaacaaggagaaaatcaaaattaacaatgtatttaacaacctgaattgtcagggagaattttttttgaattctctttgctttaaaatcactaacaggacttaaagaggaagttaaagagcatcggagttaatgtggttaattaaaaatttgtcaagttttgaagtaataatagtttttccccgcctttggtcgtgaatcgtgcccgattcactcccctctctgtccacggtttcgttttgcatggttcgccatgtccgttatcgttcgcgggaccgttttcgttcttttcctaaaacgacaccgcatttgttttcctttttgggaaagtcctaatcctattctccttctccaatttttttcctcccctccccctctcccactcggccgccgcccctccacctcggccgcgcgtgcctcccctctgccataccgagtcggtctcctctccctctcccctgccgactcccctcctctcccctccggccccacctattttatctccacccctatataagccaccataccccttcgtttttccctgttcttcattttgttggagtcctagctctagccgccagccacctcctgtagccgccgcctccccattgtcgccgtcgtcgcccttgcatcactggtaatccgtttcaccatctccgtgtcatggctatcgccattacctatccatttcttatttgttttcgtcgtaggttttgatccaacgtcgttgtcgccttcgcgtgttgccgttggaccatcgtcgtcgtttccttctcgccgatcgcctcagtttggtgaggaacctatccgtaattctctgttttaggtgttgtttctttttagcgtcattgtggaaaccgtagttgtttagcccgagccgccgctgccgtccgtgccctggcgctgtcgtcgccttgccgccgctgccgcgccacctcctgttgccacgccgccgccttagccgccgccgtcgctgccgctagccgatcccaagccgagccgagccgccgccgccgttgttctaggcgccgccgccactctcccgcgtcgccgtcgtagtttgccgttgtgtcgtagctcggtagccgaatagcaaagccttaggtgcagccctaaactcataccggcctatcgtttgccgtaccgagtctctaccgtaaactgtgtctagttttttgttgtcattccaagccgccgattccgttcgccggttcggttgaccgttgggatggccccatggcacgataagttgactcgttgagtcactaattcttgaggctttcttaccggaggtataattccattgatctatttatctatgggcaataatgtgtaataattgactaaggttttttcggttattagtaataacgcagctcatcttttaaaattcagaacttaataatccgagctccgttttaatccattcaaattgcagtgaatccgttaaaaagtatagaatccattaaaatttgtttattttgctatttcagtagacttattgcttgtatcacctgtgtgctttgtttgtcgtttagattccgtcagttccggtgatccagtttatttcgaagtggttgccgaggttcagtcagctcaagagcaaggcaagtcatacatacatcattgattatattgagcctattttacaaaatcccctgctttctattaaaattgcattgttttagaatgtcatgtggtatggatgccttttattctcagcctgatgaatatcttgtgcctttgataacttgggttatatttgatttattataatttagtccttaattactttatgtacaccaccatggttatggtttaattaaattaaaatttgctttaatggtgggtcgtgggtacatgcatgattttctggaagtcgtgcccatgacaattaaggaccggtttctcgggaatccctagaagatatactcgtactcaccacaggccagatgagctccaggctaaatctagagtataacttaaactagataacataccatggcaagggtagaggcgatggtgcagttcagacctggattttggtctctactatagccagatttacctaggcacgagaggggactgcccgacttcgaataaggagggggtgaaacctgaggtgcatatgttcggttagggagggttatatgacgggttttgtcacgatttccccctttgcagtatctcggtggtacttcggggcatggtaacatgtatggaatcgtgtctagtgggtaaagttgtgcacctctgatcagagtaaaactattcgaatagccgtgcccgcggttattgggcggtcaaccagctcaccgtgattagtcccactataacaatttgacttatagaactggtgtagtttaggtggttttggttggccctgttgcgacgtgatttagcgttggacagtgatgatgttaatactccttaattacttatattgtttttacttctttcaaatcatgctttataaatgctgattttactgcaaactatcctatgagccattcatttgaatatccttgcatcataccttccccttggtatggcttgttgagtacagtggttggtacttagtcttgctttttttcccccaccccaggagcagaagttggttcagatggtgagttctctgaggattgagcttgttctggacatcgaggattgtatggagaaagcttcgctttggtcgtgaagattaagtttatttctttagttctttagattaaataaaaaaatgagggttataaatttattttgttattttttaagtcgtggaactgtatcaaattgtcgtttgtgtaccctgactggtcttggatagggatttaatacacatcctgcttgagattcgggttgtcgaatttctgggcgtgacatagcataaactgatatatgcaattatgcattgaacatgcatgatacatataattatttactacgtacatacatatgtggcattagaatacacatattgaaattacgcagttgggtatgaaggctccatggcaagcccacacatgcccctcttgtcggaaatgtctttctccattctcaggaagccattctcaccccatgttgtgccccaggagttcttcagcaaccaatattgtgtgccatcaccgtccttgccatagccaatggctacaatcccatggtctaagtcagtgccgcatgagccggtcatcacgccaccagagtagaactggaatgtcatgtcgcctccatccacggcaacagaaacaggttggtttgccacggccttcatgagtgcggcctcattgttagctggcacatcctcgtagcccttgattgttgcggcgctgttggatccaccattgcacttgccgtctgccgctgtgtatgggtacttagactcagtggtgaggccaccattcttgatgatgaatttgaaggcatcatccatgagccctccctcgcagccctgatcctcgccatgaacatcgcagtcaacaagctcttgctcagagagggagataagcttgcccgtgctcaacttgacaataccctccatggctgccacggccgaaaatgcccagcaacaacctacaataattattcatgtttacactttcgattcaatacattttacagatgatttgtaaaatgttgcagtggcaaagtggcttgaattttcttaccacactggccttggtccttgatgggtgtgacagcgcccttggttctccagtccacggttgctggaagcgtgtcaatgctaacattctcatacctgaatgtggtaggaaccctaaccgtgctaggaatgaatcccttgttggtcttcgtcgcccggaactcatagttggtgaggtcagcgaactggttaacgccgagccaaaacttgtggttgcctgcattgaacgactcgatgaatgcgacgttggctttgaatatctcaaatcgacgtgccttctcagtagcatccttgtacacccgcccatactgttccatccacctctcgtgcctcgccaccatggctgcgtggtcgctctgctcgcgagctgctagaacagcgctgcagaggcagaggcagctgaggatggcaaagagcagagccttggggatggccatggttgatcagactttgtcagtggttgctcactactgcttctgatctgtactcgtttggttgatggctttgggttgtgaagtggatatagcatggcatgggttaatatactagcttaggagagcttagattaagtaattaatttgtacatcccgtgcttgtgtgatgttgtagacagggatgtctgcgtagcagagaagttactctgtatgtaagctcgtcagtgaacgtacgctagcttcgtagtaagataatgtacgctttgctcaccatgttcacacttactaattactgatgatctcgtcgagcaaatgctaatacaatgaaattctgaacatagatacagtaatgttagagctgtttcccttattttatatctgtactagatcctcatgcatgtgacttatttattttataacagttacagtattggtatgaaaccggattgcatatctgaaatgttgtgaaaagatttcatcttcatcatgattcgtaaaacaagagttcctcatgtctcatggtagtgtcttttgcaatttacatgttaatctttattcccattacttggagttaacattatttttagtacggatatttaattacctagtttatgttatttcctatttgggttctacagcttgaatttacaaaattttagagacaagtttcacttgatttggactttatttgaattacctatgagttttcaaattttaattcatatttctcttcacagaaataatctctcaagtcattttaaactaattttccgaaattacccttctgggagacgttagaatcactgacagcaggggtctacgggttaatattcctatttgaaattattttctctaaggaaaagggcatgtggtattgacatgtggggccggggttatagttgaccatgccatggtggccatagagaccacacgtcagtgacaccatatcttaaacaagattttaatcagtttcttccacgggtatgggcccacatgtcatcgactgattagagagggattcgaggagggcttattgttgtggattagggaaggtgggaccggggtagcgctactggagaaaccatctttggtcggttggccaaatttcacaatagtccgggttgtattaaacaccgggactaaagagcatttttagtcccggttcaaaagagggcaggtagtggacccctatattttctttagtttcggttgtccaaccgggactaaatatctatttgggttgtttcttttttttttgaaaatttgttattcggatctgagatgtatttgatttgtgtgtgatgtgaatacgtgatatatttgtgatgaattttgtagaacatgtgatgtaatttttttaagattttgtgatgtatttggagatgatcgatttgaggatttggaggtgataattgatttgagattttacgattcggggatgattgatttgggattcggggatggggtgaaatcaatatattaaaaacaatgaagaaaagaaaaaaaataaaggagcaaccagatctagcccggctccatctttaatcccggttggtggtaccaaccgggactaaaagggctccatctttagtcccggttggtgttaaaaatgaatttttactcctggttatttcaccctggactaaagatagcaatctttagtcccggattcatagtctcggttggaaaaccggaactacagggggttaccaaccgggagtaaaaaccacttctccatcagtgtaggcccacatgtcggtccaaggaaacgcaaaattttatcccctttctcttctttcattccagcgggcgatcgcgatggcaaagcgacctatagtagtgatgattctccagcggattggaggaggtgaggtggccggcgctgggagtgctcaccatgcagcggccgcatagcggaggaaccgggctcggggaagaagtggtagcatctggctccagcgtcaggcggcgccttctcctccaagaagagaaaaaccaagtagctagatttgtttgcaaaaattgtatttaatttgcgtttatgcatgaattatggaagtattatgtaagctactctatgtgtaatgtgtttgaatagttatgatatgaactttattgatgtgcggaatatatcatgtgcacacaagatttacacattgtgcataccaactaacaaatgtcacaataaaacttagaaaataatattgtactatgtacttacaataatattacacttatgtgtaatgttttcacccccaaattcattatattttacccataacgaaaaagaaaaaattctgacagttttgaagtacaaatatgtcataatttgatattttttgtctctccctatacaattaatttaaagatgatactttacacggaattgtgtaaattgcacccacgatacaacaacttggcaggtgggtgcgatatagtgcaagaacttgagaattgaacgtccgagtgcaacaacttgataagtatgtgtgttctagtataagaacttgacaatttagtattttggtgcatcaacttggctaagcatatgctatgtgagtttttttcacgatgtaaatatgccattacacagtattcctacagatattaccttataatattgaatttaatctttaagaattatactgcacacacaatttacatccaattacctttaagatttttttattttcttcaccttctcaaatatcaaccgaaatataataatttctacatccagtttaattgactttaagttattagtaattaggataaaaaaatataaatatgcttatacaaatccgcgctagtatattgtcaaaataagtacttaaaaaattgaatttatataaaaaaatgctccaaataattaagttgtcatgtactttcttaatttattgtatcaaaatcgtacctaccttacaggttgttgcatttatactaaattgcaccttcctgccaagttgttgtactagaacgctcatttctcaatttattgtaccaaattgcacccacctgctaagttgttgcaccgtgggtgcaatttactcttgtaataatattaatagaaaaattttaaatattttttggttggtatgtgcagtgtgtacacaaaaagacttgtgtgtgttagtatgtggatgtggatgttgtatgtggaatttttgtgatggtatgatttgtatgggaaattggtaggtcctgtaatttttttttcttgccagcatcttggtgcaggtttttattttttcaaaggaaggtgcgggttttaattacaaaccggcacgtatattctttgccacgtgtgtaggtcagtcaacaacctgcacctatatgctatttatgtacaggtgccggttgttttaaagaaccggcatctatatggatagcaacgtggcacgttagtttagaaccgacacctataatgccatatatgtgttagttcttacctaaaatccaacacctatatgtcttataggtgcctgttctacatccatattctaaactatagctggttcccaaccaaagtcatcagtgtgctaggtactggttgagaaatctggctcctatgactagttcccaagcaacacctaacatgttttctctagtattgtggtttgatttgattgactaatgttataattgcttgctatttaatcagtcactgaacctaatcagcaacagaaaaatcttcattcggctaattgctcaattaataaccgagttaaaccaactagccagtcgctcgtgcggtgcgactggatcaagtatacgactttgggttatttgccgtagctcaactccattaacttggaagaaaacggggagaaaataaaaccacttttaaggataatggttggggcatgtactgcaattttagggtcaacataccccactaccaatgttttctatcattacatagtgagagttaagattgtattcaaggtggcacaacggtctagtaatgtatttttgaagaatatggctaatgcaatgttagagaaatttgataaatattgggacagcacaaacaatatcatggttattgctacagtccttgatcaaaatgagatacattaaattgttcttcggaaaaaattatgactgcataagagctagcatacagcttgatgccatcactggtgagttggataagctatgaaagacattcgagaagatctatcgccagaaagtaggtgacaataacccacacgatgctcattcagcctcatcttggaaggatgcatgcaactctttggcttctattgttccaagtggattccagtcctctttgcaatctaatgctactgaatcttcaaagtatgaataactcatctatgttgatgaagcaactgtgcccatagataataatgcattcaacttacttggttattggaaggtaaatgctcataggtctcctgttttgtcgagtatggcaacgaatttcttttttttggctattcaagctagcagtgttttatcacagttcacttttagcactggacgtagagttatcgatgactatatgagttcaggcattggtttgtgctcaagttggataagagaccctcaaaatgagaatagttatccaaatacttgtggtttgtgtcgacgggtgatacccgtagaccggatatagagggtattggggtacgctggtacaaggatctacgtagtacgacatcgagcaatcaaaagacaagaattttactggttcaggccccttgataggtaatagccttaatccagttgacatgggattatatggtggaaaacacaggttacaaaggaaaagatggaactcggggggtttggcgagattgtagtcgagttgattcgactagctctcgtcgacttggctcctcgcaggctccggcttcgtaggctgtgtgggttgtgttggctctgagattcgatgatccatggcctccccggggggttccttttatatcgcaggtctgatgctctccgagtaggactcgaatatactagacctggcacgacacgtaggtaacccaattcttgtccgagaaggactctcctcatcaatcgatttcacgaaaggtttcctttaatcacaaaggaaatatccacgtacgcatagatatgccatgtcgttacgtgacgtacaccgaagggtagagggtatgcctgacccgtaaccctgacagtagcccccgacttctgctcaacaatgaactcgtacgaccattcgcgacttcaggtgtcgagaacgttgtcattccaggtgcgagaaccacggagatgatgtgtagtcgagcataccatttgaacccaacggtcacgagtgaattttgaactgaagtcaaaaaactgccacacgtaacggacctagaaatttccagcggggatttctctccgttccttggaattcgcaccatcgggagtgcggttatttaaagggattttgggtgcgcgttttgaagtccgcccactttgtcaagcacacactgctcattaacgctcctcgccttcttcgctgtcgcaaaaaaccctagcttcgtcagttttcgttcatctccggcgatcttccagcgacgatggatcttggcaagtcggcttccaccagcgcaaccctgaagaagctccaagaggatggcgcccttcctggccgtgaaaaggcagagagggaagcaggaggtactaatccacagcccctcttaggtcgcatggttgcgatcgaagactatgttgtctgcgggtttcttcctcccccctctgaattccttctgctagtctttaatttctatgggctttcacttctgcacttgaaccccaactccattgctttccttagtgtctttgtgcatctttatgaggcctacattggggtagagccctttcttgacctgttccgcttctactacgagttgcgctggatggaatccaatagggtgtctggatgcgtcgggttccgacttcgtgacggaatgaagtcgcggtatgtccccttccagtgtccctcttctcgcagtaaatggcggaacaggtggttttatcttgaggtcaaggattcggatccagtccttgttgttcccgaggagcaaccggacaaaattccggtttggaccgccaagccccctttgaccccctctctcgaatcgtttatcgacatcatcgatgatctccgagaacggggcttatcgggatatgaagtcgttgcagacttcgtcgggaggcgaatccagccgctccaggctcgggcccacccggcttataactattccggggcagatgacgcgacccgggtttctcctcggggtatccttctcgcattcattttgatatgcttgtactcacattccttttcgacttatcaaaaattgattctttcttgacaggtctgagcggcgaagtcgtgggacggcgcgtgagtcaagtaatgatcagcggcccgacaacagcgagcgacatccccgcgcccctttgtgaaagggaagcagcggagcgcgacgaggcaatcaatgtgagttcatttgataagcgtccgcctcccttgcacaaaatcggcttatgacatgatttagcgtaggcccttcctttgactgatgtcatcggtccgctcgcggatcatcaggtggcggcgtctctgaaggagaaggtcatccaggaggcgtccgatgctgccaccactagtggtggcaaagctccgactaagacgaggaaattctcatctgtactcggaaatcgccgcaaggcagaaactcccttggtaatttcctccttgtcattaggttgtgtagcgaggaaagtttgttctcactctttatcggttgtcttgtaggcttccgacgtgtctcctccgcccgcgcgacgtcagcgtattgtgacgatccgcgagaagtaagtgaagaatttttagactctcatatcttctgtttgagcggagttttgattcatggcggttaacagggaggcgcggtcgaaagctgctcggggcaagtctggggaaacgtccggcgcgtcccctgtcacggcgtcaacagatgttgtgcccgtggtcgggagtcgggaggcgacaccgaacggccccgtgggagatcccgtcgagggctgcggtctgtcagaggccgtcctcacctgggaggagcgccacgtcgagatgaggcgccttctcaaagccggtgcttgcggcgtggggcgcgaggtctcggaggcgagggcggagacggcggcggccaatgcgcgtgcggagctcttggtgcgggaactggctgaagcccgcgaggacctcacgaagatgagggagctggtggccggcaacgagcgccagcgcaaagggctcgaggaccgcatgtcggaactcggggataacctctccgagatccgtggttcgctgcgggtcacctacaccggtctccaccaacttgctgaggagtgcggcgtcaagtcctcgatcccggcgaaccccgacgagttctcgttgacctcttctcttgcggagctggcgacggcgatgggggaaatcccctccaggcacgtggccaggatcgcggaggagacgtccaacggtatctataccggggcgtgtcacgtcctcgcatgcgtgaagttgtcgtgtcctgaactcgatctgcgcgagatcttggatcagggagcggcaagcgacgcgcgcaaggaggtgatggaggaagtcggtgacctgggggagtatgtcctccccctttttgaagagtaggatctcttgtatattttttttctgacttgtaaatcttaaactctggttgccttcgtgcgcatgattaccatctttgttcaccgttgatctcggaaatctctcttatcgactgtagagatgctgatgacgaggatgtccggcaacgtgggcagcctgagtcactggcgataattccggtactcgagtttgaactgcacgcctcacatgacgtcgaggaccaaactcctgatgcggaggttgaagtgacgacaactgcctcaagtgagtagcctatcaaccttatcgttgttttgggggtttccgggttgtcttagtggtcgttacgtttagcagatctcgaggatgcccttgcgacccaaaatcgtcgtatccaatactggaagacgaaatttgaagtggcggaactcgagagagcaatgctagccgtaaagaatgagaaagctgtggaaacgctccgaggccgcgaggtgtggttctcgtcttacttgcagagttgctgcaccacgatggctagggtgtgccgggagttcgggtagtccgcggtgatcctaaggaatcgccggccgggtacatctcgtggctcaacggggcctgtgcccaactcaatggcattggcaagcgaatcgacgaggccttgaagcaagagtgtcgtcgagcgagccgatatgccggaggacacatgctggcttgcctgcgagatcaccgcccgcgcttggatctcgaatttttacgtgaaggttttttacattctcggaggaacccggcggagatagatcaccttgcgaggtcgatgtcgccgttggccgagaagattttccaatcaatggactggcgttggccgtcttggtaatgtttgtatcctgcgaccaaatattttaggggaagatgtaatgcagcgaaatatctatgtataaactgtaaggaatgttttgtgaataaagaaattaatctttaacaaatgttttcttactctggatgttgtgcataagagtgtgttctcagttaacgactttggttagccgtttgagtcgtacactctccctagcccccagccttgtcgtcggagggatttcctcaggtggcaaggctcttagacccttggcatgtcttggttgaataagctctgatcctagcccccagtcgtgaaggtggaaagctcggttttcgattacacggcttggttaatacgcacggcgagaactcttacacgaccagatctgacatggtcttttgtctctgaaggatctgataaggccttatcggctctgggcgtccctagccgaagatcccttaggttcctcggaggccttgtcgagacggcgtaaagggacataaggacaggtttcaacgctaggtgtcgtcagagtaaggggtcattgggtgaaaacactttggtcgtcatatgagaccaaggaataggctttattgatactgtaagggtgcttacaggtatagcggtattgactcatacatagaatttacgtagttggtcaatgttccacgaatttgctagttcgcgaccgtcgccgtcggcgattttgaatgcgcctggccgcaagacttgtgtgatcgtgttgggtccttcccattttggtgagagtttgtttcgccccgcttgagtttgaactcgcctgaggacatagtcgccgatcgaaagtatgcgtgctcggatgcgcttctcatgataacggcggagggcttgttgatagctagctgctcggacggcaactcgctcacgatgctcctcgagaaggtttacatcgatatctcgctgattctcctggttctcgtcggaatgcttctgtactcgtgtgctttgatgccgtaactcgtcggggagcatggcttcagaaccgtacacgaggaagaagggtgtttccttattggacgttgtcggtgtagtgcgcacggcccatagtactgatgggagttcttcaacccattttttgtcgtgtgacatgagtctgtcgtagacgcgggttttaatcccttgtagtactatgccgttcgccctttcggcttgtccattgctttgagggtgagagaccgaggcgaaacatattttgactcccaagccgatgcagtaatcctggaaatcggcgctgatgaattgagagccgttgtcggttatgatgcggtgcggtagtccgtatctgcaaaatatccctctgacgaacttgatggcgttatcggccttgatttccccggtgggtactgcttcgatccacttggtgaacttgttgatcgccacaaataggaatctgtagccgccctgtcctcgtgggaatggaccaagtatgtctagcccccagcatgagaacggccaagtcagagggatagtctggagcgcttgtgcaggcagctttttgtgcttgctgtggaattgacaggcttcacatcgctggaccatgtcgcatgcatctttaagggctgttggccagaagaacccttgtcgaaaggctttgccgaccaatgttcgaccggcggcatgtgacccgcatatgccttcatgtatgtcgaggaggagttgtttgccgtcgtcggtagagacgcatttgagaaatatcccatttggcgctttttttgtataaatcgttgccgatcatacagtaaatctttgctttgcgggttattttctcagcctctgtatcgtcttcgggtaactcctcgctgccgatgaatttgattaatgggctgcgccagtcgtctgtagtttcgatgtcagcaacttcgcattctgcctcagtgacctctgagctgatgtcgggggtgctcgggccaacttcgccgctaacttctttcaccgatggctttgtcagaacgtcgagaaaagtgccgggctcgagcggctctcgtctggatgcgcgtcgtgctaggtcatctggctcgacgttgtccttgcggtagacgtgccgaacctcgatcccatcgaacctcctctctagctttctgacttctgagagatacttggataactcggggttggagcatttgtagtctttgtgcacctggtttgcgactagctcagagtcccctttgatgattagtcgcttggccccaagtgcggctgcagctcgtatcccggcgagtagtccttcgtattctgcagtgttattggttgccctgaagttgaggtggatcgcgtgtttgaattgatctccagaaggagatgttaagataaatcctgcccctgctccttggctgttgagtgcgccatcgaacgccattgtccatgtctcattttcgccttggctgtctgacttgttatctggtatggtccaatcggccacgaagtcggcaagcacatgagatttgatggctgtttgcggcacaaagtggatatcaaattggcttagctcgactacccattttgcgatgcggccgacaacgtctttgtttctcacaacttcgccgagtgggaaggaggagacaactgtgactctgtgggcttgaaagtagtggcgtagcttccttgatgtcatgattactgcgtagagcagtttttgaatctatggatatcttgtctttgcgtcatggagagcttcgctgacgtaataaactggtcgctgcactttctctctctcaacgacaatgacggtgctaacggaatatggcgtagcggcaatataaaggaataattcttcattaggttggggagcaacgagtacagggggttttgataggtagcgcttgagtgcaataaatgcctcctcagcttcctgtgtccatacgaatttgtcttgtttcttcagcaaggcgaagaaaggctgtcctcgttctcccatcctggcgacgaatctgcttaatgctgccatacatccggttagcttctgtacctccttaagtcttgtgggcgacttcatgttctcaattgctttgatcttctcgggattcgcctctattcctctgccagaaacgaggaatccgagtaacttgcccgacggtactccgaacgtgcacttctctgggttgagcatgaggcgatatcgtcgggggttgtcgaacgtttcccgcaggtcatcgatcaatgagtcgcttgtcttggttttgacaacgatatcgtcgacataagcctcgacattgttgccaagctggttgctaagtgcgccctggaccgtgcgctggaaggtattcccggcggttatcagtccgaaaggcatcttaacgtaacaaaataccccgaatggcgtgatgaacactgttttctcctcgtcctctttcaccatactgatttggtggtaaccggagtaagcgtcgaggaagcttaaaagctcgcatccggctgttgaatccaccaactggtctattcaagggagaggaaagtgatccttggggcaggccttgttgaggtctgtgaagtcgacacacattctccattttccgttggccttccgcaccatgactgggttggctagccactctggatgaagtacttctctgatgaagccggctttgagaagtttgtcgagctcttctcgtatggcttgttttcaatctggtgcaaatctccgcagtctttgctttactggcttggcatcaggtcgcaccattagtttgtgctcaatcacctccctggggacccccggcatgtcggacggctgccaagcgaacacatcggcattatcgcggaggaaggtgatgagcgcgagttcctatttctcatctagtgtagccccgattttgacagtcttgtcggggttagcaatagagagtggaacgatcttgatggcgccgtctggcttcggcgtcttgtttagcttgctcactttcttgggtggctcagacgtggcgggtggggtgggcatttgctcgaccatgtcgaggctccgcttgtcgcactgcaccgccagttttgcgttcccttgaatagtgattgttcccttcggtcccggtatcttgagcacttgatatgcgtagtgggatgcggccatgaacttcgcaagtgcagttctcccgatgatggcgctgtaagctgtatcgaattcagcgacatcgaaggtgatctactctgttcagaagttgttggcttggccgaaggtcacaggcaacgtaatcttgcccaaaggtctggacgatgattgcggagtaattccatggaagggctgagtggttggtgtcaactcactctgcggaactcccattgcatccagagtgctggcaaagaggaggttgatcgagctgcctccgttgatgagaacccttgctaccttgacgttccgaatggtgggtttgaccacgatcggataccgtcctgggataacagaggtctttgggtggtcttctgccgagaactctattctctgctcagaccacttcatcttgggtgcagccccctgccaagtcgaacagacttcgcgttccactttcttgtattctcacttggaggaatacgttgtggagccaccgaagatgtgtgagacatggaggtcggagtctgggtacgcagaatctgattcgtgaggaggtgactcctcgttcttctcgacaacacgtacccgcttgcctttttcaaacgccatgtgcttctcgagcgactttttaaaaacaaggcaatcctccagagaatgtctgtccgttttgtgtatagggcaccatgatttttttgtatcgctgccttgtgggtctgggcgcttgggagggttcgcgtactctgctgcgaggacttccgcttgagcttttctcttcccgtttttgtgatttttcttcttgcttgactcagatgcgtctgcggttggtttcttctctcccccggtcttcggcttgtcgttcttgcgtcttagcgcgtcatccacgtgggcgcaccgctcaacgatctcgaataacctttgagtagttgtgatgcgtcttgttgccaacacctgggtagtgtagtgatctctgacaccggacttgaaggcgcaaattacagaagcatcggtaatctcgggaattgtgtttctgcactcgttgaagcgtcgaacgtatcccctcaatgattcccccgagttatgtgttaacgcgtgtaagtcgtcttcgatcgcgtggcgcttgtttgttccttggaaattggcgacgaactgttgccataggtctgaccacgaagagattgagtaggaggggagatgcatcagccacgaacgtgcagaacccttccacgcggttggtaaatagttcgccaacgcattgtcatctgctccggcagcataaagcactgtcgagtagacttgaaggaattcttctgggtcggtgctcccatcatacttttcaatagctccgggtcggaatctctcaggccatcggacatcacgtagggaacgacttaaagccctacacccagcactgggagcggtgggttgtcggtggtcgcgtgaccttctggatgtctgtctgacgatgaagaggacgcggatgatgatgatgatgacgatgggtcgcttggttccggcgtacgattacgaggatgacgacctggatctcgggaatcctgtcgtcgtctctcgctgttgtcttgtcacatcttgatttttgtttcaggatttataaattatttaataaattaataatataatttatattaaatgttctttaatttacaagtgaagttaaatgtgggaaataaaatttcttaaatctaaagcatggatggatttaatttttattaaattctccatgattaagtcaactctctgaaatattctcggatttttcggagctcaattcctaaatgatacaaagaacagttcagtaattatttgatcattaatgatctaatgatatttgttaagagcttttcttgtttaaaatccttaaattataaattgttgtttaaaaggaataattagaaaagatcttaaaagcctaaaagagaagatctaattttaatttgctaaatctcaacataaaattgggctagataaaatttcattaaatactttgcttaattctataattcctagatttttctgggatttatttgagctaaggaagtatttttaataaatggaattgcatttcatgaataatttaaattgaaaaaggtttttaaaagtcttcttttggctttgggccgaaagtcggcccaaaaccgctccctcttctcctcggcccagtccggcccagtccgatgagccgccgctcttctctctcggtgtcgctgacaggcgggacccacctgtcagggtcgtcgtcctcctcgcgccgccggcgccgcccgaaaccctagcgcaagccgccgccgtctccttccaaattcggccgatcctttccttctccggccgaatcttttgaggggaaatgatctcctcgatctcctcttccttttctcttatagaaactccggtcaatttcgtttggaaatcgacggacttgagttcgattcggatcgatctctctcctccgaacccttgctttcctccgccgtcgctgaagaccgccggagcaccgtcgccgccgtcgacccgatcttctccggcgctttttcctcgtcgccggcgccgtccgttgcttctccgccgcttctttggtcaccggtgagttcgccgcgtcgcgctctacgtcctggtgctcttcgtttgcgccgccgcgccgtcgttcaccggcgagcatgcgttgccgagccaccgccggtgctgacgtcatcgctgacgtcgttgctgacgtcatcgtcgccgtctgccgtgagccggtcgtggaccaatcgatctcggccgtccgttttggatagggtcgatctcggccgttcgtttccgtgagccgccgccgtgcgcccagttcaccgtgaacccgacccgctgacgcaataatcctcttttccttttcaaaaataattcattattgcgtcataattccattaaaatccatataagtgttttaatccgatttaatctttgaaaattcataactaattcactgtaactcagtttaatgtggttcaagttgcaaaaaattatataaaataaagatctacatattaaaattgtccataaattgaattaaatttatttaattctttttaaatgggctttaattagatttaatcttgtaaaattcgtaataaattcatatgaagtcagaatgaggccgttcaagtctcataattcatctaaaattatgatctacatgtttgtttacttttcatgtattgtttatttggtttttattagtctttttcttcgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggcctgtttacattgattactttattccttgataccttgggtgattataacttgactagttgagctatatatattggttcagctagatattagatatgattgcttagccatgcttagaaacattagcacactattgggataacttatgactcattatttaaggatggtttaatggtagctcatgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttaccttttgtataacatggttcattgcggagcaccagactgagaagtggcggagataagcccacgggggtcgctggggagtccatgcctctggtttttgagggggtgattatgatccaggaatggtgcgctgcggtggattgtgttatgcaaggggtactgtcacagcccctttccgaggtaccgtggtggtactgaggcacatggtgacatgatgtggggctgtgtcttgtgggtacagtggtacacctctggccagagtaaaactattcgaatagccgtgcccgcggttatgggcgagttgagcaatgtttttcgtgattagtcccacacctctcacaataattatagatgttatacctggtaataatttgcttagctcctggtttggagattagatctgtacagccaggtatggttgcttcagaatggttgggcctgagcagcatgggcgtgttgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagaataaagatcccgaaggagaagacgtttggcttataccccagttgagctgcctgtgggagtggagccggagcttcgctagattttattttccgctgcagttttcttcttggtgaggactaagtgcctcataagtaagtatttatcattttagttaatttgatgaatctgcatactaaattgtcagtttgtgtacctcggctgattcctggacgaggattatatgcacaaataagttcggaaattactagtgaatttctgggcgtgacatgtctcgacgccgatctccttcatcgtcgtcgttgcggcgacggccatgaccagtgttgtctggcccccgccggtcgcgatcgtcgtagtctcggtcctcgtttggacgatttcctcgatcatggcgtcgtgaggagacatgacgccgggaacggtttgcgtcatcccgtgtgcgtcgtgcttctcggcgaccgttgatttgatctcgaagatcgccagtgccacgaggtggaggggtagcttgttggggtgattccctccgttccggattttcaccattggcgtcgccgactggcgatcgattttgttgtgctgcggtggcggcttcttcgaacgcattgctaaggtcagtcaccgatgcccgtaatcgttccgtccaacgctcgaggtcgttgttcagaacgggatcgtaaggtgtttccctcagtatggcttgaacaaccctgatgtgctgggctggagtagtcgattgattcgccgtctccgcattggcttgtgctgacgtgccaacttcatcgatagccaataccttccgcgccgcgcctgacgtcgatgacccatagtcttcgaggagatgtaagacagatggttcgtggggatcgagatcgattaccccaacgaatcgatctgaggccggagtcgctccttgttccttgccgttatccctgacggggacgtatgacttaggagacggagttttcatggcgccgaggagaactttgcagcttgagaggtcgtgattctttgtcttatggataggacaatagtcgtcccgagttggagaagtacgctgaattccacgttctttgcaggcgcgaatttcagcacggacattgatgaatacccagcaatcttgaaaggtatgtttcttggttttgtggataggacaccaagacctggtagcttcggaagttatccttatcggcccgcgattcatgtcagaaggacaaagcttggccacatcagaatccttcacgagtttggacgtagtcggcaatccgttctccgtttcaacgggtggatttttcgacatggaggcgtcttggttcgtagccacggcgttctcgtttccagtcattggaggaccggttgagatcggcatcgtggtgtaaaccgggtagacgatttcgccgacttgagtccataccagcattgttgaagtaggaaaaacttggctgaagctggtgttggcgttgttgtcgacgatatgggattatatggtggaaaacacaggttacaaaggaaaagatggaactcggggggtttggcgagattgtagtcgagttgattcgactagctctcgtcgatttggctcctcgcaggctccggcttcgtaggctgtgtgggttgtgttggctctgagattcgatgatccatggcctccccagggggtcccttttatatcgcaggtctgatgctctccgagtaggactcgaatatactagacctggcacgacacgtaggtaacccaattcttgtccgagaaggactctcctcatcaatcgatttcacgaaaggtttcctttaatcacaaaggaaatatccgcgtacgcatagatataccatgtcgttacgtgacgtacaccgaagggtagtgggtatgcctgacccgtaaccctgacagtatgtattgctcatttggattgttttcgaatcagttttgtttttcttatgcatttgtatttgtgtacttgtatttagtgcaccaatgctaattattaaactcttttttcaaggggaagatgatgaagatgacactgagtttgtggagtttccacatggtgtggtggcgagcaacttgtaattctttgatggtcttgatgttgaggaggatggtgttgccttgatgctgcttgatagaagaaaggagaattgcttgcgtattttggtgctgatgttggcaatttggcacgaacttttgtgattctgtgaattgtgatggtttgatggacatgaaggactggattgtaatagtaatatttaatctaagctagttgcattgcatggcatagtagcatttttgcatatttgcacggacgatatggacatgttactatcatattatgtcaactatggagtatggatagatggacttatccgttgaagttttccccgttgcatatttgcatggatgatggattgatggacatgtaaataatcatgatcttcatcccctaacttgctggacatgcaatatgggcacgaatgttgatatggctcgtgacctaaaagccagcttgaactggctgtcgagctgagccgagccagcctcctagcacgttactataacgagacgagctgagccaactcggtatgctaacgagctagctaggctgagcccaaccgagctgagctggcttaatattcaccccctagctatgtaccacataatccgcgtgcttattattaggaatgaagagcgtcaataaaatcccaaatttacaaattcatagatggacttattacaaattccatgattggctccatgcatgcatggctctcttgtggagcaattttgttttcttgtttcattattccttctatgttcgcaacacaattacaataatttgaacactattagcagtaaaagggccactcacatttatttcgcagtcgaaaatgttgatggaaatttcttgacacatcaataattttatagtaagtaatacttcatatttaaaataccttctttctagctatatgcacctagactagcccaagtgcttagctagctagaaagatgatattttagagaccgagggagtactagcacaaactgcattgtcaatccaatgagagtactactaaaaattttgttactagaaatctctgatcacattgttaaatgcttttcactttttcagacaggtaattggattttaagaaaatcttttgagcgttgtatgatttcgtttgctactatgttctgtgttattaaattgtccgtacatttttgtttggagtcctttcctgtgttctaccaagggaagtacttctaagtctttgaatttttcatattctgaatggctgcagactatggaacacaaactagctaacccaccccatgtgtggatagaaaaaattgaagtaatagtttcagggtatatgatccttttccattgttcataaaaataattatgattttattcagtatcctattatacgtctttgtatcattaaatgattatgttggatgatacactactggagaaacccacaatagtcttggtttgcaaccccctttagtcccgggttacaaatcgagactaaagatgtcgatctttagtccctgttgttcctgttgaaataaccgggactaaagatttatctttagttccggttggttttttccattgtttgcatattgatttcgaaccaaactcaacaataaaatcattcacattcacataaacatcacaaaatcatcaacaaattcacaaatcgaatgaacatactcaaattgacatcacaaattcacaattcgcatcacaaatttacaaatccaaagacatcacaaatcaacaaattcagagataaatcaacaaataaataaataaatcatccactcgtcgacgccagagctaatgccgcgcgggctgctgccgcccccgcgcaggccgccttcgctcgctcctcgctactcccgcaaggataagagagaggaaagagaaagagaggagagagaggaggaaattaaagatgaggaaaagggaggaggagtggaggagaggataagtgtggaggagaggatatacagggggacccataggttcccggtatgcactggcatacccataagtttgaaaattttgctaggatcagctctgcaccaggaagtcaggaactatgcaggtgtatgcagtatgcagtaggctgcttgctcaatgctcctactgtactactagtagacttcctttctctctctcaatgcacgagctccaaagcaagcaagctagctagtactgtagtacgtacttcagctgtcagctactcagctgtcaagctactcagctgccaagctactcctgccaatgctttgatttggtttgaccttttatatatatctattgttaggttaatctactgtttgtattattctcctaaccatctattgcatcaagtctcgtagtactactttactaacagatttgaatcatctccaattcaccaattgtagcttaattttgaatatattaattgactttgagaaatcgacatcctaattgttttaaagaagattttgcatgatttgaatttagagtttagatagaatcaatatattgacattgttatcaattgaaaagatcgttttgatgaagaaaccaattaaattagttggttgtaatttctattttcattcaatacatatgagatgatggtttaatttctatagtaactttgcatgtataatttgatattgggattgcctttatttgtatcatgtaacttagatttccaattctacttatattattgtatgagagatatgtatatatgtattagtgcatacccagtgtagcttttctgggtccgccactgattatatataaagcaacaaaagatagtaggggccagatgctttttaaaccgagactgttggtattaaagatcataaagtggcgttgggcttttcaaccagatgctattggaaccggtactaatgtgatttttggccgatccacgaaagattagttctctagtagtgatagtgttgagtgtgattttgtataatgggacgatgcatacggttatctgtttacattgcttgatgaactattgaacttaagagcatttttatttgcaaagagtgacgtggactccatgtgcatagacagcatagtgacttggtataaggaagcaaaacgaactcctgaatataacaacacaaactggactgataacgaactgtatctgaccaacctgacagcagcctcgccatcaatccattagtggaaactagtggtctcactcacaaagatgcttggccgtgcataaacagcctatcagcaaacacataagttgaaacattgtgcttttttagtttttgaaggattgcggaccacaagtaatggatattagtgacatttccaatgtactgcactaacatgtcactcaagttaaaccagccaatggctgaaggtataggtggacgtatatttcatttgctgcaattcacaggacatacccaagttgttaggaagcaataataccgttgttggtactgtgtgtaaggctgagttgttttgagcaattcaaagtttcgttagcacatttttcaaactgttaacggatgtgttttatgaaaactcttatatattaagaaaataaaatagatctattttttatgtttaaaatatttaatagttcattagtcaccactaatgatctttctcgttttcggtgccatagaaaatctaaccggggttgctcaaaccggagtttaaaattttatgataaatataatactccctccgtcccaaaataagtgcagttttgcactattcatctccaacgtttgactgttcgtcttatttgaaatttttttataattattatttttattattattagatgataaaatatgaatagtactttatgtgtggctaatttttttaaaaaaaattataaatttttcaaataagacggacggtcaaacgttggacacgtatttccacggctgcaattattttgggacggaggtagtacatgtttaactaagtgcagcttatggagtctcgaattgaggaaactagtgcgcttgcttgtattcggtggccagtttaacttgagtgacagcattgttaaatcaggatatatgcactgcttaccaaggaaaatgaccttcaccaagtaagtcaaatcgccactcattagaacgttgtagaagaccatgcatatgggcagagcactacctgcttggatcacaagctttcctcggaagggtcgtatagttcatcaagcaattcgaaactggaattaattaggaaccacgtttcaggttcgtggaacacgttctatatgaagtaacaaaactaaaattctgtttggttgaacgagctagaatgtagagaattaacttgaggcttcacgttgttatgtgtatgtggtttttttttctattccattgtaataaatactccctccgtttacaaatataatagaatttaggccgtgtttagttcatgtgccaaaatatttttttaaatatacggacacacatttgaagtattaaacatagactaataacaaaacaaattacagattccgtatgtaaactgcgagacgaatttattaagcctaattaatctgtcattaccaaatgtttactatagcatcataatgtcaaatcatggtgaaattaggctcaaaaaattcgtctcgcaattttcatgcaaactgtgcaattgttttttttcgtccacatttaatgctccatatatgtgtccaaatatttgatatgatggaatttatggaagtttgaagggaactaaacactgtcttagtgccattccatttatccaccaatacgaaggattttaaaagcccaaggagaaaactatactccctctatcccattttaagcgtaaccttgagtttccatgtctaattttgatcgtctatcttatttgaaatattttatgactagtatttttattgatgttagatgacaaaacatgaataatactttatgcgtgacttatatttttgtttttttaatttttagaaaagtttttaaataagacggacgattaaagttggacacgaaaactcatggctgcgtttaaaatgagatggagggagacattgcctcgggcgtccaatgaatcgttcaacgtgtcacttgtcagtgctacctaaatttgtactaaaagtggcaaaattccgtatgtttgtgaataatatgaaatgatttgtgttaaaatatagtataatggattattttgctgcctgaaaaataaattacatccttttaaaggtgggacaatcattgttcatacttttggaagctccaccattacatacatagtttccgtcgttttcacgtcctaccaacattgaacaaagcacgattgactggcatactcaatttgaccatattgttttgaaaacttgcgtattattttactagggggcatattgcataagccccactaggtagggttcttgtatttgtcaatctgccagtacatctcgtctaattgttgttataccactagggttcttgtttcatccatacgttgctagaatgccattggatcaaaaacagtaacactggaagatatactgagggacaagaaaggagagagtgccggaaatcaattgagaaaaaggggttgtatgatcgaatacaagaaacaaacttagcatagaaggtgaacggtagtaacacaaaaaaactattttttttaataaaaagaacgctctaacttgatagagtgtgtcgttggttgaaccgctggaccaacactggttagatcgaatcctatccaccggtcggaccgctgtgacaccactggttagactacttgccttatgtcgctctgatcgtcggggtctagaaaaacacaaatctgatccgaatccgatccaactcgtagaatctgccagcctgactgttgagtagccctatcggagcgcaccaaacccactggtctaaccgaccacccaatgccaaccacactattcaatgtctgaaaacacttcaccatattttcacaaacaatcgcctttgacaatggttcatcaccgcgattaaatcatcacctgattctacggacactactatagaaatacacatagcgatatagtgccaaaaaatagttaaaaatggcacctatagtgctttccccacctccgcaggttgaaaacatacaaaaccggtacctttaagcaactatatgtgccttttttagagaaaaaccggcacctatcctatagctaccgtttaaaaaaaaggcacctataatatattatgggtatcaattaaataaaaaccaatgtgttggttttctaaaaagccggcaccatccttaaccgagctgaaccggacgagccaatcagagcccttctctctctctctctcctccccgcaactggcttaagcgacggtggcttctcccaaggaggatccaatggcgaaggcgtcaatgacgggcggggcggcgtcgtcagcgggcagggtgtcatcggcggggtctcccgcatgtatcgggcgtcgggacgaatgggcggcgtcgacgggtgttcccgtggcagatctggcttcggcgggctcttccgcagcggatccggcgtcaacgggtgttcccacatcgggtctgacgtcggtggggtctcccatggtggatccagcgtcggcgggggttctcgcggcggatccgtcggcggcggtagggggaacaacgttagcggttgtctacccctctttcttgttcatgtgagatattgttgttcttgttcatgtgagatttgtgttcttgttcatgtgagacattggtgccggcatcacttattagggccgcctacttggtgccaagttggaaactggcatctattagggtttcccaaccggcaccaagcccgattttttaccagtcagtggtaaaggctgggatcaaacccaggatcactgggttgtgtgatgcatgcactaaccatttaacaaacaagagaaacctagcttgatgaactactacatcgtacaaccttgaaaatatcttgggaattgacttgaatatcctcatgaacgttggtgcatctgccactattataggatgtaacttcaacgtaaagagaatgtaaaaaatgagtaaaaatcatatcttaattatttaccatcaattacaataatgtaaaaaaatgagtaaaaatcatatcttaattatttaccatcaatcacattaaaaattacactgcaaacaaaataatgtagccggcaacaggaaaacttgcatttttaggtgtcactttattaaaaagagatactaaaatggcaaccgtttttcttctactgaacagaccgctggttagtgagaggagattttgcgagagaagaaataatgttggtttttaagcttcgtggaacaaaaacatttagtagaagacatcgttggatgagaaacaccaaagacaacaggtcgagactcatatctcaatgtaaatcgaatgaccaaatattcgtgtcatttcatcaagtaaaagcattttgtaatagcaaaatctaaattaagaggctctcgttttagtgctaacgagaaaccataactagacacgttaactatagttctagtccatcaagcaagtagaaaatatattcctatcacctatgttgcaaataattttttttcttaaactactcatatgatctacgatccgattacatggttgtgttcgtaagaattaaatctttataacaagttctcacatgattatattttgatgaaaaattacaaattacttttataatatggttgtgtttagttcgtgtgccaattttttttacgtatacagacacacataataagtattaaacgtagattaataacaaaacaaataatagattccgcctgtaaactgcgagatgaatttattaatcataattaatccatcattagtaagtgtttactgtagcatcgcattgtcaaatcatggcgtaattagactcgaaagattcgtctcgcgatttacatgcaaactgtgcaatttgttttttttcgtctacatttaatactccatgcatgtgtccaacaaacatttgatgtgacgaaaaagatggaagtttgaaaaaataaataaatctaaacacggcctatatctaaattatttttagatttcactaaattacttgttatacatataaaagtaaattcaataaagtctaaaaataatttaagaagtaacttaaaacaaaaatgaagtaactttttcatgacattagaagtagattcgttatggaggtaaaaacatgagtctatctagaaattaaatttaatcaacacaaattatggaattggctaaaaatagtaataaaataaacagcgcacaacattatgaatatataagaagtaatttaataaaatcgaaaagtaatttatatatatgataaaagtaacttacatatataataaaagtaatttacaacaaagatatttcttttatcaaaatatagtcatgtaagatcttgttgtaaagatttaattacaacgaacacaatggtgtaatcggattatagatcagataggtaatttaaagaaaaatccataagaagaaaaaaaaaagacatgtatcatttggtgtactagtaggcaaccatgtatgagatgagtttctggttaagacaatatagcgtgcagtctctatgtaatcacgtccgtttttataacttgcttaacaggatctctatatcactacgtactcaaaaacagcaagtgcgcacttgtcgtacaaacttcaaatttatatcatcacgaacgcacgatgcaaagacaaagttgtcacgtcaattgtttcattttaggcaatggcattgccattttggaagtgcatagccgcaatccacgcctatataaaccccacaacacttgcagtatccagcaaacaaaccaagctaaacaatcacccacttctatagttagttaaagtagcaacacttaattatttgcaattaatctaattgcatatatatgatggcttacactaatctctccaagaaactagccgtagccttggtagcactggccgtcgcctgtgcccacgcactcgcggcgcgcgaacttgtcgacgcggccgccatggcgcaacggcacgagcggtggatggccaagcacggccgcgcatacgccgacgacgccgagaaggcgcggcggctggaggtgttcagggacaacgtggcgttcatcgagtcggtgaacgccgccgcgagccagcacaagttctggctggaggagaaccagttcgccgacctcaccaacgccgagttcagggccacgcggacggggctcaggccgtcgtcgtcgcgcggcaaccgcgccccgacgtcgttccggtacgccaacgtcagcaccggcgatctcccggcgagcgtcgactggcgcggcaagggcgccgtcaaccccgtcaaggaccaaggcgattgcggtaagcgtgcgtggtgttcgtcccattttgcgtgaggtggcgttcgccgccatggcgagctgagagcgttgtgctgcgtcgtgcgtgcgtgtgcagggtgttgctgggcgttctcggcggtggcggccatggagggagccgtgaagctggccacggggaagctggtgtcgctgtcggagcagcagctggtgtcgtgcgacgtcaagggcgaggaccagggctgcgagggcgggctcatggacgacgcgttcgacttcatcatcaagaacggcggcctcgccgcggagtccgactacccgtacacggcgagcgacgacaagtgcgccaccgccggcgccggcgccgccgccgcgaccatcaaggggtacgaggacgtgccggcgaacgacgaggcggcgctgctcaaggccgtggcgaaccagccggtgtcggtggccatcgacggcggcgaccggcacttccagttctacaagggcggcgtcctctccggcgccgccggctgcgccaccgagctggaccacgcgatcacggcggtcgggtacggcgtggcgagcgacgggaccaagtactggctgatgaagaactcgtggggcacgtcgtggggggaggacggctacgtcaggatggagaggggcgtcgccgacaaggagggcgtctgtggcctcgccatgatggcctcctacccgacggcgtgacaaccatcactctgaaatctgaacgagtgaatggcatgcagctagcaggttttaaataagcagtatggtattatggatggtgctctgtttctgaattcggatagtacaaaacagaactggaatgtaatgacaacttgtgcaagatcaaaatttcttgtcttcacaactggaatctatctattatctatctatctatctatctatctatctatctatctatctatctattatatactaaaagtccattaacttttctaaaatcgctctcaagctgacatgtaacatcctaaaagcgctctcaagctgccacgtggtgcgaggagaggagatgaggacccacaaaaaaacgaaatcctctcccacaacgtctgcatgtacgcatgcatgtggatgcttttcttccatgcttagcggcaggattaccaagtattcagggttttacattaataaggtttttttttctgttatttggatcggtatgtaggagtccaagttgggctttagtccgttcagctggctaggcctttgtgccacctatatatgccatgttccttgtattaggagattggtttttagttttcctctgtgttgtgccgccgccaccgcctaggtcaggaaggagatggcgattccatacgttttgccaccatcgttgctgcgttggttaatttggtcctaggcatgttctgatttctgacgaagtcttcttgctctgatcggctatcattcttgctgcatgggtggagtttatgtacaggtttcgttagtttattcattataaactgaatcatctatctgtttatatttgatgctactggagctattcagttcagtttatctggagtaaatgatcttatgtgcgaccctatatactttgctggacgagatctctatcttaatattgatgctgctcttgattcaactggagattagggtgtatatatatatattctcgttgcattagaaaggacacatttatcccataccaagttgtacactcaacatagttatgtttacatccaaattttaagagatcaaaaacatttcaagaacaattgatagaacatagacctccaatattcccaaagaaacagaaaggataactggaattcagacaaaatttgggctaaatttaaacaaattttgttgaatccaaagcccaatataaattgaagaaatcatttgaattttttttgcttaaagttctataactattcttaagaacacaaatttcttaaagtttagaactccaaaacgaagatttgatatgtattaaaaataacatatagtttagatgacaattcataggaaccaacttcatttttgcgacataatactttcctataattaaagattgtgttgcaaggataattagcattcaaaatattcacaaacaaaatattgacaaaaaaacaggttgccaatagaatcaggaacaatcacgcatatacaaacattatattcatatgtgtagagtaatatttcaagcacattaaattagatgcccgcgcatatgcgcgggcttcctttctagttatctaaacagataaataatcgcgctctttcaattaacgcgtagtcaaagctacatcatcacttgatggattatcattataaaaaaaaaagggctgctatataccggtatcccgttgggatgtcccaacggaatcgctccatgtccacctccctcagacgcgagagcgctccacgtccacctccctcagacgcgagagcgcaggccaccgtgggagcagcacagaggcggctaacgccggcggcgcggacgcggccggcgccgacgagctccggcgtggaggacgtggccgccggcgacgagctcccgcgtggaggacgcggccgccggcgagctctggcgtggggcatggtcgcatggacggcggaggatctgcgtggtgacagagacagtgccggcgaagagctccggcgtggggcgtggacggcggaggatcctgcgtggtgatggcggcggcgccggtcacgagctccggcgtggaggacgcggccaccgggtgaggcgtggacaacagacgcggctgccggtgacgagctcccgacagaggacgcggtcgccagcgcgcgagctccgatgtggaccatggacgggggaggatgcggctgccggcgatgaggttcgggttcagtacggagcgtggacgggggaggacgcggccgccggtgacgatgcctcgacacctcgatgcctagctcctggtatctagtaggtatcatatgaatacgatacctcacaagtatcaccccgatacgtcgtagaaatcgcacgataccttataggtatcacatgatacctcacaagtatcgtctgatacgtgataggaatcgtctgatacctgatacgtggtagaatcacatgatacctggtaggtatcacccgataccagctagttatcaggtgatacatgtagggtatcatacaattcttaccacgtagaagatgatagttgcgaggtatcaagtgatacttgagtaggatctcacggcttaggagctcagcctcgttcctatttggatgggaaatatggacgaagggtatcctgtcccgacggtataccggtatatagcatttccgaaaaaaaaaaaccttatggatgatggcatgatgcaatatttctgcattctgatacttgttcagattgcagtgcaataagccaataacaacttgtacaacaaaataaacaaagctcgttcagatttgtggttacaactggtcaaggatgcctcttcatgcagtacaagctgcatcaccacatgatagaggaccaaatcaatctggcatgctgaattaaccaaatgacaggattcacatttcgtagaagaacaaatcggaaaaatcacattacgtctattgacaattgacacgcatctctgtgcatgatcagtagagaaacagtgatgcagaacctgaaaatataacttgtagatacaaatggaatatgagaaggttatctctgactctcagaaatgagatcacaccttcacatcagcattaagccacgtacttatgtaacatcagtatcaagccttagctaaccaaagaagaggcatgaatccagaattccagatagagtagttcttactttttagttgttaggcagcaagcaaaatttacctctgtggaatggcacttgttggctagaataaacttgctactaaattaaagctaatcgtactacactactaatgagaccaaaaaccctgtccagtcttgagcacatgccaacaacaaaaaacaatgccttgcatgtggagatgtagatacacctatcctgcaaacataacactaacaactttcagagaaactgagcttggatggatcacatatgtaggcacctctggttcctagtacacaaaagggtcacggatagaataatctgatcctctctgaaagctccaaatcagaccaccttctgagtcatcgctcctatagacctgcattgaagagatcttactggcccatctcacagatttgaggatcttcgctgtccagagcgtatcaatggagtatgaagtgaattgtggattggccaacaccacagccacattcttcaccatctgcgcattctggacgaagtacttcaggaaggatatcgcgttggcctcccctttgaattcacggaatgtaagcacattgacatgggacacgatgctttcgattgggccagcatcatcccagaaattggggcttaccaagctggtggcttcagaacattttgcacactgcagaaatggttaaatcagtaaatgtttcagagttcagctagcaactaattgatcatgcagtagcacaagaaggcaatgaggcaggttcaattcataccacaacatgcagggactcagcattgggaaagcatttgaggaagttgggcagcatctgggcatcatgcctgactccaaaattcacattcaaccccaggatcttgacgctcgtgaacaatgcgcttgggctcgacctgatcccagcctgaaatccattaagatggaaatggattgttcagatattcaaatatcagaatttgggacatcagcaattcagaatcagagtgaacaaacaaactgaacagtaagaggttagagatgatggcaatggcatacgcacactgacaaaggtgtcatggatctccagcatgtggaatcctgtctccaagtttcccaacaagcgcagcctgggggcatggacgatcttgaccctgacgcaggagtcatccttgctcaaagaatcatagagcacgagccgctcgaggcatggcgcgtccaccacggcgagattctccacgcaacacgagcagatctgcacgcaacgaaggctccggtgctccaggcggaggcgcaacacctgcgtgttgcctccttggatgttgagggtctccagcacgggggatctcgccacgatgaactcgacctcgcggccctccttctccatggcgacggcgtagatgccgagctcgcgaaggttggggaaggcggtgttggtggggaggccggcaatgtcggggaacttccacatgccgatgtagaggcgggtgagggtggagatgcggaggatggcggcagggagagccgcctcgaacggccatgggcggttgacgaggatgaggtcgtcgacgcccttggcggcgaggaaccggagccagtgctcgagctgggcctggtacgatcccatgaagccgcagaggaggtggacgcagcggaatggccccgggtgcgcggcgaggatgcgggacacggcggcgacgatgcccggcgtgtcggcgcgcgtcggggcagaggcggagacaccgaagcttcgacctcgcgggaagaggtgggcgtccacgaggacgagcggcgtggagcgccagagcgggcgccagcggcgggagagcgcggcggtgcgcgcggcgtccttgacggggaggcgggagacgatgttgcggaggatcgcgtcggggagggcgctgatgcggtcgacgccgtcggaggctgcggcggcgcaggcggcgtgggtgcgggcggcggcgatgggtacgggtgggccagggagcaacccgtagatgtgcgtcatcaagtacttggtgcactcctccagcttgcgcgggtcgtcgccgcggcggcgcgcttccgccaccgtggcggggtcaaggtagatgatcggcgcaccttccgccatggattccgacgacgccgccggctagggtttggtttggggttctggacggcggcgacgagtcactgttgtgtgagggagcgagtgtcccgagtttggaggggacgtgtcgtcgtgtgagtggtggtttcgggtccgtgggtttcgtgtcctatagcaggccaaacgggcggcccggcccagcacgacacggcacgccgacggcacggcccactagggcacggcccgttaggcacggctcctgtagcgggccgtgccgtgccggcccacgtgccaaggccacggcccaagcacggcccaagaaggtgctgggccgtgccgggccggcacggctactgtagtggcacgtgggctggtagccggcccactagtacatgtggcccataaaaattgaaatttgaggggaaaaaaagaaaaaaggcagaaaaaacataatataaaggaaaaaatgataaatataggataaatgtgaggaaaatttaggaaatatatcataaaatatatggtacaaataggataaaatgtggaaaaaaataaaaaatatgagaaatatatgggaaaaattagaaaatcgtagaaaaaataaatgggccggtgggccgtgccatgcctgggccgtgccgtgccggcacgctacagtaaacgtgccgtgccgtgccagcccacgggctgaggcatcggcccaaacacggcacgggataacgggccgtgccggcacggcccacaggctgacgtgccgtgccgggcctgggctggctacagtactgtcgtgctcgggccggcccggcttggcacggcccatttggccaggtatatcgtgtcctggttgggccaaatgtcggtaatgagttgcacctgggcccatgaatcagtaactccacgtttctatgttcccattttccagatatttaggcgttactttggattttgttctcactcaaatttaacttgacgaaatatataagaaaaaaaagggaaacatttatatcagaattagtttcagactatcagtaaggatttgtttgaaattaaagtccgtttagcttttgttagacggaacaaaccagcatactggttgcattgatatccatctaggtcacctcccacatgtggctgaacggactactagaaaaataattttttacaacgaggcctataaaatttataggtggaccatattttagctgcgattatccacctgcgcagttacgtagagagggatccgattttcccccactcacagacggatggtttaaagggatcgcctgcaataatattcttaattttcacaggtgaaccactaaaacccccgcctgcaaaaaccgattgccggacaacccactaaaaaaacaaatcctcacgtatgtccttatccccaagtctccaaaaatctaagtttaccacaaccactccctgtctatccttatcctctccctctccctctccttaccatcctctccctctccctctccttaccgcgtgcaagcccagctacaaagagcagcgatagttcggcaaggaggagggccgaaggcggcgacaaaaaggatggcaggcggcagccgccgcttgacgaggagcggcgatgaggaagaacgcccacgatggtggcggcttggcaaggagaaggagggctggcagcagattgactcctccactcccgccagtggcagtggctctgcacaagggtgacggcgacctacttccgcaccgagctaaccgtatcgaccaacggctatctctagagctccttcgttgttcttgttcctctaaatccagatctaaaaattctctttttttcctttgtggctttctactaaaagccgggtatttgacctctagtctaaaaaaaattctctctttttttctctgtttatctggaatatgggaatcttgttcttctcatctgagttgtgacattttatatgaaatatgtgaattttgttcatcttatttgtgtggtgacatttgatttgatttgtattgtgcttgatctgtgcaaatggcagctgaatggggatattttcaaatgtacttttacttttttttgccgaaaattattaacataggcggttagttttatctactcacctgcaaatatcacattttcactggcggacggcttaaaacagccgcctgcgaaaatgattttttgtaggcagacaagaggcccacaagcaaaaatcgttgattttcataggccttaggtgcaggctgaggttttggtcacatgaaaaaaaaaatatattagtagtgacgacagcatgaaatccaccatcgcatgccaacacgaagtccagcaacccgaaatcctcatgcacggctgcgccctagcaatgcgaaatccaccagcaactggctcctgcttcttcttcagctcagcaccggcagggctctactgcaacgacacacatatctccatctcaaccaattcactgtccgtcctcgttgtcttccatacaaggccatgcatctatccagcagcaacagcagctcaggttatctatcaagaaatcaagacaaggctttgatttccatgattttcaaaactccatcgctgcatgcactccatctacattttgtttttgtgatcaatactcttcataagaagagtgcgactctccatcctcaaaccgggtgaaatgcggcagccacccagcattttgcacacacgatttcccaatgcaccacaaatttctgtacacataatttcaatccacctttcaagcaaatcactcaaaaacacaccagctattctaaataatctggcctgcccaaattactgacagtgttaaattatgtcataaacaacaggtacttcgtacctcacagcatgtcagcatcagctgagcatgcaacttgaatatttgtaactctcttttctcttttgaaaggaacaagaggaacaatattgcagcagaaagagacaaaagacagggtaaggttaaaatcttctcctcaagtgcaatagaattaccagatggacaagatagataattctccaccggcaatctatggaagatgagttaacagcaggcttcactttatcgatttagcccatttgatcggaggtcaccgaatctcgaaatttcagaaatttcggtccgaaattttgaacaaaatttagttgaatttgaacaaatgttaccaaaattcatgaaaaatttgaaaaatttcggccgaagtaatatcgtatcggaggggaccgaaataaccaaaatttcggtccgaaatttccaaccctggttaacaacagaacaaaaaaaaatggggtttaagtcttaaattaagcaacatttggtgaaagatgcctcgtaaatcgcaatccagttgatggtatcatcataaggcataaccactagagatgaacctcaaagtagaagaatccaaatgattatacataatctgatgataattgactttacaaagctaataattaactctatgaaattggaagtactaaactgtggtaccagacagaacaaaacacttcgtttaacatccaaaagacatgtataagattccaaacaaaacatgaacttgctcagatattagtgattctaactagcatcaaaggaattattgagcaaagtagtgcactgtaacatcaacatgtaaaacagtgaaggtaaagtacgataccatactaccagatagatcaaagcgtccagttaacatataaatcacattggtatgattgcaaacgattgcatgaacttgctcacatatcactggttctgacaagcatcaacgaaaaatttagcaaaacagtgcaacataacatcatcatcgtccaacaacaaatgaaacgcatagcagacacagtagttcttagttgtcatccagaaaacataatttgacatttgcatgatagataacactattcaagcactaatttcaacacttctcaagacagtataatcaagtccgctgtccaatcttcaataaaagggaagccgaaactctaacatgaataccatgaagctgcaaacagagcactaaccacttccaaagatatttgtcttggatcacaaaatgacatggaaatgcatctttttctttcagtagtccgtgaaagggtcaaaacgagaaaaatcagatcctctcttgaagctccaaatgttacactcttcaggttctgtacttggggtgaccaggactaaacaaccagtcggccgttttgcagccctcagaacctccaccttggaacgcacctcatccatcgaagaaaaacttccagtgtcaaacaaaatgaccactatcttcagcacccgcgtagtctcgaagaaaaacttgagaaagttaacctcactccgagtgccatgaaaatcatggaaaacaatcatctggatgcttgaccgaatgcactcgatgggaccagactcctgccagaacttgaagttgagcttgccagtggtttcatcagtttttccagactgcaaattggttagatcagtcaccagagatttgttcatcagctagtgatgacagattaagatgcaaatgaatgtggatggaggtgtaatttcaccttgatgtggagcctctcaatgttgggaaagcatctgaggacattggggatcatcttggcatcgttgcggacaccgaaacgcacctccagagcaaggatcttgacgtttggtaccatattgcttgggctcacctttgtcgcggactgcaatcacagaacaaaatgcacccaattaaggctgaaaaatcacaaattgccatcgttatatttaagaagttgtggaattgaaacgagcaatgcaccttgatggcggttttgccaaccacaagaacgttcgctgcagggtccaagtacccaaacacgcgcagagccggcgcattcccaatcttgacgctgccggaggaggcgccgtcatgcctccatgtgccggagacgatgaggcgctcaaggcacggcgtgtccaccacggcgatctcctcgtaggaggagccgatgatctgcgcgcaccggaggctgcggctggcgaggcggatgcgcatcctgaacaggttccccttgatgcagagcgtctccaggacggggctcctggcgaggacgaaatccatgtcctgcgtgtccatgacgacgctgcagaggccgagctcgcggaggttggggaacgagacgccgcgcgggaggtcagccgtggcggggaacttccagagtccgaggtagaggcgggtgagcgtggccatgccgaagaaggtggcggggaggcccag

SEQ ID NO: 72737 - DNA, 1133 bp, Oryza sativa
  unsure (1)..(1133): unsure at all n locations
atcaagtctaatttcaaatggatccagccacatgtccatatctgttctggagcggccgcaattgtcattttactcccgactattttctgtccatggtgctgcgtcatctcttttggcccaatgggctgtgtatccatgttgggcccattaggggcgcgtcctagggttggagcacgaccctatggtcgttcttcccctctttttatacctctagtcgccgccaagaacaggcgggttttgatgatagagatagcttcttgctaccggctcgcagcgcgcgtgttggctaaaccgcccgtctgcctgtaatcggaaccccaccatattgtgtttgatagtgaaactttcatctttatctagcaatttcagtgcttgtcctacttgttcttgcttgttcttcgattgcttgcaggacgagtgtcctcgtggccgggttgacgcgcaccacaagttcgcggcgaccattggagacggtgtatcggttgctaaggcgcagcgtctttggacagttgtagtcgggccgtgaacgtcgacttcatctaatcgagttatcccttacctctcatcgaaagatcgggccacaaaccctagcgggttcgcatcatgcacccaacacactccaatatgtccaaaaatcatgttttggtgttttttgaactttttcattccagtctaaaacatcgcacccacctattggcaatattggcaataattacaaaaagttcgccgcgcgaatcacgaagtgattttttaccacgaatgcaccaaccacactccaatatgtccaaaaatcatgttttggtgcttttcaaactttttcattccggtgaaaaacatcgcacccacgtgtgccaatatatggcagtattggcattaattgacaaaagttcgccgcgcgaatcacggagtgattttttaccacgaatgcacccaacacactccaatatgttcaaaaatcatgttttggtgctttttgaactttttcattccggtgaaaaacatcgcacccacctataccaataatggcagtaatagacaaaagttcgccgcgcgaatcacgaagtgatattttgccacgaacgcacccaacacactcctgatgnggtactgcgatagtcagcnctcatggatca

SEQ ID NO: 72738 - DNA, 702 bp, Oryza sativa
aaaaatctcatcccactgaggaaggtggagggggtgggtgaaaagtgtccagacctgtgatgacatcagacagcctctgagctactgcagagaccccctatacctatggaccacttgatttggtgacattttcaaaatatatccaaaatctgactatttctcaccacccccagcactgccatgtgccccaggccaccacctcctctccccacagggctccccgctgctgctgtggcccctcccaggctattctccacatggtagccaaagtgaacttctatgaacttctacaaacagatcatgcaactcctcccccagaaacccccaagccttctcttcccactctgtgaaatggccaaagcctttaccacatggatgaagtcctctaagacctgggcctcgccgacttcactgacctcaccttgcaccactcccattgcctggaagcccctcaaagacacagagcacactcccttccgtgggatttgcacttgaagttccctctgcctggaacttgcctgtcttcctcctttgcttccttcaggtctctgctcacatgtcatgctattatcaaggacgtccctgacaccctgtatgacagcactgtcctgcagaaccatctatgatatggaaatgcgtcataacctgagctttcaatacagtagccactggctacacgtggctactgagcacttaaaatgc

SEQ ID NO: 72739 - DNA, 2611 bp, Oryza sativa
ggaccaaggttgcaaggggtaagattaatgttttattttattactcctagttaacagttctgctaaatagtgccaccattttattttttcctttcgagtaaattacgtctacggtacataaaggaggtgggtgcgatctagcgcaaaaacttgagaaagagcatataagtgcaataacttggctagtgcgtgcattttggacttttggttaaaaggtctatattctacaccatactttttacgccatataaaaaaagccgccactcaaaccatctcgaaaaggatctacaagtattatatgttgctttcaattggtaagttataataataaaataatctgtcaatttaaaaccgaaagatatatgattatcaaaagtaaatgcatgactaatcaacatattcattatcgcgggttatgaacatggtgaaacacgaaaataaatccatgagccagcggtctagcaaagcttataataccaggattaatcaaaggtatgtattaaaactgcttaaaaaaaggtacgtattagtgttttggcctaaaatgcacatgattgtcaagtttatgtaccagtctactcattattcaagtccttacactaaatcgcactcacctaccaagtttttataccatgggtgcaatttactctgacctttcgctgtgtgtgcaccaaccctgttggtgtttaaattcattaactaaattttttttaccaggtttgatttgatcttttcgctatttgatttaggcgcaaaaaaagggaaaaacgtattgtgtattttagtaagcgtctatatatacacggccgtgtgttgcaagtttcacaagttgcataattttgtgtgtgtgtgtgatatataggatttgaacgggaacatgttcttcaagtagcgtccttaccatctcgcctataaagaactttgtgcatgtgggagagaagcttattcttttgacttcgcccctctaaaacttgtaatatataaattgcactataaatgatatcaaaaggaaaatttatcaaccacaaacttgtagatcacatcgagctctacaatttcgatatagagcacagctccatctgagttcatttaaaaacataaaagtttgtttattcaacaatagatttgagattttgtaacgaatatcaggacccgtaaaaagtctcgaatgaaaaaacattcaactatatagttgtagagctctccaattttcataaaaagattttcatcatacgacttcatatatatcaagatactactcctttcctattgtagtagtgctattatttttaagggtggtattttcaagagaaccgcctcaaaaattaatttttgcgtgcctttccatatgagaatcgccaaaaatgacatttctgtaggaagcccatctgaaaaaacttgttattctttgaaaatgtctaaactttaaagatttatagaaagttcattttaagttcaaatgaggtgaaccaaagttatatatgacccttacaatatttttgtatttatatttcagttagtataattgtttacttatcatttacctctaaatgagttggtatgttatctaacgtgacattagtgaataaccattctaaaataaatgttctaagaaaaatattaactaagttttactataagaagtactagaacgatctcggagaactttagtttacctcaataggacttaaaatgaattatctataaatttcttaaattttgattttttaaagaactgcttatagaaaaatagatactagagcttataaagatatttactacaaagttgtagatctagttaagttctacaattttaatatagaatgtctttatccaagatcgtttgaaatactcaaaagttcattttcaaaaatagatctgagagtttgtaacgcatatatatatttagacatcgatctaaacgtattatctaaaatgatgaaaaaaaactttcaatgtagatttcgtgaagagcgacaaattttataggcggtttcctaagaatttgccagttaaaaaataggatttcatacgtggtttataatcctggacagctaagccatcttcacacaggtgattttcattttgagttgcctgtcaagagaaaagaaaaagaagcctaagcctacgatttttttttactagtgacagttgatctaacgactaatatatatgatcctttttatatgcacagacatcaacgagtgtgatgtgtccaacaagaagaaatatccctgctacggcgtctgcaacaacatcccaggggattatgagtgccactgccgtgtaggataccagtggagtggtgaaggccccaagaaacaagagtgcagcgcaaaattccctcttgcagcaaggcttgcccttggtacatatgcacctcagcatttttttaaaaaaatataaaataatatactatatatatgtcacattgagtttacaccaattcaatgatttcccatcgactatgtttttaattgtttctacaatataccattcaaccaaacaaagaatttcttataatgcctaaaaatataagggttgacagttaattgacaaaactaaaaaaaaaaatcaacaattttaaaaaattagcctcctagcacatgat

SEQ ID NO: 72740 - DNA, 1655 bp, Oryza sativa
  unsure (1)..(1655): unsure at all n locations
aaaaaatccatttcgtgattcgcgcggcggaactttggtcaattaatgtcaatattgccatatattggcacacgtggggcgatgtttttcaccgaataaaaagttcaaaaagccccaaacatatttttgacatattgaagtgtgttgggtgcgttcgtggcaaaaatcacttcgtgattcgcgcgacgaacttttgtaaattaatgccaatattgccataggtgggtgcgatgttttagactggaatgaaaaagttcaaaaaacaccaaaacatgatttttgaacatattggagtgtgttgggtgcatgatgcgaacccgctagggtttgtggcccgatctttcgatgagaggtaagggataactcgattagatgaagtcgacgttcacggcccgactacaactgtccaaagacgctgcgccttagcaaccgatacaccgtctccaatggtcgccgcgaacttgtggtgcgcgtcacccgggccacgaggacactcgtcctgcaagcaatcgaagaacaagcaagaacaagtaggtcaagcactgaaattgctagataaagatgaaagtttcactatcaaacacaatatggtggggttccgattacaggcagacgggcggtttagccaacacgcgcgctgcgagccggtagcaagaagctatctctatcatcaaaacccgcctgttcttggcggcgactagaggtataaaaagaggggaagaacgaccatagggtcgtgctccaaccctaggacgcgcccctaatgggcccaacatggatacacagcccattgggccaaaagagatgacgcagcaccatggacagaaaatagtcgggagtaaaatgacaattgcggccgctccagaacagatatggacatgtggctggatccatttgaaattagacttgataagctttccatgaagtacttgcacgcccaaatcggagttcgcatgaagtcgtggcggccgtcagaagttggcgctgccctgcagtccgaatccaccccgcgcgaatcctcttccctttggatcctctccatcgttcctgagtaaaacacgagtgcacgcgtctccgaggtataaagacgaggaatatgaactcaagaaagaactcacctgataatttagttgacgtgcacgagcgcgggtaataggaccatcatgctgtatatggggggacgtggatgtatcgatggtgttgatgtcctcatcagtgcattcgtgtcaaaatatcacttcgtgattcgcgcggcgaacttttgtcaattactaccaatattggcataggtggttgcgatgtttttcaccggaatgaaaaagttcaaaaagcaccaaaacatgatttttggacatattggagtgtgttgggtgcattcgtggcaaaatatcacttcgtgattcgcgcggcgaacttttgtcaattactaccaatattggcataggtgggtgcgatgtttttcaccggaatgaaaaagttcaaaaagcaccaaaacatgatttttggaaatattggagtgtgttgggtgcattagtagcaaaaaatcacttcgtgattcgcgcggcgaacttttgtcaattaatgtcaatattgccatatattggcacacgttgatgngctgctttcaaagaagcgngtcatgcaattcaaggcat

SEQ ID NO: 72741 - DNA, 1631 bp, Oryza sativa
ttagtaatatactgtgatcaggatcctgattttctttatcaggaaaatgatgaaaaagaaagcactgactatggctgcattcaaacaaagggcaaaaagaagcgttctacctgataacttctccaatcaagacagcctacttttgctatctatagtccaagatggacacttttgttatcctctcatctactagccaaattacttttggtgtatctagctctgactaagaacctagactgatctactagccagttactctaatacaaagttgacatggagctttattaaaatctttcattatttaagctctagatcaaacctctataatatgtcaatactcttcaaatgtctgtcacaaatagccactgtgttttgttcagattatacagtctatatcacactatatgtcacaaaaatcttctaaattttgtagtctactacagcaatcatgattgtgcactatagtatcatgctataacttgcgcttttttttttgagataatacttgcattgttgttaaactgattattctgtctcattagggtcaaatagcatggcccatccagtattgcacgcggcaaagccgcgtgtttttttctagttttgtagctatagctaaaagaaattatggattggtatgtttttctgtccaaaatatttattcacgtttagcactcttatggcaaaattttcaaaaaatgtaaatcaacaccacaaaccgcaatcgagggaggagtagttatctaaagtagtgaaagaaataatcgttctcgtcactacaatgcgccacgtcatctgctcaatataaggagttggatgcaacaaaggctgtgtttaattccacactaaaattggaagtttgactgaaattgaaaatttaaagaaaaaagttggaagttgatgtgagtagaaaagttttgatgtgatggaagagttgaaagtttgaagaaaaagttgggaactaaacaaggccaaaaaattgagcccctactgttggatgtagtgtgtaaaagaggctcagtaaaaaagagtaaacagtagtatttttgcacactgtatgagttagaaaagcaggcagtacctgatttgtttgtgatggctgtatgtattctttcaggagaaaggataatgttctaataaatctaataaataaaccttctgtcatcacctacataatagaaaattactacccaaatgctttcaattggtatgaatagtaggggaaaaaaatcatattattaatatactgcagtgcatagtctgcatacaccatgaagaatttgatttactctttaccagccaatcagcaaataagaaagtcttagtccgtagcaggttataatttagctgatgacttaacaattcccttacaaatgctcaattcctacataccattatcaaaaggtgaacaaaaaaactgatgatatcctctctaccagaaattgtttattcattcaaataaattcgttcactcattttaattttaagttttggttacaaatttcagctagaagtcctcatctgaagtttggggacgagggggagtataatatcatgggcactgatcttcttggtccaagggtagatgactaaatcaactactgcaacagaaagttctcttttaaaacagt

SEQ ID NO: 72742 - DNA, 2213 bp, Oryza sativa
ctgttgtcagagaatatgaaattgcagaagattcttgcaattttcctgttaagtgcatttctgcatgatgtctgcatgacctacatgataggagcacaaagcttttacatctttggtaaggctttcacttacatggattaaaagaatgttaggtgctagcgaaatactagtggagtaattcacagcttctctgatgtaattttgtcggagctaaaaccctgcaagctatgataatcaaactagactactgatgttggatagaactgcatattgtcaacaactccaccgtccagatatcagccatgcatgcagtcaacgaccgccctcactacaaaaatttctcttctgttaccatcaccaacatgtataaatgattaaatgtactccgaacaaatgaaatctttcacctttgctcaactgcacttccattgggggaggaaatgtaggaagaataattttcaatggttacaggataaaagaaaccaatgtatcaagtcctaatcatcgtctgtccttgcctaatgacgtctttgccaccgatttagcactatcattttgctgtacctgacgcgaacttcgtatatctaatattatatttcatcgacttcaaaatttagagttcccatttgctcctctaccgatcggtgatccgaactatctagaaatgtagaaagtgcagtttgaagacatccagtataacctcactgtatctagcgaagatattctgagttgagaatgcttctacctgaccaactgttgaaaaatgcgagctttcaacaagagggcaataattatcagccaaatcacacagcagactttccctagttactcgtatttgtcatgcatatggaagtattccctccgtttttaaatatttgatgccgttgactttttaaaatatatttgaccatttcctatcatttaattcattgttatatatatatatatatagacacacacatacatatatatatacatatacatatatatatatatatatatacatatatatatatacacatatacatatatatatatatacatatatatatatatacatgtatatacatatatattacatattccacaaaagttcttgaataagacgaacgatcaaatatgtgctaaaaagtcaatggtgtcaaatatttagaaacggagggagttgaactagtttcaacagtcagacgaaaaacaaattgtgaaccattttcctgcacaagctaccttttccttgaattgagaggaagagttttacgcaacttgtcaacagtggcttttcacggtggaacctataaaattcaaaattttctaggcatgacgttatattttgtaaaaggaacaaaagcaccgggcagactttttgagtgtacactggcaagaaaaaagaacttcacttcgtttcgtcagaatcataagaaacaaaggcagcaccgcagcacatcaaacatttcctgccattcaaatgcacaacatatgatccatattattactgctagctaacatccagagtcttagtattctcatagccacacattagtcctactcctacttaaatttcataatagcaacaaaacatttggacaaagcaaagtgcggttgggcagaggctagtatcaatcatagaacaagctagcgtctaattaaaatgtttttggtgatcatccgcaccgcccgttctattctaaaccacaattgaagctgacgaattaagttgccagcacgacgccatgtgtataaaaggggcctaagctgaacgagcttcgccacatcagtaatcgccaagctctctttcaagcgtagagacctctccacacttatcagagtaataaggaaaaaaatatagattaaaaatggtgaagctcgcattcggaagcttgggtgactccttcagcgccacgtccgtgaaggcctacgtggcggagttcatcgccaccctcctcttcgtcttcgctggcgtcggatccgccattgcctatggtgagctcaacgcattttccggtttgatatgtacagtagtatgtttcatttctgacctaccgacggcttggtttgtgtagggcaattgaccaatggtggcgccctcgacccggccggccttgtggcgatcgcgatcgcccatgcactcgccctgttcgtgggcgtttccgtcgccgccaacatctccggcggccaccttaacccggccgtgacgttcggcctcgccgtcggcg

SEQ ID NO: 72743 - DNA, 6198 bp, Oryza sativa
cattgcactcgctcccgctttcccatggcccctctactccctggagcccctcctctcccctatgttcccttcctcttgagcgttcaaggaaaacaaaaaacttatgtccgtgaacacgttttgatgtactcacccggctgtgttcaccacaagagatcgtcgttgccgtttctctctctatgggaccatgccgttgctggtcgtgttcccgttgttctggttttcttcgttgccgatcaccatctatggataagtcacattgtgggacatgtctagctaccttactcaccgccgtttgattactggagcaccgtcgcccaccttccctcctcatatgttttttttgtttcgggtagggaagacaataaactatgttagtcgttgtttctctctctttcgttcttcctgcgtgttcaaggaaaaaggaatcccctcatccggtaacgcgttttgatgtatactcctccggtcatgttcatcaacagtgcttgccattgtcatttctctctctatcgggacacgttgttgcaggcctattcttgatgttctggttttcttcgttgccaacctctaccatctatggacaagtcacatcgtaggacacgtatcaccttcctcaccgccgtttggacgacagagcaccggcacacatcttccctcttttttattatggatcaaagtagctgacgcggtctataattttcagtggacacactataaatatgggctaactgtattatatatcagccgcgatgtgtgccaaactagagtaatatatagttggccataaggcccgaggcccgaaggcccggcccacggcacgcctttttggcccggcccaagcacggcacggcccgacttgggtcgggcccgtgctggcccggcccgaccgtcgggccgtgcctgggcctccccaccggcacgctgggctggcccagcacggtcgggccggcccggcacgatgggccggcaggccaggcccggtacataaagtatggggactaaaaatagacatataaacgtaactgtctaaagaatagggaccttaaatagacttattttagctatttatataccccagcccaaagaagagggaggtaaaatagactttttgtagctgtacatatgtcacagcccaataggagggaggaaatttagacttattctgaggaaaagcacgacggcccatcgtgccttcgggccggcccggcacggcccgaggcgtgttgggccgtgcctgggccgtgagggcggcacgtgggctggcacggcacggcccggtgcgtcggtcgggccgtgccggcccgacaagcctcggcccaggcacggccgggcctgggccgtgccgtgccgggcggcccacatggccaactatagagtaatatagtgtgtcggtcactgtgcaatggccattttgaccgttctaccgctggtcttggtgatgctgctgcttccgttggctgcaattgcatccggcgacccaccatggcagcactactgcggaagcagcggcaactacacggccgggagcaaataccaggccaacctgcaggccctcgccgcgaccctcccgtcgaccgcgtcgtcttcctcccccgcactcttcgccaaggacgccgccggcggcggcgacgccgagcccgacagggtgttcgccctgaccctctgcagaggcgacaccgcctccgccaacgcctcgtcgtcgtcgtgcgccgactgcgcctcccgcgccttccgcgacgcgcagagcgtgtgcccctacagcaaggaggtggccgtctactacgacccctgcctcctctacttctccggcgacgacttcctctcctctccggccaacccggcccaggtgaggctctacgacgtcgatcgctccacccggcgtggcggcggcggcgccgacttcgtcaccctcgtgagggcgctcctgagctacacgatgcagtgggccgtgccgtacaattccacgggcggcggggccgccgccgtgaggtggtacaccacggtgcggatggacgtcgtcacgccgccgctgttctcgctgatgcagtgcacgccggacatgtccggcggcgactgccggcagtgcctgcaggacctcgtcggcaacaccaccttcaacggctcggtctccggcgtgcgcaacatcggcgcccgttgcggttacaggtacgacacgtacaagttctacggcggggagcccaagctgaagatcgggtcactgtcggagatcaactcaacggcgccatcgagcccaccgccgcctccgccggtgacggagacacgttccggtatgtttggacagtcaccttttatatatactatatatactaggtgaaactatagttggtcccggtcttgcccgggccaagatttgccgggccggcccatgtgctccacctgtggaccaggcacggcccaataagggtcgggccgtgccggaccagcccgaaggcacggatagtccattgtgctttctttgaaataagtttgtttcccctccctcctctttaggttgtgacatatatataactaaaacaagtctatttaatgtccctacactttgggccgtgccaaataatacgtctatttatcctccctattctttgtgccttgtcttataggtggtttaaaataagtttatttcacctccctaaagtttgtgccgtgccagtccggcccaccgtgccaaggcataggcccaggcatggcccaacaaccgggccgtgccggcacgggcccgacagcgatcaggccatgccgtgcctgggccgggctgtcgggccttatggccaactataggtgaaaccccgtgcgttgctgtagaagtatactacgataacgataagtaaaagtaacatgtgttataggtgctagttttagataatctatagatgccggtttaaaaaaatcagacagccacgagccgagccgaaccaagccaacgccccaccacacgataaaaattacgccgctgcccgtatccactcccctcgctcacaaccaaatggggtattgaagttatttcatcatgtgtaatgagaatataaaataaaattatgagcaatgtataattatttttggagatgagatttccttgcagggagaaagaaggtgttgacagttgctttgcttgtgccactgatagcactttgccctgtcgtcatattctgttttgcatggataaggagattaagaaaccgtgagttatagaaatcaacttatcaaatctttaaattgtaatataattattgtttctgagttctgacagactactcttgtgttattagccttttaataacgtatttgttgctttagacaaatcaatgttgcgaaaaaaggatacaatggccagagaagaagtattaaagctttggagactagaagaaagcgattcagagtttatgctatttgatttctctcagatagaagatgctactagcaacttctcggaagataagaaacttggagaaggaggttttggctccgtatacaaggtaaaataaattagatatatacacacacataaaaatcttcaatacatgtttacttgaagtatgaactacttgaactttgtttgaaaaaaaatgcagggccaattgcccaatgggcttgaggtagcagttaagcgacttgctgcacattcaagtcaaggcctggttgagttcaaaaatgaaattcaacttattgcaaagctacaacataccaatttagtaaaccttcgaggatgttgcattcaaggagaagagaacttactaatatatgaatacatgccaaacaagagtttagacttcttcatctttggtatgcttatacattgtttttcaaaaaatgtggttattttctatatatatagcatcaaataaatagtaacatatatccttatacttcactatgcagatctgaaaagagcagcattgctcaactggaaaacacgcctgaacataatagaaggaataacacaagggcttttgtatctccacaaacactcccggttatgcatcatacatagagacttaaaagcaagcaatattctactagaccgtgacatgaatcctaaaatctctgactttgggttagctaagatatttgactcaaatgatgtccaaagaaatacaaaaagggtggtgggcacttagtaagagttaattcacctttcaaatttgttatttagctagtccaagtgatttagggataagctcattttactccctcaactatctggtttgtcttaaaaaacactacttaactctaccaaaccgaacacatacacccctcaacgtacaacctaagggcaatataacccagttctaatggtggtttccatgattttgaaatccaaattcttttttttacttgtattttttaataatggaataacattctggcctttgctcaaaaagctacagctaattattacaattttttttacttatgtctcctagtttggatgatatgtgaatagtatttgaatgtgagtgaaaaaaaaacatatatttttcgatatcaaaatcatgaaaaccattattaaaaccaagctgtgtgttgaacccacatggtattttggttggttttgatagtatgtcgaggggtgtaaaatatccggttacatagttaaggggtgtcttttaagacaattccaacgtttgagggttgtactacagacttatctcttattatgattttggtggatccagactgaggtgttttaacatgtgcatgcattttgttttgatttcagtgggtatatggctcctgagtatgcatctgagggttgcttctcgctgaaatcggatgtctttagctttggagttctggttcttgagattattagtgggaaaagaaacgctgggtttcaccaatatggggacttcttcaacctccttggctatgtaagtttttttaaaaatttagtataagagactaatatattcattttaaagatacacaataatcgagcacactgctgggaatatgtatgaactacacggtttgtgcatgcatgagtgcaataatagttaaaattttatgatagtcggtcttcattttgaaaaattatagcatatgctttatgaaacccgccttaacttggctcatggctcaaaattctcattcactgaaattgcacacaatagctcatcacatcaaacttgttgcaggcatggcagctatggaaggatggaagttggcatgaacttgtagatccatcattagtaagtgaaggtcaaatgatggaaataaagaaatgtatgaaagttgcacttttatgtgttcaagagaatgcggttgatcgtcccaccatgtccgcagttgttaagatgctttcaagcgagttgaaaattctacctgagcccaaacaaccagcattctttaatgtaagggtgaaacatggagagctgtctaatactgcacctagtagcataaacgatgtaaccataacaattgtgaacggcaggtaatgccaatatatatagggactttaattaaaatggtaaaaacccacaggactatataccttgtacagaatgtaattattaaactgcagttatgttacgtagttctgtaacattattggaacggcagatatatatagttgaattacttttgacgaagtgtacaattcaaattaaataatacagtttttccttgtcctaacctttgccaaaattcaaaattatctttggctgtgcatgactttcaattcgctctgccgaaagataaaaggccaaactttactgcattcaagaacaaagaaactgaagcaaactcatcacataaaagatcagttcgttggtattaggacatagatttatgtggaaagctgattgagccaattaatgatttttcatatggacagtgccatcatccataaatatttgacaataagctactctctccgttttaggttatactccctccatctacttttgataggcatatttctaaatctaaaaaatttatttttgatagtcatatttcaatccaacaacctatcctcttaatgacttaattagatttaatgcgtgactctccattcttccatacaagattggctacatgagtatcgagaaatgtaaatattaatgaatcgcttgtttacgacgaataactagtagcatatttaaatgaatgataaatataattacttatccttggtctgtgtgccaagataaaatatgactatcaaaagtagatgga

SEQ ID NO: 72744 - DNA, 1802 bp, Oryza sativa
ggctcgtgtacggcgacgtgttcatcggctcataccagcccgttgccgaccaggactacgcttaaaagtggatgaaccgaattaattgaagtatccgtgtcagtttgcatgcatcgtacgtttgcttgatttgatattcgtcgtgtgtgatacgttcacaggctttgtattttccggtttaccttctttttgtcaaacacggtacatgtaaaaggtcactttctgcgattgttgtctggaaggggaaatcaaaattgtaaaatttcatcgacacaattgataagatcaatttgcattagatttggtttgtaccaggaaatttggaagccatgtcccttttctggctaagataatctatctatctatctatctatctattatatctatctatctatctatctatctatctattatatctatctatctatctatctatctatctatctatctatctatctatctatctatctattatattattaaaacagctttgaaaggagacatcacgttcgctgtgggggttagaaatttccacattaatcggagaaaaagaaaaaaaaagagtccaagtagaagtacaatttaaaaatagctgaaattcggaattaaaaataaacgttcgctgtgggggttagaaattcccacattaatcggagaaaaagaaaaaaaaagagtccaagtagaagtacaatttaaaaatagctgaaattcggaattataaaaataaacaatattgaaagaagtttccatataagaacccaatacgagattaatcaaaattcgaaataaaaataaaataaaaatccaaaattagaaaaggaaaggagagtccaagtagaaatacaatttaaaaatagctgaaattcggaattaaaaataaggaatattgaaataaatttccatataagaacccaatacaagattaataaaaaattgaaataaaaataaaataaaatccaaaattagaaaaggaaatgagagtgcaagtaggaatacaatttaaaaatagctgaaatttgaaattaaaaataaggaatattaaaagaagagtccatataagaacccaatacgagattaattaaaattcggaataaaaataaataaatccgaaattggcaaaagaaaataaaaaataagagttcaagtaggaatacaattctaaattagctgaaattcagaagtaaaaataagcaatattgaaagaagaatccatataagaacccaatacgagattaattaaaatttagaataaaaataaaataatatctaaactagaaaaactaaaagagagttcaaacagaaatacaattttgaaacaactgaaattgaaaataaaaaataaaaacattataataacacaatacaatattaactaatttttttaaaaaatctgaaattagaaaaagaaaattaagatttcaattaggaatacaatttataaataactaaattttttgataaaaataaatattattgaaagaaaagaccatctaaaacacatgacgagataaattaagtaacatgcctataaaggagtagagtggtggtggttgatacgagatataaaaattgttaataaatcaccaaaatagaatcctaatgacaattaaaaggagggacgtcaggcaggccgtgaagcaaacgtggaaaacggttgccgggacttctataaagtaaaaaaaaaacctcattgataatcatattcaatttttaaaatcttaatgacaataaaaagtagaagcagcgagcggggtgtataagagtataattgcagagccgccgatgattgacgggacttctag

SEQ ID NO: 72745 - DNA, 24068 bp, Oryza sativa
ctctatctcccaaccccagagttcgagtatgcgtcaaatggtgtctactcggaggagtagacttcgtccgtgccgtcgagaatgcctgtggagtggtgttgcccgctgctatccaagtaagacttagtttcagtcatccctttaatttccgatgtatttatgtaaaactttttgtttgtaagacgtggatctgtatgtcaatattgtcgtttgtgtaccctggtctggcctgtcctggacaggggttttaatgcacattctggttggaattctattcgggaatttctgggcgtgacaataccctatctatatacacaaagacatgatattactagctagcactaaaaatctctaattaaaagatcttgtccactatgtcaaataggatactcttatgaatcaccggaatatttcaacgggaaatgttctaaagtttcactatcacaagccttagggaattcaaaccgaatacaatgtcttagagtaaagattccgatgaatcgcaacactgtcaacgcaaaaggctattaagtatcattattacacgcgtatagttcaacgcgataacgtctcaaagtatcactattacatgtcttaaggaattgaaatttcggtaacaacttccattgcactactgggtgcaccaagggtacttgcccttccttgccgcttccgaccccgcatcctttgcacgctgcgccctagccaactttcttgcctgatattcggcgcgttcttccttcttgtgtcttgccaacacccttagctccaactcttctctcctctccctctcagtcttctccattgcccatgctggcattggcgtttctcacgttcttcattccactcgcgccattgccaaatcatactcgtatggaactcatccatctccttgtcaatccactccacaaagtcacaaagaggaggagggatttaggtgcatatacattacatcacaaattatatcttcacgacaaagttgcatatattcaagatgaaacaatagaaaattaacaaatttaccttcactgccatctttgtctttccctcctttcccttaggcacatgcttaggtttctctgggctatatgcatagttgcggcacattcagtacctctggccataggtatcctagtcatgactatgctgaaaacaacactcatccccacaccaacacatagggcgctttacacctggtgctggcagctgctcaggggaatagctaacaacacccttccttaatatcctaaaattgcaaaaatgtttatcgctatatcaattgcaattaaccaacaactatacctacaaatttaacataagtcggttttttcatcaaaccatctattcaactccaaactacaaataagcattatcacatatatactagaacatatcctagaactaatctatcatgcaaccgaattggtctctcctccatataatatataggtacatattatatactcctcgattgataatacatcccgagccatattccccaaatcacggttagaaccaaatcaaccaaaatacaaagtaaaacattagggaaattagggtttttgaaggaggtcaaccttataactaaattctcaacaccgtatatgaatcgtccataccaacatgaagattgaactacaatattacattcttacccacattccttaattcacaccgcatctcgagccaaatttatcaatccatggtttcaaccaaaatacacaagagaaatgaaagcccggttgagcaaatttgggtttttcgagggggtttaccttacaaattgatgcccaatgcaatgcccacgaaatcttggggtggatttgggaatatttggggaagggaggagagaggacgaccgtgtggggatgaaccctagacaaggagagaggagaggaagagagtggatagcataggcttctgagtgttcagtcaaaaaaaggaaagacaagaccaagcaattctaacagccatcttacaatctttaagattaagaattggagtgtcttctggcaaataaccacatttatagagtgtcttaccccaaaagtgccttcctgcgatgtcttgtaacaaaaattgcctttttttaccctctcgcacgctatcatataaatctctgctacttaggcgttgtttagttcccaaaataaaaacttttcacccatcacatctaatgttttgacatatgcatggagtattaaatgtggaataaaaaaaccaattatacagtttgcgtgtaaattgcgagatgaatcttttaagcctaattacaccatgatttgacaatttggtcctatagtaaacatttgctaatgatggattaattaggcttactaaattcgtctcgcggtttcatggcagaatctgtaatttgttttgttattagactacatttaatacttcaaatgtgtgtctgtatatccgatgtgataaccaaacctaaaatttttccccaactaaacaagtccttaaaaaaatcagtaatggtgctcttgttttctggcacaacaaacgtatatgacaggcacgcgtaatatccaacggactggaccacaaacccatcgcgtaatgcacccatcaccatctccacagagatcgcgcattgcgcggacggtttcatcctccgtaaatgactcctccgcctagggccggtccggagatttgggaggccctaggcgaacttgacactataggcccataaggagttctataaaacgcatataccatatagtgacacaaataaatatttctaacatggtaaacaataaatcaagcagtttgatatagcaatttattctcgataaataatatcgatggtataattgacaacaaaaataacaccatagaaacaaagtagtatgaatagcttaataggagaccacagatatcctatatcccttataaaaagagtttcttcgcgcatttctcgaagcgaaatcattaatgaaagtttggagatcaatgctctctaagatattcttctcaatgctgcacatagccaagccgttctgagcacccgaaaataaaattttaacattgtaacaccagaaatagtaaaattgcaaagtaaattatacaacaataaccataaaaattatagcctaaataatctaacttttggagtgggaaaatcatgcaatgatgcaaagcaagaaaatcctaagtccataagtaataagttgctaacctaaatttcttagaaaaatcgaagaaataacacaagaacaaaaaacaccttagttttcctaggacttagggctaaaagagaatggagagtggagatgggaagaggcgtgaggcgtcagcgattagaggccggcccgacgtgccggcagccagccggccaggcgcccgccgcctgacaactcggtgaggcggcgaagtgcttgtgcctccccggtctgctctgcgcggagggaatatcagagaggagtagacgtgtcgtgtcgcggttaggttgtgcagtcaggagtcgcgcaagactcacgaaaaaaaaggagaaacaaagcggaggagacgcgcgtcgcggcctggcagcgccctcactcctggcctagcaacgcaaccgcgcctccctccttcctaggctgcgcttgctcactgggctaggctgcccgcagggggaggggggaaggggtggtaatcacgccctgtcagccttaaccctaggcggtcgcacaaccgacctaggcccagggctggccctacctccgcccactcgtcgccgccacccgcaaccaccaccatcgtcccccgccgcgcactccactctagatccccccactgagccgattcctactactcctcaccaccgacatctactccttcacccacccgccacgcgcattgcccacttgcaaactcaactccaccgcccctcccgcatccccccatcccaccacctcctccgccgtgctaccgacggcccctccacagcgccgctgacggctccaggtcatcctcgtcgtcgtcacacggtcccggccagctcctccaccacgccgccgttggcccatccacaagatacggagataccagctcggcaaccaagccattatggcccagccaccagagccagcctgcccaaccgaccaagcaggtcaggccgtctttcccccaatttcccgccagcccaccaaaccgagccgcccaagcctacagccttttgcgttttacctgctcgacctcgtgtcgcgcgcacctgcccggcgacctagctcacgagccccggccaccgtcgcgtccgctccatcaccagctagctaaggctgtgctcggaagagcctcttcccaacttccctctcgcattttccacactcactctttttaaactgttaaacagtgtgccgcgcactgtacttcgctgcacctgagattgagccaagcccagagtggaaacacgagtacaccggaagcgcagccgctcggtcgaacaaatccactgccaacctaggaggggcaccaagatcccacaaggccaccaacctgttcgctgcgccggtgcgcatcgacaattactctatgtgtgccataacgtaagtcacttcgactttttttaattatttttttaagtttaattaagtttatagtaaaaacacaatagtatttcacccaaaaaaacacaatagtatttacaacacaaaataaatatattatcaacatatattcaatgttggatttaatataactaatttgacgttagagatgttgctaattttttttataaacttgacaacttaaatatgtttaaaaaaaatcaaaacaacttataatataaaacagatgaaatggagagagtattatagaagaaacatgtttcattttaggggtcatccttttttctcgttttagataaaaccaaatagatcaaaagttgtcaagggggtaacttatattgaaatcaaataatgaggctggaaaacgtttgttgaagttgagtttaattgaacagggttgaaagcggttctttattgggttaattggatccatgccattacaattgtgtcaaattagagaaatgccattacaaatcgcctatttcgaagcgtgccatccatatacgcgcagaatagtctccatgccatgccgtacgacgtaggctcgctttgactcattttgaccggtgtgtagttccgtatggtcgcaaatgcccctgcatacatggttacatcggcgacttggttgggctcgaccacgagaaaccactcctccgctgtccccaaaccattctatcgacggcggcataaaccctagccagcggtggcggcggcggcgacggtgagtccctcggcatctctgggcgaccgtgggagtgactgcgatggacgcccaatcgagaaccctttctcggtcgagcaggtgtagagaggagcggtcccgggcagcagcgtgcgacatccccgagctgaagtgtgcttgcgggtggccggcagcttcaggcacatcgacgactgtcaggaatcctggccggcgatggctgcaatgcggcggagaggtgaatctttggccacgacaaattttgagttgcatttctttgatttctttcccaatcccctttccttccctttcaagcagcagggtgcacgatgctatttatggatctgggaggatctcctcagggagtatgtcgaggagatagtggcatactgccacgccggcgagtttgatagcctatgggagacatgtgacgagttgcggtggcagttgttagatgtgcagggtcgcaacatcgagttgtgtagtatcttggaagcaaaagaggcgcaattgcagctctatagagatgagttgaatcagtcaaagagggaggttgcagagatgaagcacaagatggaatcagagaaggccatgctccaatgggttctgtatatgctaatgtttatctgtgttctttgtgtgtcagtagttgtagggaagaactatcttggatagttaattactgtgaatgtgcaatatgtaattgtaaatgacttgtgtaatgaatcctagtttcagtttgagcaaatgtgagtaattgtgcatttgtaattggcccgtgcatttgtagttgtagatttttagcaaatgtgagcaaagctgataaaatgggacttatgagacatgattttcatacatgattttcagcagcatatgtgagcaaacatgattttcatgtccaaatttcagttcaactaaaaactatcaaaacttggcaatgtgagaatgttagcagtaaaacaacaaatttgctggtattttctgggttttccagtagagaaacacaaatttatctaatttccagcagaccaacacaaatcacatatgtcgagcaagttcatgaatataaggtcatatatggaccaacacaaatttatctaatggcacatgtaaggagcaatttcattcattacatatctggtatttcaagcgaatcgacacaaatctgagaatgtcacatatatggagcaaattcattcatcattgcagccaacttcacattcatcattgcagccaaactcagaatacataataagcaggtcttagtgccatttcagtactacatcacaaaataaacaggtctgccagtcatcacaacataggtgtgtcttaggcattacatcacataatatattacaaaagggaacccacttctgtgatgctaacttacacaggcattcacatcacaaataccagcagttcttgggacatcatatattacaaaagaaatcccagtaatcagctaggtgaacatcaagctgggttggttggttgagacccttcaaaccaatctgatagccttctaggagcagttcttggtggagcactggaagaagcaagaactctcctcttttgtggtgttcgcttcttctttggagtttcatgtttcttcttatttggtgctgatgagctagcttcagcattcacattagatggcctcctcctgcaagtgaaaagaagaaacatgattcaacaatagttaaaagtactgaagtcatggatcaaatcagagatcaaaatggaagggttcagtacataccttttcctgggtgtttcttcagtagccatgtcatcttcacatagtggttcagccagtttgcatgttttctcaaagtgctcaaactggttgcatctcttgcatttcaccttctttctcccaggctcaagacagccccttatcctttgcactctaggcctgccagctcctcttcttagtcttggaggatgcactttgaactcaagatcaactgaaggccattgtgacctatcagtcatgggttgaatcctccctgcataagctgctctaaagtactggacactgtaatatggatgcacaaagtcctgaatcttgcccctgttgctgcatatccaagccaatgcatgcttgcaaggttttccagtgacctgccataccctacaagaacaattttggttgtccaagtccacaatgtgcctctgggtgctgttatcactctcaaccattgtgacttcagcaaacccatggtcacttctggccaccttaaccaccttcaaattactagttgcagtgtttagctccttcatgacacttggcaggatttcatcatccatcttgctggcacaatctcttctaagtgcaaatttctccatgatcatttctctgatggaatcaaccaactcatgtaagagcaaaccttttaagcccttgatctggttgttgaaactctctgaaacattatttgtcaggtaatcacacttgctaagttctgaaaatccacatctataccaaatccttgagtggtgtttctctaggaactctattgcatcaggcctgacatcccatatatgcttcaaatgccactgaaacttatcctcagtatagcatctagcagctggatacagatgatcagtgaacactggcccttggtacttcttcatgaaattagcatagagatgcctcatgcattctctatgctctaccttcttgaaagccttacatgctttgtctaaacccttacatgcatctgtagaaataactaaaccctctgtgtctcctatggccttatttagttgttgcataaaccaaagccaattatcatctgtttctgagtcaaacacagcatatgctacataatacaaccagttatgtccatctacagcagtggctgaagctagctgtccagtgtatttaccagttaatctagttgcatctacacctatgtaaggtctacatccagccaaaaatccatctatgcaaggtttcaatgcaacaaaaattctcttaaagcacatcttcttgcctactttctgcaactcaatctctacaattgtacctggtgacttgttctgcagtgcagcctttcagttgaaaagaagcttgaagctttcttcatatgtaccatggatctggtcaattgccttcttcataccagaccatgctttggagtatttcagcttgatctcgtatttttcttcaagcttcttcctacaatcagttggtcccttgccaggattggtcttgagccaatcatgtagcctgtttgcacaccagccttgagtagccatcttcccttcatgtagctttgtagaagaacaagtgtgctcaaatggaagaaccttaatctgcatgacaagtagtgcaacacataagtaaacatcatctgaacaagaaaacaaaggaaatttgtgaagaattcacctttgcagtcttcttatcctcaatcagagatgcatgtatatatgccaagggcaaccatcagctgcacattttgcaataaaccttgtaggatctggcttcaccgaacctttagcaaattcaaaacctttcacgatggcataatgccttacagcttttctgagagctatcatgtcagggaacaaagcatctttgacaatgtttggattctcagggtcatgaatgatgttataaatctgaggatcatgatctgtaatctgtgcctcaggagctgccatagcactagcactagcaccattctctccactctgagcagtagctgcagccccctgaggttcagatccaggttgaccttgctgtttagatgcaggaacatatatgtgctcatcatcaacaccaatatactcctcttcattgtcaaagatatctgcctctctaacttctgcttcctctgttgtaggatggtcagaacctccaacagtagggatgtcagcagggatttcatgagggatgtcagcagggaattgaggagggatttcaggatggatttcagcagggatttcaggaggcaccacacatataggatttaaagcatttatagcaaatggcacaccctttgcagcatccaggatggatacaataagctcaaagtggctctcttctacatacatttcaaacaactctggaatctggccatcctccaacagtctcacatcctcaccaattaacttatgaaaataccatatggcaggagactaatttgggcaacaagttaactcaacacttaggctactcaacacaaactcaatgttaaagctatctgattccacaacccattgatgagttgacccttttgtgtaaattttcctaccagcagcatctattgtcacatagccttgaaccctaacgtctaccgaaaaccagttcctaccaaacaaatcaccacacatgaagaataatgcaagccaaagatgcatgatgcagaaaaaagatgctttgcctcccaacattacagctttcaattgatttagggttagggatactcacggcctcgaacagattgttggattggatttgcctacatccatctcctcgccatctcgcccaggggtccgcgggggggtggttgtcgccatcacacttcctctgccaaggcctactagcggcgcatctctcccgcttgaatcctcgccttcaccgccgccacaaatgccgccgccagccagatctggagcgcgaatagggaggaatggagtggggaatggatggggctagggtttcgactgggaatagagtgagcaagccaacgggtcgagctgaaacaggccagatttagagcgtgtctgaaaggggcatttctgtccatacggatatacgtatccgatactacgcgtccaaacacgggagacgaccaaattatggcatggatcaagattcacatcaatacggatggcacgcttcgaaataggtgatttgtaatggaatttctctaatttgacacaattgtaatggcatggatccaattaacccttctttatttgccattaatcatatatagggttaaaccggttaatccaggaacttggcacgacgacaagcggaaaggcagttgcaggaatgaaggatgaagggtagctagcagcctaggaaaaagaattgcgaatatacttattatttttaataactttacgtatatacttgcacggtaagactttgcataaatatatctatcccacagggtgaaaacacgagaccgaatgtatgccgcaacgcaaaatcgcggaaccaacggtctcgcgggatggtcgcgcggcaccggccgtggcatgcgtagggtgggcatatataatgctgtttgacactgtttagcacaatagagacaccgactttgctactgttcacagagctggttccgtgcaatggaattgcgggaccgtgttggtgtcacgtttttgagccacgggaccgtctcggtgccgtgcgctaccgttggccaccacggtggcgcgtttttgagccgggggaccgccgcggtgtcgcgcgacaattctacagtaccgcgtgaccatcccgtgtgatcgtcggtcccgtgttttttgctgcaactaacatttagtctctcgtccttaccccgtgggacgggtatatttatgaaaattcttcccgtgcaggtatataaacataaattattaaaaaataagtatattcataatttttttagaagcctagcacccattgaagacagttggaaatgatttacattctcatcagttcataattcgcaaagtataacacgaacaacttgttttttcctggttttcttgctaagacgattgtgagctcaaacgagtcgagttggcccattatcgacgatacaacaagtgagggatgaaaatgggacaaaaggaaaattgaggtgaaacgcaaacaatgaaagaattgaatttgtaaattttgttagagaaaagagggaactatgaccaattgactgcacacggtggcatgtcagtgccacaacaacaatactatagttgggaaagtgtttttctttaaaatatcatcactcggagattgaatagctcgagttaagcttgtatgaactgtccatcatgctgattgctgagctccttgatgaacccgacgagccgctcgaactccgccgccgacgagccgccatcggcgacgtcctgcctcacctcgcgcgccagcgcctgcgccgacgccctgatctcgccggactccatcgcctccctcaccatcctctccacgacggcggcgtcgcacacgtccttcatgtccagccccgtcccccacacggcgccgacgaaccggctgttgatctgctggtcggcgaagaacggccagcacaccgtcggcacgccctcgccggcggcctccagcgtcgagttccacccggcgtgcgtcaggaagcaccccacggcgcggtggcgcagcacgtcccgctgcggcgcccaccccacgacgcgcgccttgttgttcttctccgccgccgcgacggcttcgcggagggcgccggcgctctgactcgccccgaccatgtccggccggagcacccagaggaatgggtagccggcggcgacgagcccgtggaggaactccgtgaactgctccagcgagatgacggcgaagctgcctaggctcacgtacacgactgatcggtccggctgcccgtcgagccacgccacgcagccgtcgtccgcgcgccacaggctgcccgcggccgccggcaccgggaacatggcgtggagagggccgatggcgaagacgtcgcgcatgcgcggcgcgacgtgcgcgagcgctggcccctccatggacgcggccgtgttgagcacgaccgcccgcgccccgcggctgtgcgcggtgacctcgatgagcatctgcacgatggggtcgttctggtcctcggtgcagttccggaagttgccaggaagatctcgccggcgcaggaagctctccatgcccggaacgccgcgcaccggctcgtcgaggtcgccgtcggccgggaacaggacgacctcaccgagctcgaacagcctgtcgactgacaagtaggccagtacgctgcacgcgctggccgtgcggaagaccagcgacgggacgccgatctcctcggcgacgtcggcggcgaacggcatgctgccgtcggcgacgacgcaggtcaccggagggaagccgccggaggaggcgccgtcgtcccctgcgcgtacgagcgaagcgagcaaggagcggtacgggacgctgccgttggtccgcagcgactcgaggagctccacgatgtcgccgacggcgcgcgggtggtcgtcggggaggccgtcggggatggacatgaaccggagccgcggcgagtcggcgccgccggcggccgcggcgccaccgaggcggcggaggctgtggtcggtgtggaggaaggtgacgtgaagaccggcgccgacgaggccggtggcgaagtgcatcatgcagttgatgtggccctgcccgggcgccgggaagacgagcacgtgcgccgccgccgctgccgccgccatgttcgtccgctcgcgcggcgggcgtctcactcacggcactgcgctctcgtccaacctgacccgtcgtttccttgtaggcgcctaggcgatctcatctatggccatttggccaatggttggttctacggacaagttgctgaaaaaaaatggtattagtagaaaattttggacgagtctctagacagcaaatttcactgggcgtattaaaaacgaaattgctatgcttccaacttggattgggattcggtgacattgctccggtgacattcccgtgacattgagtcactaacgtgtgggactcctgtcaccgagaatgtcacgggggaatgtcactaaatctgcgtcggtccaactcatactataacttatatccggttagtgtatatataggcataaatactacttgtttgggtccagatgacaagaaacaagctcagtgagtcgaatggctcggtcatacgtatagcaagattctattaaaaactgccgtaacctttctgagtgattcaaagtctagaagtttaatttattgtgtgatctagagaaggtgttggtactatttataactgactttaatttgtttattttatttctccctacgtagatcgagttcagacttcagattctgtggcaggtgctcacaatacaaatgtaacttgcggttgctgccatttgccaactggcggcaataggtccatctcgccttcccttaccctctcttcttcccacactctcaatttcacatcaagacggtgatcccgagactgtgaaggacagtaagggtattcttatcttttttatgtctattgtgtatatttatatgggattcggatcaggtgcagtcactactgtgactgtaactttagcagtatccatcatccaaccatccagcacacaagggatggtttagattcgttgtttaatttccccccagctattcaactactctctgactcgagcagatgtgttttggagggaaaagtctgagagggaagtaagaattggcgccaattctaccatgggaagcatactttacctcctactgccgcacatcacacgcaattaatttggatattatctttttttccctagggttctattaatgttgaagatgtcatcttatcttaaaagttcatttgaagaggtcaatagaacttagaaggcatcgtgctgattttggaagcagacgatgatctacttttggatcatgaaaatttttgtaactgggttaatctagcagtagcatagctagttgattttgaaagcttttgtgtcagtggatgcatgacacccaatttaagcgaaaatagttagggtgtgtttagttcacgaaaagaaaatttttgagtgtcacatcggacatttgaccatatatcggaaggggttttcggacacgaatgaaaaaattaatttcataactcacctgaaaaccgtgagacgaatttattaagcctaattaattcgtgattagcacatatgggttactgtagctgtcggtgacatgggatcaggagtatcatgactagaggtttgaggcagacgcaatcgcccacgtggcctggcaccctcgggggacgtcgggcccgagggtgatgtgttcgacctcctcttagtccccccgagggggtcggaccgcacccgcctcggccccgagggccgaggcgccccgacccctcgtgggttttttctccgcgtgtatgggttaggtgagcacagcggggctcacctaaccacatttattgcggtttggctgagcgtgtcacgccgcatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctggttagatatatgccaggcttcatcctaaccattacaggcaagatgttgtgtgaagaagggccaacatgtagattgctaaactgacacgtggtggacaagaatgagcgatttgtgaccagtctgacactggtcatgtcgtcagcagacagccataatcccacgtcgcacctgcttccggcggaagtggaggtaggtatgggccgtcttatcagaaggtcattcggacggcaactatacaaatctccgtccatttatgaaaagggagggtaagtccccacagaaaagagggagatggtgcatgtggtatccccttaagatataaaaggaggaccttgcccacttagaggggggactggactggactggactggactttccgggattcggaacccagaacaagggagaggctggctcatactttgtagctccttcagacacagatccaccaaaaacacaggagtagggtattacgcttctcagcggcccgaacctgtatacatcgcccgtgtcttgtgctctttcgattgtcgcaatccttccacacatcaagagcttagaatttcacccagagtccccggccgaaccggcaaaggggggcctgcgcggtctcccggtgaggagccacaagctccgtcatctggcgcgccaggtagggggctcagcgtgtgtcttctgagctctcgcactcttccgtgtgcgccaagcttttcctgttcagcctgatggccgagcaagcaaaggcgcatgacctctctccgagtgtgagtggcgacgacggggagccgaacccacgccgtcgagctcgtactccaccgccccctccacgccaaagtcctaagcggggggaggcgcttgagagggtcgaaagatccgcgacttcaccgatcgcgggcgatggagaagaacggcgagatggggagcgtcgcctcctcgtctacggcgacggcagcacgccccagggcgcgctccaagctgcgggcgcgctcttacgtcacccgcctgtcgtcctgacccggagtctccagcccaacgatggctggacgacgtggccaaattagtcatgacggcacggcagcgcctagatgctggtgggcggtcctccgccaccaaggcctctggtgctgctaccaccggctccgcgtcgtcaagacggagggcacgacgagcggcagccgctgttcgccattcggccgccactccttcgtcgactccttcgatccgggaagatctgcgtggggggccggacgcccgcaccagcatcgagcgccggcgtaatgaccgaagtgctgcccacgcaacggagggcgcttcctcgtccagagtgtcacctcaacacggacgcgggaatcagccctccgtgcccccggttggtggtgtcggctgtagagcctttgtggcgagtcttcggaatgtccgttggcccccaaggttccggcccaccatcgccgaaaaatatgatggcagcgtcaaccccgccgagtttctccaggtctacacgaccgggattgaggccgccgggggtgacgacagggtcatggcgaatttctttcccatggccctgaaggggcaggcgcggggttggctaatgaacttgccacccgcgtcagtccactcctgggaggatttgtgccaacagttcaccatgaactttcagggcacatatccgcgcccaggtgaagaagcggacttacacgcagtacagcgaagggatgatgagtcacttcgctcgtacattcagcggttctgtcaaatccgcaacaccataccatgcatccctgcacacgcggtaatctacgcgttcagggggggcgtgcggcacaaccgcatgctcgaaaagatcgcctccaaggagccccagactaccgcggagctttttcagctcgcggaccgagtggctcgcaaggaggaggcctggacttggaacccctccggttccggtgtggcagcttcggccgcccccggatccgccgctcagacagggcggcgtgacaggaggaggaagaagaggtcagtccatttcgacgacgagggtcatgtcctcgccgtcgagggcgcttcgcgggccacccaaaaggacaggcctgcgagcgacaaaaagaaaaaggccggcgctcccagcagggagcgcccagccggcaagtggtgcaccgtccacaacacctccctccacgacctcgtggactgtcgcgcagtcaaaagtttggcagagcgaacgaggaagtgggaggaggagaggaggcaggagcgccgtgagggcaggtccccggcggttccctccggtaatcggcgaagtgaggccaagcagaaggcccccgccgaggacatcgatgatggcgatgaggacctaggtttccaagagcctggggccaccattgccaccgtcgatgggggagcgtgtgctcacgtttctcgccggagcttcaaggctatgaagcgagagcttctggccgcggcccctactcatgaggcgacgcgtcgggcgcggtggtcggaggttgccctcaccttcgaccagaccgaccacccaccgtgcgttgcccggggagggcagattgcgatggtggtttcccccaccgtttgcaacgtgaagttggggcgtgtcctcattgatgggggagcggccctcaacatcctttcccccgcggcctatgacgccatcaaggccccggggatggtgctccggccgtctcaaccgattatcggtgtgatgccggggcacacatggccgttaggtcacatcgacctgccggtcaccttcggtggatccgccaatttccgcacggagcgggtgaacttcgatgtggcggacctcagtctgccctacaacgcggtcctggggaggcctgcgttggtgaagttcatggcggcggtccactacgcctacctacagatgaagatgccgggccccggttgccccatctctgtccatggtgacctcaaagtcgcgcttgcttgcatggagcagcgcgcagaccatctcgccgccgcgtccaagcccgagggtggcgatgagaggcttggcgcctccgcccccgccaccccgaggcagcagatgatcacatgcgatgaggtcccggtcaaggaggtcgccctgggcgacggcccgtccaagaccacacggatcggtggtcttctggacggcaaataggaagacgcgctcgtctccttcctgcgggcaaatgctgacgtcttcgcatggagaccggcggatatgcccggggtccccagggaggtgattgagcaccgtctcgccatgcggtcgggcgcaaggccggtccggcagaaagtgcgacggcaggccccggaacgtcaagccttcatccgcgaggaggtggcgcgacttctggaggccggattcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatactctggttaccatcagattcgcatggctagggaggatgaggaaaaaactgcgttcattacccccataggaacctattgttatacaacaatgcccttcgggttaaagaatgcaggtcctacttttcaacgtactactcgaatttctttgggtagccaattaggacgtaatgttgaggcttatgtcgatgacttggttgtaaagacgcacaaccaggaaacgttactcacagatctagcggaaacttttgagagtctccgctccgcccgcataaaactaaaccccgataagtgtgtgttcggtgtacctgcgggcaagcttctcgggttcttggtctctgcccgaggcattgaggccaaccccgagaagatacgggctatagagcggatgcgcccccccagcaaacttagggatgtgcaatgcgtcaccggttgcatggccgccctaagtcggttcatatcgaggctgggagagaaggcgttacccttatttaagcttctcaaacgctccggaccgtttacctggacggaggaagctgaaaatgccctcacccagttgaaggcgtatctaagctctcccccagttctggtcgccccggagccagacgagcccttgctactctacttagcggcgaccccgcaagtagttagtgtggcattggttgtggagcgcgatgaggacaattctcatttcgcgcttccccaccctgtgccgacttggcccgggagagagcagggaggagaggcccccgagccgaacggtggcccaaggcccccgacgattggagttggccctctgcccgcttgtcagaccgtgctaggagcccccgacccccaggaaggccctgaggccactgtgggaaggccgcacctatcgccctttgaccccgaggctaaccctgtgctgactcgacccgggaaagagaagggagaagaggcccccgagccgaacggaggcctaaggccccagacgaccggagttggccctttgcccgcttgtctgacgacgccaggagcccccgacccccaggacggccccaaagccactgtgggaaggccgcccctgttatcctccgaccccgaggtcatcagcacagaagacaagtgcgccccgcgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctgatggcctcgaggaaactgcgccattatttccaggcgcatcgggtcactgtggttacgtcttaccccctcggtcaaatcttgcataatcgagagggtacaggacgggtggtgaaatgggcaatcgaactttctgagttcgatttgcactttgaaccacgccatgctatcaagagccaggccctcgtcgattttgtggcagagtggaccccggctcccaagcccgtctcaatccccgaggccagcacggacccctcgcagctgcctcacaccgcccacttggtaatgcagttcgacggctccctgtctcttcagggcgccggtgcgggggtcacgttgacctctccgagcggagacgtcctcagatatttggtccgcctcgactttcgagcgaccaataatatggcagagtatgagggactccttgccggactcagagtggcagctggactggggatcagccgcctcctggtgttaggcgactcccagctggtcgttaaccaagtctgtaaggagtaccggtgctctgacccacagatggacgcctacgtgcgccaagtacggcgtatggagcgccattttgacgggattgagcttcggcatgtgcccagatgggataacatgattgccgacgaactctcacggctcgcgtccacgcgagcccagaccccaccgggcgcctttgaagaaaggcttgcccatgtttgattttgaaatctcaatgacaataaactaaaaagggtaggcagcgggctagccgtagaagagtacagcagcaaagccgctaacggtttggcgggacttctagaaagtaaaaatgaacctaaacaataattatttttgatttttgaaattccaatgacaataaagagaggagccaccagacgagccatcccaatgacaataaagagaggaggcagtagacggaggcagcagacgggccgtagagtatagtggtagcgcttgacgagacttttaaaaatattataaaaatgaatcacaacgagatattaaactctaaacactacaaaggtctaatttttaaaggttcgggaattaaaaaaatataaaaaataaacccaatgataataatgttcgattttaaaatcacaatgacaataaagaggggagacagtggcgagctgtagaagagtattgtggaaaagccgctaactgtttggcaggactaatagaaagtaaaaaaaatgaaccacaacaacaattatgttcgatttttcaaatcccaacgacaataaagagataaggcagcgatcgagtcatagaggagtacagtggcagcgtttgatgagacttctaaaaactataaaaacgaaacccaatgagacaataaactctaaaagctataagatctaatttttaaagattccatagagaatgaatataaatagtggtagatcgagcaagcaaataaataagaggtaacttttgaaaacaataaagttaaacacagggatgataatatttgatctttcaaagtcttaagatatcgagataactatttaataaatttaagtaaaatcatatgaaaaatagataattttatatggatgatagctgtgaaattgtgcgggccacccagctagttcataaataaagaagggagcaaaatcgcgtccacgttgctctccccggggtgacacatatggcacttagcaccagctgccgccaccttcctcccttctcttccccgcgcctatcgttgcctgagtggccgtcagcaaagccggctgcctgctaggatggcagcggcggggtttcttcccccctcggtgccgctgcacggctagggaccaagacgcgctttggaggtggagagtcgccacgccgtattgatccgagcctgcatggctggatccggacagggagagactggcaagcgtccgtggaggtgctagcggggtggctagcggcggtggaggtgtggacagatgatggcggtgacagaagtagaggaaaggcggtggcaagagaggacgatggtacgtgggacagcaggcggcggccctcggcagatctagcgctccggcgctccactggcctgatccggtgccctcttccatctccggcaagggatgtcggatcccctcggtgatgacgtcaaaggaagctttggcagcggggaagagtgcgaggaggcaagcgacgggcaagaccagcgggcggaggtgccaacgctgaggaggacagcggcaagcccgtggcgatggcggcccaatgaaggcacgatagctgtggccggtagcggagatggccaccgtcgagccggacagcggcagagctcatggctacgacaatggcagcgtcgaggtcagcgacggcactgccgaggcagagaacggcacgcgaggaagtgcggggcggcggcggaggccggtgtggtgtgtgcgagaaggcgcgggtgcccatccgccggcggaggttagacggcggttggagcattggtgcgttagcgatggataagcaggctgcgaacggcaggtaaaaacctagcccggccttagccaggccggcaacgatggctttcagagcatcactcctttttttgggcattgtcgtgccatcccatgccctttagtgaggctgccgggtgaaaaaccagtctcggttctctttgagaccttgacagacagcggcggcggtgctttcgtcatttatctccttggaggcgttgtctaggcagcccccttgccgaaacctctgaaacaaccggtgcaagcttactctagattcttgaccccttgtgtcggtgcctagcttacgctactaggccacgttgcatgacctagggggaaagcggttccactcttctttatcaccttctctccctcaatcccaaagacatagatagagtagggttctgtgtcggttgtaagggttgggttttgggagatcccggctatacgtcctttgttggcctagcgccggccggcctggtgctagccttctccggggtctgtgttggtgttgtcggtgtgtgggtagtggtaatgttttctttgttctcctgattacgacattccacacttgtaatcatgtattttttttcctgatttatcaatgtgaactttgcattgtctggtgcgagttgttaaaaaaatattcataattaaaagcttgcatgtgcttagatttttaaaaatgggcctatagaatgatccaatgagaattggaaaccgtgcagctcgtatgctccacgtccgaagtattcgtccgagaagcacgcttattagctttttttattacacatgtgccctttcctagttcatattgctaccgattgttaaaaaaatagaagatgtttctgttataattttggtacgttatccgtgtttgaatcggttttaattttatgtttttgtcaaatcctttccttttttttcttacaccagagtgtccctcttatccgagacgcgtgcaaattaattgggcccgcaccttttcacacgcctcttgttgcatgcagcaatcgggcccgcccctgagcttgttttccacacatgcctttgtgcgccgctgcgattgggcccgcaacgccctcgtgcatgcaatttttcacatgcctgattgggtcacgacacccttgcgcatgcgatttgcccttgccgcatgcctgattgggactgcgtcgccctcgtctgcgatttaaaaattaaagatggttttgtcaatactatggtatactatctgtatccaattcccatcacgcataacattcattgcgaagttacgactcacgagtgaactacgatagagagtctgtgtgatgtggataccaagcgaatgaaactcgcagagtccatgtggatatgatgtacattgttgcccagatcatctgattctatttgtattacacgacacaattcctgggacatgttagcatgatttcaagttagtctttacacatgctcgtacatactaccagtgataccgctacaataatccataagaatcagttttactttcgaaaagaacatacaaccgaaataaaggatgctcaaaatcgttgattccatccgtcttcaatttctatccgacttgagataaagctggaggacaaatcgagctcatgtttgaaggcctcatttttttggcttatgttattcctataagccaaaatttaaattttagaacttaattttgaattcgtttttttgattttttttatcatactttattttacaacatttgcttttaggtcgctaagaacatgtatataaaatatttacacaaaaatagtcttttattcagaaataagtaattcggataagcatatgaataaacgaaacaatgggctatgattatttatccaccgacacatatgtacaaattaaattggctctatccattgcaacctacgggcattttttctagtaaataataaattaaagatgtctctgaattgtgacgaagaaaatatcgatcaatgtttcattcatatttccaatcagtgcctatgaataattttgcattcagtgggaaggcatcatatagataaaaatatttggtttttgattgatgattacatactggtaaattttaacttaattttatagttattctgaaccatgcaatt

SEQ ID NO: 72746 - DNA, 48512 bp, Oryza sativa
atggtggctttttcttactgaatattttattttggttgttaattctagtttgtaacattttcgacttggttgaaggaacataaagcactggtaattccctccactgtgcctttttttatcccgctgctacatgcgatgggaacatcttctcttcaattctgttattgctctaaatgagcatatttttttttattgaaaccatcaacaagagatcaatcttaaatgtaacgtttgaacctttagttggaaatacaggtttgtctagatttaactattcttttctcaggtcatacaattttgcaaagattcaaatataaagtatacaattcataatcatcataattacgatgcatatttattataaatggcttttatacgggaattcaaagtcatgcaatacacgactaagtggctagtggtaatgtatgacaatttatttagtgttatgataatattcttactcctacttatcaatgtaataaatatgttagcgctttgcctgtacaattatatataccgtcaatataattttaagctaattattataaacaataagtaaacgagagagattacagtcgcgccttcgcgcgacttaataaacttgtatagatgatctctggtgcatggtgggaggggtagagagggttaagctgtttatcgtgtcagccatgtgctgggcactgtggttgaaaagtgattaccttgttctgttttcctgtagctgtactctggacaactttgtttctctgggtaggtgtgaacttgatgtgaaattctaggggtttaccgagttgatgaagatttcaatagctaaattatgtggcttcatcattttctaaaaaaaaaagttatgtggcttcaaaatttaataattcataactgattctcttgtatagatatagaaaatcagaacagagcatgatacctacattatgtctgctagtaattgcctttgacctggttagcaatgaatgcgacgctaaccttgtttcgtacactgagataaacatcattggatacttgcagaattttaacatttactattctgaaaaggcttcacttaattccaaatgaggccttgttctttatagaactatctgtttacttctgtgtttgtaccactaagtctgcatcgaaattctacataataatagtttctaatgtgtgggaatttatctcattgtaaaattagatttaattttcagctagagttaaaagaacttttttttttgactcctctgtatgattcacaacattccataatcgcagagtgaatatttgcttatagtatgatcagcccctagataaagagagtaaagaactatgcacacggtaagtcggtaatagtaccatctagcaatcctataaaccaaaaccaaataaaaaaggttacttgaacactcgatcactagatgttttgttattagacaatatatataagctcccgagcagctcgggagcataggtattctctaagccgggaaaatttattcatcggttattaaagtttcttagttcctccggtatgcttcttggtgacccctggtcgacccctcctccttcccggcgccggagctcgggatcgagtggctgcttggtcctcgtcgtcggtgatccagtactcggcatagcctttctcattgtactccttgcgaatcctctcctgctcctccaggatgggtttcgcgccctcgtcatgtatcttgttctttctagcccagtagtcgtccagctgatcgacgggcacggggaaacaagccagtagctccttggagaagttcttgtatccaggtggcatggtgaggggcctgtgcttgtacgacatgattctgtccacctcgtgctgtggcatcctcaccttcttcatcttcttctccttttgcttcttcttcgtctcttctccggccgccgctgccgacgccttcttttctccagccgtctccgtcgctgccggcgagattacgcccttctcttcctcttctgcaaccgccttctccttcgattcctccgaggaactcgccatggtccgccgcgatgtcacggtagtaactgcaatttgcaattggtagtgttggttttagattggggggagaagcctgccgggtgcaaggattttatatcgctataagcagatcgatcgacccggttcgccatcggaatcggcgagagaacaacggcaccgaatcgaagtcccattgccatgaatagacctcttaccaaccgacaaaagaatcaaccaccaacaatcaatcgtatcagggcaagagtaggagaaggaaagtacctcgagtcagtcacggatgagcgacggcggtggtgggggaggcgccgccggagaaccaaggtaggagacgggagaattttttttatttataattttttttattaaaagttttacaaaaataatttttcattttgaaaattgacggaagtagtcgcctaccgccctctgggaaaaatcgccctctcgggcgacggccgtcaacgaaatttgcaggcggccctcttgccgccctccgctagggcgagtttatactgtgcggggggccgcctgcaaatgggcggcgaggggggcatggaattttgcaggcggcccccttgccgctctccgctagggcgattttgtactgtgggggggccgcctgcaaatgggcggcgagggggcatggaattttgcaggcggcccccttgccgccctgggggagggcgattttatactgtgctctatatttttgtataaatatcaatagttatcaaatttttttatattgaaaactatacaagattaaaatctccaagactggtaaaatacaattttattattttttagggcatatttggattgttaccgtacaaatattttgttagtgccaaaatataagcaagttttggcactaccaaatatttggtaaggtaaaattgcatttgatcatatttggtttgctgccaaaatgtaaaattatagtgaagaatgttctacataatctcaaatctagattacgtattaccaatgaataggcttccattttcgtgtgtggtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgatagctcgagctgccgcttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggctccagtaccgaagatcccggctgcaaatcctgctggacaaggaccatcagtttcgtacaagtatttaacagtagtaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgcagttaaaacatggtgacatattcgtgcaaaagccaaaacaaaaatgaactaatatctgggctgaactgtaccgtgcgaaaccggtgctgtaggtcgcactgctccgaagctaggggcgctcgaaggcaaacgaggtcctacgaggatggaacatcaagttacgacggggtgatgttttcgtagaaaaacagaaacaaaacttaagaaacctctgggctgagcagtaccgtgcgaaacaggtgccgtaggtcgaggtcctgctccgacggaaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaagtaatacaaattggacgtaccgccacgaagtagtctcggtcacggtgcgtgggatatgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgatgctgcaataaacatgatcggaattagacatgttatgtgaagaaaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtattcgtgcacgcctcacagagggcacggtacgtggctgctagcacggcagaaccccagctccactgcggcacgtcctgtggctgagcatccgcgatggaccgtgcgtagtggaccagccagaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacactcatccggtcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgttaatcccacggttcaacagcgccggtgtgtcgtacgccatacctgcatcaaataggttggtcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaacattgaattgaaattacacgatagaagtatttagtccgaacactcattacatcacaacagcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcaggcatttcttgtaagtatggccacgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtaccttgagcaacaactcgatgtctccgtgcctttttgattttatcttccatgtactttgtcactacgttgccaaacactatgttgttatcggccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagacaacttctccttaggctcattctcaatccactgagtgaaatttctgatggacgaccctgacctccttctcattgttggtgggtcatcatgtaatgcaccaagaggtatgggaggctcgtcaccttcaactagtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttaccatcacacccaattgctgtcaatatctgtgtcggtgacatgggaccgggagtatcatgactagaggcttgaggcagacacaatcgcccacgtggcctggcaccctcgggggacgtcgggcccgagggtgatgtgtgcgcccacctcttggtctccccgaggggggggtcggaccactcctgcctcgcccccgagggccgaggcgccccgacccctcgcgggttctactccgcgtgtatgggttaggtgagcacagcggggctcacctaaccgcatttattgcgcctcggctaaaacgtgtcacactgcacgaagtgcagcgcagagcactcgtttatccggtctgtgaccagtcacagaccggtcagatcacgggttaggtggcgacaggcggtctgacgcacgcttcgccccatcccgtcaagacgagagcttctaggcactcgtccccggctggagctagcgtgttacatcctagagatgacacgttagccccggtcagatacgtgccaggcttcatcctaaccattacaagcaagatgttgtgtgaagaagggcaaacatgcacgttgctaagctgacgcgtggtggacaagaatgaccgatttgtgaccggtctgacactgctcatgtcgtcagcagacagccacattcccacgacgcgcctgcccccggcggaagtggaggtaggtgtgtgccgtcccgtcagaaggatgttcggaggacaaccgtgcaaatctccgtccatttatgaagagaagaaaagtccagtttggaaggagggggtgcatgtggtatccccttgaaatataaaaggaggaccttgcccatagagaaggggaacgatcttttccagattcggaacctagaactagggagaggttggctcacactttgtagctccttcatacacagatccaccaaaacacaggagtagggtattacgcttctcagcggcccgaacctgtatacatcgcttgtgcttcatgctcttttgagaggtcgcgatctttccacatacacagagagcttgggatctcaccctgagcccccggccgaaccggcaaaggggggcctgtgcggtctcccggtgaggagccccgcgctccgtcaatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtacgtattattattcctctgggcaatggtggctaataaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatacgaatcttccctctccatttcatcaacaattataccaactctctccccctcatccgccatgcccatagcctgctcctcccttggttgattttcctcattttgcatcgatggtccaacaacatcccctgcattgataggaccctctatatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctccccttctgctgccctcccctctctctctttcgttttttttggatttttagtgaatataatgaaatttcacagaggagggactgggctttataggggggaggcaaaaatcgccctcccccagggcggcaagggggccgcctgcaaaattccatgccccctcgccgcccatttgcaggcggccccccccacagtacaaaatcgccctccccagggcggcaagggggccgcctgcaaaattccatgccccccctcgccgcccatttgcaggcggccccctgcacagtataaaatcgtcctagcggagggcggcaagggggccgcctgcaaatttcgttgacggccgtcgcccgagagcgaacggccgtctgccacgtcattttagccgccctctgagagggcgatttttaaaaatcgtcctcccagagggcggtaggcgactacttccgttaattttcaaaatggaaaattatttttgtaaaacttttaataaaaaaaattcggagacgggaagcctctcccgtgtgtatttatcctcaaaatttgggcctgacctagagatgtggtctttcgcggcaggctgggcccaaagaagaaaggtggtggagaaggccacgcaaggaataagtccacttcacatcctttatttttccgtcgatttaattcgctgaaccgtaataccggaaatctggatctcgcccttcgacttgtaaaaaccgggttatcacacaccttcagccctcaaaatcggatttgctgatcctgtgacagccaaatgtgatttggccggcaagattcggcacatcaccaagcctccaattgtcagttccaaccgatagatatatgggtcaattggatccatcccattataaatttgcacgtttaaaaaaagtcattactattcatttattagtaaccatgcatctgcaactaggcctgcaacactctcaaaattgattccatcccatcctgtacactatatacacattttaaatcattttagaatatcaagtgtatcaagtgtacaattaatactccgctttgtctgctctggccgcccactgctgctgccgctatgtgggaagaacgaaagagaggaaaaaagagaaaaaggaagaaagaaaagagaaaggaataagatgatgctggcatgtggacatcatttttttccttctcacgtacatgtggacctcacatatttatttatttatttatttattgctaactagaatgccatgtcaacgaaaccaggcatattatacgtcttgggaccttttttggacagtcttacatagtttagtagtatacatttatgatattacggttagggcatctcaaacagacttggcgtacaatttgagggacgctaggtgaacttattccttaatccgagccctaaaaatggccataaagggagccggttagcccagttactccagtccaggcaagtgacggtggcaggatgtaagtggcccaacatacgtttctcgctgaatggccttatcctcctctaccaaaaagaaaaaaacttctgtacctaaatccggtatgttgatcatctaaaagaacgctttgatgatcccatgagagcaagtctaataggacagcccactactagctccaattcatctatagctaatcaaatagtcaattcatataatagttgcttgctatactattaatatatggtcccacatgtcatacacacagtgtatcttggagtctgtgctgcagctggctacagatctgtagcccgctgctcttctctctcatcgtttatctcattaaaatatgtttagagctggctaatagcttagcctgctattgtacctgctctgacagtgcaaatgtgatttttttttgggagaacagtgcaaatgtgatttggccggccagaaccgggacagaaccaagccaccaatttgtcagttccaaccgatcgatgatactcctatgtcgtacctcaaccgtaacctggacctgagaccacatgatcgtatcgcccacaatccaatagaaaatacacaacgctagtactccgtattacctaccgcctggcgcctggagcgcctgaacaatttcctacgcgtttcgccgcgcatgggagcagatcacgcgcgcggtgtgccggtgtgcgtccagttggcatccggccaccgtcttcaatccggtggttggggccggccggtcggccaggcgccccgggttgggttgccgctgcatgtccccgttagaacaagtataatagtaggctataagccggctaaatgctgatgtggaggagagaagagagaggagaaacgggctgtaaacttacagcaggctcggacacaagaaactctatgagagaggtaagtggaccctatattaattgtaaagagttatctattatatgggtagattgagagaagactataaaaaatcttatagccaacatatcggctatattattaaccttgatcttaggccggtggatgccctaacggctcttgccgttgccgcagtggccggaaatggaacgcagatgcgcgtcgcgttactcgctttccgcttgctgcgcgcagcgcgagaaaaaagcacacgaccagaattccacaaaaccgtgtcccactctcagtctccccaccttttgtcgtgtctccccatcttcacttgttttctcgccaaatcctacgtgagtcgctctctcgagcagtcgagcgcgcacagggcgccccgctgtcctccgcgcatcgccagcccacgcccccgcgaacctgacacgaacatgcgcctcgccactgcagcctgcactgtactacacccctcatcctcctcgatcaattcgtacacactctcccaaccacctccgtcaccctcacgcttaactcctaccccacgcccagcaaaaacatcgtctatggctgtgtttagttggggaaaaggaaatttttgggtgtcacatcagacgtttgaccggatgtcagaaggggttttcggacacgaatgaaaaaactaatttcagaactcgcctggaaaccgcgagacgaatcttttgagcctacttaagccgtcattagcacatgtgggttactgtagcacttatggctaatcatggcctaattagtctcaaaagattcgtctcgcgatttatagctaaactgtgcaattggtttttctttttgtccacatttaatgctccatgcatatgtccaaagattcgatgtgataggtgaaggggaaaatttttgagaactaaactggccctatataaaccctgcgaggcacgcaccgatcgatcactacaccttcactttctcttctcatcatctatatcacgatcgatcacaaagaggttaacagtaacacatggggttcggctcgagggagatggcctgcgcgctcgtggcgctggtgctcgggctctgctgcgtcggcggcgcacgggcgacggggaggatcgacgaggggctggaggtgatgtggggcgacggccgggggagcgtctcgccggacgggcaggtgatggcgctgtcgctcgaccacacctccggctccgggtggaggtccaagaacacgtacctgttcgcgcgcgtcgacctgcagatcaagctcgtcgccaacaactccgccggcacggtcaccacctgctacgtaagccagcactcgcactgacacattctttgtgtgatcggatcttttttttttcttggctcgtgttcgagctcacgtacggtggattccatgcagttcatgtcggaaggggagtgggatatccacgatgaggtggacctggagttcctcggcaacgtcaccgggcagccgtacacgctgcacaccaacgtcttcgccaatggcaccggcggcaaagagcagcagttccacctctggttcgaccccaccaccgacttccacacctactccatcgtctggacctcgcagcacatcctgtaagctcatgcaattcactcatcaaccaaatgcacattctcagtttataatcactcactcgctcgccgccatggatgccgatcgagctgacaaataatgtatacgtttatcgcagtgtgctggtggacgggacgccgatccgggagatgaagaaccacgcggacaaggggatcgcctacccgtcgtcgcagcggatgcggctgtacgggagcctgtggaacgccgacgactgggccacgcagggcgggcgcgtcaagacggactggtcgcaggcgccgttcgtcgcgcggtaccgcaacttcaccgccacggaagccgcgtcgtcgtcgtcgccggcagggtacgaccagcagatggacgccacggcgcagcaggcgatgaagtgggcgcgcgacaactacatggtgtacgactactgcgccgacagcaagcggttcccgcagggcttcccgcccgagtgctccatgccgtagagtggagtggagacgcgccaaagcctcggtgcactttgatgaacgcggactcgatcgaactcacgcagggcacgcattgacctcgtttttttatttttacttctcttgattgaattgattcattctttctatgtaaagtagatatatatatatatatatatatatatatatatatatatatatatatatatatatatatatatatatagatacaaatagttggcattggacccacgagcagctcgcgcgagggagcgcgtacgcacacgtacgcccacagagcatggagcgccgaggggcgcgtccgtgtatggacgcgcccgcgcctccacgaaacatggactcgcgcgcgcacactggctcaggctgagagaggaagaggtagtgactttacgtgcttgcaattctgccaactcatacgagtaaaacgggctcatgtttcgtaagacgttatgacgtcagaagggtctgaattatatcggcaatgaaaactcaacagcctggatcgaaacacgcaggagactaatggagatgatgcctcaattgctgctgttacttgcgtttcgatcagagcagaattgtagaaacactcaaacagagcatcccagtgaacggcgttacggcaggtcaggccgaaatacagagcacagctcagacttggctgccccaacgcgtttcctgtggaccaggcaggacatctagcttacgagcccatgtaggatatggcccagccggccggtggcccatccaaaatcccaaattagaacagtgcagaacatgatcgtcgagtttacgcttcttacagttttttgtctcgaccgtgtctgctctaagtcggcagagtatgccgcaagctcgctaccagtgtattttttatctccaaaattactatctaacgaacatgggttttgggtgtacacttcgtgcggaagttttttatatgaagtttttagaaagaaactttttaaattaaggttttcggagaaaagttttaagagatacacatgtgtgctaagtagcaatctccgctcttctctcagttactttttctagcatcaagcatcagaagcaacactcagtcagattaatccaatcatttacactttagatgcattatcataaacaaatctagaaactaaaaaagaaatccatctcgtcgattaccaatcctagatacaattggactgcattatctcctggcagtagaccaaggacccgttccacttcgatgaagataaagatttttcagcgcacgattactcaagcattaattgttataaacttaaaaaatatatttattaatattttaaagaaacgtttatatagaacatttttacatgaaatatattatttagcaatttaaaaaatatgctaacaaaaaccaatgtaaaatctgtatataaaaaacgaacggatcctgactagctgtgtaggactacgcactgcatatgtatcgtgtgcaatgcggctcaacttctctaaagtatctacaatactatctccgtttcaatttataaaactttctagccactactagaaaatgcattttttccaacgtgggggtctttttttcgcaggcggacatgactcttggagcaaaataaccgcctacaaaaatataaatcaaggtgaagttcgttgtcgccctgcgaaaaatataaatatattttcacaggcagaccacttaagcgacgcttgtgaaaatcattttcgcattgcaaaaatcgtacctaccctaaaaaaatataagtcttatcttctcatccaccccctccccaccactcatttccctcaacacttctccaatccctcccctcccctccctccctccaccggcggcagcgtggacggctcgacggcggcggcggcgacgacggcgcgcgcggggcggcggcgatgcacgtgggggcggcggcgaggcgtgtggcactatttttgtttgtttgtttattggattttcgcaggcgagccatggccccaactgcgaaaatcgcagtcgttgggctgcagtcggtccttccccgtgccagtaaaatatacttttggccgcctgtaaaaatgctttttctagtagtgagcattgcccatatttatatatatgttaatgaatctagacatatatgtgtgcctagattcattaacatttatatgaactagcaaaatgcccgtgcttcgctacggtgactaaaactaaaactatttgtttttaaccaaagttatttccacactactttggtacttttgctcgctagaaaaagtcttaaatgacagagagaaatatagtagctcataataaattatttttcaaaaaaaaaaaatcgaagaaagggagataaaaaagacaaagccggcttgatttccacctttacacggtccaagttaacatggactctgaagatatgggtagatctaccgggtcgctcagcagcacgattggccagcgagcaacctcagaccaatcgacgaccgtagcaccgtaggtagcagccgtgtctggccttctgcgacagcgatgactatgagtctgtgctattattatttcaatatttcttatttttaattatggccttcgtccgtcttgtgatgaagagaaagttacgaatcttttaattaggtaagattaagatatagaattaaacttcttttctttggtcgagggacctagaacatactttttcccggcctggccggtcagcccacgacctcttatacgcacgtgcgggcgctccccccaccctgggccacaacctgggcctgggccggggaagccaccctgtgcgcgcctccacttgggccggtgtcggttgtccgatcgtagggtttcgatcggacagccgggtgctgacgtcggatggacaaaaccccatccctctcggctgtcggcgaaaaccctagtttctcctcctctccctctcgcctccctcccgtagtggatacaacggcggtggtagagggttggaggtggtcgcgggcgaatccagggtggtggcggtggctctctccaccctctcttgcctccctcccgcaccagatctggcgtggtggcggcggccgcgggcagatccggcagcagcggctccctctgccccctcttgtctccctccagcggcagatccggcggcagccgcgagtggatctggcggcggtggtggcgtcggcgacggtcgcgggtggatttggcagcgtggtgccagtcgagggtggatccggcggcagtcggcggtggtggtgtcaacaacggccgctggtggatccggcggcggccgagggtggatccggcggcagttagctatggtggcatcgatgacggccacgagtggattcggcggcggctgatggcagatccggcggcattccgcggtaggggagtgaaagttatgtgattatgttgttgttgttgttcttggatgtgaatgtgaataatgtgatgtttgatgttcttggatgattattatgtgattttgtgttgattgtggttgattttgggggcaaagagtggttgattttttttttggcaaagcgggaaaattgcgtgggcaaagaaaaatcacgcggacggactaaatcggattgtgaaaaaatcgcgcggacggacaaaataaactgtgatgaaagaaaaattatgaatattttaattagttaagattggatggctagatgacaaatccgacctcaccttctgccatcgatcgctaggcaagaagctaagctagctacccttccaaacaagagagagcttgtttgaagtaaaccgaagggcatgttatatgcgctggttttcttaaaaaaaaaacgaaaccaacaaatgtgctggtctttggagcgccgcacagcaaagaaaaatatccagcgtggaccccacctctcgaacattatctcctcgtgattctccttctctggaatcctccgtctccccgtctctcgttcgctttctccactcccagcgacggcggcatgccttctccacttcttttctcaccactcccagcaatggcggcgcaccttctccctctccgcgccttcttcactcctcacgacggctgcacgctttctctccccgcgacggcggcgcatcttctccattccccagctcgtcactcctcagcgacggcggctcgccttctctactccccgactcgtctctcccctgcggtgaaaccaacggctcaccactccccggcgacatgatggtgcggcctccacagatctggagccgcctcttccttgtctccatcacaacaccaggcacgcgtcatccccgacaccgatgccaaaggtcagtttcccccctcatcttctcccttcccccatcctctatacctctaatgtcgtcggaagcggttgtctgcagggtagcgagtggccagaattctccacggtgagcaacggccacaagtggtcttgaatttccaaatccgtgtgataaattttgtaatattgattatgtgatgtgtgatcgattatttaatgtgtatattatgtgatttgttttgttggaatcatccatttgttttatgaactttgtgattctttttctctcttttctatttattttctatggatttggagcgtttgagccgagcctgctttttttttcttttgcaaatcatatcaccaccaaagaccggttcccaaccggcaataatgtctatttttgtagtagggtagtgattgggttttgatttggattttgtttccgatttcggattgagcgattttgttctttgttcgtcgtgtgatacatgcgagggcggagggcgtcacttgggcggagggcgtcacttgtggacgaaaacgtaaaaaataggaaagttactcacgcagcgtggcgtaaacggattggcggacccgaaaattttggtgacgattaaaaaaatccaaatatttatattagttatagatatgaaagtgttaacctgaaacggaggaagtagtcactaccatataggccctagagctagtgggacccacgtgttacgatctcgttcccgtgcaatgctccggccgagcagattccatcggtcctcggtcccagcaacgctcatgtgcctggacatatggaaaagccgaaataaatggctcgggttgatcatgcatcggcctcgccgttgttgctacatgatgccggcggaacggaacaaccaccacagaatttcaggctgcgtggaaactgatggacgccgtgcaacgcgtacacttccacatgcttttgcacgctcggtgcagctcatggctctcgcgtgcccttctttttttaactgcagcacagggctaaaaacatgttaccgtcatgctgcaggcgtgattgtgagatcgagtcgtcgatccaagtttgcagtcaatgcaaagtcaggcctggtttagttttctaaaaatatcacatcgaatctttagatatatacatgaagcatttatttattatattattaaaggaatagaaaaaagagcctccacgttcgctctcatggtctagaatttctcacattaattagagaaaaagaaaatacagagtccatatagaaatacaatttagaaatagttgaaattcggaattaaaaaataaggaatattagaagaggagactagagtccatatagaaatacaattatgaaataactgaaattcagaattaaaaataaggaatattagaagtagagtatagagtcaatatagaaatacaattaggaaataactgaaattcggaattaaaaataaggaatattagaagtagagaatagagtccatatagaaatacaattaggaaataactgaaattcggaattaaaaataaggaatattagaagtagagtatagagtccatatagaaatacaattaagaaagaaaatagaaattcagaattaagaaaataaggaatattagaagtagagtatagagtccatataggaatttaaaactaactaaaatttagaataaacataataaaatcaaaagtagagtttagagtccatataaaaatacaatttacaaataacaaaaattcgaaattaagaaaaacatgggaagaagagtttaaaatcaatataggaatgcaatttagaagtaactgaaattcgaaattaaaaattagtctagagtctacatagaaatacaattagaaataataaaaattcagaaataaaaataaataatattggaagaagagcatagaatctatatagaaatacaatttatagaaaatttggaattcaaaaaaaaaagaaatactaaaaaatgagtcaatatatataatttacaaataactaaaatttgatattaaaaataattaataactaacacgtatataaaatacaatatgaatattacacattagtagttttgtaaagttattgcaaaatttaaaattatgttgtcattttaatatatttaaataatataatgagaaaacatactatatgcttttatatgagagaaaatataatgatattagccacgcaatctgcgcgggccaccatgctagttaaatataaatgaagaaaaactaattgcacagttagaggggaaatcgcgagacgaatctttaagcctaattggtccatacttagccatacgtgctacagtaacccacatgtactaatgacatattaattaggcttcaaaaatccgtctcgcggtttacatgtgagttatgaaattagtttttttattcgtgtccaaaaaccctttccgacatctgatgtgacaccaatttttttttcgtactaaacaggccggccctcagtattacgcgcacgtacgcacagagattgaagaagacagaagtctgtacggtgaacagtgtatgcacatgagcaacgctaaatgctatactgagctgcatgaaaaatactggggccgtacttctctaatctctaggattgtaagtgcatccatgtgttcagaacaattgcaggcttggcagaggcttagagctagtgatgctctactgaaacggtgaaatgtgaaaatagtattgcactctgcaatgaaatcaagacaaaatatgcagttgtgttcgtaatatgtcaacagatgtgaactaataattggagaaagcacgacaattctcggttatcgggtattccttttcttctgagagttaggccatcagaaattgggtaaaccaacctatgttaccactccatgcgaaacacagaattctgaaaaatacatggcgcagctctcccactggagtaatggacatgtgacgaacacttaatcaggtcaacttcttgcttgttttcccagctctgctcacctttagctacatactcttccatcattttctatgcctaggtcttcactagccagcccataatccaaacttctttacatcttccaagaaaccaaatatctaatgcatccatcgccgagttcgatgagatcgatctgaaagtcttttgaccctggtgctattgttctgcatatagcctgcacttgaccatggcctcactgcccctcacacacagcagtacatcactcactcactcacttcacagtttacaccaccggccggaagccatggcgccggctagggcgcaccacctcctagcctgcctgttggcttctgcgctgctcgccgccgccacgccggtgaccggcggtgggctcatgacggaccagctcgaggtactgtttggccagacgcagctgctcaacgacagcaatggcgaccagacaattgcgctgacgctagaccgcgagatggggtcggcgttcaagtccaagacctcgtacctctttgcaaggatcgacatggacatcaagctcgtcgccgacgactccgccggcaccgtcaccacgatatacgtaagtgaccatgaaacagcagctgcacctgcacagtgacatgcatgtgccaaatcgtcagttatatagttctgcattcttgagtagcttgtgatacattgcgtggtgcagttgatatccgagaaggattggaacacccacgacgagatcgacctggagttcctgggcaacgtcaccgggcaaccgtacaccctgcataccaacatctttgccaacggcgaaggcggcagggaggtgcagtaccggctctggtttgatcctacccaggatttccacacctactccgtcatctggaacccagacgagatcctgtaagctgcatttcaagatagtatgttaatggtgtaaaaataggcttgttgcgttagaaccggtaaaaaagcattgagccaaatgtgtatgccagtgtcactaaagtcggtgaattgcaggatcctggttgacaacatgccgatccggcaattcaagaaccacttggactccggcgtgccgttcccgatctaccagccgatgaggctgtttggctgcctgtgggacgccgacgactgggcgacggagggtggccgcatcaagaccgactggtcgcaggcgcctttcgtggcatacttccggaactacaccgccgacggctgcgtgccgagctcttatgcgtgggtatgcggccagggcccggccagcagcagtgactggttcgaccgggggctggacgacgtcaagcagcagcagcagctgagggaggcccaggacaagtacatgatctacaactactgcaacgaccccgagaggttccccgatggttatccaaaagagtgtgggttgcagtaggatagaggtggctcggtatgcatgtgagaagtgcgtgaaatgtaccgaatcaatattccttttttgaagattttactggaatattgagattgtttcattctttgccccgaggaggaaaaagagagcagaaagtttcagaaaaaattgaaggttttcgatttgagtgtttcggtctgaatgaaaattttcaaaagcatttggaacttttctattgttttgaaagtttttgttatgctcagacactcctcctgccccagatcagttgggtatcatgagatacctcaagaacatgggcccagaatgaagtaaactaattctgtaatgaatatatgaaaataatggtgacaaacaattcattacaggagaaaaggttgataaaactcatgacaagagttttggttcttatccattccatcagttgactgtcaatctttcatgaggacatattctagtttaggaatcctactagcacctattttcctagtcttgatagttttaggattagtctatttacaacaatttttgcagttccaatgtataatggggggggggggggtgattttgcaggtctgaacatcatttggaagaaaaggtaaaagtatgaatggcgcatgcccctgctatatatagcaaatccacaaacaacccacttccccatccgcttaccacactaagtgcatgcactcacaaatttaccttttctttgccttaacccgttttgcgcggatggccctttacttttcccctcttgtcctctctccggactctgggtcgtcgcttctctccccacaaggattttctaaatttcattgccatcaagaacacacaggcttcaggtaagagggtctatctgcatttgtgttcttttatttttcattcaatgacattttttatgttcctatgatccttttgtgttctcgggtgtaatttgttgccaactatatcataatgagcttttgttggtgtttgggtgaccattgtgatgtttgaactatgatcatatcattcatctttttcttaaaaaaaaaaacttgtttgcagttccagcatgatgttagcgtcgttttgagacaaaatcaggaaaggctctttcacaacatcaagcatgtcaatttctatgaaagatgtagatccggctttccgtggagttggacaaaaggagtatcctcactgcattctatttccaatatttattatggcttggacacttgatctcacagaaaatacattttgtgaccaaaggattattactgactcacacacaaaaaatgtcaacatatgtaatcatggatggaatgattgttaactgttcttggcaacaaaatcatccaacacaagaggctaagcataattgttcctggatagtctaaaaaaataggcaaagctggaacaaaaggctatcatgaatttataatctattgcatctataagaaaaagtagttccatagcatcatagggtgactaaaccaaacaaaaacaatgatgaagttaaagtaaataccagtcaaataaaactaaggttaagggctgctgatttatcctcacaaagttagacttggtcatcaacccccatgagaattgtagccctccactatgtcgatcagaggagtcttttgtacatgtattgtactccttaattaccttacagtggtttggaggtatggcgtattgaaaacttcaagcctgttcccgtgccaacatcttcacacggaaaattttacatgggtgattcatatatcatcttgaaggtatggtagtattcattccttgttattccttttcaacattattggtgcataatcgcaaacatagatgatgtaattcatcttgaaacaaacattacatgacattataaactattttctttctttatcttttaccacactagataatgcaatacttaagtcattttggtgaaccacatgcttcactaaccataccattgtcgtcttgatgccacaatttgtatagtatatggcttcaagtttgttcatgcattatatgcttactgcaccatgtgttttgaacctcatattcatctttcttcctatagacgacagccttgaaaaatggttcatttcgccatgatctccactactggcttggaaaggatactagtcaggtagactctcaaataatctggcagcacctcacttgacttagctctcccaagctaactattaatacacaaatgcctaatatttgaaaggacgaagctggaactgctgcaattctaactgtggagcttgatgctgcccttggagggcgtgctgtccagtacagggaagtacaaggcggtgaaactgaaaagcttctctcctattttagaccatgcatcatgccacagccaggaggggtagcttctgggttcaatcatgtagaggtcaatcagcaagatcatgttacccgcttatatgtgtgccaaggaaagcatgttgttcatgttaaagaggtaatctattgaagttgatcactgcctttgtttatgcaaaggcttgctgggttttttattcttatgctgcttgtcatacaaaccaggttccttttgttcgttcatcccttaatcacgaggacatattcattttggataccgcgaacaaaattttccagttcaatggctctaactcatgcattcaagagagagcaaaagctcttgaagttgtgcaatatatcaaagatactttccatgagggcaagtgcgaagttgcagctgttggtaagcttttttttttttgtttatgtgcttttgctttgaatattcaaagtcacatttaaagcatttgacaatctggattcctctcatagaggatggaaagttgatggccgatactgaagctggtgaattttggggtttgtttggtggttttgctcctctcccaaagaagacatcttcagaggacaatggggatgataaggaaactgtgaccaaattgctatggtaatactcaagtcaaatcactatcaatattccaatacccgcatcaagaaagtgttagttttgaatgagaataatttgcagtcaaatgatgctattttgagatcaattctcttaaaatttatgaaactgaattagtgatttctattacttcctcccagttttaaccaaggaacgctggagcatattagttttgaatctttggagcatgagttacttgagacaaacaaatgctacttgttggactgtggagctgaaatgtatgtttggatgggcagaggtacttctttgcaagtgagaaagggtgcaagtgaagctgctgaggtaatttcttattggccatatgtgtatgaaggttctgattattggaagctgatttttttttcattggtactctccattcaattatagtgttatgaaacaaaaagggaacatcaaggtagaacttggctacagcaatacaacttttgtaaaagtccattcatttccatcttacaaataaaaaaaaaactatttggcatgtattccagtactcagcaaatgtaccaccttactgatataccatgctgacttttttaaaaaatatatatattcttatgaccaaaacacaggcacatttcacatttcactttgctgtgtgtgtttctcttacttatttacagaaattgctcattgatgagaaccgaaaaggatcaaatgttatcaaagtgattgagggattcgaaacaatcatgttcaagtcaaaatttaacaagtggccgcctactcctgatttgaagctgtcatctgaggatggccgaggcaaagtggcaggtgattgcctacagactcattagttcaagcgtgaagtattgctaaaagagtatcaaatgtacacattcatcatgtatattcttactacagctctactcagaagtcaaggattggatgttaaaggattgatgaaggctgctcctgaagaagaagaaccccaaccttatattgattgcactggtcatttacaggttttttttcgatagctgttatgaatctgtattgctgtgagcaacaatccttttaaatttgtttgtctacacatcatttagggtgctagctaggttttgaagttgagacctgaagcctctcaaacgccaatgtactcatgcaaaaataaattaatagagggtaatcaacaaacactataggtgtgtttggtttggggaccaagtgggatgggttagaccaatcccagttttttaggatgggatggttccagttgtgtgtttggtttgtggtatgggatggttatagttttttgtttggtaaaaatgattgagatgggatgggatggacaatgttgcggacgaggcggcgactggtcgtggaggtgaggagaggcgaggcgaggcgcggactagtgacggcggtcggccctggaggcggtcgcggacgagccggcgaccggtcgtggaggcgaggcaaggcgcagacgagcggcggccggtccctgaggcgacgaggcgcggacgagcaacgtcggccggtcgcggaggcgaacgtggacgagcgacggcggtcagtcgcagacgaggcgccggccggtcgtgaaggcgaggcgaggtggagggagcaggcggaggaggacggagcggcaccgggggagggagcggtgccgggggagggacgggtggccgtggcggtgccgcggcggagctgagtgggaggctgtgggagctgacgacgagcggcggcggtcggtcgtggaggcggtcgcggacgaggtgacggccggtcgcggaggcggaggtcgacgcggatgaggcggcggcgctgcggcggagccgagcgggaggctacaggagctaaagccgtgggctccattgaagtgggatggattggtccggccgattttggcggaccgtttcatcttggatctgagaggaatattcctctccagggaccatcccgtcccactcacctctcaaccaaacacccctaaaagtgggttcatcccatcccatcccatcccatccttgcaaccaaacactacctatatgtatgcaaaggcatctaactaaatcatgcaatcgatctacacccctctatctttgacagtttgatgtccatccttgaactaacatttttacattgcagtcaaccaatttattttagtgaagtttgatggtgattgtacaggtctggcgagtaaatggcgatggcaagactcttctttcatcttctgatcaatcaaaactttacaccggagattgctacatttttcaatacacatacactggagatgataaggaggaatgtcttattggaacttggtttgggaagaagagtgttgaggtaatatctacgcactaactctagttatgaaaaaattgaaataaacatacacatagatttataggacatatgtgctaggaactaattaaatatttgttgtgaagtcattagcaaggactaaggataaagttagcagtctgatgctgttagctgattttttctagattgataggacaacagagaggtttgcgtaatgtggtaactgtttaacttctgtatgataaattcaagtttctgcatgtgggcgatcttaattactttcaggaggacagaacatcggcaatttcactagctagcaagatgtttcaggctgcaaaattccaggctgcccaggtaacctgtccattgtccatatatgacatattacatcacattatcactctaattcattggtgcttccatgcaggctcgcctctatgaagggaaagaaccgattcaatttttcgtcatatttcagagtcttcaagtttttaaggtttttcttctactcagtagataagtcaatatccttgagtggatctgacagagtgactgttagatatatataacaatttgacacttaatccctctccccctcacaccggctttctaatgtagggtggacttagctctggatacaagaactttattgctgtaaatggtaccgatgacgacacttacgttgaaggtgggcttgctctcttccggattcaaggctcaggatcagaaaacatgcaagcaattcaagttgatgcagtaagtgcaaaggcatctgtttggtccagacatatgcgagagcgtaattcttatattgttatcaatggtttcatctctatgatccttttttactaggtgtcttcgtcattaaattcatcctactgctacattctacacaatggaaacactgtgttcacatggactgggaaccttacaacctcactggataatgacttggttgagagacagctagatgtaattaaggtgtgaatcacttattgcggaaaatattaatctttatacccatgcagttttcctgacacttggtatgctcctatacatttaaatccttgattgaaatcttacagtaggttttcatattaattagcaaaatgcagtttgaatatcgtagaaaagaagagaaggctatatagttgatcatgatgcgaccagattataaccatgtagatttattagatacatattaactatatgagagatacaactataatttagttaattgtgaatcacttattgtggaaaatattaatctttatacccatgcagttttcctgacacttggtatgctcctatacatttaaatccttaatcgaaatcttacagtaggttttgatattaatcagcaaaatgcagtttgaatatggtagaaaagaagagaaggctatatagttgatcatgatgcgaccaaattataaccatgtagatttattagatactccctccgtccctaaatgtttgacgccgttgattttttaaaacatgtttgaccgttcgtattattcaaaaaaaattaagtaattataaattattttcctatcacttgattcattgttaaatatacttttatatatacatataattttacatatttcataaaatttttgaataagacgaatggtcaaacatatttaaaaaagtcaatggcgtcaaacatttagggatggagggagtacatattaactatataagagatacaactataattttagaaataaaagcaagaattttgcgaggcgttcatctagcttgttgtaactttatgtgcatgtggatatatacaagtctagtagttatgtatggttattggatgcttgtcatcctcacaagtcataatcattcttcttgatatcatggcttatttggcttatgttttttgcctatgttctgaaacaatcttagctttgatatacgggtaattttaccatccttgagaaggtaacaggaggtaccaccatttctggtgtaaaactgggtatctctaggtataaggtacctgggtaccaaaatttttagcgtaaaatttaggtaccttgaggtactttctcaaggaccgtaaaatttctcgtggtatacatgtccactgaacattgatacaacttcttttttgtgcttctcttttacatgatacagccagatctgccatccaggtcacaaaaggaggggagagaaaccgaccaattctgggaactcttaggtggaaaatgcaagtattcaaacaaaaaaataggaaaagaaaatgaaagcgaccctcatcttttctcatgtatcttatccaagggtaatcaaaaacaaattattgaatgttttgatatggtctacttagtgggattaccatttcaacatctattgacatttttgtttttttctgcacttcaaatgttttgctggtggggtttcatgaagaaaatctaaaggtcagaaaaaaaaactgacgcatagctttttccccccctaagcgtgctctccatgtgtctaatgccagtccttcctttgaaatctacatgatcaggtcaaggaaatacaccactttactcaggatgacctgatggcagaagatattttcgttctagactgccgcaccgacttgtttgtttgggttggacaggaggtggatgccaaattgagatcacaagcgatggacatcggtgaggtattaactaaagttacttgatccgtctattctaattagaaatcacgttttctgtttggcatcttaattcattttctcactgtaactatgctagaaatttcttctacatgatttccttatggaaaatctctcgcaagacacaccaatttttattgttacagaaggaagtgagccacagttttttactaggttcttcacttgggactcagcaaaatcgctggtaagtaattatatttagattcaagatcagtttttgttctatggtgattagatgagcgcccaaacataccccccattttggttttctcacatctactctttctttcttttttttttgtcgcagatgcatggcagttcataccagaggaagcttgcaatagtaaagggtggagcaactccatcgcttgatgtaagtctcaacatagtgctcaagtagcatattgatagaatgcggtccttattgcttgtaaaaagtcactctcttcatcatttttgctatttgttgatacttgtgattagctgtgcacatatgcatgtgataattacttggttgtaccaatgagccattgttaaactcttggtcatctgattaacaaaccaaactgccatgttgagtgtaagtttgaaatatgggttccaagtggctaacatttgatgagatttcatttttcttgtccagttgtatatatagttgcatcatttatatacagttcatgtttggtgatgtactgtcctaccaatgcctttcaaccagggaaatttggcctctgtttcaatctttggggttttacacttaatggcctctctttcaatctatattgtgatttacacttaatggcctctctttcaatccatatagattaccttacatatatatattctttatgcgttgccagaaacctaaaaggcgaacaccagcgttttcaggaaggaacgcaggacaagataaatctcagcagcgcacaagaagtatgtcccacagcccagaacgtcaccgtattcgaggaagatctccagctttcaccgcaatagcttctgcctttgagaacccaagtacccggtatctttccacccctccccctgctgtcaagaagcttttcccaagatccggagggtctgaattgccaaagacatcatccaaacaatcagctatcaatgctctcaccagtgctttcgagggtcctacgaaaagtacaatacctaagtctgtaaaaggtactctatcacctattatgctagaatacggaaggcaagtgttcagttgtcttataattttcctttatgaatttctgcaaaattaagcgagccccgaggcagagaaggcaatacaggaggaaggctcaacgatcggtgaaagtgaaaacgagccagaagatgatgagaacagcacaatctacccatatgaacgtttgaccaccacatctgatgatcctgctcctgacattgatgttaccaagcgagaggtgatcaactaatttttccacttggtattttctcctgatgttgtaagatgaacacaataatatgtactattttcaactgaatgcaggtctacttatcatcagttgagttcacagagaagtttggcatgacaagggcatcattcaaaaaccttccaaaatggaagcaaaacaggctaaagtctgatctccagctcttttagctcaactctgaggaacagccccttgtcctcgccttgaaggcatcacccatttttgagggcacgcaatttccgtgccattctcgagttcttctcttcacctattttggtctgctattgctctaggatcaccctgctctttctgcagtagcaagtaggtcttttggtagtgtttttcttttccctttattgatatagagtgctcatgaatgtttctgttgtgagcctcgcatttttgtgccgctacaaaatttttttaagaaaaggtctatttattgtctctcaactctcatcatcatctctcaactaatggggagagagcaagggcatcactattctctaattccacaaattcacaagttctactgacaacaacgccattccacagttcaacaagttcatcgatatggcacgaaattccgttgctaaacggaatagatacgcgcaggagcagaaccacaatcaaataacgcagtccacttcacgcatgcaagcaacggaaattagggtgaatagaggggatcgagttctgaccttcaaccggttggctgccgagtgccgaggcagtcctggttgcaggagttcggcggcggggcgaaggactccgatggttgcggcaacgccagcggagaagccccgggcggagaggggagctcgactcgagcgagctgcttgccgttgccgtactgacggaccgcgcccacggcacccgtgtcagaaccacaccaaaacacccccgaaatggaattgacgaacacgctctctctcagatttgtggccaccgcaagacaagaaaaactagggttctaagctaagtactagggttaatgatcttcgatagcttttccattcatcacaccgggttatatacccccaggcatctcaggttttttttacagagcagcgagtgagacagaggaagcagagtaaaagcagcgtcgcgcgcaggcgacgacaaacagaaacggtaaatagtacaacaaagcgatcacagccgtaaatgcaccatggtaatttggaatagcctcatctctaccgttcatcttcattaaacgacgtcacccaaccggtatcccactctaactctgaacttctgaatttttaactgaaacttctgaaactcttctccatttcttctctgaaatctccatctctaacaatccaatccccttgagcacgaccttgtcctcaaggtcgaaaatgtggaaacgttgcttgaataaaagcagagtcctcccaagtagcatcctcaggagatagattttcccagtgaacaagccattgagtgaccggctcatttcttcttggaactacccttcttgctagtacagcgacaggttcagtcttgatgttaccatcttcatccaccaatggaagattaggaagtggtacaaccaaatttcccacatgtttcttcagctggcttacgtggaacactggatgtattccagcttcctccggtaactgcagatggtaagccactttcccaattcttttcaggattctaaatggcccatagaactttgcacgaagcttcagtgatcccctcaagccaaaagcgttctgtctataaggttgcatctttagatacaccatgtctccctcctgaaaacttctttcagacctaagtctgtctgcaaatttcctgattcgattctgagccctcaacaagttatctttcaatctcaacatcaactcttctctctgttgagcagtgattctgatttcttcagttacatttccagggatagcttgctccccattctgaggtggatgtacaccatatagtgcttcatacggtgtgacctgtagagaggtgtgataagaagtgttataccaccactcagcagtaggcaaccacttgtgccagtctctaggttcttggaacaccatgcatctcagatatgcctccacacattgatttacccgttctgtctacccgtcagattgtggatggtaagaagtgctgaacctcaaagtagttcccatggatttgaagacattctgaaagagatcactagtgaatattttgtccctgtcgaaaacaatcaccagtggcatgccatgcaacctataaacattttccataaagatctgcacaacatcttgggtatcatagggatgagacattgcaataggcatatttggtcaacctatccaccactactaggattacatctttgccttgagactttggcagcccttcaataaaatccatagaaatatgtgtccaagccatttcaggtatttgcagaggatctagaagaccaggagaatgaacatgctcagcttttgtaatctggcaagtggggcattcagagacaattttctccacttccttcttaagctgtggccaatagaaaatcttcttgattcggtggtaagtgactttaactccagaatgacccccaaaagctgatttgtggaaagcttgtatcagtttgttcctgatattagtagtactgccaacatatatcctgtttttgtatcttagtattccagcacccaaagaaaaattgctagattcttcatttagttcctccccatccaccaatttcatatattgggcatcatttagataactgctcttcacatcctctatccattcaggatagaccaatgtgattgcatagcatttttccttctcttccacttctttggtgtctctccttgataatgcatcagctgctgcattttctttcccttttttatattcaatgttatagtcaagctccaggagtttcagcaataatttgtgttgtattccttctgaaagtttatgtgtagccatatacttaagactctgctgatcaattcttataatcacttgattacccagcaaataatgcctccattttttaagtgcttccaaaatggcaattgcttctttttcataagtggatgaccctgctgctctctgccccagagctttgctataataagctattggtctgccctcttgaattagtactgccccaatgcttgaaccacaagcatctgtttccaatacaaacggtttgctgaaatcaggaagagctaatactggacaagtagtcataatcttctttagttggtcaaaagccttctgctgttcaggaccccaatggaaattatccttctttaataaatcatgtagtggtctacagatagcaccatacccctgaacaaatcttctgtagtaacctgtcaatctcaaaaagccccttaacttagttatattcactgggactgcccattctagaacatctttaattttgctgggcttggttgccactccttctcctgatactatatgccccagatattctacacttggtgctgcaaatgtgcatttactcctcttagcatataacttgtgggatctcaaaatagataggacacactgcaattgtttttcatgctcttccagatttttgctgtaaatcaatatgtcatcgaagaataccagtacacattttctcaccagcttttcaaaaatttgattcatttagagcttaaaaggtgacgggtgcatttgttagcccaaatggcataaccaagtactcaaaatgacccatatgagttttaaaggcagttttaggtatatcactttccaccatcctgatttgatggtaccctgatctcagatccagtttggagaataccttagcaccattcaactcatctagcaagtcctctacaattggcataggaaacttgttcttaatagttcttgcattcaattgtctatagtccacacacattctccagctgccatccctttttctgaccataacagctggtgaagagtaaggactcaaattgggcctaatctcttcagactccaggagttcctttataatttcctccattgcattcttctgctggtgtggtactctatatggtctctgattagggggttcagctcccatcttaagtgggatagcatgatcacattctcttctgggtggtaaccccttgggctcagcaaaaacctctgcaaatccagctaggatagttgctacagaatcagggactggcacattctccatctccaaagtcttgagagtatgtacttcaattacaaaccccataacatttttgtccagcattttgttcatcttttaaaacttgatcaacacttttccaccaggtgcagtatagtctttgaattaatattttgccctttgtaggttactgtcagagttctctgcttcaagtccaaattaattggactgtgctcatatatccagtctgcccccaaaacaatatcatacccctttaaaggaatcaactggaatgctttaccgaaaagatatccctggaccttgtactggatcacctcggttttagctgtggaattaagtattcctcccccagctaccatgactctattgtggtcaaattctatgatttcacacccacttctcaatgcaaattcataattcatgaaggtattagtgctaccactgtcaaccaatgccacaactttccttcctttaacataggtaatcaaagagaatgtattgattccatatgtaccctgtattgcatgagtagaaatctgcatcagttgttcttcattatcatcttctttcttagcaggacttccaggtgctgtttgatattccccttcctggttttcttcaggacttcctgattcctcttcttcatcctctacttcttccatcatatgtatcaccttccctgtcctgcacttatgctggtaagaccatggttctttgcagtaccaacaagttttcttttccctctctcctccagtatttgccccccttctgtcctacattcttgttattattgaaacctcctgattgaaactggggtttactcttgttaaatcccccttgagcatttcccctttttgcaagactggccttctcataaacttttgcatactagtaccctgctaacaaactttgtggtttttgcccacacacatcatgtttgatatcagctctaagacccccaataaagcagctcaaaatataatactcaatcagatagggatgatcccttttaaccaatgcaacactatcctcaaatttatcaatataatgcatgacagaaccagtctgcctcacattctgcaactgctccacagcttcgtgtgcatttgcctcagtaaatctatctgaaatcatcaagtaaaattggggccaattaatataatgccatggtatcccaagatttctaaaccacttcccagctcttcctaccaagtgcccagtggctaaattcacccattgctctactggtgttcctgtcatttcaaagaacttctcgcattgttgtaaccacccaatagcatcttctccattaaatattgttaactccaacctctggcttcttagtgtcatgtcagcatatggattaggcatcccaccaaacagatgtctgggtccttctggccaaacaggtcctcctccatttgccatatgtatccctgtagcattcagatgaggtctggctgttggctgcatctgcggatacctccatggctggtttgtttctattccataatgattcattcccacatcctcctgagactccactccatgtatatttaaccccccaggtaaatgaccagcctgagttctagtagctgaagtgaatattggtgctgaggtgaatattggtgcaaaatttgggttaacagtgtttggctcaatagaaaaattcacatgtccaacagaaggaacagcaccagacatgtgtattggaaaaattggtggaagacttgttgatggaaaaacacttcccataccagcatgtatctgactggaaggaattgcattagttgagtttacctgagtctcatcagcagtttgaggtagagccactcctgactgcattcctcccgtagataaaattggtgccactgatgaaaatccagggggaactaatggtgcaatcaaagcccctgtcccagtagcagcctgtgctcctgcagatacacttgcaccagccatagcctgggtccctgcagatccacctgcaccagccgtcccactagtactcgcaccagcagagtgaaatccaggtagagctgtgcaaatactcttcaaaaggtccttgatttctcccatctcacctctcagattactcagatctgtcatctcccgcctaagctgcaggatctcagctctagcgtcaaatccatccacactatccaaactgttaacggacctggtgcgagccggcatgttcactgacaacgaaattcggcttgagggttatctccaagattcaccctctcccctttttgatctcgtcgtcgcaggtctaccgccgcctgagtcaggtcgaaagctctggagattttacagggaatacacatcaaagtgattccccaaccctcgcttgtcgatctgtctcacttctactcgcctccggttcgaattgtataggcttttgggattttacgagaggaatccgcagatcctcccaaccttcaccttacaaatcgagagccaagaatcagctgtgctctgatacccttgtcagaaccacaccaaaacacccccgaaatggaattgacgaacacactctctctcagatttgtagccgccgcaagacaagaaaaactagggttctaagctaagtactagggttaatgatcttcgatagcttttccattcatcacaccgggttatatactcccaggcatctcagttttttttttacagagcagcgagtgagacagaggaagcagagtaaaagcagcgtcacgcgcaggcgacgacaaacagaaacggtaaatagtacagcaaagcgatcacagccgtaaatgcaccacggtaatttgatatagcctcatctctaccgttcatcttcattaaacgacgtcacccaaccggtatcccactctaactctgaacttctgaatttttaactaaaacttctgaaactcttctccatttcttctctgaaatctccatctctgacaacccgctgactcgtcgccctcgttcctccacggcatcggcgcgccatccgcccgtttggccgtaacgcgctccgccaccctcgtctactcagagacggagctgtacacagtcgcggcggcgcacgcgccgccgctgcgccgagaaatccaaggagacagggtcacgtgacctacagctcggccttcgctttttgagacttcctctacccacatctctatgtgcctgcagcactttcatatggggaaagatgggcttaccatgttccatcaatagcacctaacctatgctgattttggcggaccgtgctccaccccggtgaactcatgcggttccgacgtgcccagaggccagaggcgaatccgttcacggtccgtaggaccaacaccattcgaaggttgatggcccgccccgtctagaataggaatctttgactgggcttacgcacattcgctcacttacgctgtcccccctcagctcaccccagccccgggtacgtcgtctccaaggcttcacacaaaatcttcactgacaacatatgcatgcttttgtagggtcaggcagaaccgttgttgcctgatgggaacttcccccatattgctatcaatgtcttcatgtcgcacgacctcttaacattacacacgttttgcaaaattacagggttgctactactactagggtgctccgtgaaaaaacttcctttacaaataagtcccccgcgtataacccgcgacccatttgggggtaaaacgaacagccaccggcccatccccttgtggccgactaagacagagcccagtctactagactttggaataagtccactttgactcccttaaaagtgacccgaatctaatccatgaccctcaaccgtaaaaccagataggatgactccccgaactattcaaaccagtgcaatttgactccctcagtggttttggatggcggttttgctgacgtggcgttgacgtggcgatgttgacctgatctgtgttgttgatgtggtgcttatatggcattaaaataaaaaactatatgggctccattcgtcattcacatggaaaaaaaattgcgaggcccacatgtcatcctctatctatcctccttccccccctctctctctctcccttctctgtatgtttctcttcctccagattcggtgtgcagaatctggagcggcggcggcggcagggtgagggccggcgcggaggaaggaacttgagcgggtcgagcggcggcttcggcggcgacgacagagagccggaggagaggcggtggagcggcgacggcctcagctcgccggagaaggcgggggcgtccggcctgtggcctcccccacaatggtgccgcgccaggctgggacgaaggagagggctaatgcagacggcgaagcctgagacgccgccggccctagccgtgcctcccggtctgcgccggaagggggtgccgcctctgtttctttctgcccggagaacatgcatgtgcacagtgttgcctagcagatgcaagtgcagtgccagcgtggggtagcaaggcgcagccaccatggaatccagtcgaattttggcaggaccagcagctgtaggacgaatccgtcctaccagcgtggtccacctgagtcctgcagatcttgaggtcgtggactggtctgatttttttctttgtggtcactgtttgcaaggtcttgaggtcgtggacaatagctacttcatcaccgaggacaacgttggcatgctgaagctcaccaaggaggccaacggcatcttggttcgttgatcagcgcatcgactcatgttaccaattcgcctatgaaaattgctaacatctaaccgtgacatcctgtgattaattggtacaagcagtttgactaccatatcccgcgccggagacggtgggttgcgcagtggtgcactcaaacggccacaccgcggcagccatgtccacgggcgggctgatgaacaagatgaccgggtgcatcggcgactcgccgttgatcgggtcgggggaaggcaaggccatcatacgctccacgctggcgcgcgacgtcgccgccgtgatggagttcaggggtgccgggctgcaggaggccatcgactactgcgtcaaggaacggctggacgaagggttcatcgggctcatcgcggtgtccggcaccggcgaggtggcgcacgggttcaactgcaccggcatgttcagcgggtgcggctgcaagagaaaagagagagaagggagagagagggggaggaagaaggttggagagagaaaggatgacatgtgggtcccacaatatattttgtgtgtaaatgacagacgggtcccacaaaatatttttcattgtaatgccacataagcgccacgtgggatgaagaccgggtcaataccgccacgtcagcaaaaccgctcagggagtcaaattgcactagtttgaatagttcggggagtcatcctatccggttttacggttgagggtcacggattagattcgggtgactttttaagggagtcaaagtggactttttccactagactttcacccacagctcgaaggcccattctacctacctctcgaaagccaaggcccaaatcttatcctacagcgaccaaccaaaacgtactaaactgaaggtacccgccaaccaaaaaccaatctctaaacgccaaactgtaactccttaatccattctcgttttttttctgtcagctggatagggacgtctactactccctccgtctaataatataagtaattttaagtttttgtttgcactgtttaactactcgtattattaaaaaaattaaaattattatttattttttgttacttactttattatccaaagtattttaaacataacttttcattttttatatttgcacaaattttttaaataagcaagtaaaaactcaaaatctcttaagtaaatttcacaaaactacatgtttttttttcaagttgcataaaacaacacacattttgatacttggcactttagtacatatattttggtaatttagtttcacaaaaccacactattgatgaatagattcacccgtgagatgacgtggttgttccatctaagatgaggatgttacatcctattaatttcgtgcgatggctgataataggatgtcatgtcctcgtcctaagtgaaacaaccacgtcatctcgcgagtgaatccattcattgatagtgtggttttatgaaactacactaccaaaatatatgtacttattaagtgtcaagtgtcaaagtgtatgtggttttctacaacttaaacaacaaaatgtgtagttttgtgaaaattactcaatctcttatattatgggacggagggtgtaattatttgtttcatgctcagaattcaaaagtgtggctgttattctaatctcccacgagtccacgacacgatgccgcacggttggccgttgccccgagaccagcgttttgtccatgcgtacgtgtcaaacctccacctaaccatgacgcgaccacggacggcgacgctggcataccgccaaaggctaacgtctccgtcgccgtctcggcgagcaattcccccagcccaccgctcgtgtagtcgtgtgggcgcggcgcggacgtgacgtgcgtcggcgcgcgcccctgcaggtgggtcaatctcaatccctttgctcaattgctccaagtgtcggcgcgcgcgcggttgctgctgggtccgcgcgtcgtggcggcgcagggatcggacacttgtgaggcgcgagcggctgcagctcgacgcgacgtgacgtggccgttgtttgggaccggcggtgatattgctacctccatcccaaaataagtgtagccgtaaggacacgtttgaccgatcatcttatttaaaaattttatgaaaaaattgaaaaaaaatagtcacacaataagtaatattcatattttatcatctaataacaataaaaatactaattataattttttttcaaataagatgaacagtcaagacataaatagtacataactacatttattttaggacgggggagtagattgctagtactaccatgtcgacctttttttttggttgagatgaactgcctctgccataggttgttttgaccgtttgtacccattttgtacattggttttagagaaatcacgttctcaatgccgatgcatgaactgtgaagggagaagcgtacagacgaaagagctaaaccctttgttataaaatataataaattatagcatttagaatttgtttaaaaatatgacaatttatctaccaacatttcttcctaacaaattataacctttcatcgtttaaattcctcacatgtctatatttttaacccatcataacatttttttatttagttttatctttttatatatgtttttaattttttaaaacactttaattatgaaacggaggtagtatttttgttctcttctttcctcacggggaaaaaatgaaaggccgcacagccaatcagccatagaacgcagtgatacaacttgcacaggatgagctctcaaaagcaaatactcaactccatatatgggtgcaggagcagtagcgcgtcaatcgtcaaaataagagtattgttgactaccctactccatttatctaccacgtgccactttaaaagcctcatgggttatgggctgcgtgggccgagaaagaagcggggtctgatgagacgtgtgttgtgctcacatgttctgaacctcctgatgagatggtaattcgtcattgtaatttttgcaatgaatgtcaactgaatatctcatgtgattttcttgcgctccaaatagaatttcacaagagctcccctgcaaatttgaatggtcatcacagctcacaataattccacctgtagttagcatgtatatatatagcctttgtcccgtgttcttcaaaaaataatattagaccttaattcaattgaagataatttctgaactgaagctccaaacacgcacccagcaaaaggcacggcataaaagtgatgttcataatgggttttattgatagtagaaatcaattgaaccatttatctattctgataggaaaaaaatattttattgctctaactattctacctaattacttaacccctaaactctttcatgcttattttataatctgagctattttgtactgaaattttgatagaatacatatgcatttagaacttacgtctagtcctctcttttttttttgaaaattttgaactattagcgtagttcgaaagcactaaagactaatttaacatcaaaaatttaaaatttaaagttcaaacaaacatccatggaaaattttgaaaatattcttgaactttaataatgatgtcatatatggcttaaaaataacagttttaaatacagcttgtataaagaataaaaaaataaatgttatttaaacattaaagtgaacgatttttattagtttaggggtaaaatgagccaaaaaaaaatagttcacgggttaactgatccattgaattagttcggataagtaaaatggatttattttcattaggggaagtaaaatgaatttattttcattataatacaatggattatttattgtcacattgactatgggtaatagaatatcttgtatatttcatcaccgattaagatcaatttttaccagagttagattagaaattagcttaaacgtatctcgggataaaaaggcgacagcacgcaaatccagaacgcaacatgttccggccggagaacgcagaccactcggcagtcgcacacgcgcagccgacgtaactaaccaccttaccaaacgggacgatataagcaaaaccgcgacgcgcgcggccaagaggcaaacaaacaaacacgcacgcacaccactactccatcagcagcagccagcgagcccgcgccgcagccacccgcgcgcgcgcgcgcggccggtgaggtgtgtgagatagatcgtcgagcgcgcgtacgtcgatcgtcgaggctggccgccgccgcgaggataccggcgccggtgcgcgcggtgatggcgtggtggcggaagaaggtcgtcttcccggcgcgccgcgcgtgggccgccgtctccacccgcgtccgcgcccgcaagccaggtacgcgaccaagctaacgattctccccccatcaccctgactctggctggtagtagtacgcacacgcatacttgatgctgcccaaggatggcgtgctagctagttcttctgggagaaataatcttggtatactttcttagagcccgacaagtttgctgctgatttgatgatcttcttggtctggctatgtccatacagttcttttctcttttcttgacgccatgagagatcccataagaagagagagttctaggtctgaattatattggaattcagttctagatcatttcgctacttcgtggagacggtaaaacagttatagaaaagtggcatgactcgtgaaatcatgagtcaaaactatttaggttaaaatattgaagtgcagttacctggatgaatacagaacttctctgttcaactggaaagtcatagccatgcttattgtttttttcccctttgaaattcataatgtctggactttacatctaaaccaacaatccaacatgatactatttggaatcttcactataaaaaagagagatactgttcgaaacaaaactgcccatgttttcatcattccttctccttcttctttcctctgatcttgtattgtcagtatttctggtcatgctctctagagaaggagtaattctcaatctagagcttatgccatctgggaaatggaaacccttttgttttatgcaaaatctagagcttttcttccatcaattatttactcttacagttacagtgttgaccattcttcaatttcgttcacatcaaccatcaaccaagtatttgtccatggtggaatgtgattcttttccactacaatgccgctgagtggatgagactttgcaggctaagtctagaaacaatcttccttttgcaccatctcatctcccactaacattctccaaaaatctagctcatccaacactactcgatcctaacatgtgggtccaagatgaaaagtctatggtgatacgatccctctttttggttgccaaaccagaaaccaccaccaatgccaaaatttctctgtgatttcaaagggtttcaggaatttgttccaaaaattccagcttttgcacagccaccaaaactaaatgctcttctgaaagtcaacctccccggcgggtacaacgcgacagtgaaatggcagcgacctaccagggattatcagcagtgcacagtgagatactgccattggtagtactatggttttgtttggggagtttaagattttgagaaacaactagtgagaatttagttggtgagaatatgaaagggctgggtttcttggcttctaaattttagtttattttctagattgtataactacatattcttaaaatctgggtggaaatctaaactatttgagaaagattctgacagctgaggattctaggagaagctgcagctaacagaaacttcccaaacaggccctatacctagtaccactctgctgcattgctgctacagtaccatccttattcaataggagcaccaagtgtcacactgtcacgaggtcgatggttcagtacactgaagatcagtaggtgcatggatatttttagggtccaaaattcagtactaccacgctgcccaattagtgccagctcgatctcaacatcttgctttgtcaactagcagtaatgacccaatcaaacatgatgtacagttagttacctgcatcttcttctcagatctgaaccagattctgcttgaacacatacactggaactctgcaagctaatctcaaacgggaaagcagcaggagtagagtactgtcaagtggatcgttctgcttgttctgttctgcttgcagcttccctgcaagtgttagcagtatcagtctccaataattcagaccttttggtatgaactgagccgttgcgatttgcggctgcatctgatctgcacccaaagattcttcttcgcggttagaaaagggttcccttgtaccagcgtcgcacgcgacaacacaattaataggagataatgccgtccacgcgtaagcccatcaacttttaaccaccagcttgtctagagctcgaggcagggggcca

SEQ ID NO: 72747 - DNA, 1087 bp, Oryza sativa
  unsure (1)..(1087): unsure at all n locations
atttatgcaaatataaaaaaacgaagagttgtaattaaagtaatttggataataaagtaagtcacaaataaaacaaataataattctaatttttttaataagacgatggtcaaacagtgcaagaaaaatgttaaaatcacttatattaggggggagaagtntacttttgtccacagctactagtataataacacattttttttagataatggaatataacatcccagccagtataataacacatgaatagtactttataagtggcttatgttttttaatttttctaaaaaaattaaataagacggataattaaagttgaacacggaaactccagattacatttaaatagtacttctgtccacagctactagtataataacacatgaatagtactttataagtgacccatgtttttcaatttttttaaaaaattaaataagacaaatgattaaagttgaatacggagactcaagattacatttaaaatggtacggagggaataactttgccgttaaaaatctaaaaagtttgaccatgttatctgcatgtggagaggagtgacacggggtcacgggccagccgcaactgtcgggttcaaaagatgcgttcgcaagaaagcaaacagattagagtggtggccccgcatgcagtggtaacaactgatcgaaaccacggcatcccgttcaagtagctggtttagctccacggacgcatgcctattctagtgctccactgccactatctttagtagcgccgtgtcgggctcccatatataacgtccctcgccgtctccatttggatttcagcgatcgatctcgaccgcaccggccccgcatgcctgcccactgcccaaataaagcgtcgtcgatcgaccgcgcgcgatcatggcgatggtcgtcgcggggagccatcggccgccgccgccgccgcagtcgctgcggctggtcccgccaccgccgccgcagcctcctcctcctcctctgacgtacaggcaccactgcaaggtgtgcaagaaggggttcatgtgcggtcgcgcgctcggcggccacatgagggcgcacggcatcggcgacgacaacgacacgat

SEQ ID NO: 72748 - DNA, 850 bp, Oryza sativa
caaagtgcggagtgcccacttcacttgcacggtttgacctcattttgccccgtttttaggactaaccgtgaaggcaaagctgaatagcctgccaccactacgccaccacatactctcaccagttgctgatgaaatgtctttaggactaatcgtgcatgtagtacactttccggctttccgctccctgccgcctatctcggattctcggtgtgcatgccactggtgagtatacggattactataaggaatgaacacccattagctgcggaattctgtgtcaagggaccgattgccactagctatattttgactgacaaaattctaggagtagtacttgcctacggcctacctatggaccgtcagtgtcacttggccaacatcaaacgctctaggcaccggagggaggaaactcaatagtccagcctaaaccatgcatagatgcagacggctgatgtcaactgtaaattaagcatgctgagatgagctgatttaagcccagccgtttggtactctaagggattttgagtttttatttgcacagtttgaccactcatcttattaaaaaaatttagaattattatttttttgacttaatttattatttaaagtactttaagcacaacttttcgttttttatatttgcataatttttttaaataaaatgagtggtcaaagagtgtaagaaaaacttaaaatcccttatattatgggatgaagggagtagtatattagtgttggtgtgtgacctaactgatattcactgcacaccacagtcacatgaccaaacatacacggggatttgatgcaacagtaaaaggtctgtaaatgaaaaagcaaatccaggacctaa

SEQ ID NO: 72749 - DNA, 11093 bp, Oryza sativa
gcggtgcgcgcggcgtccttgacggggaggcgggagacgaccctgcggaggagcgcgtcggggagggcgctgatgcggtcgacggcgtcgtgcggggcgagcgcgtagaggcgcgcggcggcggagacgggcgggtcgggaagggcgtagtggatgtaggagagcacgcgcgccaccgtcccctgcacgtcgtccgggtcgtccccgcgccgccggaactcggccgccatcgcgcggcccatggggacgggcggcacgcgggtgtccatggtcgccgctcgccgccgccggggccggaagggaactagggaaggggacgagccgacgagggtttggggcgtcgtgtggtgtggactgtggagtggagtggaggcgagctctggtgtgtgtaggcggagtgggaggtgctggtttgtcttgtagtggggtagtttggtcgggatgcgaggaaacctagggtttcggtggtttggttgggccaaatttcggatgcagattgctcatggcccaaactctctccgtcacaaaataaatatataagatactttttacacgttactatatttatatcataataagtttatttttgatttatatgtgttaaatatttaaccgttcatcttactaaaaaaatataaaaatatatttagtcacatataaaatattattcatgttttatcatttaatatcagcagcataaaaaatttaaataagacaaagagtcaaacgttatatctaaaaactgaaaaatgaactttttacgagacgaacatagtaagaaatatctcatcctatcttaaattgttgataaaatttccttaagaaaatacctcgagtaacttaaaagtgtggtacctcccaatattttcttaaggatagtaaaattgccctagattgtttattttgggatggaggaggaaatcggtcactttgttcttcctaatgcaaggtacactcgactcacaattcttgctagaattttgcgatggatagattttgctagaatttatagacaccgatataattcttgcgaaattcccgtaatattcatgtgttccaatgaagtccttcgaaaaatgtctattttgcctatacttaaatttggggagttcaatgtagtatagaaattgtttcgaaaattatgaagtgctacgggtatatcactatgattcgtgtgataattactccctccagtcacgagaatatgttgattagggtttgttacaagtaagactttggccgtgtttagttttccctctattcccaactttccatcacatcgtatcacatcaaaactttcctacgcatataaacttccaactatttttctaaactcccaactttcttcaaacttccaacttttttcaggaattaaacacaccctttaaaaacaaagaaaacaaatactccttccatcccaaaatataagcatttttagatcttgtcattgttttcgagatgctattttgaccaacaatttgtataaaaataaaatattttaaataacaagagtcgcatattataatagtttattaatgataaatctagtaacatcaattttatatgatttattttttttattttattgctattaatagtcaaagttaaaaattgttgatttagcactatactgaaaatgcttatattttggaacggaggaagtatataggatccaataacgctaaaccacgtgcacgtgtgccataatatacacgctatgagtacaaaagatttcgcaggtatatcctgcacaccgtggccatcttgatctgaaaatatttccggggttttcaaaaaaaaaaattctagagttgcagcgacaacattagtcaacgcagcaggctttctaggccgagtttatttccaaactttttcttcaaacttttaactttttcatcacatcaaaactttcctacacatacaaactttcaacttttttgtcacatcgttccaatttcaaccaaactttcaattttggcgtgaaaacacacccctagtttctttatttcatcttctaaggacgaatggcagatataattctcctgtatgatctgcaaagaaatgtattgaaagaagatcataactgttggcattcaaagttaatcatcaaacttttgtataaattcgattcacattccacaataaagtttattcacattccagtattccccagtagaagaccaatagatagaccacgggagttctgataaaaacagacttttcactttggactttgagacgtccactaccaatcagaactgcaactctccaagcaacagaatgcgctactagatggaacagaaacttcataaaatgtggtaaaggaaattggtaatgcagcatataaacatgaattagctttgatatctctgatttttaccaacacgaaggcacaattttaattagcagaaactgtgtgacgtcacatgctcacaggtcaatacagcattcatcttagtcaaaagagagtcctgttaaagatactaccagactgaagaactctaccgaacctcaaaacgcaaccagaaaaaagaaatgcagaagttatggaagaaaaataatccctctcacgcagaaactgcaacagaacactagcaactaccagagatgtcaaacttcgaagatcggatgatgattgtcaaagggtccacaaatctctgatgaaattgaccttacagaaatccataccaatcaggactgcaactctacaagcagtaaaatgttctaccagatggaacaaaaacttcatgaaatgtggaaaaagaaattggcaagccagcgtacaaacatgaagtaattttgatatctctaattcttaccagcacaacagcaggatggcacaaatctaattagatagaactgtgtgatgtcacatgatcaatgccaggtcaatacaacattcatctgagataacatttgtcttctgctggaaagacaatactgttggagttgctacaggattgagagcactgataaatctcaaaattggaacaaaaaacagcagaagtcaaggaagcaaaacaatccctctcatttagaaactgccacagaacactaacaacttccagagatgtcaagccgagaagatcggatgatgatcgcaaaagggtccataagtgaaaaatcacatcctctctcaaagttccaattgctttctcctgcactagcatcactctcaaggaccactagtgaacaacatttactagcccattttgtggcgaacagaggcttcagtctgaaatttgcctcatctgtcgatgcaaatgttcctttgggagacacaattatcagcttcttcagcatccgcgcactctcaaggacaaatttgaggaagttaatctcaccccgcgttgctcggaaacgacgaaaaatcatcacggtaatgtgagactggatgcattcgatggcgcctgcatcctgccagaacttgaggttcagcttgccagtgagctcatcagttttccgggactacaaatgagtcaaacaatcgcacacttgaaagttagagatggataattcagccaaccaagtagaacatttttagataatactcgtaactaagtagtatatgaacgctaaatcaagcaagctgtgtctcacttcgacgtgcagagtctcaacattaggaaagcatctgaggaaactgggcagcatcttggcttcattgcggactccgaaacacacaattatgccaaggatcttcacacttggaaccatggtgcttggactagcccttgttccagcctgcaattttgccaatatgcaatgttgtaacaaaatcaaagaagaaacttcacacattggcatcgatcagcaatccacacattttgaccatctgcactgaacagattaacggtcataccttgataatagtgtcgccgatctccagcacatgggtttccagatcaaggtatccaattgcacgcagcgagggagcacggccaatctttaccagcatggaggagccacaggagtagagcatgatgaggcgctcgaggcggggcgcgttgaccacgttgacatcctggtcgaaccccatcatcatcaggcaccggaggctgcggctggcgacgcggacgcgctgaagcgtgttggcctggaggcagagcgtctccagaacggggctcctggcgaggacgaagtccatgtcgtggttggtgatgccgatgagggagaagccgaggtcgcggaggttggggaagcaggcggcgcgcgggagcgcggccgtgtcggggaacttccagaggccgaggtagaggcgggtgagggtggccatgccgaagaaggtggcggggagggtgaggtcggccgggaacgggcggttgacgaggatgagctcctggatacccttgacggcgagcacctggagccagctcgcgagcagaccctggtactggtccatgaacctggaggtgaggtggaggcggcggaacgggccggggtgcccggcgatgacgcgggacacggcgaaggtgactgcgcgggcctcctcgcgcgcggcgtcggtgtcggcgtcggacacgccggcggggaggaggtcggcgtcgacgaggaccagcggggtggagcgccaggcgtcgccccagcgggaggagagcgcggtggtgcgcgcggcgtccttgacggggaggcgggagatgatccggcggaggagcgcgtcggggaggaggctgaggcggtcgacaccgtcgtcgtcgtcgtcgggcgggagcgcggagaggcgggcgtgggaggagaccggcgcgtcggggatggcaaagtggatgtaggagaggacggtgccgatggagctctcgacgtcctcggggacctggccgcgctgccggaactcggccatggtggcctcgtccatggggatgggtagcaccctcgtgtccatgtccgccgcccaccgagccgacgccggaagggaagagggttgggctgtggggatttggggttttgggtgatgtgttttgtctggtagtggagctgaattctggattggtgtctggtcgtctcatgatcaggggagctttgcgcctttgcaaaacatggaactttcaaacattttaccggcactttcgctagtacactctcagtcgtaaatataatacagagtaatgtcgttaacttttttttttttagaattacacagtacaacgcagacactcacaacgcacgcgcactcaccgctatgaacacacgcacgcaaaccctagagagattgacgaagtcaccacaggcgcctgcaaaccctggagagattgacgaagtcaccacaggcgcctcgctgtcgacgggtacgtcacctaccactgaaagcacaacgctgttaaatcctggaaaagtcgctcccatggggagtcgaacccaggaccttaggtgctactaaggctcttgtaaccactaggctacaggccctttcgcaatgtcgctaacttttgaacatatatttaaccactcagcttattgaaaaattttatgtaaacgtataagatttaaattatgcttaaatcaggggtgaagctagcataaataatcaccagggtcaacactaaccaggtctatttatcaaccaaaaccaatggaaaacgacactatttcgatgtttcgatgtgggacgaaagtagattagagtgaaatttcggatagttttcgagaattcaaatttgaaacggcaaaagtcaaacgaaattaatcaaattttggcaaagaaaagtcatatggtcgggttcggaatccgatattaaatcgaagaggtgaactctgatacaaacatagtttgtttgaacgtagctaaccattccctcccaacacgtaaaatggagcgaggattagcacatgattaattaagtattagcttaaaaccttaaaaatagattaatatgattttctaaaagtaacttttccatagaaattattttgctagggaatttgagaagttgtgggccactaggcttatgcatgatctcaaatttgaaagattcaaatgaatatgcatattcggctgatgtataatcataagtgctagctaattttctattttttaccgctagcatcgttcctagttgtcaattgggttttaacacgacaattaacaattaatgtcactggggtctaatctttcttatcaccggtgtcatagccagtaaaataaagagaaaatcctttgtatacctctaaaaattttagctaatcatttatatgcccccgaattttgcttacttccttgtatactttcaaattttgattttgatcccttccacacccctcccgtcagttgaccgtgagttgaccatctaaattctataaaaataaccattttatcctttgaatgaatatagaaatttatgaatatattactgaaaatgtaaaagtctgttacgagtttgctgtctgatacattatttatgaaaaatagataattaactaaaaatatgtatttattttgtttttaaaaattcataaaaaattaggagcaatcatataaagataggactactaatgctcatgatatttttttatgaatgctcttgataaaaaaaagttcattgtccaattaaaattttaaacaataattttactttattacattttttgattttcaaaatttatgtcaaaattttttgcactaattatttattctcattagtttcataaaatacacatactgtgcactcaaacaaaattttcaatcgtttttcaagtttatattcaaacctaaatcatcaagggcataaaagacattttcaaccaattgtaacagtgaaaggaaggaaaatgtaacgataggggcatggaagggatcaagttaaaatttctaaggtatagaatgaattgggaaaatttcaggggtataaaggggatcgggtgagttttcaagggtacacagagaatttactctaaaataaagagggcatataaagttcatagaaaattgtcggtgtcccgataaataattgtagtgttgccctggcttaaactactttgtggggtaaaataactcaacaaaaaaaattataattacatattttttttagtaagtcgaatggtcaaatatataataaaaattcaacggcatcatctattaaaaattggagatagtataaatttgcatgaacacttattgagatttatatgtaaagtggttatattttgagacaaaggtagtacttattttaaaataatagaagtttaagatttatagagcatgtttgacacggctctagtctagctccacctcttttggagttagagcccaaccaaatagtttcaacttcacctgaaataagagttgagctggcgatagcgctctcaaaaagtaaattacagacgcggagatgcatttatgcagctccacaactcaactctagacctaacaaatgaagttaagtttaagagtttgagttctacgatattaagaaaacatgtgaaattgagatggtggattgtgatttgttgattagaaaacataggtgaaaatgaaatgaaaaagatgagattggttgagaagataatgtaggtggaatttttttatatttttagacaaattttaaatactaaaaatattatattttagaataaaaggcactatatttatttaacggtctaatttctagcaattatttggctcattagatggttatgttatccgtgcaattatgtgtacttgtattttgtgggcatgggtctgcgcaacggtgaatttggtgctcatatgtagaaatttgacagcctgaaatttttttacgtcgttttgataagatgccactgtatgataaaatgctattccctttgtctcattttggttatttctcatattttgtaacggatagagttgtatactcaatattttttcccgtgactaatgccgagtgggtgtttctattttgtctggtagtggagctaatttctggattggaggctggagcctgatgtgagttgttcttttttttctctctctcttttaagtaagggtttggctgcttcaaaaaaaaaaaaaagtaagggtttggcaccattgtgttaatagagcagaaagtatggatgaggttcttaggctattttttttagataatagaatagaacatcgcggccttggctcaacgagctacaaccaattattataatctaacaatcaaaatgagtgtagtttagagaaacttataaagacaagaccagccatatacaagaaacaaactaaaggttgccaacacaagataaagagtacacgattattgaattatgtttgtgaacctctatctgaaattgacaaaaagttgcataaccgttgtcaagattacgacatgcaacctttaaaagctcgccatcttcatcacatttttgtagttgtgcctaggaccagagccaatatgttgctctgaaaattacctgcatttataaaatagatggtgaattgtcaaaaaccatgtcgttcctgctcaaccatagagcccaacatatagcagatgctcctataagaataagttttctacttttttttgttaacctccataagccaattttcaaatatatgatgatgcagcaacgggggttcccgatctttcgatgagaggaggataaacttcgatttgggggaggacacgacgttggcggtccgactacaactaccacagggcaaccggtacaccgactccacgttgttgctgttcttgccgtgccaagaacaaccttgaacctgcaagcaatcgaagaacaagcaagaacaagttgacaaggaaacagctcacggcacttgtcaaatgatgaaactgaaataaaccaaaatggggttctgaatactagtatccgggtggtctagccgacacatgcgagtacaaggaagtagctgcagctaaacttacatcaaaacaaaacccaaaatgcaaaatggtggctgctaggagtttatataggtggaggaatgaccaggagaggaggtgggagcaaaccctaggttttgtggacccctaatgggctgtaaagatacaaggcccaagcctaagtttctgatgtaaagaactattttcgtcattctgagcagcctgggtcaaatttgatggtgaggccacacatagctgaaagtagacgaggagatctttccaacaagtactcatttgccccgtttgccctccggagtgaagagcattgacttcatcaaatcagtgctgctagtgctgcttgcgatctgattcctctcccatattcctaacaacaagtagatcacaacatccatttagtagcacccaattctgagaagaacttgtatgattagctaggaatgactttacctgataattaagttcacgagctcgagctctagtcattggtccttgctgtgcaataggcatggttgtatcgttggaagggatgtcctcgtcatcctccccttcttgcatttgagtcgtcctcgactctaactcatcttcttctcccaaatatggctttaaatctgcaatgttaaacgtggggctaaccccaaaatcggcaggtagctcaagcttgtatgcattatcattaatcttttgtagcactttgaaaggaccatcagctctaggtagcaacttagattttctcaaattagggaacctatcctttctcaaatgcaaccaaaccaaatcaccaggttcaaaagcaacatgtttctttcctttgctcccagcaagtttatacttaatattcatgctctctatgttctacttagtggtctcatgcagttttaacattaattcagcgcgatgttttgcatcaaagttcactctctctgaagttgggaggggcaaaagatcaattggagcacggggtagaaggccataaacaaactcaaaagggcacttcttagtagtagaatgttgtgaacgattataagcaaactcaacatgaggcaaacattcttcccacattttaatattcttttttaaaacagccctaagcattgtagataatgttctattcaccacctcagtttgtccatcagtttgggggtgacatgtagtagaaaataaaagtttagtccccaacttagcccacaaggttctccaaaaatgactaaggaattttgtatcgcgatcagaaactatggtgtttggcactccatgcaagcgaacaatctcacgaaagaacgaatcagcaacatgtgtagcatcatcactcttttgacaaggtatgaaacgcgcaatcttagaaaatctatctagaacaacaaagataatgtccctccccttctttgttctaggcagccctaaaataaagtccatagaaatatcctcccaaggcacactaggaacaggcaaaggcatatacaaaccatgagggttaaggcgtgacttagctttttggcatgttgtgcagcgagcaacgaacctctccacgtctctcctcatcttgggccaaaagaaatgatcagcaaggatatcctccgtcttcttcacaccaaagtgtcccatcagccctccaccatgcgcttcctgcaataatagcatacgcacggagctagctggaatgcataacttagtagctctaaacacaaacccattggtgagaacgaatttgttccaggtccttccctccttgcaattcaacaacacatctttaaaattatcatcgtgcgcatattgctcttttattgtttctaagccaaaaattttgaagtcaagttgggatagcattgtgtaacgtctagacaaagcatcagcaatgacattttcttttcccttcttatgtttgatgacatatggaaaagattcaataaattccacccatttagcatgcctacggttaagttttccttgacttcgaatgtgtttcaaagattcatgatcagagtgtataacaaattctttgggccataaataatgcttgcatgaatccaaagttcacactagagcaaacaattccttatcataagtagaataattcaaactaggcccactcaatttctcgctgaaatatgctacagggttgccttcttgtaacaacacaccacccaatccaatcccactagcatcactttcaagctaaaagttttgttgaaatcaggaagttgcattaaaggagcgtgtgttaacttatctttcaaagtgtcgaatgcattcctttgtgttgcaacccaa

SEQ ID NO: 72750 - DNA, 978 bp, Oryza sativa
agtactccaacttatggacttctagctattccaaaagtttttgatttctgcattgaagtatagcaaaaccaagccgtcaacaaaaaagaatagtgtgaaatctacaagttcaacagcatattgaaaggaagtaatgcgacttaagtacacaaaaggcacaaaagaaacatcaagatgagccctatgaagctagatacttcatttgtttaaaggagagcaaaattcaagtatacaacgcggaaccggtgttctcgtgcatttctctggagagaagcaggccttgtgggccatctctaaaacgctggttcgaggtagtccgcgtatgatcctacctctaactcgaaaaggctcgagatgccctctagagagtgtcgcgttaatgcaactttaccatactgctggaattaagggcaaacagtgcatgagcaggagacttactgtttattgcgtgcagagaacactagaatatcagtatggcaaagtattgtcaagggtattaatatgccctttggcagttgacacatttcactaataccctttagcaagaataaaagtgcatttaatgatcaggcatctcttttgcaaatctatgatgtagtttgagcatcctttggcaggctagtgaaaagtaacaaaataactctccatttgaaagagtgcagcaatcatacaagccgaaaactgcatgattgctaggaaaaaagtacagtttattttgctgtgtcataaacaagagtgatctggtaacctcagtaaatggcggcaatatggcatttggcatatcacaattgttctctcccaagttccggtctattctctttataaatggaagtgagtataaattagtttatacttatatgaaaaacatcaatactctttagtcagcttattagcagcagaaggtgagttgtggcataacagatcatacttgattcaccataattttccctagcagaaataatgaacatgtctttcgaa

SEQ ID NO: 72751 - DNA, 3171 bp, Oryza sativa
ggtttaagagttgttaattgtttcgcattgttcgatgttagtatgtatggttagcacatgttagtatgtggaactagttcagtatttataaatgatgtgcaactggttcattatttctaacaaatgtgcatcttgttaaatactcttaataaatgtgcaactggttaaataattttaattgccttgattatttgtggaacaggcggaatttgttgagcacgttcacgtggagtccgacaccctgctgcaaagactagaggcgagacctccaggtctgacgacgtggcgagtgtccttcgcaacttccgtgcacgtgctgccgcactactacgtcgtgtctcctgtcggagcgcggcagatgtggtgcagacgtcgggccgacggccatcaccaccactaccccgacgttccagcgtggatcggagtggtccatcctcttcacgtcgcgggtacgaagcggcccacacatctcacagtcgtccttcctttcagcacaccccagcaccggagtacaccagggggtcagccggatcaggggtacccacgtcgagcacggcaccaccacgtccgcaggtattccaaactccgccttatgttcacccctcgcagggagcatctgggtcggcacacttcccttacatgccaacgggggacaacgtgttgaacacaccagcatggggacttcatatcactccgcgtgcgccagagcagggccacacacagcacacatgtaagtcattttaaacaataacacgctttagtttctaattatatgtatcgttactaactacgccatattttttggtttctccctcttgtacaaacagacgatgagtacggttcggcgtcgacgcatcacggagtgcctgcttactcccctcgcacagcattcattgaggacttcttttccactgatcctccccagggggaagtagggatggattactggcacgcagcacctcaggtcacacagccgacgcaggagacggaggccggtcaggggccagacgtgacaccacagcaggcagctagagataggcacccccctgataatttgacatatcccactgagcagattaggcgtagtaagaagggaggacctagcaagcgtgcgaagggcactgatcgtccttgacttatctatttgtattaaacttttagtcatttatgttctgtccgtactatttgagaaacactttacgattaacttagtactatcagtactatttcataaacttcttcggataattactcagtagcatacccttcgaatgaatcatgacaaattatcattcaaatatacaaataatgaaactaaataattcaaatattttaaccaacaaataaatactacaatttctgaccaaacattatcaaaccctaaatcacatacatataacattacaaaaatattttcctttcttacacactaaaataaattacatattattaaaaaaataacttattacaaataaatggagaacgcgaccctgtcgaactgcggcagttcgacggacatcctgtcgaactgcggcagttcgacagcccagcctgtcgaacgggggctgttcgacagccctgcctgtcgaacgggggctgttcgacaggtcctgtcgaacggcagccttccgatctcgtcgccagtcgcgctctggccgttcgataggcgccctatcgaactgcatccgttcgacagggacctattttcgcgattttccccggttgaccactacttttgcgattttccataaaaataatattaattctcaaaaaaattctctaactcacagcatgcactccctctgtatattcgttgtggcatgtacttatattttgggatgacatgctagattggccatattcgtcagtttccctgaattcttgattgccgttgataatatcctctaggaagcatattactctactgattctgagttttaagcaagatcaagtagtcctaattattcccataatcttgcagctgcttgacatcttagaatgatactatctgttgtttctcgtgctgggcataaatcaccgtggggattctcatcccattttttccttgccatattggccttagcattcggtctctgaaaaccaatagaggaatatacaacaagggcaagctctccctccaaactatgaagtgatgagtagaataactgatgctaagaagctccaatggattcacgaactatcacaaggcagttgactcaagctaaccagaataccaatgcaaaatccaaacaaaattgaagtcacaaacttgaacatttgaacgcatcaacacatatatgcacttcatcctacttgtttcacccagaaatcaagcgagaaggaactactaaattccgaacgagggtgtaccttcttttcgtcggagcgcgggggaggcacggaccgattggtggctgccaccgcagccggcgaggcggcgccggtgcaacagagctggagcgctgccgctccgggtcaggatcatcagtgccctccatgatacgaaccctaaccacccctcccaatgcgcccaaaccaccgtaccaatccctcctccggcgaggcgaaggggaaaggcaccaacccccagcctaatccccggattgcgatttgaggtagcaagccgaggaggtgggagaatttgggggcatttaactatttgcggtggttttggctgcgcctgcgagaggtgggaaaaaaaagttggcatggatccaattaacccttgttatagccaacaccaaaaggaaaagcacgtgctcgtgtcaaaccgcagccgctctcgcgcaccgcaccagctcgggagcccggtcatcacctactccgcccgccgccaccatctacaagtacccaaacactgtgccgcacgtccgacgccgcagtcttgtagtctcgtgcaccaatcgtcgcgccgcggcgacgttaggcatttcgtcgaacacctagagcgcagccatgatgctcaccaagccccacccttcgtccaacctcctcctccccaccaccacagcgctcccaaatcctagcccaaaccctagccgcgtcacgcccctggcttccggccgtggccgcccggccaccaccgcgtgtgcgcctcccccgtcgcgcccgcgcagcccgcgtcggtggcccagcccacggcaccggcgctgagccgacgtggacgttgat

SEQ ID NO: 72752 - DNA, 21059 bp, Oryza sativa
ccatgccatggcgctgccggcgctgttgtcattgtggatgaccaagtacctcctcatcatgctcggtgtcagtagcgtactccaggtcttcccttgctgcgatgctgctattagcatcatggcattgggttgtgcctagccgatcatcatgaccatcttggcccattctctccaacgtattcaagatacctgcaagagaagtgttcacagccacaagggacctctccaatgaggaaagcttggagttggtgtcaatttgagcagcctccaattgaccaaggcgatcattggcgaccctaacatcctcatcaaggccttcagcatgctccctcacttggcgctcaaaatgttgtatgatgcccctcgtacgtggtgaatgttgagggtgctcccccgatcctcctgtcatggttaatgggaagaaacaattcacaagaaattcctatcaactattggagctagttgttgtccatctccacttctaccaaacttgtgcaaacgagttcttacatgttcttactttgttatgtaaaaggcgttggcaaacagcaagaacagcaacaatggttagtagtaccggagccgacaacaagcacgatcctgtgatatagcagataaaaatttgtggagctataggtggctgcaagtaatatcaaggtacagctagaaccacattaatcaaagcaagttgaataatcgttcaacgatggtattgtgctggtcctaggcaaaaccctttagagacgcgagcctagtcacaagcatagccactcaaaatagcacgaaaataacacaaacaaaacagcaacaacaacaacttcctctcttcccttccttttttttttccttctcttcacttctgattgattttttttctttcttttttctttcttttttttttgtacagcaagctcaaagcttcagccaacaagtcaaaacaagccttagcaaaataaccttatctcaaacattttcgaaatttcacaagcttcagccaacaaatcaaaagaagtaatgatgggttggttggctagttacatgattcagccaacaagtcaaaagtgagagcacttaaatgctttcttgggaagggctaattcacttcaaaaagttgcaaaagggttggctgttggtggaggcagcaataaatgcatttgggggtggctgatgtggtgatgagggggctgctggttgtggtggacgaaatttggcggggttggaggtggattttgtggtgaatatggtggtgatggtggcagcgggatgaagataaatgaagtgatggtggaagtgtttgtggtgacgaaatcgtgagcagaactcgaaactctaaaggactaaactactagaaccagcaactcaaccagtcgatgcaatcgaaaactcagcaagcaaagactaagtagaacagcaaaggctcaacatgttttggtgatttcgggtctgacctatttttgtggtttttcttttgggctataggtaaaaacaaagaagtgataaaatctctcaccgagcaacttgagctctgatactacttgatgcagcaacgggggttcccgatctttcgatgagaggaggttaaacttcgatttgggggaggacacgacgttggcggtccgactacaactaccacaggggtgctgcgccttagcaaccggtacaccaactccacgttgttgctgttcttgccgtgccaagaacaaccttgaacctgcaagcaatcgaagaacaagttgacaaggaaacagctcacggcacttgtcaaatgatgaaactgaaataaaccaaaatggggttctgaatacaagtatccgggtggtctagcaacttggcaacttggcttatagaatggttagagagatacttccttttcaataagtcctaccagaccccttgctcatttattaactcaaacaaccatttactcaagagtcatttattttggatctccaaattatgaacacccaatccccccggatctttgagttggcaaataatatcccatcttgtaagtctatacgttttcttatgaccatctccttgccaaaagaaccgtgatctttaataatcatttttttaaaaatcccatttttgaatctaaaaaaagatatcataaacataggtaaacttgaaagtaatcaaaaccagtcttcccccaacggacatatggttgcctttccaactactaagtttcttctcaattctttgttcaataatattccaacatttatttccaagctttctaaaatgcattgtaataccaaaatatttgtcaggaaatgtacctagctgatagccaaagatattagaatattgatcataatattcctttgcttgaccaaaacaaaataattcacttctatgaaaatttattttcaagccagataatttttcaaacacagataaattcaattttagattcttgacttcatgtaaatcatgctccaagaaaatgatagtatcatctgcatattgcaaaatagataaagcatcatccactagatgaggtattaccccacttatataaccaacatctttagccctcttaattagtaaagctagcataccagccactatattaaaaagaattggagacaaaggatccccttgcctaagccctttatatgtttgaaaattattgccgacttggtcgtttacttttataccaacttgaccaccttgaatgaaagaagttatccattacaaccatttaggtgaaaagtagttggagaaaagggaagtccttaggatatagtctggataaaaggaaagtccttaggctatagtttggataaaaaacagctatctaaccaatccggttaaacaaaccgattgggactacactaccatagaaaattagcaatagacttgtcacacgtgtggtgcctcccacgataagaagaacaacatccgagcgctacactaacatcaaaaactccttttggctccactctaccattggtgcaaccacttgataataggttctcatggtggcacagtaggcgatctcagtaaagcctccacaggcagtttgatgattttcatgaaaaacagtaaaattcgataaaacgtgatgactggtggggccccaaatccaccagcgggaaggtcggattcgaacagatccgggccacagcatggagccactgcggaagaaaggccacggcgctaccctggagaagtgagatggcattagcagtgctagggagcgtagggagcaaggacggctacggagcttggagcgccagatatgccacccggcgttgctcttccactaagtcgaccacgacgacctcaagtgcgacgatgacgacagcaacaaccatgtcgaccttgatttgtgatttgtgatgccgtgagatttgtgatgtctgttttggatcctttaatttgcgatgatgtagatttgttctatttcttctataaattcatgatgctacggatttggaactttgaactttgaatttgtgaatggaaattttggattagattgaatgggaaggcttgaatggaaatggaaaatggaagcttccaacccggcagaaacgacgtcgactgcttctgttttagcgctgaaaatcattttcacagtcggaccatgtaacctagtcgcctatgaaaatcaattttcgcaggcggttttcgtctgcttgtgaagatcgtctattttcactagcctatggttgctggcggtcaggtggctcactagcgaaaacgtgttctggctatcaggaaaaatgtgatttgtagtcgtgactgaatagcttttccttcttttttgtttatcaaaacaacttttcagtttgacaagaatcatgcagatagatgaaaataagttcttgaatatatccacttattatacatacctattgtgggacaacagaaatgaacttgtcgtgtttggtgcctgcgtcgataagaagaacaatatcctgctagtgccacacctaacgtctcatactctgtctttgccatcaactgacaacatcatcagcggctcatgtgatggcaccaatatactactatgaaacaggctccacaaacttcagcatcaaaacatccagctatccatatcattcctggtaccatccgttcccaactagtacacggcacacaatggtacacatgaagtagtgtggcttcgtcgcccactcgctttctagctatctgaaaattgaagtctagcctccttggtgaaatactgcagggagggagaattcttgtgttgcataggaaatgtaagtagcagatgattgaatcatatgcatgtgtgcccttcattctgccctagctggctttatgtgtctttgcagtttgacacattgagataaccctttgtctttaatccgacgactgactgagcacatgggagatagtgaaatattaacacttgcttatgatctgactgacttaacacgtgagaacatcactgaccagctccaccaggtaaagccttacaattaaacaacccaagttaatgcactttgcaaatacaaaccaagaaaggcagggttttacctttccgaaagggtacgaaatccaaggacctggttgtaacaccccaaccatttgtagcttctagtgtggtgtggtttaggcctaaataacctagaattagtgtagtagtggtggttcagtattaccttggaagtttaggtgaggacatgtttattagcttttgtgctccaatcatagtaccctcgagtcgaaactaggatgaaagtgtaacagggtactgatgcagatttaagaggcagggtgttacaccggtggtttgttgatttttgtgggaattgataaattaaaaaaagggcagattttaaaaacccaattgaattcgaatgctcttgctgaatactgaaaaccaattgatctcattgattttctgaatgaaaagacagaactccttcgggagaggtctgtaaattgaatgagatctcaatcggtttaaaccgacatatttgtgcaaacaaccagtaataactttttatttgctgaaaattggaggtagtatcattttttatgttgtgacttattttatcattaaatgtatttttccatcatttatattttgtatatttatactaaatttttaaatatattcaaacattatattttgaagttaacaacatcatatatttatatgtacaatagatggtggtagttctctatggaagacagttttgatgttacgatttgtggaggacatatgtaccaaatgcccacatatcctgcatatccgactacagatataggaggtgggctagacccatacaatatataatagaatagaacacggtcgccatgttctcttgtaacccaatgcaggtagtagagcctcagccatagactaccatgtaacagactaggaatccaatgatttgtctggctaggatttactccttgtaactctgttacctaacctgtataaaacgggtaggaagcctttcaatggcaacaatcacaacacgatcaacagataagtgcgccaagtaggggttgcatcgagtgtgtcatcgaccagcacgatggaaccaacttctggagtcgccggaatcaacttcccacgggctaggttttatgcttcaggagcttcaactttctcgctgacggcttcaacaagctttccctctccaactcggatccaaactagttggggaggcccaagaccacacaaatcctatttcgtctcccgaatgtggcccaagacctactttagagtggctattcttgactcggattcaaaccagttgggcggaacccgcctgttgacaaaaaacacgaggcctgggagatctgcttaactccagtgcaggtccaaaactcgccttcaaatgtatgagcgtgccagttgatttactcctgtaataaaaaagaaacaaagacaaagaaaccgtggttaaatctataaatgatagccgatcggctagatgccgatgatatatcatttatcttaagccgatgtcatatgtacatcgaccggcaagtattaataagcaaatcagaactaaatctactcgatcggctgtagatattaataatatataatccttatatcgatatatacttaaatcaagtgattgggatagatcggtcaccttgccgagatagtataaatcacttagatcgaaatatatattaataatgagattttatatatattcatagcatagccgatcagatagatctagcatgtatcggctaatactccgataccactctatattaagatattaaagcaagtagaatgttccaaacaggagcttaatatacttaaatgcaacaagatcttaatataaacggcagatttaacatatcaatcaggcatataggatgaaagtaattaaatcaggtaagatcggctgaaactccgatactaatctaatcggcaaccagaaggcaggctagatattatggttctaagcacgacttaatagatcaaactcaactgatgcagcattaagtattaaaagaagaacaatatctagacaatcaagccgctggatgtttcatagagtggtagatatatcacataatctaagtcaatgtcgttatttaacctaatcgactgccttctattgacagaggctagccgattataggttagatgacgatatcattaaagattatgtgagatatatgataaatcgacgaattacataaacaagattagagtgtcataaagatggaagcactaatctcgagaacacaagtcgtcataacaagttttacctcttgttgaagatcgaaaccgatgcagctcaacccgaaagcaagaactcgtcgaaacaaagcgaaagtaaaagggtggcgatgcgccgagattgtattgaacgtgtgtcttctttacatagggctcggggtctatttatacccgagaattacaagatatgctcataccggacacgactattatctctaacaaactctaagataccataagtctttgcggcagacttttgcccacatttatctctaaggaatttacatgaaatatcctaattaatagatacaattgctttctcaggactctatccatgtatggcaatcatcttgaagcacatcaactcagacccggtgtcgtaaacgagtcatattgtcgtaatcggttgtatcacttaacctagtctgactctaacttagccgatcccatccatggccgatccggactcagccgatccatgctctattcttgaattgatcttcgcctctgactccgcttcgatccaacctccctttccgatgctgatattaccaaatttggtcgttaacaccgccccgtgctcttcttcaatcggtttctccaagaacgtgctgacggtttatcctagaatcatcatgcaacttcctccactcctcattgcaagttttgggtctacttcaaccctatccccatgggttcaacttggatatgacatgactctatcctagtacgtgcttagggaggtagcagaccatattcacccggtcgatgatgcaaatagtaatatcgacaacatcgatgaagaatgttatatgagtaagaatgccttcgtaaggaggcggtaaatgcaaagcaatggagagctgagcgtatccgggacttgcgcatgccttcaagctatatgcaaaagaatattctccagatagagcacgaggagcatgacgtcttactcgtcttagtcaaacctcagcagaatgtcatcatggcggctgttaccttcctcgatacagtcatggagaccacaccagatcactagatttctcaaactttggcaaaagtaaaggcaatgatgagtgatgcagtggtgcaacagcaacaacatatttctccaccttcttccatcgcagttccctcccccatccttccactgacattgaatgcccttcccgttgaagctcccaaatcattgtttatccttctagctgaagtcttccaagagatgcagacgaagcttaagggaccacctctgagatcagccgcattcatgtagaactggtctcgacgacgaacaaaatggagaagcttggggaggatatggagagagcgaagtctgataatgcccaccaacgccttttggtgcaagacaatgaggtcatccacaagaagagtgaggcagcactatcattccccctcctcttctcgatccggatcaaagccctggtgggcagcacagctagatccgtcgctcgaggttagggtcgatcgctagatctggaggttagaggccaccggatctggccacccccacctcgaggacctcagtggtttgatagttcaggcaagtagcagtgacgccggacatccttttctacatggctacacgtcatcttgacattcttggggttttttttcacacgtattttgcatcggtgatgggccgtgttgtataaagtgacgagtcaccattagaacccttcaatgataaatgtcattagtgataaaggggacccaacacagataaggttttcacaacattgataactatcatccatgaccaggcgcccatccatcacgcataagggtcataacccgtttcaaatggctggttgtagtgacatgtattgaatcatagggtagaggcagtcgtttgccaaattttcaaagaaaatccaatttatttaaataatgtggagtgtggatattttaaactatcgtatgaaaattacattttttttctcaaatttgtctaagtttttatttatatggtctcatgacctgtaagtatgtttaacttagaagtggagacggttcgatgggcctcacacgtagtaaaccacgcatagaagtggctttctatctatgtttccatctataacgtaaaacgtagacagggctgattcttacacaattatatattcatgagtaaatcatttttgtaaaattaatctgaatttaaatatttagctacgattgtacctgacctggtgaacagtgcacatccaacacgtacggatggtagacattttattgctgtatgtgacttgtcacgtgacacttttccgttctttggccacgtacttggtactagtatcaaattttcaagcgttccagcgaactaaagcacacaaccgcgtacacgtacggtcaatacctgtgagaaactcgtgagccggccgggactagggccctgttcgggagtgagggatgggaaccctaaccccctagcacggaaaatggaggaacgattagcgcgtgattaattaagtatttgctaatatttatttttaaaaatggattagtatgatttttttagcaactttcttatagaattttttttttaaaaaaaacgcaccgtttaacagtttgaaaagcgtgcgcgcggaaaacgagggagacatgccatctacatcattatcctttcttaaattatattctttttaatatatggtaccgtcaattagtaggcatacgtttcgaccattcatttcatttaatgtaaatataaaaactacaaaccatgcttaaatatcttttacgagaaaaataagtaaaaacaataataattacacattttttaaaaattgtaggagtgatgaaatgcatatgaaaagttaatggccccatatattaaaaacggagggagtattatacttttcggttttatccgtcttcatataagttcattgcgcacaaatatttcttcaagaaaatattcattatacgttcctccaacaaacggtcacttttatctcactgcatagttttttccttcttttttaatttaggccgagtttagttctaaagttttttttttcaaacttccaacttttttatcacatcaaaactttcctacgtatataaactttcaacttttccatcacatcgttacaatttcagtcaaacttctaattttgatatgaactagacacacccttgacaccttctaactgccatgtggtcacggtttaattagctagtgtggtgcatgggctaccgtcgcgtcacctgtttttgccgtattggcagtggcagtgcacgtactcaaatcattcaagacggtacatgtattaatcggcaagggactgccagtcaacaaccaaacattaagatataatctttaacagttcgttgtcgatcgtgaaacgataaatcagtatcgattgattattcaactgttaaagattagaccaatatatagtctcaacccaatagaagtgatccttaacaatatttactctcgtaatataaatctcaactaccaagtaattcacacattaaaaaaaatgcaaatttggaatcgacatattaccaaagtttctcatacaatagcaaatttggagttcaacgatttgccatcaacattgtctctttctataatataccgacgattttatcaattaagtgatccttaacaatatttactctcgtaatataaatctcaactaccaagtaattcacacattaaaaaaaatgcaaatttggaatcaacatattaccaaagtttctcatacaatagcaaatttggagttcaacgatttgccatcaacattgtctctttctataatataccgacgattttatcaattattctacaatatgttattgggctggaccttcttttcaaaaatacttaaaatactcctagagacatataagattaacaattgatttaattatctcaccagaagtttcaaaaaaaatatgaaaatttttatgtggcctccttatacaatatggaagtttgtatacaagtttcaagttttttctgtatacttagcttttagaaaaaatatatattgatgtgatatatgtgagagaatttgcttatacaagagcacaaaaatatcttatgtagtgtatgaaagatgatttatattaaaaatagtaataaaaagtattttatatatcatataacaaataagttatattttttataacaaataaaaatgtaataaacttgaaacttctatataaatttccacgttgtgtaagaaggccacataaaagttttcatattttttgaaacttcaaattagataaatcaattgatatattttggtaatatgatttatttgttttggaaatgcttctatgtcttttataaacttagttaaacttaaaaatgtttagttaattaggaaaagatcaaagtgacttatagtataaaacggagggagtatttgatttctttataatatataatatttactttgtccctaacatgacagataatccatcaacttttatccaccattcatctaaaaatatatttattttttgactttgtgaaattccacaagtttgaggctaatgtgaaaaagttgggatattatttgctttaaacatattatcacaatatcacaaacttatattattttataaacatatttaaatttaaatttgatattcacagttttaaaagtttgatcctaaatgtcaaacatttagatcagcttgtactcgtttgagcactaaaaggtttttgtgctagctgctccgtgtcatggcacgaaacaattgacacatgaccacctatagtgctcctcttgtgacggaaacgtaactttttggacatatgaatcgtactttgaaccagtttttaacttcttattacataagttgtatattagagaaggtagcaaatgttttcgcatcacaccatatatattttgtttagccctagttaaaattgtagcatgcgtacgtaaaaagaggtggtcctgtatatgcagttgactctattttaaattaaacttcaaaaacttaatgtgaaaatcaatatgctttgaatattcaatttcacgtatgaaatcataatattgtagttatattatgtttctaaaagtgttttgtattttagttaaatcactggtcacaaagttatattttaaagaccatgtgtcgagttcaaaacgaagggcccctttaattaatttggagaaaaaatataggaattttagaggatttgaatcctataggaaaatttcctacgaagccccttgaaacaaatgatcgaatcatatccaatcctttgaaattcctacggaatggacaatcctatagagattttggaggaaatttagcaagagttttaacctcttggtaactttcatttgagtctatctctctcatccaattactgtgtttttcctattgttcagtcaaacggttattcgtgtgtttttcctgtgttttacaattatctattttgcacttacatttctatcaaaaccctacgttttttctattcctacgttttctcaatcatgcgatttaaagggggtctgaaatgtttttttaggggaaaaagtatatgctatatattgttccttctgttgggacaggtgcagtgtaacaaacatatatgtaacctgccttgtatccattgaaaaaaaaaatgaacaagagaaaggaaaggaaagtaaagcaaagctttgcaataactccattgcacgagcatcctcacctacacaacccaacccaaccaagcaaagccaagaatacgtgtagtacgatcatcacagcaatttgcaacgcttccgtttccacggaagctcagctatctatctagctagctacccattagctgtccacgtactttcttctctcatcaccatcgatcacgagcactacacctctcattttcccccttttaacaaccctacacatctcgcctccatgacacacacacgctcgcacgtacgtctccacagcatctaggcatctagctagctatagctagccatgtccaccgtcgtcgccgccatggccgtcgtggctctgctgctcctgatggcgctggtgccggagatggcgctggctgatgctgccggcgaggggaggaggcagcagccgccgcgcccgcggccgccggcgttgctggtgccgttcagggcgcggtcgtcgtcgccgcaccgccggcagcagccgccgccggcgttattccgcgggcgggcggcgaacgggtgcatgccgagggggttccgcgtgccgccgtcggcgcccagccggtacgccaactaccacaccctcgacgccggcctgtgcgacgaccacggcggcggcggcggtcgccggaagccatgagcctaccagctgcaatgcaaccttttgtttgtatatcatgcatgcatgatgatgatttctttggaggagttgagctagtataaacaaatgcaagcatatgcatacgcgttgtggttgtttaattttctttgggcataaataatgtttgaatttttttctggaacggaacatatgtaataatgtaatatgttttattaatatgtgccctttcttcgaagaaaaaagggttaattcggtatggttttagtccactgatcacttccagaattctcgtcctttgggtcattcatatcccaatatggcaacattgacaaattagactcttagatcaagcattaaaaaaatttccgtacaagatcaatgtgtacataaaacttcatttcataaatgaagttttaaagatatagctgaggggtcccttttctttgtgctaacttctccccggtttggcggatagctggcgttgtcaacttttatttagaaccacctccccctgctttgctaacctccaaaaccacccccttatttcctctcaaaacaaaaaaaaaatcccacatcctctcccctctcggccatttcctgccgtggtaggaccgtaggagagcttgctaaggccccatattaaatttaacccatatgttataacaacttgagactatatatgatgtgaaagaaagatgaaaattctcttcgtaattgacataaattaggttgataaataatactgtgccgcacaatttattatacaagtgacaaactcatgcattcgcacggctatatattgatgttataggaattccaatattagtgtgggatatatattacctactcaaataacattcggtagaaaattccttcaaattctttcaaatgtaattatagtgtaattgcggcgtaattatatctttaactctagagtaactaccgtataagctggcttggtataggctagcagcggagaagcttttattcccttgatcaaagggttcgaacactgcttcatacgtgggtttcaaatttttttttctcccacgctgcatgaatcttaaagcacatctgatggtccaaattcgaatgttttgaaagaaaaaataaattattagataatatttttattttagtgtacatattcaggtataaaattatttacaatatcttctattcataacctaaagtccataacaaatcagtctataagtttggaattgatatttccaagtatataacgtgttatgggtgctgttccacttaacgtttcttttaggagagctttaggaggtcagaatctaacttattggcacgaattatgtgcttctattgttcatatccagttgaataactcttctgattgttttagatggagttatcatcagaatggtcagttttctgttaggtcaatgtacttagctctaattaataatggttacattgacagaaataagattatttggaagcttaagttgtcgcttaagatcaagatctttatgtggtacttgcttaaaggggtggtgttaaccaaggataatttggcaagacggaattggaatagtagtctaaaatgttgtttctgtatgaaaaatgagactattcaatatttatttatggagtgtcattatgcaaagtttatttggagagcagttcagttctcttttggattacaccttcctagtagcatatctgatatttttaatggttggcttctgggggttgacaagaaaaagagtaaactgatacttgttggagcctctgccttatgttgggctctacggttgagcaggaatgatagggtttttgataattcaccatctgtttcctatatgtaggtaattttcagagcaacatattggctccggcagtaggcacaattacagaagtgtgatgaagatagagagttcccgattgttgcatgtcgtaggcttgacatgatggttatgcaacttttttctaattatggatggagattcaccgatagactggaatagtgttctcattgtcctgttcggttttcttctattttggtttggtatgtttcgctttattttggactatactcttttagagtgctagattgtaataattgactgtagctcttttgagcaaaggtcaggatgttttattccattatctaaaaaaaaaagtatataacgtgttaaccatattcttttctttatcttatatactttactgatttacatttcttgtccattaaattagttatatatttttgatatcttttttttgtatggaataaactttgttttgtaatgggacaatttattacataattcgaaagaaccggattcaatttcagcatgtgtcttatgtattacaaatcttagaaataataaatgaactcaagaaattttaaattttaatttcacatagggtttcactatataaatgaaaatttaaataatttttaaaatttgaaaacatatttttagtctgcacaacgttgccacatcacctaaaaccgcccccaaattatcgtcaaggtttaaaattgcactttttaaacagtagggttgaataatacgcagttaaactatataaagtttacggtcaattttgtggagttcaaccaaagttcacggttgtaaatggtcttttccatgttccaaatattcagatattcccatgcatatttgtactccctaccactagtttaatgtttgaaaatatcggaatggctaaatggttggcgaatgatttttaaggccaaaatcatgcagattactgaccttgggacttgctttgcgattcgtgctccggcgaccttaactcttctcctccatctccggcgacaccttctcctactccagcgaccccgaggaaagcaatgaaatcaaggtttagggtcccgggttgggatgggtgggagggggtggggggaggaggaagagggatcgccgagtttagaggaatggccgtgggaggcggtgaggcaccggcggcagcgccgaagctgcgggaatggaggagggcggtgggccggcgttggcggcgcgggcaaatggctaggagacagcggatccggtggttagtggttaggaggcggcggctagtggtgggggatctggctgcgggaagccacaggaaatggggaaaacggcaggacgagggcactcatgcgtccattggggaagagagggtggagggggtaggggaggaggccagcctggaggggaggggggctcgttggcaccgttaaccctttccagccagccgacgagtccgggcagcggcggaggcaacgcacacgagaggaggcagcggcggcctggaatgactaggggagagagaggggttagggttagaattgccatcatgaatcttaaaagcgttctaacggtccagaatttgcatgatttgtgaggtgttttttttttcaaatgccatctagacggtccatgaaaatatttggtcatccaacataatagaacttgtacgtcccatcttgtgccatgtgctccaaagatgtatttccacatttgctaagcccagctccctatttaggttgcaacaccacatggaagtgttaaaacagccgtccgggcagccaacatatctgtctctcatactcacacaaacaggctaggtggtctggcctagaaaacagggagaacttaaaacaacagaaaggagatgattagctaggtagtacttgcaatccatggtgaatgcttttcttttcttctatcctttattggttggattttaggacaatagtatgagtaatatctccgggcattgctacagttgtttcaccaactcattgttacacaaatgttgtactagtaggtacgttgtagctcttatgacaacgcaaggcgtttgttgtctgtaggctagtcttttcatgacatcttcttgtaataacttttttttctcacttttgttataacgcaaggtttttgttgtccggagcacttgacagtaggaaaaaggagaagattgataacataagcaaaatgagatgaaccattaatgcattattaattgagtatcaattattttaaccttaaaaaaattaatatgattttttaacaacttttcttagaaatttttttgtaaagtatacaccgtttaatagtttgagtagtgtgcgggcagaaaatgagaagtattttctctcaatcctgcaaaattattttattattagaaagaataaactggtttacacaaactgatctgccgtgtttccacaagcttacttcatgaaaaaaatatgtagtgcaaacaaaaaatgaaaacttgaaaactactgtatgtagacccccgattttagaaatcggaaatcttctgtgtttatccgtaccaatccctagatcagtagttggtacacacatacatagttggatcacaaattcaggctaaaagagttaaatacttacattagggccaggtaggccaacaactatcagaaaacaacagcggaagacaaaataatataagggcccggttaacatgccacaggcagtcgactggggaacgagacctagaacaagaccgcactccgatcatcttgttggatacgcaagcgtaccgacaagggcttctcttcaacactctcctaaaagatatataaatagcaaggatgagtaccaaccgtactcagcaagccaccacaacaacaatgcgtatgatagaaggtatttcaaggaatggcttcaggttcttttgcataaagctagttttgcaattcttttcacaagcctaagacctagcatagactgatcaagttttaataccagcgttcatattaaacaacgacggttctgtccaccatccattgtaatcccaaggatagcttcccgttattgagtcgtcatggttttctgaggacgtccaccttccctcctctcaggaagtggctccaacagcataaaatcatcatgcaataacccattccacacaagttaagaatttagagtctagccaagtgtaatacatgtcccggtgctcaattaccgcgagcacggctattcgaatagatttggtttactcacactgcagtggatgtatactttacccgcactccgcgactgcccaacacatgagcctcgtcccaacacatgagacgtgtcacggcaaagcttttcgataacctcgcattggcagtacccgctccatgaacttttcatcctcatgcactctagacgtacatagtttctagcagtgagaggagttctagcgcacccgggaagggaagactcacacacatgcattaagttataattatgttcaacttatcacatggcagtcctaccgatggcgacaccactgtagacacccgcctcgcggtcctaccaatggctgccccaccgtagagcccctgcctcacacatcaagaaaccactatgcatggatactgcctccgctcagctatctactccgctaggtctatacccatacgagaagtgcggttgtacgggggtcgtttcatgcttaacttcatggctcggtccttaactgaccagggacggcactagccttttccggacaccacccaaatcctccgtccgccccagtcgaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcataattgactagggactcatacgtaaacatggttacgaaggcataaggggtaaacaataatcaaggcatggcataatcacaagtgggatgttcatccttacatgcaattttatttgtagataaaataatttcgcaattgggatcaacatgttcaaagaatagtgatgacttgcctgctcaggataatccttattattgatataatcttgatcaatcttcacctcctggaagttgcagacgttgcctcacgactaaccgatacacaaggtctataatacgcgagaaaaaccaatattcaaacaacaatcaaatatgcacaacaaaatgtactatttgtgtttgctaatgaattccaatcatgctaagggctaaagtttcttaatccttctattgtcatcgtggtctatttaggagttaaccaacttagcatttataggatacatatatatttggctaatcggtggtttagtctatcaaatggctatggaagtattatggctacacatgcatttatctaaataaagtggtcatatactagaggttcggttgtcggatggatttaggatcaatcaaataattacagtgaatcatttgtattattattattctattgatgggggctttactttaattatgaacaaattttatttgtcacaataaattatgaaaggataataattatccatgctttgaatgttagagttgtttaggttaaccatattatggttacagattatcccttaatgaacaatcctaatttacagttgaactataattataattatacgaggtcaagatttataactagtatttatctaatatacatgcttgtcatatactccctctaatttaatatatgcaacacgcaaattaatactataccgtacaactataatgggatgtatagtatatgtgtaagcaacaatatcttattattggatcatatatttgagtagttgctttttagtgtaagctatacaatacatgttgattttaagatggctctgtttggttaactaatggatgtcaaccgactatatatatattctacttcacataacattgtatcgactaacttttaagtggtccaaatacaactagctctgtgattattctcctaaacaagttaaagattcatctatgtgtgtttatattttagttacaaaatatgaggctaaactttatgtaaataatttataagtcatggatttagttatatttggacatagaccagtaaatggcactaatattttcctatacacccattaatttgaaggattgattataactaatttatgtggtttctacagtgacaaaacatgttaaagaccaatattattacatctactctactgtacaatatcaaatctatttattagcacatttttaagttgactactatgcattatcttgatattaattgtttaataattataaatatattttattaaatagtgaattatataccattggaaagcttatgaatttatatgaatttaggatcaagtttcattcaaatccgagttaaaatgagagagttatgctagtttaaagattcaaatttgaataattgcgaaacagtactgttcctaactcatttatttttattccataatttacattgactgacctgtgggaccggcctgccatggacacaacatatataagtgaattttcatagatttttaatcatagtgaccccacatgtcatagactaacttacttgagattaatatctaatcactgtgcgctaatcaagtagggcccacatgtcatatccttctctctctcgttctttctctatcgtcttctacctccagaccgagcgggagcagcaggggcggcgcagcgcgcgcggcaaggccggcggagggcgacccgacggcgaccaggggagggagcggcaaggctccggcgtccacctgccggcggtcacggcataggacggcgcgggggcgagcggcgctgcaaggccgccatggccgggcacgggtagctaggtgctagggcgatacggagggtttccgaccgaattggtgagggcgtcagcatctacggcgtgtgagggttccattttgctagctagatggagaggaggggctccgggatggcttgtccacagcgagctcaccggaggcaaaacggtggccggaccggcatggctacggttgctaattggcgaaattaaagggggctctagtttttacggaaataggagaggacataggagcgaggacttaccgagggatggaggaacgacgaagctcgacggcgttggtggagcggacaagaagctgccggcatgcacacaaggtgtttgagaaaatgcataca

SEQ ID NO: 72753 - DNA, 2011 bp, Oryza sativa
ccaattcaccagggagacgagagtacgagacgcagtctgcatgcatacataatttcgacgacctgcagatcgattaaaggcggccaatgcaagcttggcgtttgtccgcgccggcactgtttgcgttagctgctatagctaggctccgcgtgcggccgtgcagagtatggggtggcatactgctacagtacatgctacgcgctgtgccgcggatcgcgacggcggcatgacgacgcgcgctgtatcaacctcgataaatcgtcgcgattggtaggagagggatcggagggagccaatgcaagcttgccggctgtgcgcgatgatggggtgaaaacagatacggaaattcccgatcgaccgaacgacgttttcgtaatatgggtactgtttctgaccgtactttttcttaatttttaaaatttggtttttcataatttcttttacatcgtattaatatcgatactgagtagtttaaatgataaatatgttccattaccgatcgagtattgtttccgactgttttcagcccgcgcgtgcacccgagccggcggctgttgcggggacggtggcgtttaatgtggatgccacggggacacggggtgcggtgcgccggtgcggtggctggtggtagatcgagctatagcgttagccggaataggagtggagttcgcgggcccacggatcgatcaatcggtgccgccgcgacagcgtcggcagccggcaggccggccggccggcctcgcgtacttcctcctcgtgcgtatggagtcaaatgctccaggtgtttcacagttgcagcgaatacggagcacaactagcttggttcggttcctgcgcgagggtaatttcgcggtcagatcacgccgcgcacgcctacctacctgcacacctacctaccttgcaccattctactcctgcctgtttcccatcaaggccgtgtttagatcaccctcaacttccaattttccatcacataacatctaaaacttttctacacacataaacttttaatttttttccaaactacaacttttatcaaacttttaacttttttcaggaaccaaacacaatccaagtgcaaagttagtttttttttagggggggggggggctgaaaattccggaagctctgaaaatgggagcatctcaggtacaactgaaaaaaagaatcacgaatctttttcaaggaccaagtaagagcacgagctcgaataaggcggaacacagtgaacgcctctagctgcgatgcatggattgcatgacttcatcaggggtcaaagcaggaatgatgctaccgcgacagttcaaagtgcgggcaaggcttttcgtgacacgacccttctctggccgactggccgtcgaaacccaaccacgacacgcaccacgggagaaacaacagaggaagcttacaaacaaaagtgccatcttatcttggcgaggcgtggcagtagagcgtatcagggctccttcagtccagcaatcaatgtagggcatcatggacataaactcgataacaccaagcgtaccagtacgagaaaaaggaacagggagaaaggttttgatgccctcagcaacctctaccaacctgtctccacaaaggcacaagaaagccatcaatgagctctcgtcaggaaatggaccttaattgtaacaaagtcagaaattacagaacagggtccacccggaacaacgaatcatcgctaattctgctggcaagtgatcagccataaccataatacgctgatttaagcccgtgacatgagttatacaaatgcatccaagcttatcaaccaagttgcccgtgccagacaaatcaaattctgttgctaaagaaattcatttgatgtgatttggctagcagccaaaaaaaactggaaccgtgtacccggtaaaatctagactccagacgaaccagtacctttccatcatctcaaccattaggagcaatagaactataggagtataccatgcatgacatgttttggactcactatgcatcactctttcatagg

SEQ ID NO: 72754 - DNA, 2959 bp, Oryza sativa
gcctcgcacctgactccttccgcgccaccaacgttgccaccgcctccacagtcacggccgccgtcgccgctgccaccgacgcgaaccaccgcctccgcaaacgtcgttgcgccgtcgccctccaccaccaagcagccagcaaccgccgccgccaactgccgcgaccacaccgccgccgctgtcgccaacaggcgtcgccagccgaccaccaccgaccgcacccagatccggccgagagccgccgtggacgttgcagatcgcgggcgccgtcggcagccaccgccgccggcagcaccacctccagaagctcctgccgacggatgtcgccgccgctgccgccgcgacgggtgcccctgccacaagcttgccctgctgtcatcgccacgttgtcgcgagctccgctgcccccgccacgagctagctcgatccggccgccgggtggctagatctgccttcagcgtggccggatccagcgcctctgccgccgtcgccatccccgccgccgtcgacccagccgcgtctctgccgacaccatcgccttttggctgtcaaaccttacaattcgaatttaaaattccaccccctctctcgaactgagctattccgatgataaatcactaggacgacataagacagacacataacctacgtaccacaatttcttcccgccgccgtctccatccctgcgccagccgccaccccgccagatccggccgaggcggcgcggatctggcggtcaccgtcgccactgccctgggttgctcccccggccgcccggacgagatgaggttgacgagaaaatgaggagccccgccgccgccgtccttgcggccgcgcggctttgccggcggccgctcaggcggcggcgaggcggaggaggaagatgggggggaggggcggccggagattgacgcctcccgtgccacctatgggggagggcgacgcgagaggaagggtcgaactcgcttcacaaatagtgaacttttgaagctgatggcataagatggtcattaacataaattactcattcgatctcaagtaacaatgttcatacaaagactatagatttcactcaagtatccaccttggtttccaggtacaaattgctcatcttactcctaactagatgcaattcgaagaaactaatatagaaaaggctggtaaggagttgtaaggactgataaccgcggagaatacaaacagggtacgtacgcgacggcgcggtggggctcatcggcggcgatctccccggcggccgccggccgtcgtgctgtggcgtaagggccggatgtgtgggggaaaattagttcaccagctcactcgtccatccgagctggacaagtcaacaagccctccttccacatctcccgagccagccacacccgtccgatctggcgtcgcgattcatgcagatccgaccgccatgggccgtagtgcgctcgtgcctggacaggattaatgggccggtcgaagcaggaggcccattatatcgacaccgagtaggagaggccaatgcaaattagtaccacctcgcctggcgagagtggaggatgaggcagaggatgctataaaacgatgggcaaggcaacgtagcaactcatacctttctcggccttttggctaagatcaagtgtagtatctgttcttatcagtttaatatctgatatgtgggctatgtgttcactttgatattaaatttattttcttgtgggggaaggcccaccacggtagcttgctatcggggctctcgcgtgtcgccctagcgttgcactactgcttgggcccggcgcaccccaaccaatccacgtttcaaagattttgatctgctcatttagttttatagattttcatttgttataaatatttttttcaacttgcctaccgcagcgcaatgctgaattgctgcctgggctgaaaattagtatatcaaattagtatatcagtataatcaccggatggacgggggcatttttcctggtcgattagtccatttccgtttccgaaccttttggtcgattaatccgtttccgaaccttttctggtcgatcaatccagttccgaacctgcatggctgttattcgatgactcctgtttcttgactgtgttattctttactaatccctctcgctgcccgtccgttctatcgcaagggcgtggtgttggggctgaaggaataaatgtgcatacttgtaacatgaataatctgtaaaaggatcagtagagatgtaggtgaatcactgaaacatgcaaacgtgcagtaatatctcatctgtattccgaagacgtttttgccctttccgtcagggcgtcggggaaagcccattaggcccagtttagttctcaaattttttttcccaaaaacatcatatcaaatatttggacatatatataaagtattaaatatagataaaaacaaattaattgcacagtttgtatggaaatcgcgagacgaatcttttgagcctaattagtccatgattagccataagtgtaacagtaacccacctgtgctaacgacggtttaataggctcaaaagattcgtctcacggtttacaggtgagttatgaaattagatttttcattcgtgtccgaaaaccccttccgacatccggtcaaacgtccgatgtgacaactaaatattttcttttcaccaactaaacaagcggcagttattgagccttttcatttacaggcagtggaaagcaacaatactagactaggcctatcaatcgtgtatcgaactgagacagttcacaagctcagctacgcaaacagagcaagagtcaacttttgtagcatggtcattaacataaactactcattcgaggtctcagtcattatttgacttatacttataatttaaatttaaatgttacaacttggagtaagtttccatttgttttcttaatcatagtttattttacttcatttgcttttcttttacgggtcacgaggacg

SEQ ID NO: 72755 - DNA, 7637 bp, Oryza sativa
ctgggattaaaacttgaacagtctatgctaggttttaggcttaagaaaaaaaattacaaaccttgctttgcgcaaaaagaacaaaagccatcctttgaattcctctgtcatgtgcaccattcttgtggtggcttgcaaagaacggttggtactcacccctgcaaatataaaattaatcagaaccaggagatgaagcctcgaaggatccctatgcctactaccaggagggagatgaagacgatggcgctcagtaggtcttagtacggtcgttgcctgtggcaatggcatgccgctgcctgaattccgctgccttatctatttctgcttttgggatgtattccggaccgctcggtccgatgatttaagactacgcctgcgggcttatgatgtaataattcgtattagacactcgtgtatgtgcacttggtatttcagctatgaattcgtgtgtaccagactacgtgatccagggaaatggtactgtttacacgattgattcctgttataaaaacgggggtccacagagctggtatcagagccatatgactgtaggaaaagaccaaaaggcgccccaccccttttctaagttggccaagggagaaattcccatttagtaatactttcaaaaataaaaacgctatatttacaaaactcggtacaattttcatcttactcttaactattttcttcacaaaacaagttttactctcaattgactttgggtttttcttaaaattagatggcagattcggattcacccgctacctgagagttgagcttacctcaatcagaggggtatgtcattgagctgcatcgtatgttgaggcgtctgcgatactctgggttcccgtcataccgagtgagacagtgtggctcactttgggaggctcgggtcgaggttcacccccgagtcccttccgagttggactacagctttcagacacgtcaccaccgagacctgccagataccgcgatgcaggatgcagcccgggaggccttcctccgactcagctctatccaccgagctgagttagtgagtaccgagtttgctcatcacccgttccgggaggagagcaactcagtttgcacagttcaggacacgccctgctgctacaacccgatggtgactcggttgtcacgatgggctgaggcagtagatgactactacgaggaggctctgttggagattgacgaccaccagagacgtatgggagagctggagactgagttgactgacctctcagtgcagcagcttcagttggaggaggagcaccaggcttggggcagtgagatagacttactgaaggcacagctccaggtccacggcgaccagttccagcagttatctgaccagtacaacgatcgccgcgggatgatggatactcttgaggagcagctgagagagagtcaggagcacgtcagccagctggaggagcagcttcgagtagccaagatcagcaccacaggggcttctacttccacagcagtaggccgtgaccgctactttttcctcaccccgccgtacccaccggcgttccacgctcttctgggagaggctagtatgctagctaccgagtcagcaccttacatagtggacccgacagcagcacagccacctgtcccggagatggtgcacactccactgatccctacaccttctccgcagctgggttccagtttggagactccgatctaggtcgactccgagacagaggggaccgacaccgagccagagatcaagccagacatcactgatccttcagaggatgagacccctgttccccgcatcaccttccttggaggtcctcgcaccctcagcactactcgcaagagcacacgacctccgggcaagaggcccaagccagatccagaggccactacttctgagccgtggggactccggtttgcgcgtgccagcgaccaccctctacctgccccaggatcctgcggatggctggaggactagactgacggactccttgcagcttcgatctcgtatcagatggtttttggatagtatgcgagacacccccctcccttacctagattgacgagtagattgatgattagtttgatgtatcttttggatgaaccttatttggactgcgtatgtatgcagtcgattgcatcatgatttatgtgccatttgtgaaactctgtgatgttatttatgatatctattgttgctgtgttataaatgagtttattccaccatgcttgcaaaacaaagttcacatcaaaacaatctcccctaatgggataaagccgtaaaagatagctagagaattaggatacttactcaatcaatcaacctgcacagatggcaagccgacgtcgggcaacaaccagcaatgacgaaactcagacacccgacttagccactctggccggagttatggccacccaaactcaacttctgcaagctatcgcgaacaaccaaggcaaccgcggagggccaagctttggagagtttatgaggaccaagccacccacattcgccacagctgaagaacctatggatgctgaagattggttaaggatcattgagaagaagctaactcttattcgagtacgtgaggccgataaagtgatctttgcggcaaaccaattggaaggaccagccggagactggtgggacacgtacaaagaatcccgagaagaagatgctggagaaccaaactgggaggaatttaccacagcctttcgtgacaacttcgtgcctgccgcagtgatgcggatgaaaaagaatgagttcaggagactacggcaagggaataccacagtacaagagtacctgaaccatttcactcagctggcgcgctacgcgactagagatcttgccaacgaggaggaaaagatcgacaaattcattgaaggcttgaatgacgagttacgcgggcccatgattggacaagaccacgatagtttccagagtttaatcaataaggtcgttaggttggagaacgaccggaaggtcgtggagcacaatcgtaaaaggaggcttgccatgaaccgcccgcctcagaccgcaccccagcgtcctaaagggacaacctcctcggcatggagaccaacagtggtgacaaccagtcgacctgccgcctccagtaatttccacaggccggttaccattcagaaccgcgctcctgcaccgaatcaggccgccactggatcagtaaggccaggaagttgtttcaactgtggagagtatgggcatttcgccaataaatgtcctcatccgaacaagacacccattcgcaccggagctaatgcaacggctattcacgggactgctacccctgctgctggacgaggtctattcaggactccgcagactaacaggaccgctaccgaatttggacgcgggcaagtgaaccacgttcgagctgaagaggcccaggaagaccaaggcgtactgatgggtatgttttgactcaactccactccagttaaagttctcttcgattcaggagcatcgcattcatttatatctttgaaagcaagtcaacaacacaatttaatcagagttaaactaagacaaccaatgttagtacattcacctgggggtgagatagcagtggatacagcttgcattgacgtacccatccgccttcgggatgtggtatttccctccaatcttatggtgctaataccccaaactcttgatgtcattctgggtatggattggttagcaaagcatagagggataattgactgtagacgtagagaagttaccctgaccacaccctggggatcggatatgagagcaaccatggatcaagatcctaggctaaccgaacgtgccggaggtatatttaccatgctacccctaaagggaatgcccgtagtgcagcgatttcctgatgtgttcccagaagatttacctggaatgccaccagatcgagacacagagttcattattgacctgatacccggaactgcccccatatccaagagaccatatcggatgccggtcaatgagttggatgaacttaaaaagcaaattagggagttgcaagaaaagggatttgtacgccccagttcgtcaccttggggagccccagtgctattcgtcaagaagaaagatggtagcatgagaatgtgtgtggactaccgctcactgaacgaagtaactatcaaaaacaagtatccactaccacggattgatgatctttttgatcaactcaaaggagctaaggtgttctctaagattgaccatcggtcaggataccaccaattgaaaattagaaccggggacatacccaaaactgcgttctcaacacgctatggattatatgagttcaccgtaatgtcgtttggtttaaccaacgctccggcatactttatgaatcttatgaacaaagtgttcatggactacttggacaaatttgtggtggtattcatcgatgatattctaatctactccaaagatgaggaagaacatgcggaacacttgcgattggtactcgagaaacttcggaagcataagttatatgcaaaattcagcaagtgtgagttctggttaaaagaagtcgcttttctaggccacgtaatctcggccggtggagtagcagtggatcctgctaaagtggaggctgtcacagaatggaaagcacccaaatctgtgactgaaattcggagttttctaggcttggctggatactaccgacggttcattgaagggttctctaagatagcccgaccaatgacacaactactcaagaaggaaaagaagtttgtgtggtcagaacagtgtcaggaaagctttgagcagctcaaagaaaagctgacctcggcgcctattttagttcttcccgacatcaggaaagacttcgttatatattgtgatgcgtcaaggcaaggactaggaggagtactgatgcaggacggaaaagttgtggcctatgcgtcgcgacaattgcaaccacatgaggaaaactaccctacccgtgacctagaactcgcagctgtggttcatgcgctaaagatttggagacattatctgattggaaaccattgcgatatctacactgaccacaagagtctaaagtatatcttcacccagtcagatctcaacttgaggcaaaggcgatggttagaattaatcaaggactatgatctagaagttcactatcacccaggcaaagcaaacgttgtggccgacgctctgagtcgtaagagccattgcaatcatctgagaatggaagggatgatccctgagcttagggaggagatagctcagctgaacctacatatagtacctcgtggacagataaacaccctggacattcaacctcttttgagaacccaaatagaagaagcccagaaggacaacgaggaagtccgagaggtgaaggaacgcttagctacaggacgtgcaaaggaattttcaaccgacgaaaaagatgttctatggtataaaaagagaatttacgtacccgaacagggtggactgaggggattaattttaaaggaagctcacgaatcggcatattcattgcaccccggaagtaccaagatgtaccaagatctgaaggaaggatactggtggcccaacatgaaaagagatgtggcggaatacatagcactctgtgacgtgtgccaaaaggtgaaggctgagcatcaccgaccggtaggcttgctgcaaccccttaggattcccgaatggaaatgggatgagataggtatggattttattgttggattgcccaaaaccgcaacaggatatgattccatttgggtgatcgtggatcgactcaccaagacggcgagattcattcccgttaagacaaattatagcagtgctaagctagccgagttatacatgaccaggatagtatgtcttcatggtgtacctaagaaaattacatctgatcggggcacacagtttacctcacatttctgggagaaagtccatgaagccctaggaagttacctcgcatttagcacagcttatcatccacagacagatggccagacagagagaaccaaccaggtcctggaggaaatgctgagggcttgtgctctggattttagcaaggactgggagagatgtttgccctacgccgaattctcctacaacaacagctttcaagcaagcctaaagatgtcacccaatgaggcattgtttggtcgacgatgtcgtaccctgctaatgtggtccgagactggagaacaggcggtatttggacctgacattattcaagaagccgaagaaaaggttcgcttgatccgtgaccgtctaaaagtagcacaatcatgataaaagagttacgccgacacccaaagaagaaacctggaatttaaggagggagattacgtttatctaaaggtttctccgatgaggggaacaaaaaggtttaaggtcaaaggaaaactggcaccaagatatgtgggaccattccagatcatcgccaggcgaggagaagttgcatatcagctacagttaccagagaatatcgcggatgtgcacccagtcttccatgtgtctaagctaaagaaatgtttacgagtgccggaagagcaagctccgctggaagagtcacattagcaaggatctcacatatccagaacacccgatccggatattggatgaagccgaaaagaggactaagagcaaagtgtggcgtatgtacaaggtacaatggagcaatcacactgaggatgaagccacctgggaaaccgaagaattcttgagtacggagtacccgcatctattcgaaaactggtaagaaatctcgggacgagatttatttaaggggggtaggtttgtaacaccctgaaaatttgaccgacaaaatcaaaactataaaaatacggattttcaaaaactttttaaactaattgcatcatgctgatcttattcgtctattttatctggatttgatctcgaagattattaatcgtgagtaaagaatagttaattaggaataaaccttaaaaacaaattggtaaaataaatacaaattaaaataaagattaggtggggatagaaataaataaaatattatcgcaaccatatttggatcaattaaatttaaatacgatggaataagaattaaccctaattaaaactcaaataaattatataaaaataaaatatgagtaatattaatctagggtgaattcattagttaagataacacaaatattgagtaaaatgcatatatgcaaaattaggaatcgtggaatcaaatttatatggaaaatacactaaaatcgggttaattagaaatcggcactgttcattgcacctaaggtgttcgacggggtcccctaacccagctccttcttttttccccctctctctgtcgccatcccgtcgccgcgtgcgcgttccatcgccgcctcgagccttgccgctgccgcgccgcgagcccgcgccgcgccacgccgcgtcgtcctatcgttgctgtcacgccgtgccgtcgtgtcgccgcccatcgcatcccgccccgagccgcgcgccaccgctgtcgccgtcgccatcgatgtcccgtcgccgcgcgcgtcccatcgccgctgccgccgctgataccgcgccgcgccggccgttccatcgcctcgcgccgtcgccgttcggccgtcgcgtcgccgatgccagtcctcgcgccccgcgccctgccgcgccgcgttgt

SEQ ID NO: 72756 - DNA, 912 bp, Oryza sativa
aagctagaaggtgtaacatcgtggggtaacgaatgcactgcgttgtgtccaccgctgcagcgaataaccggcgacggcgatgccaagcgcaagcggcgcggatcaaaatccggcggaagatgatgccacggcacctgtagacgatacggaagaaattctccaacatgtaagcaaggcaagaataagagatatcttttcacttatgcttaagtttattagccaaaaattaaatttaatttttaggatttcttttcatcgtagtctttatttttagattgttaagaatacgtatatacaagttttattcacatatttttttttttcatttacaaatatatgttgtttgcgctgacggctcgccgagccagtggtggatccagaaaattgattcgttggtgtcataacgtatctactggtgtcatagtatgctaattatgcttaaatcatagtgctataatatatggataagcaatttaactatacgttttgccaaaattcgtcggtgtcgcttgacaccggccgttacactgtagacccgcccctggccgagccgccgatgatgctatcgacctcgcaaatgtgtgataaattgacgatcaatgcaggtgaaggacgtgattgcgaggtgcctggaagcacggctgtccaagggacaaatgttccgacaatttcgcaggagcaagatcgatccggtaatctactacgctggtaggatgaacgttcacatctgcaaaatcgatcgagctagttgagataaactaaattcagttcatcctgaccgtgcgcacatgtatgtatgaaactatgaatgtagtgtacaaggagttacgttcgcaaaacgaggagttcttcgagctgttcatgttgaaagtgtcgctgaaaaggcagatcgaccgggtcaatcatcacctg

SEQ ID NO: 72757 - DNA, 1993 bp, Oryza sativa
acacgactagtgcggggctcgggccggcgcggggctcggtacgatgatggcgtcggcacagcagctggcggcagcggcgcggggcttgagacaagcagtgacgcgacggcgacacgcgacaacgcgacggtgacggcgatggcgcgacagcggcgtggggctcggcgcggcgggggcgacggcgacgtagcagcggcgcgatggggtggcgcgcggtgcggcagcacacggggcgcgagggcgcgtaggcggcagcggcacggcaggccgacggcaatggcgacaaaacgacgcgcggtggcggtggcaaagcgaggcgacgacgacgcggcgcggtgatggcgacacgacagcgacggcgccgatgcagtcggggctcaaggccggctagggcggcgcagcagtggggagaaagagagctgggatggctaaaaaccaaatcgaacacctaggggctaatgaacagtgctagccaataatttttgattttagagggtactttacaattaggaaaaatatactgttgctactaattttgtcacaatgtaaaaatacaccacgtctaagttatttcatcgaaatttatattcaaattaatattgtccaaatttaagttttattaaagattctataatttcctaatgagaccgttattaacacattagcacattagctcaatttatttatatgttagtttattttatatggaggggtttaatatattaaatttcaatccctaaatgcaattaggaacttggtgcaatatcgatctacatatcgaattaaatactcccataattctattatatatacagagagctcagtttatttgaatgatcatcattccatgtgtactcatattatggcacccacctttattattcaaatattttaatatttgataaaataggttaataataacttttcttttatttgattttaatatcttgtgcataattatttgtaggattaaatatattctcgtaaattatatctattgcttaaatttagatcttttctttactttctttgtgatcttttacggtttggcaagcaatagcaatcataacaaccagcatgatgcaaaagttttaaaaagttcaaaattttagtgatttttattgtcaggaattttcaggatgttacactgtaggattcaaaaataaatccctaagatttgttaatgtcatcatgagtaaaatttttactcccactacaacttttacttatggttaaatctgggtaaaattagttcccatggtcatgcaaacaaatctcaaacgtccactgtagttttttgtttgcactatatatatttttttagtgtgcaaagctttggtaagaaccaactagaagtacaaactttctacgtgcaaagtttcgacaaaaatcacaagaatttgaatgacaactaaaaaaccaaaaccccatgtgtgtgcaaagttttgtcaatattcactaggaacttgaatgaaaacttaaggaataagatcactttgactccctcaattgaccaccgaatctaaatcgtatccctcaactgcaataccagaaatcttgaccccgaactgtcaaaacaggtacaatttgactcccttagtggttttagagggcggttttgctgacgtggtgcacatgtggcagtgttgacttggtcttcgttccacgtggcattgacgtggcgcttatgtggcattaaaataaaaaaatatatgcgggacccatttgtcattcacacaaaaaaaaattgtgggtcccactgacatgtgggtcccactgacatgtgggtcccacatgtcatcctctctttatcccttcttcctcctccctctcctcccttctctatctctccctctttctcttcgtgcgtagggatgggcgtccggattggcgacggcaacagcgagcgatggacggagcagcagcggcgggtgggatggcgggtggacagtcgctggagttgtggaccacgagacggtggcttgtcgggcgg

SEQ ID NO: 72758 - DNA, 17229 bp, Oryza sativa
agaggagagaaaaaggagagaaaaagaaagagagggagagaaaagagagaaaaagaaagagaggagagaaaaagagggaaaatagaaaagaagaaacggagaaaatagaagggaaattgggggagaaattaggaggatttaggaaataaaaatggtcggggttaatcatagattattttcggaaattcctcgagcgtaatagtatttcggtcgaaattccgagttaattataaaaatatgtttcttaaacagattagattaaaattggtagtaatttagatataattaataactaaacaattagatgaattcttatagattattatagattatttttggtaatctctataagtcatcggttcacggtagaaattcggatttaattactaggaatcttagccgtgtattatatttaatcgtttagtcatagactgaattaaattgtataatatttctaggatttcgtccgatatttagctcgtaatagaaatttctaacctattatatggatataatgctcgggaagagtaaattaaaaacttatgacaacaaaataattatacccgcaaaatagtttaaatcgaaattgggtttgccgtagttcgcagatagtaaagttaataaaaaggaatcgactttcgcatttgactttcatttggatttatttggatttttatttgaattctaaccgaattcaaatcaatttttgcacgtaaccatagagcccgagggagttgcggatccaagcgaaggccaagacccgcaagactttgagcaaggcaagtcatcactattccttgaacatgttgatcccaattgcaaaattgttttgtttacaaataaaattgcatgcaatgatgaacatcctacttgtgattatgccatgccttgattattgtttacccttaaaatccttgtaaccataattacgtatgagtccctagtcaattatgacaattgcttagaaatgccattctagaatcatgcatactcatatttatcaaatgctatatgcttggtcaattacctttgggaaggtaattgagatgcggcatgtggagacatgagcgccacattgccatgatgttgatgacatgatttgtgaaaggagaaataaaattaaacaattgttttcgactggggcggacggaggatttgggtggtatctgggaaaggctagtaccgtccccggtcaattaaggaccgagccatgaagttaagcatgaaacgacccccgtacaaccgcacttctcatatgggtatagacctagcggattagatagccgaacggaggcagtatccctgcatagatggttcacccctgagtgaggcaggtgcgctatggtgggacagccgttgaggtagggccgagaggcgtgccctacatcggtgtcgccattggtaggactgccatgagtgtgtgagagagagaacttaacttgaaccataatttaatatgtgtgtgagacttctctttcccgggagcgccagaactcctctcactgttagaaacatggacgcctagagtgcatgaggatttaagttcatggagcgggtactaccaatgcgaggttatcgaaaagctttgcggtgacgcgtctcatgtgttgggacgagactcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtgggggatgggatattgcatgatgaattttatgctgagggagtcacttcccgagaggagggaaggtggacatcctcagaaaaccatgacgattcaatggcgggaagctatccttgggatcacaatggatggtggatagaaccgtcattgtttaatatgaacactggtattaaaacttgaacagtctatgctaggtcttaggcttgagaaaagaattacaaaacttgctttgcgcaaaagaaccatagccatcctttgaattcctctgtcatgtgcatcattgctgtggtggcttgctgagtacggttggtactcacccttgcaaatataaaattaatcagaagcgggagatgaagcctcggaggatccctatgcctactaccaggagggagatgaagacgatggcgctcagtaggtcttagtacggtcgttgccggtggcaatggcatgccgctgcttgaattccgctgccttatctatttctgcttttgggctgtattccggaccgctcggtccgatgatttaagactacgcctgcgggcttatgatgtaataattcgtattagacactcgtgtatgtgcacttggtatttcagctatgaattcgtgtgtaccagactacgtgatccagggaaatggtactgtttacacgattgattccagttataaaaacgggggtccacagaatactacatattcagtaatgcacagcaggtcattttgtgatggatcaacattactgtcgatgctaggaatccgcaatatgaaaagggtgtagcgcatgagaactaaagtacgtgagttggatgacaaaagatttatacaagtttacgaccttatcgagaggtaatatcatactcatgatgttaagggatttgtatatatgaggtgctgtatctcttcttcctatatagttggtacccactagagaagttattactataaagtttgcaccacgttgcgccacatcatcatttattttcagccgttggattggactgcatgtttccagatgaacgatgttgatatcttgggccaacttcccatcattttttttccgttgggccagcccaccctgcacacgctccttaaattcttggaaaaaagttaatcatattgccaagaggctaatatgacaaatgatgtttttataaagttttgaacttactcagttaatcataggctaatcctgttttttacacctaacatatcttcacagcaatcaagcaaatcgaccagctcggtacgctagaataccatgtaccttgaattgggtttcctgattgaattgtacttgtttaaacgaacatttaggcgcatctctatctcaacattgtaaatctccttttcttcgtatgctgattcagtgaccaatttacatcaattttatgcacatagaaaattttatagtgtgcccactgcaacgcatggggtatgaactggttgatataatgatcttgggtatgattatgcccttgaggggcctcctacctgccttatgtaggtcgggggcaagattatagataaaacctaactaaacctggtatctatttgacaatattccggagtcagagctataggccgtatcccttaatactcagggaaacgtaatactcaaggcttaatcctttacatattctagagatataaactatctcatataatcagtcgataaactaatcgtatgggtatatgatacccgtaatctccacagtagcccatgagcccttcacactcgaaaatacggtcgcatcggctactttgataatactgtcttaaatcaatttgttaaattctatagacagccgattggtcatgtttagggtttattattctttgatatatccagtccataccgatttggtctaactccatcgactgagaccatcaacgatatgctatcggcctatcgatcgatcggctatcgatcgactgattctgcttttgtcctttcttgctgattgcaggatcaaatcagctggtatgccctagacacactcaaggctaaccttggacctgcactggagttaagcagatctcctaggccgccgtgttttcacatcaacaagcttttggcacatctagtgggacaaagttttgttattcaaccatgtcgtcactgtctgacattggtaaagaaaatgttatacctgctaaggttgaagatctgtctgaagagcaaaaggcagagatggagcagaagatgcaagaactgaagaaggcatatattaattctttttctatgactcggcaagggaaagttattcaaaagtacaagtgccaaatgccgaagttagaaggagaaggagcatctggtgccaaaggagagcagaaagaagatgataataataaaaaacagttgatgactttataggatcgtcttgatttagctgtgcaccatgctctcatcaaccaatctggaatcttggtcaccacattgtcaaatttgatcaactcagtggttgatgggtcgattgctgagtagaagacaagaggaccagtatatttaccaagtggtgttttttttcccaaatatagagaaatcaagactagtcttgggaaagccgagtgcttcgatcatcttcaccacattctcccaagtgcttttaccaaatcataaggctgtgaaaggctgaaaaaattttatgagataataaagaatatatactcagatacatcgactagatacaccttattaggtgtagccctccgactatatggttagttggacaaactaagtatatagtcaaggaataaataatctaaccaaacaagtggtttttgataattatagtcaaccaagtgacttaatactaatatatagcataggcggtatgaatcctcaaacaacatgatccgagtgatatacctactacttattaaaaagtataatgtgcatagccaaaagccaactgcatctttaaaagtcacatagtaaatgatttaataaaaagcctttatgcagtgagtaaaggaattttctatggttgttcacattgtgcgcatattgccaggacaaatatgtttatgtccctataagacacacaacatcgccacagccaaaaatatatggcatttgtagtgtaaaatccaagtaaaataacactaacgaatggatttaccaactgcctgaaaatgaccaagatatattattagactacaaccataatattggtcttttagaaaaatgcacacataagtggccgaaagcaatgataaactaacatcaatcaattgctttataaaaagcaaacatcgtcttaacaaccatacgtaaagctttacttttgccaccttttaaattgtattgtgccaactactgaaaagttgtgtatcagatatataaaaagatttaaggtatatattagacacttgagcacgcatgtattgccaagagcaaaaatgcttaatccctaaaggtacatgacagaacacaactgaaaatatagtccgtgaactcttgatgggccgtggcccgataattccacggatcgataccctaaaatataaaactgactaatgaggcctccacaaactgcccacagccacaagctgtctgttgcactgttcagcctaacgaggcctcgacacagaaaaaaaaaagaaaaataattaaaacgcacaggtataattgctagtagtaaataaattacaataaatcaattctaaaccattatcggtaccaatcaacatatatacacccctagaatgacacgtcgctgccacattcgcagtgccgccttttatgaaacattccagagggattatgcaggtcgagatacgtcggtccatcaaagcaagcgacgaacaagtcagtactccctccgtcaagtttacttttcatgcactaatctcacacgtaacaataatacgaaaccaataaaatactgcaatactactattttatcaaatcataatacaactatttctcactttatctacttctattattattattattatttacttttacaaactccgatacaataattatctttaaaaaaattatttaggataaatgagaggagcctaaaaatatggccccattcaaaacaaagaaaaaaacataggaattccaaaggattttatatcctatgggatataatcctgcgtgaccttttgaaacgaagtattgattcataccaatttatttggaattcctatggaatggattattgtagaggaattttggaggaaaattagcatgaggcactactacaaaaaggacatgtagagacatcccgtaagagacggttaagcaagtcgtccctattaaagcccatctcctacattgcctcttacgtagatacactaattagagacaggataatagaccgtctctacgatcacattaatctatttggtaaattttgaagttgactgagagaaaaaataaatcctagacatggccgtctctacatcacataaaaaccgtctctaggggctgcttctactgcagtgaggtcttacctcatattttcttcttcctatgtcttgaattcctatattttccttgtgtgactatatgcaaacggtagttttgaaactttcccgtgttttcgaatcccgtatatgaatctaatgaatatggcattctattcttatatttcttctattcccatgttttgataatcgtatatttgaaagggacggaggaagtagctagctagcttaattaatttggtcacgtgtagggtaatacacttccaagagaacatccacttcacaagagatctcctactttcgttggccctagctagcttagctggaaatgttagaccatatattgcggaggttttaggattatacgatgttgatgtaggagtattctagaagtccacgagtataccttctgtcttaaaaaaaaagataattctacctataaatttagatatatggttaaaaattcgtttttttaagacggaatagtaagtatatgcatatcgctacttttgcaatagaactaacttctcgctgcacactaaggccctgtttgggagaacttgtcctagctgcagcttttttctaaagctgcttctgctagaaaatgccccaaacagtccatagtttctgagaatctgtagttatagattctgaaaaatgaactaagaagtcagaagctggagaagctggatttcaaagcttttccaaattcttaaaagctagctactaaatagctgtttctcagaatctaaacctccctaatcaggccctaattctaggcgtgggcggaccgcatgcagcagagctagctcgatcgatcggcaacagctgcaccccatccaagccgtcgatctgtatgacgacaaaaatatacaaaatcgatcagatataacagctgatgatcgatctgttttttttttttttgaacatcgatctgttaggatgaaaattaaacagctcagaccctgtcgaaacaccggttggatctacttggatgacctgcatatcgaccaaacgaaaggtagaagtcaaatttgtatgtatgaccgtcctatatatagtgtggactggggaggacgaagatggttttcactagagttttattatgaatactgatttccgttagatatttaatttgcaggagatattttgtcctagacccgtactatgtttgttcaaatgacattttgccttagaaactggatggcgactctcatgcttattgatactattatctatatatctattatattattaggatagttgggttaataattctcacattaattaaagataaaaaaagattttaagtagaaatataatttaaaaataactgaaacccgaaattaaaaataagcaatattgaaagaaagagtccatatcaaaatctaaaataaaattaattaaaattcaaaataaacattcgctgtgccgacttgtattaaacattccagaaggattatgcaggtcgagactcgagatacgtcggcccgtcaaagcgagcgacggacaagtcagtactccgtccgtcaagtttacttttcatgcactactctcacacgtgacaatacgaaaccaatacaagtctgaaataccactattttatcaaatcgtaatacaactattttttactttatcttcttctgatacaattattctttactttcacaaactccgataccataattattttaaaataaatttattttggataaatgagaggagcctaaaaatatggcgcgctttgaaacaaagaaaaaacatagtatttccaatggatttatatcctatggaaaataatactataagacccttggaaacaaaatattgattcttatcaattcaagattcctatggaattttggaggaaaattagtacgacgtcttacctcatatcttcttcttcatgtgtcttgaattcctcatttttcccgcgtaactatcaaatggtagttttgaaactttcatatgttttcaaatcccataggaatccaatgaacattacattttattcctacattttttctatttctgtttttgacaatctagcgtttcaaaggaacggagaaagtagctagctagcttaatttggtcacgtgtagggtaagagtatatcggatacactccaagaggccatccacttcactaatttggtcacgtgtagggtaagtaagatctcctactttcgttggccctagctagcttagctggaaatgacttactacctccaattccaaaataagtacagccgttggtatccgtatccaacgtttgactatctgtattatttgaaaaatttatgaaaaaatttaaaataattagtcacacaaagtattattcatattttattatctagtaacaataaaaatattaatcataaaaaatttttaaataagacaaacggtcaaatgttggacattatcgatataaaactgtacttattttgggacggagggagttgaccatattgcggaggttaggctagaattggatgttcatgtaggagtacgctacgaagtaactccccccgtctcataaaaacaaatctaagattggatgtgacatattttagtattacgaatctgtacatatagaagtatgtgttacatctgatattaattagttttctatgagacggatggagatgcatatcactactagaacttgttcttaaaaaaaaaaaggaagagtagagctaacttctcgctgcacattaattctaggcgtgggcggaccgcatgcagcagagctagctcgatcggcaacagctgcaccccatgcaagccgtcgatctgtatgacgacaaaaatatacaaattaatcgatcagatagcagctgaggcgttgattaaacagctgatgatcgatctgttaggatgacaattaaacagctcagaccctgtccaaacaccgcttggatctacttggatgacctgcatatcgaccaaacgaaaggtagaagccaaatttgtgatatatatatgtatgactgttctatatatagtgtggactggggaggagtggaggacgacgatggttttcactagagttttattatgaatactgatttcagttagatattttgccctagacccgtactatgtttgttcaaaagatattttgccttaaacactactccagatgacgacactcatgcttgttgatactattatctctatgtagtatactattaagaaaattataaaagtaggtatcacgatagttattggggctacaaattcccacattaattggagataaaaaaaaatagaagattttaagtaggaataaaatttaaaaataactgaaattcgaaattaaaaatatgtaattatcaaataaagagtccatataagaacccaatacaatattaattaaaattcaaaataaaaaataaaataagatctgaaattaaaaactaagagagttcaagtaagaatatagttttgaaacaactgaaattgaaaaataaaaaattaggaattttgaaagaatactccatatacagcacaatacaagattaattaaaatttgaaaaaaaataattaaaaaaggaaaatagaaatacagtttataaatactgacattcgtaataaagagaagataccatctgtaacacatgacgagattattaaaattgggaataacgaataaaatagtttccaaaaatataaaaataatataagagttcaagtgggaatattatttttaaataaaaaatattggaatgagaatatgaaattttaagaaaacaagttcatctagaacacaacgatgacaaatcacaataaagaggggagaagcaacacgctcgcagtgggtgttagaaattcccacattaattggagaaaaagaaaaatagaagaagagtttaagtagaaatataatttaaaaataattgaatatcagaaataaaaataagcaatatttaaagaagaaaccatataagaacccaatacgagattaattaaaatttaaaataaaaaataaaataaaatccattagaaaaatgattataaaagttcaactagaaatataatttataaataactaaattttgtaataaaaataaagattgtcaaaaaaagacaatctagaacccatgatgagattaattaaaatttaaaataagaaataaaataaattccaaaatagaaaaataaatataagagttcaagaaaaaaaataatataatttataaataaaaatattggaataaaaatatggaattttcaaaaaataatcatctggaacacaacgatgacaaatgacaataaagaggagagaagcatcatgcctgtagaggagtagagtggtggcggttaatgggttatctgaaaattattagcaaaacctcaaatagaattccaataatgattaaaaggagagacggcagatatgtcgttaagcagtacagtcatggcgattgcgggacttctgaaatgtaaaaaataaaccccaacaaatatcatgtttgatttttaaaatctcaatggcaataaagaggggaggcaggtaagtcgtaaaagagtaaagtggcaaagacgctgacggtttggcgagatttctagaaaaataaaaaatgaacccaaattattattatgtttgattcttaaaatcccaatgataacaaagagaaggaagcggatgggctgtagaggagtatagtgacagcatttggcgagacttctagaaataatgaaaacgaaacccaatgacaaaataaactcaaaaactacgatgttcaatttttaaaggttataagaaaaatgaatagaagcagtggtagaccgagcaagcaaataaaacaaggggtcacaaagaagcaaggaatagcaaccagcgtggcatttaaaaactgtaaattaattttacaaacatgagcattataagatttgttctttcgatgtcttaagataacgagttagctatttaacaaattataaataaaaatataaaaaatatataattttgtatgtgtgctagccgtgtaattgcgggggccacctagttgtattaaagcactctacttttcaagccccagatggaacgtactgtttctctaagagaaatcaagtcaaagtcagttagaaatcaagtcaaagtcagttagaagacacgacaacagacctggagtaacgtactactgtactgtactccctccgtctcagaatatagcaacctagaaccggattagacatatcctagtactataaatttagacatgagacatgtccagattcgtagtactagaatacgttccatccggttttagattgctatattttgggagggagtactaaagtcaaagtcaattcaattcttgatcgactcgtcgtgagctttacgtacactaattatttcacacgtgtgccatgccagcttcgttttccagtcgtgttacgttttacaactccacagagttaggaaacaaaattttaatatttgtgacaactgtaaaacaaaattttcataactgtcaatacaaatttgtgatgaatatatcagtagtacataaaccatttctacaaacggtcaaaagcgatctttgcatacggccatcccaaccaaccaaaaggtctgcgaaaatattttttttttcatgtggccaaccgcatgccaaaattccatttttttcacgcggtttcctataccggctgcatacaaaaataaattcggcgagaaaaaataaaaataaaaatagaaaccgggtgaacctaggcccgccaccatcgtcattcggatccgccgcccgccgccatcgtcgttagtgccatcggatccgatggtcccacctccctctgttgtgtcaccagcactagatccacacgagaaagacccccggtgctagatccacgcggccgagaacgggccgtcgccgcccgttcccggtcgccgccgtcgtcgtcggtgccagatccgcgaggggacgagccgctgccgccagctcctggttgccggcacctgacgctgttgccgaatccatgtggggtggccccactcccagccgccttgtcgatgctgctcgccgctttcggccgcctgctcccggttgcccactgtcatcgtcggatccacgcgcgccgcctgccgccgagcgccaaaccccccgccgcctcgcaccgagctgctacctagggcagcagatccggccctcccgagggtggcgttgccaaatctgccgctgccgcccggcgacggcgcgtcgccgcagccactcctggtgcccgctgtcatcgtagccgcacctactcctacccctctcggccgttggctcctactcggatagagagagagaagagagagagcagacgagagagaggaaagtaaataattaggagaggagaggagaggagttcaaaaaataaataaatgatgagagggaaaagagagtggagggagataaaaaaaatatgtaaagggatgatatttttcatgcggatcacttaagaggtccccttttcgcatatgtcctcttaagaggaccgcatgagaaaataggcttatttttgcatgaggctccttaatagacccgcatgcaaagagaaaattgattttggcatgcaggtcttataaagagctactcccttcatttcatattataagaatttgtaatattgcctacattcatatagatgttaatgaatctaaacacatatatacgtctagattcattaatatatttatttgtacggacaatgctagaaagccttaattataatatgaaacggaagaagtatatgcgaaaatgaagatcagtttttgcagatgtcgccagttacgtacggtctctttgcaatctaaagggcttcttgtaaaaaaataatcgtttttatagtgtattgggatgaatttctagtggaaacagtacgggacaattagaaacgtacgctataggaattgaaacttcagattgaaaatcggaaaccgcgcgctatgatcaggaattcccgtattgtttttcacgttatagcatcacccacacaatagcctatagaaacctggatataggatgatccaatgagaattgaaaaccacagctcatgtgctctttaatgtaaaatccgaagaagtattcatccgagaagcgcgcttattagcttttttattacaacaggtgctcttttctaaatatagttcacatattgctaccaattgttataaataataaaataaagttgtcgctgaattgtgacaaagaaaataccgatcaatgtttcattcatatttccaattatcaactgtgctctaatttgtttatcctaaataaaagggaatagcacccctgattatcaatatgtatcaaaggtgaaagactaaattaagtacatatcgggacaaaaattccatatttgttcctaaacactcacatattcgtgaacgcacagcaggtcatttgtgatggatcaatattaccgatttcaaatggctaatatctaacggacggatctaaaagtagcccgtacgtttgatatatgcatatgtggataccagtcatagaagattagaagtgaatccatctataatgggtgttagttgtgacccgtcatcaaagatgacaggacatttctaacaagtgtggtagctacagatagggctgtcaatctgtttgagtttgatttgttacagcttaatttgagcacgactcgaatgctacagacaagccaaacttaagcataggttgaggttcgcaaacctagtgagctcgagctcgaatagcttggtagggtttgattagcacaggatgcattgcatgtagaaagatatttttatgggtcaatatatacttgtcatcgtgcttgacctactcaagtctcaagaccttatcaatgcttttcaataaagctattatctgtctgctagtaataatactactgttcctagtagatgtagacatgtagtagctagctttttttaatttcaacgttttaaaaccatgaattcatgagagaagctgcaggcttcattcaagacaaaaggcaccaatttagttttgactaccgatagtttgtattgatatcttttatacaagaggaagttttggaattacaccaagtaggctcaaagctcaatcgggaaagatcgtagatttatggttagtgatgcgtgaccacgactagatacctagtaaaatttaaaattcttttagggatttttggtgtctttaaaattaaaaaaaatcatgactagtagtgacggtacataacttatacgtatagatgacttatggaatccatcatagataaggttttctttgtcactgacaaatgagaatagatgggacatatacccgttacagatgtgggttaccgcccatcatatatgaggggttccgttgtaatgaaactacgtgatcttggtttgaaattcacttgtgaaatcatttagtaatactttgcaaactctcaacatgatccgtactttatctttagactacaccagtcaagttttgataatgtggcagctgggtggtgaagtatagttagtcaaaaaagtgataaagtcattatgaaatcactaataaataaaaaaagtaaatccatattaacttggttttttttaagagtctctttgtttaggcttagacttattattggcttcggtttttaagtcagtttttttggtttatataacttataagccaatggatataaagtattaagtttaatggtgtggttatacatgtaccgcacataagataaaaaaacttctccaacctagcctttggattaatagtgtatgagtgacttatgacttaaacaaaaaccaaacgaaaaggttgcttctttgcttagcttagacgtagtgtttagggtagaggttagcttcatttattgtgtgcttcacagaaagtgaggtaggcagcaggtggtgacagtcataatagagttcaaggccgaactcagcctgtcagtagactagggaagggccggtgcccaaagcattcgatagagttttaccttggttaaatccataggaatattctctgtcctaagcctatcatttagttgttgtccttggttaaatcctgttctgagatacacacgttccttctgttcgatacgcttggaatactcttgtgaatttatctgtgtgcgtaacaaataccaagagggggaaggggagggcaaggggaggaggcgacgagagaatgagcggtgagagagcgatgagacgaggtgcgcgggcatgagaggacaaggaagcgaggggcgtgagaggataaggatgcgaaaggagctggtttagctcgctcccaaccattggcgtgactcgaattttaagggtgctggatttttaacagaccggcacctaaaatatattatatattctggtttaaccgacacctataatatattaaagttgttggtatttttacaaaataagcacataaagtattggtccagttttctctggaactggtatacatagttggttaaaggtattggtttatatttttccatcctgtggaggtgggaaaatgtctatagatgttgtttttacaattttcggcacctataatttgtcccattggtgatgttctatattactagagcctcaacacgtgaacgccaacagaggctgaggaggacccgcgtgcccgcgaagatcgaggaggagctgcggtgactgcgagtttcatcacatcaaaggccgaggaggagccaagctcaccagcctccttgagagcaaaaaagcttgagacatcgccagtcttgtcgccgcctacacgcgaggttgggctccacctctgcgcaagctccaccgtcaggcatcgggcgagctcgtgtgggagagtgtcacaatggcagtatgcttattgtgctaacgagatggaggcacaaccggcgagcttgacgggccagccaccaccgcactcttgagctaggggagaagagggagagagaaggtggggaatgaggaagctaagatagagagaggtgagaggggagggaatctgataggttggtcccaccgattcttttttaaaaaagttgttgactacttgctgcctcgtaggaccaaaataagaatggatggagtcaaatggttatttgtctggctcgaatagttgactgtaaaatgtttggtatttaagttaggggtaattcggttgactgtgatagttcgggagtaattcggattttttccgctaattaatctatgtacgtaaagcttccgccttctctttcgtccgtccgatcccctccctcccaagcacctctgcttctgccttcgcctccccccctaccggcacctcccatctctcccttgctgcacattctcctgctcccccatggctcctgttctccttggcgcccctcctttcttgcctcccttccttctccccccccccaaatctcttcctcggtgcacgcgctccccctctcccacagcccctcttctccttggcaccccttctctcctgcctccctccctctcattgcactcgctcccgctttcccatggcccctctactccctggagcccctcctctcccctatgttcccttcctcttgagcgttcaaggaaaacaaaaaacttatgtccgtgaacacgttttgatgtactcacccggctgtgttcaccacaagagatcgtcgttgccgtttctctctctatgggaccatgccgttgctggtcgtgttcccgttgttctggttttcttcgttgccgatcaccatctatggataagtcacattgtgggacatgtctagctaccttactcaccgccgtttgattactggagcaccgtcgcccaccttccctcctcatatgttttttttgtttcgggtagggaagacaataaactatgttagtcgttgtttctctctctttcgttcttcctgcgtgttcaaggaaaaaggaatcccctcatccggtaacgcgttttgatgtatactcctccggtcatgttcatcaacagtgcttgccattgtcatttctctctctatcgggacacgttgttgcaggcctattcttgatgttctggttttcttcgttgccaccctctaccatctat

SEQ ID NO: 72759 - DNA, 1638 bp, Oryza sativa
  unsure (1)..(1638): unsure at all n locations
agacgcaggtgtgccgggtgagaacgcgcggcgnccgccttttccgccatgacgacccccacagcggcgaggtgcgccacgaactgcgccacgaggaacgcgcactccgcggcgagccatgcggtcctcgggagcagcacgaccgcgagcacgagcagcacgagcgacgcggccgcgaaacacacggacgccgcgagcgcgagcgcgtgccgcaaccccccgcgcgggggcggcgggggcaccgcagccaccacagacggcttcgcgagcaggggctcctcctccgcgtggtccccgttgccgttcgcgataccctcacgccgggaccgcgacaagcgagcgcggacggcgacgaacaccaccgcgaggaggaaggcgaggtcgacggcgccgccgaggaccacgcgctgcgggcatggggagaggaagaggaaggcgaggcggtcggagagggagaaggaggaggaagacggcggaggcggggagcacgcggtggtggacagccaccacgggagcgaggtggccggcatcggcatggccggtgagtggtggcgcggtgtggcgcggcggccggagagcgttacatctgggtgtcgggtggtcggcgttgcagcggggaggacgcgtggcggttttgatggggagcggagcggagcagagcagagagcaggggagaagagaggtgaagccaggaaggggagaaacgttgaccgagtcgttgaaaaggagtgctacaggaaatttatctaatttgctggaaaacattataaaaacatctcattgctgaatacactttaaaaaattgataatttgttaaagaatactttcgactgaattattgagagaaattctaataaaaatgagaatcaccctagagtcaaaagttattgtggtaaggtggagtgaaatgaaatataatgtaggttaatgatgaaattaagagttgcataatttctaaaattttattctaataatgtcatgtttgaagcatgtggtcttatggtattctcgtctttcttaatattttatctcttcaattgagctgaaggtatcttctagaaaattaaagggttttaggatgtattttagccgtgatatgtttattcgacgtctatcaacaaattacacaaaatttgtgtcctttcgaaaaatttgtcaaaataaaaagttcgaatttatttctttttcctaccgcttcggatacagcaggtttggcccgggatctagggggctgtttagattgaggtttatttttactacaatctgaacatgtcctatattactttcacttacagggtgggtcccacgtgccagtcactagaaaatgtttagtgtgaacagcctgaccaggtggggctgaccaatactcgggcccacttggtcgtgggcttgcgtagtgtggcttcgtgccaaccaaggagacgcggcgtcatggaattttcccgtgatcgcctgggctgcgacggccgtcgtcgtggatttctttcaaaaacgtggacatttgtaatatttattactacgcaaataagatattctgtcccaatctatgtcgcaagcaacgtcatattatatactcctacgttggtcctgtttggatccgaaaggctattaaatagccctccagaatcttgttattta

SEQ ID NO: 72760 - DNA, 5233 bp, Oryza sativa
aggcccggtacataaagtatggggactaaaaatagacatataaacgtaactgtctaaagaatagggaccttaaatagacttattttagctatttatataccccagcccaaagaagagggaggtaaaatagactttttgtagctgtacatatgtcacagcccaataggagggaggaaatttagacttattctgaggaaaagcacgacggcccatcgtgccttcgggccggcccggcacggcccgaggcgtgttgggccgtgcctgggccgtgagggcggcacgtgggctggcacggcacggcccggtgcgtcggtcgggccgtgccggcccgacaagcctcggcccaggcacggccgggcctgggccgtgccgtgccgggcggcccacatggccaactatagagtaatatagtgtgtcagtcactgtgcaatggccattttgaccgttctaccgctggtcttggtgatgctgctgcttccgttggctgcaattgcatccggcgacccaccatggcagcactactgcggaagcagcggcaactacacggccgggagcaaataccaggccaacctgcaggccctcgccgcgaccctcccgtcgaccgcgtcgtcttcctcccccgcactcttcgccaaggacgccgccggcggcggcgacgccgagcccgacagggtgttcgccctgaccctctgcagaggcgacaccgtcttcgccaacgcctcgtcgtcgtcgtgcgccgactgcgcctcccgcgccttccgcgacgcgcagagcgtgtgcccctacagcaaggaggtggccgtctactacgacccctgcctcctctacttctccggcgacgacttcctctcctctccggccaacccggcccaggtgaggctctacgacgtcgatcgctccacccggcgtggcggcggcggcgccgacttcgtcaccctcgtgagggcgctcctgagctacacgatgcagtgggccgtgccgtacaattccacgggcggcggggccgccgccgtgaggtggtacaccacggtgcggatggacgtcgtcacgccgccgctgttctcgctgatgcagtgcacgccggacatgtccggcggcgactgccggcagtgcctgcaggacctcgtcggcaacaccaccttcaacggctcggtctccggcgtgcgcaacatcggcgcccgttgcggttacaggtacgacacgtacaagttctacggcggggagcccaagctgaagatcgggtcactgtcggagatcaactcaacggcgccatcgagcccaccgccgcctccgccggtgacggagacacgttccggtatgtttggacagtcaccttttatatatactatatatactaggtgaaactatagttggtcccggtcttgcccgggccaagatttgccgggccggcccatgtgctccacctgtggaccaggcacggcccaataagggtcgggccgtgccggaccagcccgaaggcacggatagtccattgtgctttctttgaaataagtttgtttcccctccctcctctttaggttgtgacatatatataactaaaacaagtctatttaatgtccctacactttgggccgtgccaaataatacgtctatttatcctccctattctttgtgccttgtcttataggtggtttaaaataagtttatttcacctccctaaagtttgtgccgtgccagtccggcccaccgtgccaaggcataggcccaggcatggcccaacaaccgggccgtgccggcacgggcccgacagcgatcaggccatgccgtgcctgggccgggctgtcgggccttatggccaactataggtgaaaccccgtgcgttgctgtagaagtatactacgataacgataagtaaaagtaacatgtgttataggtgctagttttagataatctatagatgccggtttaaaaaaatcagacagccacgagccgagccgaaccaagccaacgccccaccacacgataaaaattacgccgctgcccgtatccactcccctcgctcacaaccaaatggggtattgaagttatttcatcatgtgtaatgagaatataaaataaaattatgagcaatgtataattatttttggagatgagatttccttgcagggagaaagaaggtgttgacagttgctttgcttgtgccactgatagcactttgccctgtcgtcatattctgttttgcatggataaggagattaagaaaccgtgagttatagaaatcaacttatcaaatctttaaattgtaatataattattgtttctgagttctgacagactactcttgtgttattagccttttaataacgtatttgttgctttagacaaatcaatgttgcgaaaaaaggatacaatggccagagaagaagtattaaagctttggagactagaagaaagcgattcagagtttatgctatttgatttctctcagatagaagatgctactagcaacttctcggaagataagaaacttggagaaggaggttttggctccgtatacaaggtaaaataaattagatatatacacacacataaaaatcttcaatacatgtttacttgaagtatgaactacttgaactttgtttgaaaaaaaatgcagggccaattgcccaatgggcttgaggtagcagttaagcgacttgctgcacattcaagtcaaggcctggttgagttcaaaaatgaaattcaacttattgcaaagctacaacataccaatttagtaaaccttcgaggatgttgcattcaaggagaagagaacttactaatatatgaatacatgccaaacaagagtttagacttcttcatctttggtatgcttatacattgtttttcaaaaaatgtggttattttctatatatatagcatcaaataaatagtaacatatatccttatacttcactatgcagatctgaaaagagcagcattgctcaactggaaaacacgcctgaacataatagaaggaataacacaagggcttttgtatctccacaaacactcccggttatgcatcatacatagagacttaaaagcaagcaatattctactagaccgtgacatgaatcctaaaatctctgactttgggttagctaagatatttgactcaaatgatgtccaaagaaatacaaaaagggtggtgggcacttagtaagagttaattcacctttcaaatttgttatttagctagtccaagtgatttagggataagctcattttactccctcaactatctggtttgtcttaaaaaacactacttaactctaccaaaccgaacacatacacccctcaacgtacaacctaagggcaatataacccagttctaatggtggtttccatgattttgaaatccaaattcttttttttacttgtattttttaataatggaataacattctggcctttgctcaaaaagctacagctaattattacaattttttttacttatgtctcctagtttggatgatatgtgaatagtatttgaatgtgagtgaaaaaaaaacatatatttttcgatatcaaaatcatgaaaaccattattaaaaccaagctgtgtgttgaacccacatggtattttggttggttttgatagtatgtcgaggggtgtaaaatatccggttacatagttaaggggtgtcttttaagacaattccaacgtttgagggttgtactacagacttatctcttattatgattttggtggatccagactgaggtgttttaacatgtgcatgcattttgttttgatttcagtgggtatatggctcctgagtatgcatctgagggttgcttctcgctgaaatcggatgtctttagctttggagttctggttcttgagattattagtgggaaaagaaacgctgggtttcaccaatatggggacttcttcaacctccttggctatgtaagtttttttaaaaatttagtataagagactaatatattcattttaaagatacacaataatcgagcacactgctgggaatatgtatgaactacacggtttgtgcatgcatgagtgcaataatagttaaaattttatgatagtcggtcttcattttgaaaaattatagcatatgctttatgaaacccgccttaacttggctcatggctcaaaattctcattcactaaaattgcacacaatagctcatcacatcaaacttgttgcaggcatggcagctatggaaggatggaagttggcatgaacttgtagatccatcattagtaagtgaaggtcaaatgatggaaataaagaaatgtatgaaagttgcacttttatgtgttcaagagaatgcggttgatcgtcccaccatgtccgcagttgttaagatgctttcaagcgagttgaaaattctacctgagcccaaacaaccagcattctttaatgtaagggtgaaacatggagagctgtctaatactgcacctagtagcataaacgatgtaaccataacaattgtgaacggcaggtaatgccaatatatatagggactttaattaaaatggtaaaaacccacaggactatataccttgtacagaatgtaattattaaactgcagttatgttacgtagttctgtaacattattggaacggcagatatatatagttgaattacttttgacgaagtgtacaattcaaattaaataatacagtttttccttgtcctaacctttgccaaaattcaaaattatctttggctgtgcatgactttcaattcgctctgccgaaagataaaaggccaaactttactgcattcaagaacaaagaaactgaagcaaactcatcacataaaagatcagttcgttggtattaggacatagatttatgtggaaagctgattgagccaattaatgatttttcatatggacagtgccatcatccataaatatttgacaataagctactctctccgttttaggttatactccctccatctacttttgataggcatatttctaaatctaaaaaatttatttttgatagtcatatttcaatccaacaacctatcctcttaatgacttaattagatttaatgcgtgactctccattcttccatacaagattggctacatgagtatcgagaaatgtaaatattaatgaatcgcttgtttacgacgaataactagtagcatatttaaatgaatgataaatataattacttatccttggtctgtgtgccaagataaaatatgactatcaaaagtagatggagggagtaagac

SEQ ID NO: 72761 - DNA, 4706 bp, Oryza sativa
ttcgatcgatccgggcccctccacttcgtcccatcccaaagcgcgaacaatcacggcagttgtaattaaccttgttccggcacagacagagagagccagtcacttcctttctctctgcagccgcacggaaacaaaaacacaacggataattcgatctgcggcgtgtgcgagaaacgcacgaaagatgggggtgtagtacgctgaggcgtacgttgacgcggacggccatgcgtggcgccacgccccgcaccggccgggacacggacatgcaggcagcgtcgcagcgaggacagcggggtggttgcgcgcataaatatggccgggccgcgcggacagtgagacgacgggcgacgccgcgcgcgggggggataaggcgagatcccatcgcccaatcgatcgatcggtgaagccaacgcccctgtactcgcgaccctgatctccctccgtctccgcccatgtcgtaacgcattcgtcatttcgtcttgggcttgtttttagggatgcttcagctttataccagctcgagttttttttcccaaaattaaaagaatttttagatatatttgtgtgttcttagaattttaaactctttcaaacagaagcttggactcgtggtgcgtagctgtgtgactgtgttgatacatgcgcacgagcaagggcatggaggtgatgcggtgatgctgctactactgttctgggggaacggagggatgggagtcgttatttttcttcaaagggacctcgttttcatgtgatacgtactatacgcgcgcgcgtgcctactcttctggggggaacggagggatgggagtcaagatgggttgcttgtggtcatccgtgttaccggtagtgggaagttgggatccttgtttcaggggttaactccggtgagcccgttgtttgtttctccttgagaatgaagcttctaaaccgcgtgctttaattcgtgattttcattgtcatggctgattaggtacgattttcctgatttgaagtaaagccttgaatacacatcttatccatcatcatcatacacatcggtacggccttaaatacatgttttcgtgaggaatcatgaaaaccacccgtttgatttccacttttttttgttactctcaacaatttctttcatttttagtttgttactgatttccaattatcgttctatatttatttctctctcttcacatgtttatcttttcagcaaaaaagcaagtttgtttttttttcccaaagcagcccactccctacgtgatagccattcgccaaatccatcctacccataagcggcatccgtaatctcacttcgtgacaagaccatttgtacgtaaagttggcaaatttttaattgaattggctctgctgttcacacaaatcacaaccagtaataggcagctgtctgatccccattaccaggacaccccaaattatagatgaaaaaagcgtcttttttctgggtaattaattaggactgttagtaagatggacgtccaacaatccacatgtggatcacacccggagatgaagtgagttgtacacccgtacccttggcaccttcgccagcaccagagggttcaggtcactatcagccattaaacaaagcttttcttttcagtaagcttgaaagacacaataatgaacttgtctaccaacataacgtgttaggagtaatttgcttcacttctggcgatagcacaagaaatgtggagtatggcttccttggccaattttttttaaagtatacgcacacacatttaaagtattaaacatagattaataataaaataaattatagattccgcctgtaaactagaggcgaatttattaagcctaatttattcatcattagtaaatgcttattgtagcatcacattgtcaaatcatgacgtaattaggctcaaaagattcatctcataatttacatgcaaactgtgcaattggttttttttcgtccacgtttaatactttatatatgggtccaaacattcgatatgacgtttttggcaagaaaaaatattaaatctaaacacggcgtatggccttaataaatttaatcatccccacgacagttcatttaaagctttgtaaattgggtaaattacactttataccgggtaatgtgccttgttacctttttatcacatatatttcacttcacactagagtgtattgatttaactttcacttaacaccaggatacataatcatcacacacacacacacacacacacacacacacacacacacacacacacacacacacacacacacacacatatatatatatatatatatatatatatatatatatatatatgaaagggctttatgatatttcattattttaataaatccctttcaaatattgtctaaattcaaaagggttttgaaagttttacacatattttacaatattttcccttcaattatatgatacaacacctagtgtgaggtacaatttatttcaatgtaaaaatatgtattaaatccggtgcaaagcaaaccaaggttcactctatccagtgcaatatgcaatttacttaaaaaaaacctaccaatgcgtttcatatatcgtgttaaaataaataaattgataaagctaccttaacaaagctttggataaaatattttaaatgcccataagaaatctatggtttgatttaaattctactcatgcaccctactaccattagtggtagaaggtactgaagagtgttggtcaatttgaaagataactgtaaaagtgccaaaatagcttacagtatctcgaaattgaaactccaacaatttgaattgcgttgaattatctacttacacaattagtctggtttgtagaatattttttcttcacctggttttgtagaatttctagtgttgtgtagtacttctacaagaaaacacgatgcttgttctacgtagctccacctaccatgtgggcctcatggggccgggaacaatggtacgactcatatatgggctacaagtaacaaaggtctgcccaaacgtctttttgtagagaccctctttttagaacaataattttttctagagactagaggtgttatttgcacccgttgcaccggggccaaacatatgcgtggtgtacaactggacatctctcctaggcctccgagaagcatagccggtggcttgaggtgctgagctgagtctgaatagaatcactttcatttctttcattcttttcacgagatcacgattaaatccttcagcagccagcctagtagggtatgggtagacagaccagccgtacctccgtttgctagctgcagccgaggggtgagagaccaaggaatggccaaaagtgctcgtcatataatgtgtggcagatcgtatcgcaccattttatgatgagacggagtaggtgaccttcaataagtagctgcgcaacattacattttttttatgttttcgttcttttaaaaaaaacttatttatattatgtcgtgacattaggtcacgaataagtttggagataaacaggaaagtttcttttctcgcctatccaaagaaatgagctcaaatacaaaatacagaactttgatggctaatgtttctctagtagtattaaattatgtcttgtcttgctacatgcttttgatcggctatataccccacaatcgtacatgtgagattacaactttgcccccatgggcccttgtgagttaaaattatactcttgccatgtcagcaaccctagatgtattatggtacattgtagaggtcattatggtcttttggcactagctggcatgagtgtttgaaaactggtctctatggaatcttcttttggcatctttcttggttgagtagctttttctctcgagtcattaagttgagtcgtcttttccatctttgttcatatttttcaacatgagtcgttttttcatcttgggtcgtctttccatcttgagatttcaaacactccttctcacttatatggctctcggaatttactttttactggttagaaacacactcaaacgggacgagttgcttcaatagcataaaaccactcgaatagaactttccactcgatagtactttaccgttcgagtagtattatactgctctcaccgctaaaatagtattttaccatttgaacacttgaaaatctcaagaccttcttctctttagtgttttggctgaacagaaaggatggtgttagtcccctgcaagtacatattatataaatagatccctataaaaacttattataagatgagatcattttcttgaagtcaatgaccctagtattgaggttcaatgtcctagtgccaacaccctcacccctagaagccgagatgtaaaggagttggagacaaagatgttaacgtcgatgacctatttatattttttaaagaaaggttgaaatataacctttttatcacaaataagtcctcaaaggcaaagagactatcacatggtgtctatttataagaaaaaaaattagaatatctattattatattaaaggaatagaaaaatgagccaccacgttcactcttatggactagaaattctcacattaatcggagaaaaagaaaaggcagagtccatatagaaatacaatttaaaaatagcagaaattcggaataaaaaaaggaatattataagaggaaactaaagtccatatagaaatacaagtagaaaataatagaaattcggaattaaaaataaggaatatta

SEQ ID NO: 72762 - DNA, 8642 bp, Oryza sativa
tttaatactcctaaatagtaagattccggagggctgtttaatagctcggaggatccaaacaaggccgttgtaccactcttcctatattctttcccaatgaaatctgttggaatatttattatcaccaacgtcttgaaacgtacgtatagcttgttttaaaatgaagctatttcttcacatatcctctctactcaaccaatcataactattttctatttaatgtattcacatttttttctcaaccaatcacaatatttctctaattaatttcacctattttcctaatactaatatttactttaaaaatgtttatattttgggatggagaaagtacggaaataagaagtagtacacgatatactagagatcaaatcctttccgtgtaggtcttcggcaattccttaacctcatggagatattttccataacttgagacaaattcctaacggcgtatacggaaaccaatccgtatatgtgaaggtataccttatcggtatattctataagtcgtaggatagagggtatgccttatccgtaacgatacataggattctagtgtcaataaagtgagtgcataatgacagatcatcaaatccttataccttccgtccagattcgttgccacatccctctaaaatttcttatattatggaattgtggcaaatcatctaataaaaaataattcggcacttactcaccaaatattcccccacgtattcaagcccgggtcattggcaggtattcaaaccgatctggtgagctcattaagaaaagtgactaattcggtcaacatacagatcggtgagaagtaaacaaagtgatggctactaggtatataatctcttaagtggcgtctactaagtacaacaaaagtaatggctacaaagtgaccaaatgtgatattttttcgtttcatattataatactttctaacattgcttatataaatatagatattaataaatctaggcacatctatatgaatgtgggcaatgctagaaagtctaagggcccctttgaaccgtaggaatgaaaaaacggaggaataggaaaaacataggattctggcaagaatgtaagtgtaaaacagaggattgcgaaacacaggaaaaacacaggaataatcgtttgattgaaccacaggaaaaatacaggaatcggatgagagagatagactcaaaggatttttaccaagaggttggacctcttgctaagtttcctccaaaatctataggcaataagccattccataggaattttataggaataggaaaagttcaatcctttgaatcaaagggctatatagaaaaatttcctataggatttcaatcatatgaaattccttcataattcctgattcaaaggggcccttataacatgaaacgaagggagtatctacaaagcaatggctacgaggttagtacactaaaacattttgccactagtaaaaagtacaccactacatggattatactaaggccccatttgattcaaaggaaattcataggaattttattcctataggaatttttcctacaaagccctttgaatcaaaggaatgaaccctatggaatcctatgaaattcctataaaatgcctttttccatataagttttggaggaattttaacaagaggtagaacctcatggaagaaattcgatgagtctttatctcttctcaaattcctatgtttttcctgtggtctaatcaaacggtcattcctacgtttttcctgtgttttgcaatcctctgttttacggtcattcctgtcagaatcctatgtttttcctattcctctgtttttttattcctgtaattcaaaggagccctaaaccgtaaactactagcataacagataatatacgagtactgtatggtataggtgagaaaacaagccaaagcgcgaatgcgcgatggctagtacggggtagttagtaggcctcttgcatacgtctgtgctgaggtcgatcgttcccgagtttttggtggccgccgccggcgatgaccggccgtctctcgcgttgaaccgaacgtcaggctgactcttagcctgcaaggaacactgatggcgcgcaaaattcttccgccggttaaagatgtggtcgtcagaaccactagaaagattgttaagaaacacagacgaatgataccgtgcacaacccgcgaatacaaaactcatatcttacctctatgagaacttttagagatttagatcgatattatatatatatcttgaagttgatgatatcatcatatgcatctcactcttcaggcatgtacacaatcaatttacgagcaagctaataaaggagataaatattgtgcttttatgggagacagagactattacatgacaacatagcagcaaaaagtgacctatatatatttaaagtttagaatgagattcgttcagaattttgaaagtttgaccatcagctttatattgacgccagtttatgaaacctaataacaagattgttagagtacttttctacataaatctacttaaactcttctttagaaaaattaagtaggtgagaaaaacgacaaatatttataacaagcgggagtaactctcaatcaaaatttatactcactaatataaactgtgtattttatcttctaattcctgtcaacttttagtcataaacaagtccacaaagagtttttgttcggttgggttttttccgacagaagtgtcagcaggaaagctgtcgaccatacagactccgcattcagcaacgaacagaacttcaaaacaagtgatgccagaaaagggattgaagtaaaaaccaaacaacagaagattgaagttacaaaaccaaattggaatgtcagagaacgagtgtttttccttcgaagcttcaatagctcatgtgcaaagagtttatgtacccagcaataacaaccgctattccaaccttttcgtgttgatctaagagtaactagtgaagtaactactaaaacgtcgacgcacacacaaacatagcaagggaaagcgtggaaatacaacacataatctcttcaaacttacaaaaatgtttcatatctagagtttatcctttttcgtgtagttagttttttcaggtatgtcttgtatgtttgtatgtatgactaatcttgtgattcttaattaattggctatcatcaatcgcgtgcctctgtgctgtaagagcgatttgcatactcctgaaccattgctcgaaaaagtgatggcctccccatcaacttggacggctcatcaaattccttcactaaccctgaaaataaaggcatacaacatcatactcagagctgtgaatagaagtgcaaaatcaaattatcagcaaatttctcaggatttgttttttatattgccatgcttttctttggggctggaaaaacattctggtaatactagaaatagtcacagtgtaaatcctcacctgcatccaacactagactctatcactgtccatgacagtcggtatgcggtgcgcaatgctgatgatagtgcaatcagtgaactcttctcggatgatcctctggatagtcgcatctgtctgagaatcaacggaagctgttgcctcatccatgaacaggatccggctgcgcttcagaataacacgaccaaagcagaggagctgcttctgtcctacgctccagttctcccccatgtcggcaactacaaagaacaacataaaagcaaatatgtgcaacagtaattgcagctacaaaaacaaaaaataagtgttgttcaattaaaaagcatacctagtgcatcaagtttctctggttttgtagctactatatcttttagttgacaacgctcaagggcctgcagaggaatacatatgttagtctcgacagaaacaaagagttgcaatagaaaaatccacacattgaaacatacagaagctgtaaccaaacttttgtacctgccatatctcgtcctcagaatatcgcccaattgggtcgatgttgcttcttatggttccttcaaagagcacaggctcttgaggaatcacaccaaagcgcgacctgagatcatgaaggcccaaagtgccaatatctactccatcaacgatgatatgcccttctacaggctccacaagcctgaacaaagcctgaactaaagttgactttccgctgccagtccttcccacaactcctatcttttctccgctgttaatgctaatagtaatgcccttcaagattagaggtgtgtttgatcgatacctaacctgaaaagaatagtattgatatggatcacttctatagttctattaatcgcagtgtacaaaaaggaagttcaatgaaggaacataaaatttctcacctttagatctttaacgtcaatatctcctcttctaggccaatttggtgagggaagacaatctgccacttcccatgctgcctcagaaggaagagtactgtactgattcaccctttccacagcgaccatgtcattttctatcatacaggtcattgaaattgtatagtacaccagtgaattgagagatagaccatacgaaagggacatgccgacaaactctacatcagaaacagtacaaatcaatgaagtgatctttgaaggtcacaaaggattaaactgataacatatattagcaagtcttttaatataattgatcatttagagactgctgtattttatcctctaccatacaaacaagtagctaccgttctgcgaaaatatggaagtttgcatctaacataaatttgcgcttgatctttgctaatgacacagaactatccataaagcgctatatctcaaatttagacatctatagattcacaactcatgctatcccattctacccagtgataaattcactaagaatcattcgtttatttctatatcttccagatgatgactggtatactttctaatataactactatgcttaggacaagactctattttccttaacagttcaaaattgtgttcaagggaacaagccaatttatacgtaagatgtagacaacataacatcaggagtcaacaattcgagtctcttctaccaaatgggacccgtataaatacttggtgcaacaatattttaagaatacctttcttgatgaaattgctaggcaagctgatcataagaaaagcagttatagacagtagaagtgtgccaatcaactccaggcgaaaacccagccactcattagctccataattatgaaaagacatgcgcaaattcgaattgattctgtccaagtttatttggtaaaactcatcctccttcccaaagcaccttacagttggagcacccaaaaaggtttctgagaagtgatcaataacaggtgcccttgttactccttgaagacgagttaactctcgagatgttgcgatgtaacgattctgaaaaacatgaagaaatgaaagcaatcaaatttattattataattcaattatggctgttatatgatgctaagtagtacaaaaaatgatttcagttctctgatatgcatggttgtagctggatcatacccggtaccaaatgtttaaaagcactagtggaagtactgctatgactgacggccatgcaacctggcaggtaacagcaatgctgctcaccacggaaatgcacattgatgtagcaaaaccaacatagaatacaagggcagtgtcaattttcatttggtctgctgatgcctgaaaaaataaagcagcaatagttcagaaaatgattgtgcacgtgctgtgaaacaaattaaattctactcctacacaagacatacccggcttagtattctcccagaaggagtggtgtcaaaaaatgacattggtgcccgtagaatgctgtcaaacatcttgttaaagaagacctgggctgacttaaaccccaagaatgtcacgaaaagagtactgatcgcatcacatacaattgaagcagcaactatcgaaacgtaaacaccaagaaaaacagaagtgtcaaatattgtgcccccagatgtttcatatgagagccagtagttactagccatactggagccttccgacagaactgatacagctaaaatgaccagaactccccaccaaccccaagcttctgttatgtatagcttgtacacttgccaacttactcggccactctccttttcctcttcctcgatcagtttagatgaacctgcttctttgcttggtgcaacactggtacctccattttcattactagaattggacttgacaggagattttgctggtacggtggtgtcctgagaatactcagtggtctgatcatgggacatttgctctgctgcccctggaacctccattgaactatggtgagcagtaacaagaactgaaaaatctgagcatgatgttagtagctggttgtagctcccagactgaatgactaccccatctttcattacctgctcaaacaagttaatattgtttaatttgtattatgtgtaaatgatatcagaccatggtgcatttgtcatcatatcataaacttggcatatgctgatacctaaactaaacttagaaaaaaacgcaaagaaaaataattcttgtccctactcctagaataaaaaacaaagccagtgctacagtgctactggtattgctcaatatggctaaacgattcataatatgtcagagttcatttctgcagcaaaaacatatttactactctatttcctccaaatgtaacaagtacagtttgagaatagaacttacgaatactgtatccacattctttaagaaatccacttggtgagtcacaagcaaaactgtcttcttcttgagtatacctttcagacattcctgcagaaaaaaaggtaaccattagagtactacttaaaaactgggttgacactacctacagtccatacttgttttcagaattttctttcgagacatcatagtaataagaaaaccattggaaagcaattaatattggaaaattaagtaggtcactagtcttttttttttgaggggaaactagtccatttggttgtaaactgaatttcacatcatcaacctttgtagccattcctactaaaaaattacaggtttttgtaatacaaggttccttttagtttaccataacaaatgaataaataaaatatggaacaaagtttcttgaaacagaaaggaaaacgaaagagcgctaaaattttccttcgctttcttctagacgaatccaacagaaaaaggaaaattgataaataggtaaactaaatgggatctgaattatgcaaatataaaatcatattggtaaggaaaactctaaaagcattttaatcaatatttttttaatattccgtttatgtagaaaaacagaaagatgccgtgagggcttgattcacagcatgataactaccatgccgaaagccagatggcattgcttgatgttgaaatttattttataatttacaagaatgacttttcctcttatctttcaaagaattcgaccttccatatttgatctttcctcatttattttacctttcggctttcactagacatcctgtaaatcttcattacaagttccttccccaagttcattttcacttgtggttattttgcatttgttctgaatttaaatcaactcaatgaaatagctaaacaccacaagaacacaaaagaaataaatgtgaatttaccttgaagatagctgaaccagtatgagcatcaactgcactaaagatatcatcaagcagatatatatcacaatcttgataaactgccctagcaagctggatgcgttgtttctggccaccactgaggttgatccccctctctcctatttcagtcttgtctccaaactccatcatttctaaatctttctctaagcaacaagcatgtatgacttccctgtacctctctgaatgcattggttgtccaaataaaatgttctcttgaatggttccattttggatccaagctgtctgagcaacacaagctgtgctcccacatatgctaacctgtatcaaatacgaaacgataacacagttattatcagataaaaagtaggaaaataacttggaaaaggtagcgacagaaaaaaaaaacgaaaatagcttgaagaaattggcaacaactggtatgctaatagataagcatatgtaatgagctcagtcgcaatattcagaattattgatgcatgaatgccatactggtattttattctgaatagtacataagtatggtctcaacatttagatttattgatatactacttctgataagatcagctacaaagtatgcaaagtgcgaagaaagagtctcacaaaaaatggtgtgaataaatgaatcacatcaaaactaccatctgggacgatagataagtaaaacataggaattcaagatgcaaggaggggaaggcatgagacctcaagtttgttttaatccagatatctatggagaacggactgtgtatagtgacggaaactgacagcagccagtttgaatcaatggtggctagtgggtctgctgtggctagcaagaggaactgaaagtgaaatggacaacatatgtggagattgatggcaaccggtgtgaatcgacggtggccaacaaggttgctgccgttagcaagaggaacagatagacaacggacggtgcaaatcagtggtggatgatgcagattggtggtggacagcaaaggggattgaccgtgtggttt

SEQ ID NO: 72763 - DNA, 2622 bp, Oryza sativa
  unsure (1)..(2622): unsure at all n locations
attgatcatatgtgtttgctattttactctaagtctcttgtttgccgaaacaaactttggtcgttgatagttttttttatggaaattgtattttaagtgacgatggacgtcttaaaacttaactagcttcgctcatgagggaatctcctctcaattttcactcattataagtgagaatcacctataagcatttgatatccctaaagaaaaggtatgctccctctctttcaatataaatgcaacttagcatagacatgacatatctcagaaatacgaatctagacagtattgggacaaagggaggaggagggagtattgtctataagcatgcggacatgggctttgagcctttgaacaagggacaaatttctgatatcaaaatgcattatatgtacacaccaataaaggatggtgtttggaattttcctctatatccagagcaggtgccatattggaataagccaaatcccccttgcaaaaaaaaggactaacctaaaatccatgtatctcgtgcgtggaaaatagattcctagatgccaaaaccattctctattattaaaccccccacaacaatcaaaacaccaaacgggaatcatgatcaacttgcgaggtcaacacacccaatgatccatctcaggaaaataaagaatttagagcaaaaaaacaaagaaagcgtcggcagaggcagcagctttatcacaaatatgcatgtactacgtatatcagctatcttatcgccattcgccaataataatctcgttcgttattcccgtatttcccctcgttgttttctcggggaaacaggcgtcgtgcgcgcgtgggacgtgggcgccatctgcagcacccacccaccagcaggaagtcgtccaccggcgtggaacgctccaggtttcggctgggcgacgcacgccgcggagccaaaaaaaccaacgcgcgcgccgcgcgcctgctggggagtacggcggcaaggcgtgagaccacgcgcggggcgatgagaactttcggcccgggtttcggctgccgcgcgcggcgacgaacgggcgagtttagccggtagagcctgacccctgtcggtggacggtggtgaggcaccgggtacacgtgccggcgccagcgccaagatcggcggggagctactacccctgattattcctcgattcacggcttggacatgggctttgtcaaccgtcaacaagtgatgactcatgatcactggccttttttgagcttctagtaaattaaaaaggctcactgaggcgtgcgtaacagcgacagtgcaccgtgatttatagctttggctactgtggacgcgtgtgatttagatagaccgacttgcggcgatgtttggatcccatgtgcaattggtccggcattcgtattaagaacttcagtacagtagtaagttcagtagcgtctaggaatgcgagcaccatagcgcttcactttctgccaaaaacacactactccagattttagggagaaacgatcagataatatatgccgatggacgtcggtggccgggttcgagtccggngccgattaaatcaactgcaactaacgtgcttccgagtcagagattacggacggaggagaagtactactaatcagcgtgctccgacacgatcgaactgaagaaaagaagagagaacgcagaggagccccatgtgccactggttaaacaagcaggcgcccctacatacacgtgtctcggatcggacaccaactgacaaccccacggctagctccacgaggcacacgatcctgcccgtctactcgtcagagactagtaacgtgggccccacgccaacggtcaactaattaacggccggttcggttttctttactgtgtttgccacttgctcctgcgtgtgttcctcccttattttagcagaaagatcacctgctccagtaggataaaaagaagaggttcgattagaccctagacaggcatgattgatgattccaaccttgtttgccaataaaaaaactgcgtgattgcataaaagctagtagccaatttaatttcttggataaattgaacagtttagtttgtttaaaaccattgaaaaaaaatcaataattcctagtttcggtcactatgtgtttccaaatatcaaaagatagagatagccatttaggacgatgctagaaaaattgatagcctaagaacaaatcaatgtattttagttagacataattttctctctcacaaaatattcatataattttaaaggatttgaaggggatttttggagtcagcctaggactaagccctaatttccctagcttgtagctccacccttagagatcaccaaggaagatgtcgttgccttttcacatcctgcatttcagtgtcctcgctagtgttgaagtaaagaagacatggttttcatgttgctaagggctgatttagtttgaagacaaaacttgccataccaaaatattggcattttaaacgtaattttgttaatgtttagtttgctacgaatacttgtcaataccacacaaatgttgccaaaatattggcattggcaaaaaacttccacatgatttggcattgccaatagtttggtatggttgcaaactaaacaagccctaaatctctatcagtgtctaccgtat

SEQ ID NO: 72764 - DNA, 2157 bp, Oryza sativa
cagtagcagatattctgacatctcagtaggtggccccatggtcggaggccaggcattgggtgacagtgatgagtccaaggagaggccattgattctccgtaacaaggccccaagatggcacgagcagttgcagtgctggtgcctcaacttcaagggcagggtaaccgtcgcgtctgtgaagaacttccagcttgttgctgcaacacagcctgctgctggagccccgacgccatcgcaacctgccccgccgcctccacctgatcatgacaaggtcatactacaatttggtaaggttgcgaaggatatgttcacaatggactatcgttaccccctttcggccttccaggcctttgcaatctgcttgagtagtttcgacaccaagctggcctgcgaatgaaatcatcggtgcgaaagcatggttatcgattattgtaacaaattgggccccctccaaatttagctgggggctctatcctgttgtttgctatttatgccctattaacttgtagtcattagaaaaccaatgttttttttctagacatgttccctgatttgtagatgctgttgtgttgtatctgtatccctacattctccttttcttttgttttttttaacaggttgctctgtagaagcatatttgctctgcctgtaactgtaataattagctgactgaattgttatgttcatgcttggcttgtgcctagagtttcaaatcttgagttgtatcaaaatttcgtaatggctgcctgttgtgggagatgtgcaatgtatttttgatgaactttgttgagtggcaataaagcaacaatcagttccatgtgcttccaagccatttctccatccgttgtattctatcatggaatatccgtttgtcatttgatgaatgtttaatcggtactagttttagccgaaactctcttgaactaaagatgagcaatggaagaaaaacaaacctaaattattcctaaaattaagctgtgaaattcaaaattgtcctaaagacatactccctccatcccataatataagggattttgactttttgcttgcactgtttgaccactcgatttattcaaaaaatttgtgcaaatataaaaaacgaaaagttgtgctcaaagtactttagataataaagtaagtcacaaataaaataaataataattctaatttttttaataagataaatcgtcaaacagtacaagtaaaaagtcaaaatctcttatattatgagacggagggagtagtaagcagctaacggctgctaaaagttaaaaagaagtttgacagtgagtttttgtaagttatttttaaaagcacatgcacaactcatcagggtttaaatcctagtatccataaataagtggtctttcaatagaatttttgtgagattatggttgtgttgttttgaacttatgctagggaacatattcgtcaggtggtaagtgtgctgttgcgtgtgtaatgatgtgtatgggtgtgcggaaatatttgtaagtttttttttatatatatgtaaagcttttgaggggaaaaaaagaactgaggccgatctgcttgttccatttccgcagtgttcaaaaccagttggccgctgcctgcctgcggatgctctgagaaagtgagaagtccattcggactgctgcgtgagaacaacgcgcgtacgggcggcgccgacttcgacgtcgacgcggactccctcctccacgctcgccggcggccggaagctcctccgggtgaaggtacggttggttcccgagcgagccccaaccctaaaacctttgacacgccgcccgcttcccttcctccagtccaccgatccaatttgagttttcttttttttttcttcttcctttttcctttgcgcttgttcgttggattggtgcttggttagaactcgttactccggccgcaacgtccagcggctattgtaatctggagagtgcttcaatactctgtggatgcgatgcgatgcgatggtgtttcgagttgtttttcgtttaagccagcaggtgtggtgtgcgggatttatgagaaagatatattcgatgattagcactaatttgatctgatttcgaccactgtgaaagttatcagatagaaatgagtagtatgtggtatgtaccaagcaatttatggtttggatgtatcatcattcag

SEQ ID NO: 72765 - DNA, 17806 bp, Oryza sativa
tttgaccaaagtcaaaacgtcttataacctgaaatggagggagtataagaaacgtattcctggctcttgtttgtgtgttgtctctttatagggagatgtcaatcagacgaagagagatatttctgcaggtttaggccctcttcactccttagaataatgaccctaagttatcaagcaagttgttggttttattgataccgaaagagtatggttacaagggtatatgtggacctagtctaggtctatagatatgctagtcatcggtcctggcgcaatggacacgggtctttggttatattctgcatcataccctccgttccggtatgacttgctgagtacagtgggtagtactcagtcttgctctatctcccaaccccagagttcgagtatgcgtcagatggtggctactcggaggagtagacttcgtccgtgccgtcgaggatgcctgtggagtggtgttgcccgctgctatccaagtaagacttagtttcagtcatccctttaatttccgatgtatttatgtaaaactttttgtttgtaagacgtggatctgtatgtcaatattgtcgtttgtgtaccctggtctggcctgtcctggacaggggttttaatgcacattctggttggaattctattcgggaatttctgggcgtgacaataccctatctatatacacaaagacatgatattactagctagcactaaaaatctctaattaaaagatcttgtccactatgtcaaataggatactcttatgaatcaccggaatatttcaacgggaaatgttctaaagtttcactatcacaagccttagggaattcaaaccgaatacaatgtcttagagtaaagattccgatgaatcgcaacactgtcaacgcaaaaggctattaagtatcattattacacgcgtatagttcaacgcgataacgtctcaaagtatcactattacatgtcttaaggaattgaaatttcggtaacaacttccattgcactactgggtgcaccaagggtacttgcccttccttgccgcttccgaccccgcatcctttgcacgctgcgccctagccaactttcttgcctgatattcggcgcgttcttccttcttgtgtcttgccaacacccttagctccaactcttctctcctctccctctcagtcttctccattgcccatgctggcattggcgtttctcacgttcttcattccactcgcgccattgccaaatcatactcgtatggaactcatccatctccttgtcaatccactccacaaagtcacaaagaggaggagggatttaggtgcatatacattacatcacaaattatatcttcacgacaaagttgcatatattcaagatgaaacaatagaaaattaacaaatttaccttcactgccatctttgtctttccctcctttcccttaggcacatgcttaggtttctctgggctatatgcatagttgcggcacattcagtacctctggccataggtatcctagtcatgactatgctgaaaacaacactcatccccacaccaacacatagggcgctttacacctggtgctggcagctgctcaggggaatagctaacaacacccttccttaatatcctaaaattgcaaaaatgtttatcgctatatcaattgcaattaaccaacaactatacctacaaatttaacataagtcggttttttcatcaaaccatctattcaactccaaactacaaataagcattatcacatatatactagaacatatcctagaactaatctatcatgcaaccgaattggtctctcctccatataatatataggtacatattatatactcctcgattgataatacatcccgagccatattccccaaatcacggttagaaccaaatcaaccaaaatacaaagtaaaacattagggaaattagggtttttgaaggaggtcaaccttataactaaattctcaacaccgtatatgaatcgtccataccaacatgaagattgaactacaatattacattcttacccacattccttaattcacaccgcatctcgagccaaatttatcaatccatggtttcaaccaaaatacacaagagaaatgaaagcccggttgagcaaatttgggtttttcgagggggtttaccttacaaattgatgcccaatgcaatgcccacgaaatcttggggtggatttgggaatatttggggaagggaggagagaggacgaccgtgtggggatgaaccctagacaaggagagaggagaggaagagagtggatagcataggcttctgagtgttcagtcaaaaaaaggaaagacaagaccaagcaattctaacagccatcttacaatctttaagattaagaattggagtgtcttctggcaaataaccacatttatagagtgtcttaccccaaaagtgccttcctgcgatgtcttgtaacaaaaattgcctttttttaccctctcgcacgctatcatataaatctctgctacttaggcgttgtttagttcccaaaataaaaacttttcacccatcacatctaatgttttgacatatgcatggagtattaaatgtggaataaaaaaaccaattatacagtttgcgtgtaaattgcgagatgaatcttttaagcctaattacaccatgatttgacaatttggtcctatagtaaacatttgctaatgatggattaattaggcttactaaattcgtctcgcggtttcatggcagaatctgtaatttgttttgttattagactacatttaatacttcaaatgtgtgtctgtatatccgatgtgataaccaaacctaaaatttttccccaactaaacaagtccttaaaaaaatcagtaatggtgctcttgttttctggcacaacaaacgtatatgacaggcacgcgtaatatccaacggactggaccacaaacccatcgcgtaatgcacccatcaccatctccacagagatcgcgcattgcgcggacggtttcatcctccgtaaatgactcctccgcctagggccggtccggagatttgggaggccctaggcgaacttgacactataggcccataaggagttctataaaacgcatataccatatagtgacacaaataaatatttctaacatggtaaacaataaatcaagcagtttgatatagcaatttattctcgataaataatatcgatggtataattgacaacaaaaataacaccatagaaacaaagtagtatgaatagcttaataggagaccacagatatcctatatcccttataaaaagagtttcttcgcgcatttctcgaagcgaaatcattaatgaaagtttggagatcaatgctctctaagatattcttctcaatgctgcacatagccaagccgttctgagcacccgaaaataaaattttaacattgtaacaccagaaatagtaaaattgcaaagtaaattatacaacaataaccataaaaattatagcctaaataatctaacttttggagtgggaaaatcatgcaatgatgcaaagcaagaaaatcctaagtccataagtaataagttgctaacctaaatttcttagaaaaatcgaagaaataacacaagaacaaaaaacaccttagttttcctaggacttagggctaaaagagaatggagagtggagatgggaagaggcgtgaggcgtcagcgattagaggccggcccgacgtgccggcagccagccggccaggcgcccgccgcctgacaactcggtgaggcggcgaagtgcttgtgcctccccggtctgctctgcgcggagggaatatcagagaggagtagacgtgtcgtgtcgcggttaggttgtgcagtcaggagtcgcgcaagactcacgaaaaaaaaggagaaacaaagcggaggagacgcgcgtcgcggcctggcagcgccctcactcctggcctagcaacgcaaccgcgcctccctccttcctaggctgcgcttgctcactgggctaggctgcccgcagggggaggggggaaggggtggtaatcacgccctgtcagccttaaccctaggcggtcgcacaaccgacctaggcccagggctggccctacctccgcccactcgtcgccgccacccgcaaccaccaccatcgtcccccgccgcgcactccactctagatccccccactgagccgattcctactactcctcaccaccgacatctactccttcacccacccgccacgcgcattgcccacttgcaaactcaactccaccgccccttccgcatccccccatcccaccaccttcttccgccgtgctaccgacggcccctccacagcgccgctgacggctccaggtcatcctcgtcgtcgtcacacggtcccggccagctcctccaccacgccgccgttggcccatccacaagatacggagataccagctcggcaaccaagccattatggcccagccaccagagccagcctgcccaaccgaccaagcaggtcaggccgtctttcccccaatttcccgccagcccaccaaaccgagccgcccaagcctacagccttttgcgttttacctgctcgacctcgtgtcgcgcgcacctgcccggcgacctagctcacgagccccggccaccgtcgcgtccgctccatcaccagctagctaaggctgtgctcggaagagcctcttcccaacttccctctcgcattttccacactcactctttttaaactgttaaacagtgtgccgcgcactgtacttcgctgcacctgagattgagccaagcccagagtggaaacacgagtacaccggaagcgcagccgctcggtcgaacaaatccactgccaacctaggaggggcaccaagatcccacaaggccaccaacctgttcgctgcgccggtgcgcatcgacaattactctatgtgtgccataacgtaagtcacttcgactttttttaattatttttttaagtttaattaagtttatagtaaaaacacaatagtatttcacccaaaaaaacacaatagtatttacaacacaaaataaatatattatcaacatatattcaatgttggatttaatataactaatttgacgttagagatgttgctaattttttttataaacttgacaacttaaatatgtttaaaaaaaatcaaaacaacttataatataaaacagatgaaatggagagagtattatagaagaaacatgtttcattttaggggtcatccttttttctcgttttagataaaaccaaatagatcaaaagttgtcaagggggtaacttatattgaaatcaaataatgaggctggaaaacgtttgttgaagttgagtttaattgaacagggttgaaagcggttctttattgggttaattggatccatgccattacaattgtgtcaaattagagaaatgccattacaaatcgcctatttcgaagcgtgccatccatatacgcgcagaatagtctccatgccatgccgtacgacgtaggctcgctttgactcattttgaccggtgtgtagttccgtatggtcgcaaatgcccctgcatacatggttacatcggcgacttggttgggctcgaccacgagaaaccactcctccgctgtccccaaaccattctatcgacggcggcataaaccctagccagcggtggcggcggcggcgacggtgagtccctcggcatctctgggcgaccgtgggagtgactgcgatggacgcccaatcgagaaccctttctcggtcgagcaggtgtagagaggagcggtcccgggcagcagcgtgcgacatccccgagctgaagtgtgcttgcgggtggccggcagcttcaggcacatcgacgactgtcaggaatcctggccggcgatggctgcaatgcggcggagaggtgaatctttggccacgacaaattttgagttgcatttctttgatttctttcccaatcccctttccttccctttcaagcagcagggtgcacgatgctatttatggatctgggaggatctcctcagggagtatgtcgaggagatagtggcatactgccacgccggcgagtttgatagcctatgggagacatgtgacgagttgcggtggcagttgttagatgtgcagggtcgcaacatcgagttgtgtagtatcttggaagcaaaagaggcgcaattgcagctctatagagatgagttgaatcagtcaaagagggaggttgcagagatgaagcacaagatggaatcagagaaggccatgctccaatgggttctgtatatgctaatgtttatctgtgttctttgtgtgtcagtagttgtagggaagaactatcttggatagttaattactgtgaatgtgcaatatgtaattgtaaatgacttgtgtaatgaatcctagtttcagtttgagcaaatgtgagtaattgtgcatttgtaattggcccgtgcatttgtagttgtagatttttagcaaatgtgagcaaagctgataaaatgggacttatgagacatgattttcatacatgattttcagcagcatatgtgagcaaacatgattttcatgtccaaatttcagttcaactaaaaactatcaaaacttggcaatgtgagaatgttagcagtaaaacaacaaatttgctggtattttctgggttttccagtagagaaacacaaatttatctaatttccagcagaccaacacaaatcacatatgtcgagcaagttcatgaatataaggtcatatatggaccaacacaaatttatctaatggcacatgtaaggagcaatttcattcattacatatctggtatttcaagcgaatcgacacaaatctgagaatgtcacatatatggagcaaattcattcatcattgcagccaacttcacattcatcattgcagccaaactcagaatacataataagcaggtcttagtgccatttcagtactacatcacaaaataaacaggtctgccagtcatcacaacataggtgtgtcttaggcattacatcacataatatattacaaaagggaacccacttctgtgatgctaacttacacaggcattcacatcacaaataccagcaattcttgggacatcatatattacaaaagaaatcccagtaatcagctaggtgaacatcaagctgggttggttggttgagacccttcaaaccaatctgatagccttctaggagcagttcttggtggagcactggaagaagcaagaactctcctcttttgtggtgttcgcttcttctttggagtttcatgtttcttcttatttggtgctgatgagctagcttcagcattcacattagatggcctcctcctgcaagtgaaaagaagaaacatgattcaacaatagttaaaagtactgaagtcatggatcaaatcagagatcaaaatggaagggttcagtacataccttttcctgggtgtttcttcagtagccatgtcatcttcacatagtggttcagccagtttgcatgttttctcaaagtgctcaaactggttgcatctcttgcatttcaccttctttctcccaggctcaagacagccccttatcctttgcactctaggcctgccagctcctcttcttagtcttggaggatgcactttgaactcaagatcaactgaaggccattgtgacctatcagtcatgggttgaatcctccctgcataagctgctctaaagtactggacactgtaatatggatgcacaaagtcctgaatcttgcccctgttgctgcatatccaagccaaggggatcctctagagtcgtcctgcaggcatgccataccctacaagaacaattttggttgtccaagtccacaatgtgcctctgggtgctgttatcactctcaaccattgtgacttcagcaaacccatggtcacttctggccaccttaaccaccttcaaattactagttgcagtgtttagctccttcatgacacttggcaggatttcatcatccatcttgctggcacaatctcttctaagtgcaaatttctccatgatcatttctctgatggaatcaaccaactcatgtaagagcaaaccttttaagcccttgatctggttgttgaaactctctgaaacattatttgtcaggtaatcacacttgctaagttctgaaaatccacatctataccaaatccttgagtggtgtttctctaggaactctattgcatcaggcctgacatcccatatatgcttcaaatgccactgaaacttatcctcagtatagcatctagcagctggatacagatgatcagtgaacactggcccttggtacttcttcatgaaattagcatagagatgcctcatgcattctctatgctctaccttcttgaaagccttacatgctttgtctaaacccttacatgcatctgtagaaataactaaaccctctgtgtctcctatggccttatttagttgttgcataaaccaaagccaattatcatctgtttctgagtcaaacacagcatatgctacataatacaaccagttatgtccatctacagcagtggctgaagctagctgtccagtgtatttaccagttaatctagttgcatctacacctatgtaaggtctacatccagccaaaaatccatctatgcaaggtttcaatgcaacaaaaattctcttaaagcacatcttcttgcctactttctgcaactcaatctctacaattgtacctggtgacttgttctgcagtgcagccttccagttgaaaagaagctggaagctttcttcatatgtaccatggatctggtcaattgccttcttcataccagaccatgctttggagtatttcagcttgatctcgtatttttcttcaagcttcttcctacaatcagttggtcccttgccaggattggtcttgagccaatcatgtagcctgtttgcacaccagccttgagtagccatcttcccttcatgtagctttgtagaagaacaagtgtgctcaaatggaagaaccttaatctgcatgacaagtagtgcaacacataagtaaacatcatctgaacaagaaaacaaaggaaatttgtgaagaattcacctttgcagtcttcttatcctcaatcagagatgcatgtatatatgccaagggcaaccatcagctgcacattttgcaataaaccttgtaggatctggcttcaccgaacctttagcaaattcaaaacctttcacgatggcataatgccttacagcttttctgagagctatcatgtcagggaacaaagcatctttgacaatgtttggattctcagggtcatgaatgatgttataaatctgaggatcatgatctgtaatctgtgcctcaggagctgccatagcactagcactagcaccattctctccactctgagcagtagctgcagccccctgaggttcagatccaggttgaccttgctgtttagatgcatgaacatatatgtgctcatcatcaacaccaatatactcctcttcattgtcaaagatatctgcctctctaacttctgcttcctctgttgtaggatggtcagaacctccaacagtagggatgtcagcagggatttcatgagggatgtcagcagggaattgaggagggatttcaggatggatttcagcagggatttcaggaggcaccacacatataggatttaaagcatttatagcaaatggcacaccctttgcagcatccaggatggatacaataagctcaaagtggctctcttctacatacatttcaaacaactctggaatctggccatcctccaacagtctcacatcctcaccaattaacttatgaaaataccatatggcaggagactaatttgggcaacaagttaactcaacacttaggctactcaacacaaactcaatgttaaagctatctgattccacaacccattgatgagttgacccttttgtgtaaattttcctaccagcagcatctattgtcacatagccttgaaccctaacgtctaccgaaaaccagttcctaccaaacaaatcaccacacatgaagaataatgcaagccaaagatgcatgatgcagaaaaaagatgctttgccttccaacattacagctttcaattgatttagggttagggatactcacggcctcgaacagattgttggattggatttgcctacatccatctcctcgccatctcgcccaggggtccgcgggggggtggttgtcgccatcacacttcctctgccaaggcctactagcggcgcatctctcccgcttgaatcctcgccttcaccgccgccacaaatgccgccgccagccagatctggagcgcgaatagggaggaatggagtggggaatggatggggctagggtttcgactgggaatagagtgagcaagccaacgggtcgagctgaaacaggccagatttagagcgtgtctgaaaggggcatttctgtccatacggatatacgtatccgatactacgcgtccaaacacgggagacgaccaaattatggcatggatcaagattcacatcaatacggatggcacgcttcgaaataggtgatttgtaatggaatttctctaatttgacacaattgtaatggcatggatccaattaacccttctttatttgccattaatcatatatagggttaaaccggttaatccaggaacttggcacgacgacaagcggaaaggcagttgcaggaatgaaggatgaagggtagctagcagcctaggaaaaagaattgcgaatatacttattatttttaataactttacgtatatacttgcacggtaagactttgcataaatatatctatcccacagggtgaaaacacgagaccgaatgtatgccgcaacgcaaaatcgcggaaccaacggtctcgcgggatggtcgcgcggcaccggccgtggcatgcgtagggtgggcatatataatgctgtttgacactgtttagcacaatagagacaccgactttgctactgttcacagagctggttccgtgcaatggaattgcgggaccgtgttggtgtcacgtttttgagccacgggaccgtctcggtgccgtgcgctaccgttggccaccacggtggcgcgtttttgagccgggggaccgccgcggtgtcgcgcgacaattctacagtaccgcgtgaccatcccgtgtgatcgtcggtcccgtgttttttgctgcaactaacatttagtctctcgtccttaccccgtgggacgggtatatttatgaaaattcttcccgtgcaggtatataaacataaattattaaaaaataagtatattcataatttttttagaagcctagcacccattgaagacagttggaaatgatttacattctcatcagttcataattcgcaaagtataacacgaacaacttgttttttcctggttttcttgctaagacgattgtgagctcaaacgagtcgagttggcccattatcgacgatacaacaagtgagggatgaaaatgggacaaaaggaaaattgaggtgaaacgcaaacaatgaaagaattgaatttgtaaattttgttagagaaaagagggaactatgaccaattgactgcacacggtggcatgtcagtgccacaacaacaatactatagttgggaaagtgtttttctttaaaatatcatcactcggagattgaatagctcgagttaagcttgtatgaactgtccatcatgctgattgctgagctccttgatgaacccgacgagccgctcgaactccgccgccgacgagccgccatcggcgacgtcctgcctcacctcgcgcgccagcgcctgcgccgacgccctgatctcgccggactccatcgcctccctcaccatcctctccacgacggcggcgtcgcacacgtccttcatgtccagccccgtcccccacacggcgccgacgaaccggctgttgatctgctggtcggcgaagaacggccagcacaccgtcggcacgccctcgccggcggcctccagcgtcgagttccacccggcgtgcgtcaggaagcaccccacggcgcggtggcgcagcacgtcccgctgcggcgcccaccccacgacgcgcgccttgttgttcttctccgccgccgcgacggcttcgcggagggcgccggcgctctgactcgccccgaccatgtccggccggagcacccagaggaatgggtagccggcggcgacgagcccgtggaggaactccgtgaactgctccagcgagatgacggcgaagctgcctaggctcacgtacacgactgatcggtccggctgcccgtcgagccacgccacgcagccgtcgtccgcgcgccacaggctgcccgcggccgccggcaccgggaacatggcgtggagagggccgatggcgaagacgtcgcgcatgcgcggcgcgacgtgcgcgagcgctggcccctccatggacgcggccgtgttgagcacgaccgcccgcgccccgcggctgtgcgcggtgacctcgatgagcatctgcacgatggggtcgttctggtcctcggtgcagttccggaagttgccaggaagatctcgccggcgcaggaagctctccatgcccggaacgccgcgcaccggctcgtcgaggtcgccgtcggccgggaacaggacgacctcaccgagctcgaacagcctgtcgactgacaagtaggccagtacgctgcacgcgctggccgtgcggaagaccagcgacgggacgccgatctcctcggcgacgtcggcggcgaacggcatgctgccgtcggcgacgacgcaggtcaccggagggaagccgccggaggaggcgccgtcgtcccctgcgcgtacgagcgaagcgagcaaggagcggtacgggacgctgccgttggtccgcagcgactcgaggagctccacgatgtcgccgacggcgcgcgggtggtcgtcggggaggccgtcggggatggacatgaaccggagccgcggcgagtcggcgccgccggcggccgcggcgccaccgaggcggcggaggctgtggtcggtgtggaggaaggtgacgtgaagaccggcgccgacgaggccggtggcgaagtgcatcatgcagttgatgtggccctgcccgggcgccgggaagacgagcacgtgcgccgccgccgctgccgccgccatgttcgtccgctcgcgcggcgggcgtctcactcacggcactgcgctctcgtccaacctgacccgtcgtttccttgtaggcgcctaggcgatctcatctatggccatttggccaatggttggttctacggacaagttgctgaaaaaaaatggtattagtagaaaattttggacgagtctctagacagcaaatttcactgggcgtattaaaaacgaaattgctatgcttccaacttggattgggattcggtgacattgctccggtgacattcccgtgacattgagtcactaacgtgtgggactcctgtcaccgagaatgtcacgggggaatgtcactaaatctgcgtcggtccaactcatactataacttatatccggttagtgtatatataggcataaatactacttgtttgggtccagatgacaagaaacaagctcagtgagtcgaatggctcggtcatacgtatagcaagattctattaaaaactgccgtaacctttctgagtgattcaaagtctagaagtttaatttattgtgtgatctagagaaggtgttggtactatttataactgactttaatttgtttattttatttctccctacgtagatcgagttcagacttcagattctgtggcaggtgctcacaatacaaatgtaacttgcggttgctgccatttgccaactggcggcaataggtccatctcgccttcccttaccctctcttcttcccacactctcaatttcacatcaagacggtgatcccgagactgtgaaggacagtaagggtattcttatcttttttatgtctattgtgtatatttatatgggattcggatcaggtgcagtcactactgtgactgtaactttagcagtatccatcatccaaccatccagcacacaagggatggtttagattcgttgtttaatttccccccagctattcaactactctctgactcgagcagatgtgttttggagggaaaagtctgagagggaagtaagaattggcgccaattctaccatgggaagcatactttacctcctactgccgcacatcacacgcaattaatttggatattatctttttttccctagggttctattaatgttgaagatgtcatcttatcttaaaagttcatttgaagaggtcaatagaacttagaaggcatcgtgctgattttggaagcagacgatgatctacttttggatcatgaaaatttttgtaactgggttaatctagcagtagcatagctagttgattttgaaagcttttgtgtcagtggatgcatgacacccaatttaagcgaaaatagttagggtgtgtttagttcacgaaaagaaaatttttgagtgtcacatcggacatttgaccatatatcggaaggggttttcggacacgaatgaaaaaattaatttcataactcacctgaaaaccgtgagacgaatttattaagcctaattaattcgtgattagcacatatgggttactgtagctgtcggtgacatgggatcaggagtatcatgactagaggtttgaggcagacgcaatcgcccacgtggcctggcaccctcgggggacgtcgggcccgagggtgatgtgttcgacctcctcttagtccccccgagggggtcggaccgcacccgcctcggccccgagggccgaggcgccccgacccctcgtgggttttttctccgcgtgtatgggttaggtgagcacagcggggctcacctaaccacatttattgcggtttggctgagcgtgtcacgccgcatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctggttagatatatgccaggcttcatcctaaccattacaggcaagatgttgtgtgaagaagggccaacatgtagattgctaaactgacacgtggtggacaagaatgagcgatttgtgaccagtctgacactggtcatgtcgtcagcagacagccataatcccacgtcgcacctgcttccggcggaagtggaggtaggtatgggccgtcttatcagaaggtcattcggacggcaactatacaaatctccgtccatttatgaaaagggagggtaagtccccacagaaaagagggagatggtgcatgtggtatccccttaagatataaaaggaggaccttgcccacttagaggggggactggactggactggactggactttccgggattcggaacccagaacaagggagaggctggctcatactttgtagctccttcagacacagatccaccaaaaacacaggagtagggtattacgcttctcagcggcccgaacctgtatacatcgcccgtgtcttgtgctctttcgattgtcgcaatccttccacacatcaagagcttagaatttcacccagagtccccggccgaaccggcaaaggggggcctgcgcggtctcccggtgaggagccacaagctccgtcatctggcgcgccaggtagggggctcagcgtgtgtcttctgagctctcgcactcttccgtgtgcgccaagcttttcctgttcagcctgatggccgagcaagcaaaggcgcatgacctctctccgagtgtgagtggcgacgacggggagccgaacccacgccgtcgagctcgtactccaccgccccctccacgccaaagtcctaagcggggggaggcgcttgagagggtcgaaagatccgcgacttcaccgatcgcgggcgatggagaagaacggcgagatggggagcgtcgcctcctcgtctacggcgacggcagcacgccccagggcgcgctccaagctgcgggcgcgctcttacgtcacccgcctgtcgtcctgacccggagtctccagcccaacgatggctggacgacgtggccaaattagtcatgacggcacggcagcgcctagatgctggtgggcggtcctccgccaccaaggcctctggtgctgctaccaccggctccgcgtcgtcaagacggagggcacgacgagcggcagccgttgttcgccattcggccgccactctttcgtcgactccttcgatccgggaagatctgcgtggggggccgaacgcccgcaccagcatcgagcgccggcgtaatgaccaaagtgctgcccacgcaacggagggcgcttcctcgtccagagtgtcacctcaacacggacgcgggaatcagccctccgtgcccccggttggtggtgtcggctgtagagcctttgtggcgagtcttcggaatgtccgttggcccccaaggttccggcccaccatcgccgaaaaatatgatggcagcgtcaaccccgccgagtttctccaggtctacacgaccgggattgaggccgccgggggtgacgacagggtcatggcgaatttctttcccatggccctgaaggggcaggcgcggggttggctaatgaacttgccacccgcgtcagtccactcctgggaggatttgtgccaacaggtcaccatgaactttcagggcacatatccgcgcccaggtgaagaagcggacttacacgcagtacagcgaagggatgatgagtcacttcgctcgtacattcagcggttctgtcaaatccgcaacaccataccatgcatccctgcacacgcggtaatctacgcgttcagggggggcgtgcggcacaaccgcatgctcgaaaagatcgcctccaaggagccccagactaccgcggagctttttcagctcgcggaccgagtggctcgcaaggaggaggcctggacttggaacccctccggttccggtgtggcagcttcggccgcccccggatccgccgctcagacagggcggcgtgacaggaggaggaagaagaggtcagtccatttcgacgacgagggtcatgtcctcgccgtcgagggcgcttcgcgggccacccaaaaggacaggcctgcgagcgacaaaaagaaaaaggccggcgctcccagcagggagcgcccagccggcaagtggtgcaccgtccacaacacctccctccacgacctcgtggactgtcgcgcagtcaaaagtttggcagagcgaacgaggaagtgggaggaggagaggaggcaggagcgccgtgagggcaggtccccggcggttccctccggtaatcggcgaagtgaggccaagcagaaggcccccgccgaggacatcgatgatggcgatgaggacctaggtttccaagagcctggggccaccattgccaccgtcgatgggggagcgtgtgctcacgtttctcgccggagcttcaaggctatgaagcgagagcttctggccgcggcccctactcatgaggcgacgcgtcgggcgcggtggtcggaggttgccctcaccttggaccagaccgaccacccaccgtgcgttgcccggggagggcagattgcgatggtggtttcccccaccgtttgcaacgtgaagttggggcgtgtcctcattgatgggggagcggccctcaacatcctttcccccgcgggctatgacgccatcaaggccccggggatggtgctccggccgtctcaaccgattatcggtgtgatgccggggcacacattgccgttaggtcacatcgacctgccggtcaccttcggtggatccgccaatttccgcacggagcggg

SEQ ID NO: 72766 - DNA, 18125 bp, Oryza sativa
cttttagtgatgcaaatctaaaatcacatgacaatttctccaatggctgaatacaaagaatcccaaacaaggaaggccaaacgcaaattgagtgaaccaggcaggtttatgtcaaactaatttctggggaaataatcccacaatctgccgtgagcttaccaaaaaaggagctaaactaaagaatcttatatacagaatttaaggaacaaatagcttttacatcagctggattttattggcttcaataaaactgtcaagagagatttgaattattttgttgtgatagtaaacacttgaattcacattttcttatcagaatagaatgttaattattccttaatcacatgccaagaatttgatatatgtacactcaccgtgccggaaaccttgtgcatttctcccataatgcaggacagcagtgacgacttgccagagcccactgtcccaaccaccgcagctagctcacccttcctcacctccacctcaatccccttcagcaccatctccatctctggcccctcctctcggccattctccgtaccatggccctgccgggcatcctctgcaccttcaactggcacatcccaagcaaacactccattctgtactttcaccgctgctgcatcaccggcgctactagcaatgcgctccacagccgtgctgtcaatctcggcatcagacaggaacttgttcagcctgccaagtgacacaaacgcttgcatacacatcacgatcgtctgcgggaagttgtgcataggcccctcgagcattgagaagaacgcggtggccgtgaacaccttcccggcatctagctctcctccggtggcgaggtaggtcccaaagaccagcacagtcatggcgagtgggccgctggagaacacgacattgttggcgcacatgaagagtacaatcttggtcaaccaccccatctcagtctgcctgagttctcgcaccttgccaccgaatttctcctcccaggcctgcagcttgatgacacgcatgtggttcagcatctcggtgatggccttgatgcggctgtcgcggacgccgaggaacttgagctggtaggccaagttgagcttgttggcgaacgcggtgatcacggtgaccgcggtgatcacggcaagcgtcatgagcacggaggggccgaggtaggcgtacagcaggacaagcgccaccacgatctgcagcggcatcagccaaaggccgtggagaccgtgcatggcgtaggacaccgtcccggcgtccacctgcatgtagttgacgatggcgcccgaccgtgcgcgcggcgcgcgccggtggacagacgcagcgacttgcggtacagcgccgtgagcagcgcgccgcggatgcgcatccccagcagctgcccctggaagttgtagtggtgcgaggccagcgtctgcaccgccttgccggcgacgaggatggcgacaagccggaggccctcccacgtcgtgccgccatggctgatgaagtcgacgaaatggttgatgagcgacgggccaacgtacatggcggcgaggcgcacaaggccgagcgccgccgtcaataggacgcgcggccagaaggacagccacagcgcgacgcccaccgggtagcgcgacccctgcgccggccagttggacacgaaccgagcgtacgacgcctcggcgcggtgggccggcgacaccggcgggacgtcttcggcggcgagcgagtcgctggcgtaccccttggagaccagtggattgatccaactgaacgtcgcgcgcgacagccacgacgccgcgtcgtacggcgtagagggctccgccgcggtggtgacgtcagcgggttcgcgttcgcacgtacctgcgacctcgccggatgaggcggtgatggctacatacaccagaggcagcgagagggcgaggccggcgaatgcgagggggtcgtcggggaaaagcagcgaatcctcggcccagcggaccgcggccgaagcggagaagagcgcgccgacgagggccgtcacgacccaaaacacgcggagctgcagagggagggcgccaccggccgctcccctccgcgacgcgatggtccacgccgccacggcgtgcgcgacgaagtggacggcgaggaaggcggattcccaaaccctccataccgtgttcggcaggaggaacaacgcgagcgcgaggaggatggccgacgccgccgcgaacacccccgacgccccgagcgcgaccgcgacccggaaaggccttcccgacgcccgaggcttcggcagaagccccttcccgttcgggaccatccccagcgccgccaccgtcgccgcggggaagggcgaggacgacgagggacgcgacgacgaagacgaggtcgacggcgccgaggagcgcgcgctgcgggcagggcgagaggaagaggaaggcgagcaggtcggggaaggaaccacctgacggcggcgagcacgccgtggtggccatccaccccgggaggaggagagccatgtcgactcggtctcagtgtcgctcgccgtcggcgaacatttgggtttgggcggagacgcgcaatggcggcggacggcaagtccggtgcgagtccgggaaaaaaaaaggtttaatctggaggaagatggtccccacttcggccactcctttgactgctagtgctaacaccacaaaagattgtatatcaatctaaaatacagaaataccgtagaatgttatactgtttcaaccgaatagcacgaggtatcatggtaacatgatgacgtgaacatggtatttagatgccagatctaattcttatggggttcatatctagcattgtaggtaccagatctgatacgtatagtatcatattgacgtcagtatgatacctaaatatcagatatgatacgtacggggtatcatgtttggtatcgaatgtattagatctaatacctataggattcatgccgatgtgagttattccgtcgaaacgataataccgttacgtagtctccctttatgaaataagatcttctctttttctctacaatatcggtagttgttaaaatttaaattctaaaattttgattttcaagttttttttatcaaaatttatttttcaacattggtatttaaatcgctaagaatacacacataaatgtgttatccatatttggttaaacgatggggcctaaaacacacgacaaatatatgttgaaacaatttgctatatagctcttataataaagagagaaagaataaatgaagaggagaacttttatattgtgttgttagtgatttaaatgttaatgccaaaaaaactatgataaaaaaccttaaaattaaatttagtagtaagatttaaattttgactacggctggtaaaagcaacgatcaaatgacgggtggttttaaaaacaagtacaccttgaaccaggtaatcttatttttattatatcttgaatcacgctactcttatttttattatatcgaatcacgctgactcttttttttaaggcaaattttgctacaaggcacacaaaatttgtacaatttgctgatatacatcgcaaaaacatctcacggctaaaagacatctctaaaactgataatttgctggaggacaatttcgactcaattggaacaataaattcttcaaaagaatgagaatgactctagggtgaaaagcttttgagctaaggcttgagtgaagatggaatacgatgtatactagtgatctatttggggtgatggctaatttagaattgcataatttctaagtcttcactctatcactatgtttgaagcatgtgttcctaggggcattatcttttttcctaagaatttatctttacaattgagtcgcaagtgtcctctagcaaattattagtcttttaggatggctttcaatcgtgacatgcttttacaatttctataagcaaattacacaaattttaggtgtcctatagcaaaatttgccattttcttaagtatatgaatgatcttaagtatttcggtttttacttggcaatgaactcacatggttgtgtgtacaataaattgaatgtagatagataaaagagcatatagctgtccaaaagagctagaaaagtaaaattatctagtttttttaaaactagtgggttcgccctgcgagttcgctggctttggcttcagtgctcattgcatccctactgggctggccttaaggcccccgttgagcggagtgtctccgacatgtttgctgcgtcacattcttcgtgtcaagagatggtgaatcaactctcttctggactgaccagtggatcgacggtcgcctggtggcctccttggctcaagacctcctcgtcgtcgtgccctcgcgtctccggggttcacgcacaattggttctggcgtcgcaaacaattcctgggttagtgatatccgcggcgccctcattgttctggtcatctcctagttccttcttatttgggatgcagtacttcctacccacctctcgccgggcgtagagccgtagaggacgtcttgtttggcaatggacgagcgaccagcgttactcggtgcactcagcttaccaggcgttcttccttggccagcactcctttgcgtatgccaatctgctctggcacgtgaagggccctgctaaatgcaaattcttcctctggtttggttttcaatagcgctgctggatggctgatcttctccagaagcgtggtatcaatagccactcagcctgccccttttgccctcatgatcttgagacggcgaaccacatcccccttgactgtgtgttcgctcgataggtctggcaccacgtgttgttgcccgctggctaggctgccctctttcccccatggcagctggctttaggactggtggccgtcttctagggcctgcttacttgagcatcttcagccagcttcgactccctagtcctcttggtctcttggtagctgtggaagtaatgaaactctagggtttttgactctacgctctcttcggtctcagtggttctggagtccattctctcggaaggccatctgtgatcttccgctggcattgctatttttgagggcttcttgggagtgtagtgtggctctgcccttctcccactaattagagttgcgtttggccgcctgaatagtttttctttttcatagcttcagtttttgtttttcttccttctcctggataggcatgtctcactggttgcgttgtgtatcaaaaactcttttccttctaatatattcacatgcaatccttttatgtattcgcgaaaaaaatattgatcaaaacaaaacataggtaataaaaagttgtccaaagtgaaactcaaacctcataaaatacttaaaaatataccaatattttagttgtgctaccccactaaatttcacaccaatattttctttgattggacgaaatacacaacaaaatactatattatctttgattggacgaagtactcctcccatcccataagaaaccaacctaataccagatgtaacatatcctagtactacgaatctagatatacatctatctagatttatagtactagaatgtgttgcatccaatcctaaatttgtatttttttttacaaagggagtaccaatgttagatttttttttatatatatacgaagggagcacacgagaatacaacaaaatgtactattcaaattaaagtgttcttttctggactgcttagagcaagtttaatagtatagctaactattgacttcaaattatctatagtcaatttatacaatagttataaacatgtactacataattaatgtctggtcccacctgtcatacacatatgcatcttggaatctgtagcccgttgctttatctcttctcttttatctccttaaaatatgtttatagctggcttatatggagaactagccaagagttattttgagagctattttttagcacaagataatagctctccaataaaatagccctaagttgtttggatcccagggttattttgagagctatttggcctttaatgtaccttcctatagagagagatagagagaaaatacactttttcagtggccccacccgaaatagccccaattagcaccccttgggtgggatagtttttggggtgggttatttccaaatagccctcgaatagctcacccttttgatctttttgggttattttgttggaaatatggtcatgaattggcatattttaatccaaaatgttaagacaataatcatggcataagcagtgtagggtgatctgaacataaccagtagcatactaaagacatcatgcgcatcaccatgaatatcaagaacagaaacatagcgcacaaacatgctagaggcatcatgaatattaggaacaggaacatagcgcacaaacatgctagaggcatcatgaacatcaggaacaggaacaaagcagtagagcgctaatagcaggaacagaagaaggagaaggatataccccgagaaaggccctccgctggattgtgaggcagaattgcctccgttggtgttgttgttcgccgcaccacctccggctcctggcacgccacctccggctccaggtgcgccatctcctccagcagcagcagcggcaccggcggcagctccggctccaggcgcagacatggcgaggacgagcagtcgtgcgggaagcactccccaaaaacctgatcacccgcctacccggtgcagatctcaggcgaagccttccaatctctcgtgcgcgcaagagatcagaagcgaggaagcgagagcagcacaggcgcggaggaggaggaactaacaccggaaaagaagcaagcgattagaacggatcggactcgcggcctccttatttatcaggagagaggcagtcgtgggaacgtggacgcgctgttgcggggcagtcgtgggaacgtgggttagtggctgcaaaagagtagcgacgtgacgcacgccgccagccagccacgccacgcctcgcctcgcccacgccctcggcctcggcccggcccgcgcgcgcgcgtgtggctttccgacccccatctcaaccagtcaacagggagtctctaataacaacctatttaggttgagatattcctcgcttaaatcctgaggtggtattattatccttaacacttattatgggcctttgagatttaataggataagttgggcctagcccaattattctaacaatccccaccaaatttcaaggctcgtaagaaatgttgtgcctgtttgatatatcagggttttggtggagactgttaagttgaacttccacctaggaaatgagctacatcagaccacaactgaacaatggactatgccttgaattgtcagttttgtgtgatcaggtttcactcagaaccttgactagtactgggctaccgttcgcatcccctctgtttgaagcatataagtcaaactccgggcctttcatgagtatctagagatcgcccaacctcacagactgtgactagcagtcgaactcatataggtgtgttccttctaagatgttctgcaggtcaacatctctgcttagaaaagccactcggatcacattaaggcatgagccatcctaccatgcaggaaagaagagaagcacatcatgaaaatgagcccttttcaagggtctcttctctcagtcacacaatagtttgtttcgccatccaaattcacgggatctccgatcacaatggacaggtttccactattgtgcaaccttaggtgggtatcaagcccatttccctcgatgcactgtctatcacgttacatggtagccccttggtaaactgatctgccagatttctagccgtttggacatagtccaatgctatcactccggagtttttctgctttctgacagatttcagtcttctcttgatatgtatagatgacttcatgttgtcctttgagctattccctttaataatcactgtttgactatcacagttcattaggatagttggcactggtttttctaaccattggcaaatccatcaggagttctcgaagtcaatcggccttaactgtcgcagtatctagtgctgtaagttctgcttccattgttgacctcgttaagatggtctgcttgcaagacttttaggaaacagcgccacctccaagtgtgaacacatatccacttgtggcttttatctcatcagcatcaaatatccagtttgagtcactatacccttctagtagttttgaatacccggtatagtaaattccatagctcatagtgccctttagatagcgcattactctttccagagcctgccaatgatcatctcccggatttgagacaaaccggctcagcttgcttacagcaaatgagatgtcaggcatcgttgcactagccaagtacatcaatgaaccaatgatttgagagtatcttagttgatcccttgctattcttcggtttttccttaatagcacgctgggatcataagaagtaggagctggcttgcagtcactatatccaaagcgactcaaaaccttgtccacatagtgggattgcacaagtgtaatcccaccctcatctcctctttgtagtttgatgttaaggataacatcagcctctcccaaatccttcatttcaaaactcttggacagatagtccttgacctcctcaatcacattaaggctggtcccaaagatcaatatgtcatcgacatataagcacaagatcactccttctcccccaccatagcgattgtatacacatttgttagcttcgttcacaacaaagccagcagatgtaagcgtggtgtcaaacttctcatgccattgcttaggtgcttgcttgaggccatacaaggatttcaacagtttacacaccattccctcctgaccttttagtacatacccgtctggttgatccatatagatctcctcctccagcgctccgtttaggaaagctgtcttaacgtccatctgatggacgagaagaccatgagaggctgccagagcaagtagtacttgaattgtggtcaagtgagcaactggtgagtatgtgtcaaagaagtcctcgccttccttttgggtataacccttggtcacaagccttgccttgtacttttcaattgtaccatcaggcctaagctttttcttgaaaacccatttgcatcctacggacttgcacccatatggacgctcaacgacttcccaagtaccattagatataatcgagtccatttcactgcgtactgcttccttccaatagttagcgtcaagagatgaatatgcctcttctatggttcttggggtgtcatccatgaggtatacaatgtagtcatctccaaaaggattttgcaaccctttgtctcttactcttgcgagtgtctacaatgttgtcctcctcaggatttttctcagacgtttgatcattgtgttctatcggtgcaaagttctcatggggcatgacagtttcttgactagaagtgctaggtgtatgcttcatgggaaattcattctcaaagaatgtagcatctctggactcaagaattgtaccaacatgcatgtcgagtactctagagtttactattaagaatctataacccacactgtgaatagcataaccaatgaacacacaatcaacagtatttggtccaagtttccgctttttggctataggtatatttaccttggccaaacagccccatgttcgtaggtatgagagatttaatttcttcctttcccattcctcgaatggtgttacttccttatgcttcattggaattttattcaggacatgacacgcagtcaaaactgcctcaccccaccattccttggaaagcccagcagagtctaacatggcattcaccatctcagttagagtacggttctttctttcggccaccccatttgattgggggtgaatagggaggcgtcctctcatgaataattccaaactcttcgcaaaaggatgcaaactcattcgaaaaatactccccacctctatcagacctcaaccgtttgattttcctttcaagttggttttctacctcagctttatagattttaaagtagtgcaatgcttcatcctttgttttcaatagatacacatagcaaaatctagtgcaatcatctatcagtgtcatgaaatatttctttcttcctttagtcaacacgccgttcatttcgcacgaatcggaatgaacaagttctagaggtgccaaattcctcgcctcagatgccttgtgaggcttgcgaggttgtttcgattgaacacaagtatggcacttggaacctttgaccaaagtgaattttggaattaaactcatgttagctaagcgcgtcatacaaccgaaattcacatgacaaagtcgcgaatgccacacattagactcatcattcttgctaatatggttaacaacattatgattattacacatgtcattcaaagaaaagcggaacaagcctccgatgtcataaccttttccaacaaaagtcccatatttagatacgacacatttattggactcaaacacaagtctaaaaccttctctacacaatagagagccgctaacaagattcttctttattgaagggacatgctgcacgttcttcagctgcacggtctttcccgaagtaaacttcagatcgaccgtaccaacaccatgaacagccgcaagcgacccatttcccatcaacaaggaggaacctctcctgacctgataagaagaaaacagagaaatgtcagcacatacatgaatattagcaccagtgtccacccaccaatcaggtgagtgaaaaacagagagaactgtaggtaatattttaccgtaccccgatgttcctccgccctcgctaatgaccatgttggcagacttcctgtctttgcgctcaggacagtccttggcccaatgcccagacttgccacacacaaagcagtctccctttgcctttcccttgcctttcttcttaaagttggttgcagcattgggtttgacatcaggcttgacatcaggcttgactttcttgttgttgtgggatgcatgagggttcttcttctgtaccttattggcactagaacctccctcaacctttttgccccggacgtcctttgccctcgccttctcctcaacacccaaagagccaatgagatcagaaacactgaactcttgtctcttgtgctttagagaagtggcaaagtccgaccaagaaggtggcaatttggcaataatgccacccaccacaaacttgtccggcaactcacagttgttgttctcaagttccttagccagcatctgaatctcatgagcttgttctactacagaacggtcatcgaccatcttgtagtcatagaactgctccatgacttacagctcactgccggcgtcagaaactccgaacttggcctcaagtgcatcccacatgtccttcccaaaaggcatgtgcatgtacaagtccactatgttgtcagctagtacactgatcaatgctccacggaacaggcaatccgaagcctcgaacttagcctcttcctcaggagaaagaggtggttcacttcgtttgccccgtgaaacatagaagcactgcatcgctgtcaaccacaatagtgcacgtgctttccatctcttatagttagaaccatcaaaagcatgcggtttcagtgcagcagcaaagccaactaccgaaaatgacctatcaggtttttggattgttggaaatatggtcatgaatcagcatattttaatccaaaatgttaagacaataatcatggcataagcagtgtagggtgatctgaacataaccagtagcatactaaagacatcatgcgcatcatcatgaatatcaagaacagaaacatagcgcacaaacatgctagaggcatcatgaatatcaggaacaggaacatagcgcacaaacatgctagaggcatcatgaacatcaggaataggaacaaagcagtagagcgctaacagcaggaacagaagaaggagaaggatataccccgagaaaggcgctccgctggattgtgaggcagaattgcctctgttggtgttgttgttcgccgcaccacctccggctcctggcgcgccacctccggctccaggtgcgccatctcctccagcagcagcagcggcgccggcggcagctccggctccaggcgcagacatggcgaggacgagcagtcgtgcgggaagcactccccaaaaacctgatcacccgcctacccggtgcaggtctcaggcgaagccttccaatctctcgtgcgcgcaaagagatcagatctctcgtgtgcgcaagagatcagaagcgaggaagcgagagcagcacaggcgcggaggaggaggaactaacaccgggaaagaagcaagcgattagaacggatcggactcgcggcctccttatctatcaggagagaggcagttgtgggaacgtggacgcgctgttgcggcgcgcctccttatctatcaggagagaggcagtcgtgggaacgtggacgcgctgttgcggcgcagtcgtgggaacgtgggttagtggctgcgaaagagtagcgacgtgacgcacgcacggcagctagccacgcctcgccctcgccctcgccccggcgcgctcgcgcgtgtggctttccgacccccacctcaaccagtcaacagggagactccaataactccctatttaggttgagatattcctcgcttaaatcctgaggtggtattattattcttaacacttattatgggcctttgagatttaataggataagtagggcctagcccaattattctaacatatttagcctatttaagatagggctaaaaaatatctctcggatccaaaacgggccatggtctgctattgtactgctctttatccgtttgtagatcacccatttatcctctttgtgcggccggcatggcactaaaaatgccatcggaatcaacgaaccattgaagcaataggttaatcaatgaccaattagtcaaacaaaattaatatcatcttgaaatattcaaatgttagattctctgacatcgtaaaaaagtattaaaatgtcagattcttctatctgacgctggctaatagaatcaatttgtcatttcatttgtactgacggccccaggttgcacaaaattgattgccaaaccctctagcaaaatgattactacgatgaaatgaagacgtatgctttgtttaactatgtgaatggtgtttgcttccttcgtttggaagaatttggagaagcagacaagaaatggctgacgatttcaagaaggcggcaacaagaaaaaaagaaactgaactgaaagagaaaaagacaaacgcgacctggatagctgtcctttgagtcgcgaagagaactagccgctctattttgtatgtcgggatgaagagttctccacgctcatcaccgaacacagcggtcacatttcacatgaactaacctaaattttgtatagcgggaacttggaagcagctttcaagttaggcctggtttagtttccaacttttttttcaaacttttaactttttcatcacatcaaaacttttctacactcacaaactttcaacttttccatcatatcgttccaatttcaatcaaacttttaattttagcgtgaactaaacacatccttaaaaaaattagcgtcaaactaaagaagcccaaatacaacaaaaacagtctatctactcaagtcaagtcttctcataacaactgcacctctgtaagccttgacaaaccagaggcaagaaccaatccatgcccccttgtcctaacccctctctctcgttttccgcgcgcacgcttttcaaactgctaaacggtatatttttttttcaaaaagtttctatacgaaagttgcttaaaaaataatcaaaataatctatttttttaaaaaaacttagctaatacttaattattacgcgctaatagaccgctccgttttcggtgtggagggtttcgggaaccaggtacagcgaacacacccgtcttcgagtcaaagtctacctactaatacaccgacgacatgcaacaactatatccatgtcatcacgtaaccaatgatacaacattttcaaactatcaacgtcaggaagtttacaatggaaaagaactcagcaaattgcgtggaaacggagccaaatagttactgacgtctcagtaaatcaacaaagctaaccaataaactagattaatggcaactgcatagcttttgtaagcatgaaaaaaactttggaaaaacgttgacatccttggtattctagtaattctctccaattctataatccttggcgttttagacattgacacggtctccaaaatatatctttgactatatttttctattataatatatgcaataaattactaatttttaattttattatagtactttgtaaaagaaatctatatatgttgttctaatacctttaaactaaatagttttaaagttattgataattaaagttataaaagtttgattacaaccttgtttaaaaggtcaaaaattatagaaccggatgaagtattatatttagggttaagtccgatttacccctctaaactcttgcgaaagtacgctttacccccctaaactatgataccatacataatcccccatttaactattcaatccgcacacttaaccccccgcgaccaatttcggctggttttacgtctttgatccgacgtggcacacccatgtggcaaatgatgtggcagttacataaaaatacccctcccctcctcttctctttctccctctttctctcccccatgaaaaattccccaccgaacccctatccctagcggcgcggagggagctgggcggcgcggcggcgtggtgaagaacgacacgggggcgtggtgaagggcgacgcaggcgagggtgtgtggcgcgagcggcgcggcgctgcgcaggcacgacacttgcacggcagcgcgagacacgcgcggcggcgcggcacaagcacagcggcgaggtacatgtgtagtggcacgacgctcacacggcggcgaaacgcaagcatgggacggcgcacaggtatgccacggagctcaagcatgtcactgatgcaaaggtgcagacggagaccaatcttgctaggcacaaagaacagacggaagcaatggggaagcaaaaggatgctggaaaagctaatctagttgctaaaattaatatcttagagaaggaaagatgtatgcattagtagcatgtgtatttataattctggggttgtatgttaagctgtgatctttctgtatatgcagtatactaacatgtaatcactgcatgcatgtaacatgtttctcaatttgtgatggtcatgtgtttgtgcaataaaggagctttgtcatcagagtcacaaatctgactacaaccaaaaatctatgtatgtcattaggctcactgctgtgcttgtgcgcgtgtgccttgccgctgtgcttgtgcctcgcctcgcgcgtgtcgtgcctgcgcagcgccgcgccgttcgcgccacacagcttcacctgcgtcgctcttcaccacgcccccacgccgcccttcaccatgccgccgtgccgcccagctccacctgcgccgctagggttaggggtttgggtggggaatttttcacggggcagagggagaaagagaggggagaggtaactgccacatcatttgccacatgagtgtgccacggcagatcaaagaggtaaaaccagccgaaattggccacgagggggttaattgtccggattgaatagttcaagggggtattatgtctggtatcgtagtttagagaggtaaagcatactttcgcaagagtttaggggggtaaatcagacttaacccttatatttatctggtgcaggagaaagttgagttgaaatggaatcgagattagttatcccggttcaattgccaggcatgcaacttctgttgtctttccatgaatgtgtttttttaaatagttttaaagaataacacatgttaggaaaagagaaaatccctcgtatatccctgaaattttagctaatctcctctgtgcccctgaattttgcttaattccgtataccctctaaaatttgattttgatatcttccatgtcccttctgtcagctgccgtctaatttctatatgaccattttactctttggatgaacatagaaatttatgagttacataattgaaaatgtaaatgtttgtcgcatgagactattatagttatgagtttgctgtgcgatacattatttatgacaatttatttttagataatgaaatgaaacatatgcatttattttttaaaaaagtcataaaaattgaggagtattcgtacaaacataggactaccaacgtccacggtatttttttatgaatgctcctgataaaaaaaaatccattgccctattaaagattcaaataaaaatttaatttattacattttttattttcaaaatttatgtcaaaattttccgcactaattatttaatctcattaattttacaaaatgcacatattgtgcactcaaacaaaaattttaattgttcttcaagcttatattcaaacctaaatcatcaagggcataaaagacatttgcaaccagacttaacagtgaaacaaaggaaaatgtaatggcaagggtatggaagggatcaagttgaaatttcaggggtatagaagggatcgagaaaattttaggggtatgaaaggaattgagtgagttttcgagtgtatacagggaatttactcataggaaaaacacatgaatagaaaaaatataggaattgaagttgcaaatttctttaatcgtataggagtgaaaagcataggaaatatgaagatggagccctttgacagcatcaccggaaactaacaaatcaaaggaaagttttcaacatgttgtgcttcttgcttatttttctatgagattgaaccatttgaatgtagtcctaggaaaaatttcgtatctttcctatgaatcaaagggttccatagaaaaaattctttaggaaattaaatcctccaaattttctaccgcaatccttcatttcgggccctaaaaggcaggaaattcagataaatagttttttttttatcatgacatcacctaggatttaattaggctccacccatacgttgtgcttcccattttaagtattacctgtctacctcggagccaccggttctcatggctgcttccttccataggttaaaattaagtaaaaatgctagcatctctgcatcaacatgacatcccccttaagaaaagaggacgttcagtgctactacactgtcatcaccttcaggaaaaacaaacaaaccagttttggatagtgaagggttttggacagcctccatcttcaagtttacaactaccatggctttaggtcacatattgaacaattgaaagattgcttcgagctaaaattttcatatagtacttagacaccttaaagtacaaaaccaatttagtcagttcagtacaactcaggatggagcatctttgagggagagaagcataacttttgttgctacatatatgtgttagttaacatggatgccaatagggatggcaatttccccggtggggacggggatccagcggatacccacccctatggggccggggacgaggctgttttttgccctgcgggtgagtcgggtcggggccccagtcgttaccgggggtgggggcgggtgtgaaaattaacccgtgggtgaccctatggagctccgaaagtgtatatcccattttatggcccattcaaaataaagactaataggcccaatttggtgtcacacaccaatccggcaccgccgtacaacagcacctgactggagcgcgtcgtaggagaaacggtgcgaaccgcttcctacgagaccgcgataacggtaccagtcctaggacatagagctggtacccacggtgacaataatgaagcattgcaatccttaatttaaatagaggacttatttaccttaacttaggttgcagctcagaatagcccgagaatgcaatcgatgacgcggacgaggaaacaccaacaacagcagcagcagtgaaaccaacggactaacacccaacaccacatgcgacggctaggaaccaggatgaaaccctaatcttcacttcactttatcttcagcttcaggtcggaggaactatatatatttatatagagcaagggtgagtacttccatactcagcaagtcacgggaatttaggtgttta

SEQ ID NO: 72767 - DNA, 3044 bp, Oryza sativa
agagagagagagagagagagagagagagagagagagagagagagagagagagagagagagctaaagattgatgaacatttgggaaaggaatggattcgaagatgatgttcagtagacagtaaaccaattgttaaatcgtgtgcgtttgagaaaggtttgggccagagatgttcgccaattcttggtttttttttatgcgtgctatcctaaccgccgagggcaactacctcgtgagatttcgttttctttatcatgatttgggcgttggagaacgtgatcacctacattatcaaagaggatggcctctgactccttccattttgtgttatactactaaccggtagcaacaatatgatcatgcatatgggattatcctatcgcccaaaagaaaatcatgagaccgatcgaccgatcaatcctccccaaattcgtcctcaaatcgcgtgtgatttacttcattgttgttttgtttacttcgcttttttgtttttaaaactaaagcttgatctgacattgatgacattagtgatctccggggccgtaaataaataaactcggagattcaactcatgatacacctgaactattagcagttagcttcctgacttctagcacttccatcatttgagtttgtttacttaagtctttgtgtagaggtcttgcacaaattgccatcactctcactcttaactttttttatttttttagaaaagttttaaaataaataaagtcaacaaagtaattatataatctccaaatgcacccctgaaagattcttacataattcttacaaacaaactcttaattgttggatgtaattatatgggagttaaattaaatctagattttagtcgatgtatagagatcacatcattgtttgtaaggtttttgtaagaaaaaacattgtacatatagccttttccttacatataattttgttaatattatgtacgcattccttaattagaaattaacatatgtacataaaacaacaactttaggatactatccctaataccctataacaattttattttattcatttattcacatttgacaactagaattataccagtgggtaaagaccaatgatataatagctattaggagctccgataaattgaaacattaggatcgctatatacatcataattgaaaagttaatgaaaaattcttccttggttttgggccaaatactattcattccttcctttctagccccaacctagtacactaccacccttcgctcggtctgtctcttttcgatccagcaggcccaacttgcacaaccggctaataaatatatttaatgtaattgtgctgcgtgtgcgtgtggtggatcgaatcagaaaaaaaaaatcagaagcctaaaaaaactggacggacagaaaaaccccgaaaactttatgtatcttttaattagttatattatagatgtaagaaatggttatctttcatgcagcttgtgtaatgacttgtatctctttcatgagagatgactcctcatatttctcttacatctcgtcatttgaatcaacatggcagtcttggaactaatacttactcgccactccatcgtgggcacttaattagccaaaatgaccacttttaaaataagttttagatgcattttttttctaaaaaaagttttagaaatggaaatttgcctgcataccttgagatttgggatagcttaagtccctggcaaacgcaggaaatttaaccaaaaaacaatatcatgccaacttcgggagcaacgtactactgtacatagatcaattctttacttatgaatggtatatataaaattgaactaggcgagatgcatggtttcagatttgactgttcttgaaaccgatcagacttgactgttagttgtgaagttttccctgtgttccaattacaagtagacactagctaatctaatactaacagtagcatccctcttggttgttctgtagtgtactgaaaactaatacaacaatgctactagtgcctgataagttgatcttcgaacaatgtgcgcttatagcaggtacatactctgagattgaatttctcaacttgtgttatcccaattgtacttcaccaatccacttccttacaagaaattcagctcgccttattttgtaggtactggatactgatcgaaaatcaacaacagttcgtttagcctttttccctacaccaacttgtcacgttctcaccaataattctcgaccggcagaatccctaaatttcttgccacgtacgtctgcatccctccaaaaattccctataaataccccttctcggccactccctgcaactcacccaagaacacactcgagctgaccacgtctagctagctatatctctcaacatcttccgagctactactagtagctagctagctagaggaagcagcagcaatggcgaaatcttgcaccttggtactactacttgtcgcactggtcgggctctcacttcttgtgagccccattgcttgctcccgcaagctcagcaagccgaaacccaagccgaagccgagcatgaagaagccggtggtccgggctcacaacaactacaccggtagcccgtcggtgacggtcaccaccggctgggccgccgccggcgccacgtactacggcgcccccaacggcgacggcagcgacggttagtgctcgcttgctttcgctttcgagcttacagtacttgcattgcacggcattggtcgagctggaactgaaattaaaatggaatcgggggaaaacttgcaggcggcgcttgcggctaccagaccgccgtcgggcagcggccgttctcgtcgatgatcgccgccgggagcccgtcgctgtacaagggaggcaaggggtgcggcgcgtgctatgaggtcagcacacacacacgacactgacacatgtacacacagcagtgtgtggtcacacgggcgagctagctattactgctgcgagagctttcgtgtagctccattaatggcggaaagtggtcggctgatcccaactcaatgcgttcatgtggccgtgtacgcaggttaaatgcac

SEQ ID NO: 72768 - DNA, 2323 bp, Oryza sativa
  unsure (1)..(2323): unsure at all n locations
tagtcccatctaaacagggcattataaacgtttcgtgctatggtggatgggcagcaactctttgcttccacctggatcttctcttgttgcaggactaagcctagcactagcatacacgcaatcaaactgttcacaccttccatgtttcctagcttgttttccaatcagatttactcgaggatcaactaaaggaagagggctgtggttgtgcatacgattggagagtgagacacgcctatttataggtgaagcctatacagatgattatgttattttaattcacaatagttatattgatgatctgtactctgtattgtttgtttagagaccaagccacttacactagtacataatagacttttcgtgcggtcaaaatacattttttccgtgcagaggacctgcccgtctacacccaggtatctacgaaaatccatatttttgcgttcggacgggcggaccgcacgtgataattgattatcccgtgcggtcgtgttaagtagaccgtacgggataattagttatcccgtgcggtcctattatattgacctcacgagataatggataatcccagtcggctagcatgtgctagggcgnctgcccggtataatanattggngcagtcaccntagcacatgctagccgtttggaaatatctacacactttaaccttttttttgtgtgtgtttttgaattgtaaagttacatataaatcattattgctcaatttcatacaataaaagttgctaaattataaaaaaatgacttaatacaagatcctcggcgtcccaaggtgtcttggttcgttccgtcaatgcactatcccgaccgaaccaacatggcacccggagcacctcgtattatgtgatgaattgataagctaggaactaaatccatatataaatgaataattatcaaaaaaattacatatataccacatatcctatatcccaaaaatcacaaaattgacatataaaaaaaattgcatctacatttttgcctaacaattgacatcgcacaaatttgataattggtcatctcacaaatttcataaatatcaccctaagtcccaaatttcacatatcaaaaattgcacatatatataaaaatattgcacatatcctaaatttcacatatcacaaattgcacatgtcacaaattgcgcacatatcacaaattgcacatatcacaaatttcacaaaaaaaactcaaaaatgattaccgccaatggcttgcagaggaggtggccggcggtggaggtcggcgacaccggcggtgagggcgaggaggagaggcggcagcagcggcccaaatcttgatggctagaggtagaggaggagaggtgtagaggaggcggcaacggtggtggttggggaggaggtcgccggcgttaagggcgaggaggagatgagccgacggcgctggtggaggtcggcggcgtcttttggtgctcggtgaggaggcagcggcggtgaaaaactgggcagtgtaggtgcaaatttcgtacgcccgcccagtgcttatatatccatattatcgcctcgggtggcttatgccacccgcacgggataatcgatattcccgtgcgggcagtttaagtagcacgcacgggatgatattatcccgtgcggacggcttaagccacccgcacgcaaaaataaatgcagataaattaataaatcccatctaatatggttaattaatcaatataattattcaaccacaaattaaatatagctatagttaattaaacccataaattatttaactataattctttaactataactaaatatagttatagttaattaaaccacaacttaattaattaatcaatacaattattcatccatatgattaatgcaaataaattattcaaccatagaaatatatttatttaaccacaaatgaatttcaatcgcatctaattaaatcgcttgtatattgatcaaacctcatcttaattattcaaccatatgattaccagaaataaattattcaaccatataaattgagaacgacacatatagtatggataaacatggaaccataagtttgatacattaatcgtttgaagggagccataagttgggtacattaatcgtttacaaaaacaagttgtacacaacaacatatatatatacatatatatatatatatacatatatatatatatatatacatatacatatatatatatatatacatatacatatatatatatatacatatatatatatatactaatgttttacaattttcgcaacaccatcctttcacacggacgaaaacttctcttcgtcaagggttgtctcaattcgcttga

SEQ ID NO: 72769 - DNA, 3106 bp, Oryza sativa
actcaatcctagatttgaaactgaacacattggtttttttttttaacggagggagtatgtcctagttgcagttcgaatccctgaacaatcaaccagtaatttgaactggagtagcacaagatagatgctgtacaaagaaaatactggacgtgcattttggtgtaaatcatcagcgcgctgtttctgtgtcctcctttttttcttttcgctgaaacctaatactcccaaacagcataaactccaatgctgcattatccgcccgcacattgcaaagtactactgtagtataagttgtgctataaattttgctctcctgttatgctgggttcctgccgacgaagacacatgcagttctcatcgaaagtagacaaaagtgcagagtcttgaatgttacacacactgattgtactcaattattagtagtttaagacacgaactggttttcaatggaattattaatgcatggagtacacttgtgctcctctacataccggagcttcgcttgtcctcggcattatgaactggaaactgagaaaagtcgtctagtttgtcatgtgggtctgacaaatgaagattatatataccaggagcgacgaccatggatttcgattcagaaagtttttttttctaaaaaaaactctgcctatttctgcacgagtgtgcagattaatattgtacagtacccgccgtcatatggatacagatttttattttaccacttagtttatgtcatttgatctacttaattccactagcattcaatttcttatttgaaacgtgccgctggttgcatggattaaaaataaatctcaaaattcaactagcaaccaattgcctgccccagatttaccggaaagggatacccacatgttagtgctcaactgcacatccagttttaccatgatctctacgtagtagaaattactttaaaccattatctttttttttctgatacaatgaaacgtatatttggtactagcatcttgactttttggttgtagaatatctttttccacaagcactgataatagaactaataaatcaataattgagtttgcttttaatcgtgacaatattagtagagaacaccgtaaaaataagtatgtaaaaaatagataaatttcgataacatacgtgtgtcgtggatatggattttcataccttgatgggatctccacccgttacttgtatgtcacctaaatatttatcaaaaaattgaaaaacattgataacatatgttaatatgaaatatatcagtgcacaaacatacaataccaaatttgacttctacaagttaaagcaaaaaaaaaaaggtttaaccaaaaatagttatcatacattcgcagctatatttgttatttttcttacatcttacagaaattgaattgtaatatatttaatattaatctatcttgtcaatttattttaaatctgtaatgactatttaaatagcatttacggaactagaggatatcacctatcctcttgaagaataaatacactttcccgtgtgttgttggtatatttctgctcgcagaatgcaaaccacatccgatgctaacaaccaatcacggcctaacaaactagtagtgcggagtacgtgccaacattttgatatggcatagtctcagccagcaagcaaaaaatctgcgcttgtctcctttttctcgttttaatgcatcacatggcagaaagtgaccgtgcgtaaatcattcataactaggagtaggctatttcaagaccttcaattgctcacagtacaacgatctagcggcggtgatacgaaagagaccaccatctatggcacatagctctctttcccaagaagaagaacatgctgcagacctgacctgcaacctgcattcaggtgcggctcgcgcgagtggtcgatgtcaaaagacgctacctagtcactgtcaggatccatcgcgatcctccatggctgcgctccatgtgcccgccaagcgcacacgacaacgatctggatgaaaataataatcgctctcgaaacggcacagtgtacgagcggaaaaccgatcgagagctcccccatgctctgaccgctcgcatgttccgctcccccgttctgtctcccttcccctcccccctgctaataatctcggcgtcgatggatcgatcggttggtctgtgcgtttcacagtccgtgtagccgcctccggccaccaccaccatcaccaaccaaccaaccaaacaaccgagcgagcgatcgtgcaggcggcgtagcgtgaggtgaggtgagcagcgcgcgcgcgcgcgcgcgcgttccccaccgtgtcagtcgcgggcgcatgtggagagattctccggtgacgggagggtgaaagactgaaagcaacgggcgcacatggcggtggtgctgtgcatgcatgcgacgcgcgcgcgaccccgcccgcggccacggttcggctgattttgttgggtattcgcccctattcgaccgaggggtggtcaaaactcaaaaccccgcgaacatgttaattggcagcatcgaaatttctaatctgtcctgtccttccatacatctaccctggattcggatcaggccactttggcagtacccaatcatccagccatccagcacacgagagatggcccagatttaaccgtgtcatacatcattttagctatttgaacaagcatagaacagtttcagttcagattttgcctgcaatttctctccctttgatctgaattttcttgaactttaagacaacccaaatattgttaaagaaaagtagacacatacttcatttcattatattgaacttcataatatcttgcacgcataattgacaaaatgagctagagtttaagcccttgtttagtttccaaaatattttttccaaaaacgtcacatcgaatctttggaaacatgtatgacgtattaaatatagataaataaaaaaaagtaattgcacagtttacatagaaattgcgagacgaatcttttgagcttatctttgatcttatttttctattataatatataaaataataaatgtatatttacttttattatggtgttttgaaagacaaatttatatatgttgtcctttaaactaaatatttttaaaattattgatgg

SEQ ID NO: 72770 - DNA, 514 bp, Oryza sativa
aaatggcgctcgatctccactgcactctctttcgcctgcctgtcgtactcggcaatggattcttgcaagctactcctctgttcattaggcaacccacctaggtgtggccagatgatggcagacatatttgggaaggtgtacgccggcgccctgatggcttcaaccattggccccttccccttgccgggttgcttgatagcataacaagtgctctccaacggtcgcagctgtgaagtacaaacagcgcgttagtaaaaaaaaatgtatatgcaggattaccaacgaatatacgataataggggtgcattgaaagctatatagaaatgaaaatgcaagtgcattgttcaggagccctcatgataactttatgattgggttttagtgtacaaatttagtgatcattaaaaatacccgcgtacgccggccccagtgtatgtgagcacatgaatgtttattaatggaaaggaaaatggggaagaaagaatgtgaaacacttacagggaggttgcaaaac

SEQ ID NO: 72771 - DNA, 2774 bp, Oryza sativa
gcataatcgagagggtacaggacgggtggtgaaatgggcaatcgaactttctgagttcgatttgcactttgaaccacgccatgctatcaagagccaggccctcgtcgattttgtggcagagtggaccccggctcccaagcccgtctcaatccccgaggccagcacggacccctcgcagctgcctcacaccgcccacttggtaatgcagttcgacggctccctgtctcttcaggcgccggtgcgggggtcacgttgacctctccgagcggagacgtcctcagatatttggtccgcctcgactttcgagcgaccaataatatggcagagtatgagggactccttgccggactcagagtggcagctggactggggatcagccgcctcctggtgttaggcgactcccagctggtcgttaaccaagtctgtaaggagtaccggtgctctgacccacagatggacgcctacgtgcgccaagtacggcgtatggagcgccattttgacgggattgagcttcggcatgtgcccagatgggataacatgattgccgacgaactctcacggctcgcgtccacgcgagcccagaccccaccgggcgcctttgaagaaaggcttgcccatgtttgattttgaaatctcaatgacaataaactaaaaagggtaggcagcgggctagccgtagaagagtacagcagcaaagccgctaacggtttggcgggacttctagaaagtaaaaatgaacctaaacaataattatttttgatttttgaaattccaatgccaataaagagaggagccaccagacgagccatcccaatgacaataaagagaggaggcagtagacggaggcagcagacgggccgtagagtatagtggtagcgcttgacgagacttttaaaaatattataaaaatgaatcacaacgagatattaaactctaaacactacaaaggtctaatttttaaaggttcgggaattaaaaaaatataaaaaataaacccaatgataataatgttcgattttaaaatcacaatgacaataaagaggggagacagtggcgagctgtagaagagtattgtggaaaagccgctaactgtttggcaggactaatagaaagtaaaaaaaatgaaccacaacaacaattatgttcgatttttcaaatcccaacgacaataaagagataaggcagcgatcgagtcatagaggagtacagtggcagcgtttgatgagacttctaaaaactataaaaacgaaacccaatgagacaataaactctaaaagctataagatctaatttttaaagattccatagagaatgaatataaatagtggtagatcgagcaagcaaataaataagaggtaacttttgaaaacaataaagttaaacacagggatgataatatttgatctttcaaagtcttaagatatcgagataactatttaataaatttaagtaaaatcatatgaaaaatagataattttatatggatgatagctgtgaaattgtgcgggccacccagctagttcataaataaagaagggagcaaaatcgcgtccacgttgctctccccggggtgacacatatggcacttagcaccagctgccgccaccttcctccctccttttccccgcgcctatcgttgcctgagtggccgtcagcaaagccggctgcctgttaggatggcagcggcggggtttcttcccccctcggtgcccctgcacggctagggaccaagacgcgctttggaggtggagagtcgccacgccgtattgatccgagcctgcatggctggatccggacagggagagactggcaagcgtccgtggaggtgctagcggggtggctagcggcggtggaggtgtggacagatgatggcggtgacagaagtagaggaaaggcggtggcaagagaggacgatggtacgtgggacagcaggcggcggccctcggcagatctagcgcttcggcgctccactggcctgatccggtgccctcttccatctccggcaagggatgtcggatcccctcggtgatgacgtcaaaggaagctttggcagcggggaagagtgcgaggaggcaagcgacgggcaagaccagcgggcggaggtgccaacgctgaggaggacagcggcaagcccgtggcgatggcggcccaatgaaggcacgatagctgtggccggtagcggagatggccaccgtcgagccggacagcggcagagctcatggctacgacaatggcagcgtcgaggtcagcggcggcactgccgaggcaaaaaacggcacgcgaggaagtgcggggcggcggcgaagaccggtgtggtgtgtgccagaaggcgcgggtgcccatccgccggcggaggttagacggcggttggagcattggtgcgttagcgatggataagcaggctgcgaacggcaggtaaaaacctagcccggccttagccaggccggcaacgatggctttcagagcatcactcctttttttgggcattgtcgtgccatcccatgccctttagtgaggctgccgggtgaaaaaccagtctcggttctctttgagaccttgacagacagcggcggcggtgctttcgtcatttatctccttggaggcgttgtctaggcagcccccttgccgaaacctctgaaacaaccggtgcaagcttactctagattcttgaccccttgtgtcggtgcctagcttacgctactaggccacgttgcatgacctagggggaaagcggttccactcttctttatcaccttctctccctcaatcccaaa

SEQ ID NO: 72772 - DNA, 4096 bp, Oryza sativa
aattctttaaattttctgtcgatgtttcgccactgcgaaccatcggcggggtgtctcagcatcccgtcctattgaccctctttagcgtgccatcgcaacattctagcattccccttgttcctgaacaaacgccttagccgtggtattatagggaaataccacatcaccttagcatgaattctcttctttgttagctgcccgtcaacttctcctggatcgtcccgtctaatcttgtatcgtagtgctttgcaaacagggcatgcttctaggttctcatactcctcaccgtggtataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccagtggtatccaactttttgtgcccctgctcgcaacctgggtacaacgaagttctgtggtcctccaacatcttgtccaatttatgggcctccttttcactttcgcaatcatccctggcatcctgcaacatctgactaagatcatccgcaacgtcgttaccatcagcagctatttcctcctcgcccgtttgatttccttcaaatccaacatactgagcaaagtccggaatattgtcgtcttcacttcatcttcttccatttcaacaccttgctctccgtgggatgtccaacaattatagcttggcatgaaccccgactcaaacaagtagaaatgaatagtcctggatgcagaatactccttctgattcttacacttattgcatggacaacaaataaaacccctttgcctgttagcttcggccactctcaaaaaatactgcacgccgtcgataaactctttggaccgccggtcagcgtacatccattgccgatccatctacatgagtcaaaaaaaaccgtacacaaataattattcttacaataatgacagtcatacaataattataagatatctttattcatacaaaaatcataaaatattacaccaaataattattaaaaactatttgtaaagtgttaaactaaatttaatgtgttttacttcttttaattttcattttagtttggtttctattatttaagattaactttcactagagttttccttctcaactattttataaaaccttgtttagcaaatgaactaaatttctatatattctttcttccccacacacattttctctctcatcaacttacaactaaattttggagacaaaaaaaagtgtgcaaaacataggtgcaaatgtagtatgacaaaaaaaaaaacattggaggatgaagttgcaaaccttttaggcacctccgatttctctgtaatcaccaaaataaatttaatagaaattttggcatgacctcccctcttttttgaagaaattttaaagcttgctcgggcagctggaggaggaagaagacatatatataggggtgggactttagtcccggttattagcaccaaccggggctaaagatcaccgggatctttagtcccggttggtataaagttacgactttagtcccggttggtaatgattccgggggggcctgacatgacctgacagcattcgaaccgggactaaagatcatctttagtcccggttggtaacacaaaccgggactaaagatcaaatatgcccgttacccttttgaaccgggactaaaaatcatctttagccccggtttttattgcatccgggactattgtggaaatcggccgaccgacgaaagatggtttctccaccagtgaggcttcatgcccttgcacggagcctatcattgcttttggacatcctcgacatggattaacgattgactctgtacttaaaatcagcaattcaatgtctctgaatccatgacacattgcggaggagcgcagactggaactaatcaagcaaaaaagatgtacttgaaaaatacacatatgatctagtctaatgaagcaacataccttctagtttccagttctcctccaacccctctcctttaaagtgattccaattttcactgtaaacaggttaatatggatttgcaatctctaatttaccccctatggaaaatatgaagagaaagattttgaagaagagaatcaccttgggttaatgcacatgttgagttcaaccagcccacgtgtggtgatacgttgtggtcaacagagattgcaggcgacatcaacaaccggattattaacatgactaaaaagctaagggtgtgtttgaggagaaggggattgaggagattgggaagattgggaagatacgcaaaacgaggtgagccattagcatatgattagttgagtattaattattttaaattttaaaaatggattaatatgattttttaaagcaactttcctatagaatttttttgcaaaaaacgcaccgtttagtagtttgggaagcgtgcgcgtggaaaacgaggtgttttctctcttaatctcccagatcaaccaggaacgaacgaagcctaagtagcctcctcgtgattgagagaacattgcagattttgcagctgatttgaaatcaaattcggcactgtaaattccacaagttagcagggctcctagatgatctaccactaatggtgtaaagagttatccatatgtgagaattgttcataatgcagtataatcattaaactgaaattgattcacaataaatctgaaagcaagttcttctccataatacttgtcatgattaccttgaccaacggttgaaattgattcataattaccttgacctctcatgagataacttccatcgccatcactgtatattatagccgcttgtcacattagcacattattacgggcctgcagcgacggccccggggcggctcgtcgacggcgtgcggcacggtcgacggctagcagcgccggcttcctccccgctcaccgcgtccccagactggccggtcggcctgcgcggctgcaccgtgcccgccacccgtcgccgccgtgcccgtctcgccatcgccccgccgccccagtcagctcctccacgcagtcacacgcgcgccgcccgcccggctcggcagccgccagcggcacgcgccctgcgcggccagccgaccacgccgcggcaccagcgatccctccaaaagcaggcaggctgccaggctccagtccaccggccggccacacgccagcgatgccgcccagtcgtcggagtccgacgaaagtaactcttccctagttcccttcatcccctgtcctgcgcccttgctgcccgtagatgtcatgtctgatgttgctcctgctaggtatgaggccatatgctctggttcttttttaccgtgctctcagtaagcgccgccgcctcttcttctccccccgttagatgaccacgctattagaggattgatgaagtattgggtttagcagtgaatttaggtttctttgaagtttcgtacatactgcaagatgggcagatttgggtgttttgatatccagatcttgctttacacatgtgtttgcagttaaattgtttcttttcttgatttcttgaaggggcagctttggatgttttgatgttcaaagatgtactcgcctttgtgtttgcttttctttgttcggtttagcagcgaagccagaagaagctgaagtgagggagcaaagagggccttaggtgataaatcaagagacagtagaatgtatataatttagtaactgcaaatctttgtccagagtaaaaatattgatacacttgacatatagataaaatcagattttagatttagccatggacttggaaattattatctgaaccctagcacagatttaatttatcatgaagcataagaagtataacaactctgtcaattaggctagttcaattatagatcaattatagttcatataggagtccatgagtagcatatttttaataaagagatcaatttgaataattaaggagtctatgaacagaaacatagacctttataataaaccatctggagcaaatggttagggcatgacatgggggaccatgtagcagtatgggtaatagttaagataaggggcaactgt

SEQ ID NO: 72773 - DNA, 995 bp, Oryza sativa
aagaatatcgagaaaaatcgtcaacaataaccaacacataccactttcctccaacagattgcactctagctggaccaacagtgtccgtgtgtaatagatgtcccggtgcatccgtcatcacagaaacaataggagcatgtgaagaagcaaccatcttagcatgacgacacggtgtacaaaccaaatcaagatctttcttaagtttaggcaaaccacgaacaagatccaaactacttaacctagtaagataatcaaaaccaacatgtccaagtctacgatgccaaaacatcacatctttatcaaacttatcaaccaaacatgttatcacaggtgaaacaggattatcaaaatcagctttaaacactcttccatagcgagaaatattcaacacagaatcaccacaagaatcaaaaactttacttccagttttcttaaagtgaacctcaaaatcttcatcaacaatttgtgaaaccgaaagcaaattatactttaagtcctcaaccaaagctacattcttcaattcaaatttctcatttaccttaacaaaacctgtagcgagaacagcactagtagatgcatcaccaaagataatcgattcagtcttggatgccttttttgagggaggagaaccaatttttatcaccggtcatgtgccgcgaacaaccggaatccacgatccacatgttctcctttcacgccaccaaagcctacacacaagcagaagtcgaagcctcagtactggggttagatgataacaaaaatttaggaatccagtactaagacacacgaccagaagatccaataggcatatatccacgtgcaaaaacagtttgataattttccgaaaaatttctccgagggggtaccattgttctgaccgggggccggtccgaccgccgctgtaccgccggtctgaccagtgcccggtctgaccgccgctcagtagccggtccgaccggtcgccggtccgaccgcgagacccactgcggtctgac

SEQ ID NO: 72774 - DNA, 677 bp, Oryza sativa
gctatcacctgaacaaatccgttgtcgcccacaattccacgtacgtacgccgtgctagcttttccatgtagtacgatagacctcgccaccctttgatggtcatctccaaaccactcccaaaatacaaataatgaaataatcactcacgcagcatgtcgtccggccgggacgtcgtcgccgtcgtacggccaaagcgcaaagccacaggggcagcgacaaacaaagggtagctagccacgcgaccaatacaaccgccgtggcgccgtcgattcgttttcggggcgcaaaagtctcgacgtgatcaaagctagtagtacgtataaggaaatggagaagatgatggagagatcgacgtcgatatgatgttccctttctcccctcaaggttcttcggtctttttttctgacgctgattcgcattcgcgcacacaccacacacagctcacaatctcacacatccatcgtcggatcagaccaatcaaagaattttttttttagaacaccaatcaaagaattactagtacattcttctaccaggcacgccgctgtgctgtgtccaacgaaacggatcgatcgagatcatcaaaaattaattaacgcagtgaattaattaagctgttcgtcgtcctggaccggggaccttcattcaatttggtggtacgctcgctcactgcgtat

SEQ ID NO: 72775 - DNA, 11467 bp, Oryza sativa
gtttgtgattttaccctcactttttcaaaacgaaactttgatttgcccctactctgttaaaaccacctaacggtgtcaatgaaactaaaaaagacaagtataaccctgtacacttgcccctacttttctaataggatttgtgtattttctaaaaaaatatgatcgcacttggacaaattttgaaagaacttcgatatcattgataggatttcacagaactttcaccaggtgcgaaaatttaccaaaaagatccatcgcattcaccagtaaaaaatcaccaaacaaacaagctcctcataaagtagcacaagatcggaaaaagaaaaagaaaaataagaggcggctgcagcacgaccggagtcgccgccttctcgtgcgatgccgctgctgcgggctcgcacgtgccgccgaagctgcctcctgcttgcggctgccgtcggagccgccgcctattcactcgctccgccgaagccgcggcttgctcactccgccaacaccccctactcgctttgctgatgtgggcatctgctgctgctcgctgggcatcacagccttgcccagccgccggcctatctcgcctgtgcacagccgccgacggtgccactagggttaggctaatcaagtaatcagaatggggatcgggtggtgggatgaaaaaggcaatgcagggtgttgttctttgcactggggtataatggtccattgtttttctcttagtaatttcatctatattttttacactcttattttgggtccaccaaacggtcatccaatataggggcaaacggcagcttcgttcgaaaaaaatgagggcaaaattacaaacaacagaaaagaggggtaaaattacaattagatatgaaagtaggggtaagaacacaattgccccttaagaggaatgaataggacgcatagaccttgttaccgattatttagaaatcagtttcatctttttatatttaaggtcaggcttcataggtgataattaaattagttatagtacagatcttctcatgatattcaaagtgtaggatcatgtaattttcagcatcattcaataaaacttatcctaggttctaattatgttactgtgccagaaatttttcagaatttatcctaggatctaattagcagttattcccagaacttttacattttagaatataatgaactgatttcagtatctgattcataaagttagtgtggtctgagttggccctcccaagtttcttttaagctgtttgtctcacaggtgtgcctttgtatttgtctagtgtgtactagaataatataagttggaccgggagcaacaaaatctctgcttttgacagtgtagcaatacttatgcctctaatagtatttctcaaaaacattgcaatcaaaagctggcattgtcttgtttcacaaaaaaatgttcatcttttggaagtgttataatttttcaattcaaatatgtttgttaagttgagacaactgagctggtatcattgagtagactggtagattatgcaaccatgccaaacttggcatatcttcttttttttatcatggtacagtcggcatatcatttaacattttctcttgtggtgatctagcagaacatagggttttatcttgagaaattctagatttctatctataagttcaataatctttaccacaagtatggattgaactagatgcaaattaattaagctgtggttgcaaattgaattatgtgagtgcatactatcatttagcaatgtcaacagattaaattttgagatatttggatgtagtattgaagtatcaattagtaatatagacaggttggattttcagatgattatgtggcatatcatgcattaacgaaaaaactattactcagcagtcgtattatgcttaaaattttcactattcaagattatcagtttacactcattactgctttcagcatgtttgcagagctgatacttcgaggctatctatcttctgttgtacagtgaagtttagtagtaattaagaaagtgtaagtcataattttttgaagttctctatttccattagctaaagctagcttcctctgtcgaagtatattgtagctgcacatatatgttaaactgattcatactagtcagctaaggatgcatatcttcctgccatgcatgtctgtttcatggcaaaagatatgcaagaagtaaatgagaagaagcagggcacgaccttgtcctcccactagtagacgaatttggctggatttggaatgtggttggatttggctgttaactgggttgtaagttttgtgttgtattggatgtttgtcgggttgtgttggatgctaattgtgctttgacctttgtgctatatgggttgttattgtgtttcattgttggccctctatgggcttagccgatactaatgtaaatgaatacaacatgacgggcagaaaatggtgtggtataatatttgggcctatatgggcttttgcaatggacatggcccatttattatttgatattaaagcaaatggatataatagaattgtgttgacaatatgctacaacatggatggactaggctaaaatctagtcgggtttgccattgggctaaacccataaacaaggtgctaaatacatgaattttaatgggtcatcagctattttatgacgttttttaggctagataatgaaaaatatgagcgtcacaaagctatgacgacggaaggattgtcactagattaatagaaaaaaatctttcgtcatagaacgctattagagatgcatgatatgtcatagcctgaattttcgtttcaggatttataaattatttaataaattattaatagaatttatattaaatgttcattaatttacaagtgaagttaaatgtgggaaataaaatttcctaaatataaagcatggttggatttaatttttgttaaattctccatgattaattatactctctggaattttctcggatttttcagagctcaattcctaattttaataatataaagaatatttcagtaattattcatattaaattaatcatttaatgagctggtttcaattttgttaaatacttagagtgtccaagtatgttcaagatttttcttggaattatttgagtattgaaagtatttttaacaattgaaagatcatctcattggttaatttatttggaaaagcaataaaatcttccttcctagtcttgggccgaattcagcccattctctcccttcctctcagcccggccgaaagtctgtttgtggtccctgccgctacagtactccatcttcaagctccagccgtctcctgcctgtgcacgctgtagcagagcccgatgccgccgatccccttccaaaattcggcctactcgttgctcctttttccaaattagtttcgggaatggaatcctctcaatctcctcttccttttccccaggaaatcccaaaagtttctatggaaatcctttccaatttcgcggttcaatttttcctttttccggcgagaaccctagactttcccgagtttttcccgtcgatgtgggcttgatcccgagctcccgtgcctcgtcgtcctcaagtcccgtcctccgccgtcgccggaaacgctctccccgcgctcgccttctctctccacctccggccgccgctccagccgcagtgcgccgtcgcctcggccgtcgccagtcagcgccgccacctccctcggctccgcaaagtcgagctctatcccggccgctggttgtttttcgccgaatcccaccggagattggccgtcatcatgaaccggagcgccgccgtcgccgccgtgcctccagccgagccgttcgtcgacgtccgtcgtcgccttcggtcgccgtcgtctccattggattcgcagctgcgaggagaagcccgtccgccatctgtcatccgccgaagatcgccggaaagccatcgccgccgtggacccgaacctcgccgccgtcccaatctcgtcgccggccatctccttcgccgttcatcgctgtttaagtgttggtaagcatcgccattgcctcctctttctcccggtgccctccatttgcattattgtgccgtggttcgccggcaaccgccgctcctatgccgttcccagtgtagtttatccctagggtcttaatcccatctaatctaatcttgtatggccctagcgtcgtcatcgtctccgtgtgttgccgccggttcaccgccgtcatctatctctctccgatcgctttggttcggtgggacgtctatccgtgtctccttggtttagatttcaacccatcggccgcgcttgccaagccgctttgtcgcagccgtagccgtgcccgttgcgttgttgttcgccgcactgctgccctagcctgtgcaccgtcgctactggttgtgccgctgttgcttgccgtcaccgctgcgctagtcgcctagctgccattgtgccgctccctgccacagtcgtgttgctgctgctgtgcgttaccgcttgccgctagctgctgtttggccgctgctcgtgtgtgccaagttgttgccgttctgctactgcaaccaccgagccactggccgctgtgctatgccgtgccgttgctgctgtaccgtgtcgcagccgtgcgtcgcttaaacctagccgccgctatcccgtgttgtcgttgttgtggtttgttcgctgtcgttgcccggtagccgagttgcaaagcctaaggtgcatcccttaattcctaccggcctatcgtttgtcgtaccgggactttatcgtgaaccgtgtctagctcaccggtttagtcgcagccgttattgagtcgttcgctcgttcgttcaaacgaggtgttccccttgcttcgttcgttcgtccgtgttgagtcgtcctttagtttagagccgttcagagctgccggttccgttcgccggtttcggttgatcatttgggtgatcccgtgtcacgtagaattgactcgttaagtcggtatctcgtgaggctcgcttgccagatcaatctaatccgttgaatcttggtcaactctatgtcaagattaatcttagccatccaaaatcaatataaatccgttctctcttttcaatggcatattagttcttttttatcatatggcatctaccaaatataatctaatctttttccggaggttgttttaatcttttatctcagttataaattatttgtaaattgtttaattaatttggaatagtcttttctttaataggtttaattggaattaatcttgtaaaattcataactaattcatatgaagtcggaatgaggccgttcaagtctcataattcatctaaaatcatgatctacatgtttgtttactttatgtgtactatttatttggtttttattagtctttttcctcgttttgcgtgttagcttgtcgtttccgtcgtttcgaaggatcgcgtgtgcgtcggaagtgttcaagaagattaattgaagacccactattgcaaggcaagtcacacagatcccaaacacaattcttttgagcatgttgatcctttatttaaattctctatttttttcaactgtgcatttattttcgaatgtcatcgggtggtgtgaaactgtttctttgttatggccaatttgcattgattatcctatttcttgattacctcggattataatttgactagttggatttatatcttggttcaactagatatattagatataattgcttagtcatgcttagaaatattagcacactattgggataactaatgtttcactattacttaatgatgtacatggtaaaggtagctcacgatggtcaatcgtgattggttaattaattaatgtaccaactaaaacttgataatggtgggttgtgagcatatggttttgatggtcgtgctcatgacaattaaggaccggttcacgagtttcgattgtgaaacattaaccgtgccaaccacaagctagcgtgggtaacagctttatcttttgtatagcatggttcattgcggggcaccagactgagaagtggcggagataagcccacggggtcgctgggaagtccatgccttgtttataagggggtgattatgatccaggaatggtgcgctgtggtggattgtattgtgcgaggggtactgtcacagctcctttccaaggaaccgtggtggtattgaggcgcatggtgacatgttgtggggctgtgtcttgtgggtacagtggtacacctctggccagagtaaaactattcgaatagccgtgtccgcggttatgggcgggtctaacaatgcctttcgtgattagtctcacacttctcaccataataaaagatgctataactggtaataatttgattagctcctggtttggaatggtatattcctggtttggagatagatctgtacagccaggtatggttgttcaggatggttgggcctgtgcagcagggtatgctgttcagtgttgattaatattgatgattaattactctactattttacaattctcaaatgtttgctaaatgctgcttttgcaaatgagccctatattatgccatcctttggtatccttgtgcacttgcatatttgctgtgtggcttgcggattattccatgtactcaccttgcaataatcaatcaaacctcagttgaagagaagtcgcaaaggagaagacgtttggcttctaccccagttgagctgcctgtgggagtggaaccggagcttcgctagaccgtaactccgctgttgttttctcttttcttttgtaagtatgtaacgttattattatgatgaatctgtaaattaaattgtcagtttgtgtacctcggctgattcctggatgaggattttgcacaaattagttcggaaattactagtgaatttctgggcgtgacatgataggtgacgaatgaatttttgtcacgcaagcgtcacatattatgaaacgtgacgaaattttatgtgtttgtgacgtaaatgaagcgtcatctatcataagatttcctgtagtgatcgccgctgctgcctggctggccggcctcccatcccgctgcctcccctccggccggatctggcggagggttcggcgaggccgccgccccacgcccggccgcgccggccggcttcccatcctgctggatctggcggaggggaggccgaggccaccgctgcggccaccgagacaagagagaacgagagagagatacagagagcagaggacagggagatcgacagagatcgggagagatagagagagcgcgagacagaggatcgaggagatcgagagaaaggcatgggacattataaataggtgggagagatttcttgtcacgcccagaaattcgctaacccaattttcaagcagaatgtgtattaaatctctgtccaggaccagtcagagtaaacaaacgacaatttgataggcagatccacgtcttacaaaataacaaaataaaactcacatacgcagcggaaaaacaaaataaactagacttaatcttcactaccaaagtgaagcttcctccgtaaaccacaggcaatcctcgacgtccgaaacaagctcaatcctcgaaaaactcaccatctgaaccaacctttacttctggggggcggggataaagcaagactgagtaccaatcaccgtattcaacaagtcataccaacgggaaggtacgatgcaaggatattcacaaagaaatggctcataggataatttgcagtaaagcaacatttataaatcatattttgaaatagtaaaaacaatatatatggttaaacagtattaaatcatcactgtccaacgctaaatccacgttgcaacaggcccaaccaaaaccacctgaactacaccaattctataagtcaaattattatagtgggactaatcacgttgagctggttcaccacccaataaccgcgggcacaactatttgaatagttttaactctgattagaggtgtacaactttacccacaagacacgattctacacatgttaccatgcctcgaagtatcgccacgataccgcaaagggggaaatcgtgacaaaacccgtcatataactctccctaaccaaacatacccacctcagatttcaccccctccttctcccaagttgggaagtcccctctcgtgcctaggtaaatccagctacagcagagaccaatgtccacgtccgaactgcaccattgcctctacccttgccatggtatgtcagctaggttaagttatactctagattcagcctagagcccacgctggtatgtggtaagtaggagtatatcttccaaggattcccgagaactggtacttaattgtcatgggcacgactttcaaaatcatgcatgtacccacgacccactattaaagtatattttagtttaattaaaccataaccatggtggtacaccaataataaaattcaggattaaattatgatgaatcccattgtaagctaattgatctaagcatggctaagcattcctaaaccaatcatctagtcaattataacccaagttatgatcaatgattttatgaaataggctcaatatgatcaatgatgtacgtatgacttgccttgctcttgagctgactgaaccttggcgaccacttcgaaataaactggatcaccagaactaacagaatctaaatgacaaacaaagcaaacaagaaatacaagcaataaggctactgaaacagcaaaggaaactaattttaatggattctaaacatttcaacaagttcactgcaatttgaatgggctaaaacggagcttggattttttagttatgaattttacaatatgagctacgttattactaataaccaaaaaaacttaatcaattattacatattaatgcccatagataaatagatcaatgtaaataaatctccggtaagcaagcctcacaaattaaccactcaacgagccaatcctttgtgtcacgggaccatccaaacagtcaacggaaccagcggcttagaacgactacggaaaactagacatggtttacggcagaggctcggtacggcaaacaataggccggaagggggttagggatgcacctacaggtttgcgactcggctaccgagctacagcacagtggcaaaccacgatgacgacgcggtagaatggcggcgatggcatctaaagcagcggctagggcacgtctcggctagggtggcaacagggcggcggaggcgcggcacagggcacggcggcggcggctagggcacggccggctagggcagctagggttttaccggggctaaacaactagggtttcaatgatgacactaaaaagaattaacaccctaatcaggagattatggataggttcctcaccaaaccgagacgatcggcaaggaggtgacggtgacgacggtccgatggcaacacgcggagacaacggtgatgttagatcgaaacctaggacggaaaaaaattagatccggatagataatggcgatagccatgacacagagagggaaaacggattaccggcgacgctagggtgatggcggcgacggcgggaggtggtggcactgaccggcggcggcggaacagcagcgggcagcagcgcggcacttgggctaggcggcggcagcggctagctaggactagggacaaaacaaaaacaaaaacgaaaatagggaggggctctaacttatatatgagaggggaaaaactaaaggagatggggccggaggggaggaggccgactcggactcgaacagggggagggcggcgcgcgcgcggggagaggaggaggtggcggccgagtgggaggaggagagggggaggaaaaataggaattgggaaaataggataaggactttcccaatggaaatgacgtgcggtaccgttttaggaaaagaatggaaatggatcccgcgaacgaaaacggacacggctcgtcatgcaaaacgaaaccgcgaacaaagggggcagtgaatagtgaatcgggcacgattcacgaccataggtgagagagaaaaaatattattactttaaaacttgataatttagattaacatcattaactccgatgctctgaatattctgctttaagtcctgttaatgattttagagcaaagagaattaaaaaaaaattctccttgacaattccgattattaaacatatcgttaatttatgttttctcttggttaaccaaagtaatttctataggcaattcattagtgaattagaaattaatgaaaaggggaaactccgggtgtgacatttctaagaaaatttggttgggctttttaatcgggacaaaaaaagatgttcagtcccggttcctattcaaaccgagactaatgtggtttttggccaacccagcaaagatggtttgttccagtagtgtctacctattgtgcaatagtgattagtaaggcataagatgccacgtggttaagctttaatgtctcatcacgttcaccacatgggcagccaaagttttccatgaaatgggagttacagtctacagaaggcagttctcactctgctggaatataattaagttagctagctaaatttgtattatctatgggtacaaccatctctaacttttgcgctgctaattttgtaatttctatgggtacaaccattcatggatgcactaaattagttttacatgaatctaacacacgtatgcttggttttgtagaggaatcggatgtacttgatttctgcaagctgggatgtacttcctccgtgtgcagcaccattaacatttgtaaggctagagaaaacatcaaacaaaattactcctgattttcaaagaaaatgtaaaatgtatttgttttatatacctagctaatgtatagaatcattttttttcagttgctgtcaatgaagaagggaatggtgccgtggatagttgcaacaatgcacgctaccgcttctgctccaaggaagctgaggtcgtcactgttgcttcctaagcaagtgcaagatgcaagcataaggtgcttcacacatcgaagcctatatatgcaaggctatgctatcctcgagagtagccataaataagttggatattatgatgcccaagccagtgtgccgtcaacctcttttgtcttgtgctcttttgtattccaataagccataataatcgcaatctgccatcttgtcttgaggatgtgaccatatcaagagtgacgatatcattggctaataaatatagcatctttgaaattggcccatcaaaaaaccagaaacatacattatttttaacgagccttttatgtatgggactgtttatatatctgttgactgaaaatctcacctccaatctttaaaaattttgactgttggatatgctttgagattcgtgcacagccttaaccctaactttttcctcccgttcctctcctccacgcgcattccgccgccgccgccgccaccgccactggcccaacgcgccgctacctgcctcgccggcgggccgaagggagtcaacggtgccggcgaggccgcccgcggtgcgcccgtcccgtggc

SEQ ID NO: 72776 - DNA, 985 bp, Oryza sativa
ccggctgccctagcaagaaagctggtcaattggaagtaggctaaatgaatgaatgttgctggggacgttgggccagccgcaagtggattggacaatttggacaagataacccttctctctctctctctgccttgtctcctctctactcctcagcatctatataagggccttgcaggcagtggctctcacaccaacgaaacaaggagagactcagagaggaggcgtgttggttagctcattggcagcagcacacacaaaccacatctcctatatatagctcatttttagcttttggaatttgagagaggttttgagagaaatggctagccaaggtgtagcctccatgttcgctctcgcattgctcctcggtgcctttgcctccattcctcaaagtgattacctttccctctctttccttttctttttctctctctatctctcttttgtgtttttttttttcgatttgttgcatgtttggaaaatcattaggtatatataagttttagtttagttcatgcactcgctcacgatgcagagtctggggtttaattttattctattaccaaaaaaaggttttgtttacgcacgtcatgcatggtgtgtggatagattgcaaaaagttaatgattaatttcttgggagacagagaaagatgaagagattataattggtagaaatgggctagctaaatagagatagctagctaacaaataatacacacagtggtcaagagtcacatagatatacatcaattttcatcaacaacgtcatgcggaaaagagagataacaactctcgttagcgagtcatctcgttaaacgcctcccctgcagtttcggtgcctgtcgctctcactgcgagtttaattattctcttccgctgcttaattgctgctgctgctgctgctgctgaaagaaggttaattaagctcgtctcgtgccgtctcattttgcccatcactcacacgcatcgtcgtcttcgtctat

SEQ ID NO: 72777 - DNA, 2277 bp, Oryza sativa
ctgcaccccagctttgcttttacacacttgggacaagaaagcacttcattggttttcacaacatcttccatgtacccaacacgacctaaagcatcttttaatttcaacttattcaaagtacatgttgagcaatccaaaacatcatgaggttgttttaactttttagcacaaatcatgttaaacatcaaactagcatgaaaagcaatttgatatttttgcaataactttttagttaaacacaactcatccaaagtgcgtgtgtgcaaagcaaaactaagagctagagaagatctatttttcaaatcatgtgcagcattaacatctctaattttagaaatttcattcattaaaacctcacaatttgtgcaatcatcatcattaggaataagatattttaatctagcaatttcagaattaagagattcaatgataaactcctgttttctatacaacttctcacacttcatattttttgcactcaaaatattaatggcttcctcaagagcacttacctcattgtcttcacactctgaatctaattcaccacgcgccatgaagcaaacaccggagatgttatttcccttatcttcatctccactctcaccatctacatcgcttagtggctcaaacgcggtgtagacttgatcaaaagccttcttgagattctccttgatcttcctccctttgaatgtacccttcggcttgttgtcattggtcttctcatcaccattatcttcccccctcgctctcccaagcttaggacatcgtgaacgaaagtgatccgtagaaccacattcaaagcaatgatttggtccacctcttttcctttacctaacattagtcacagctcgagaaagtctgttagataacaaaaccaagtcctcctccacgaactgttcgagttgatcatcggacatggcattaaacaaagcaaatgcggaagacttcgatgaagaagaatcaacatccaaagaagttgaggaagaaaccaaaacactcgagttagaatcaactttacgagaaagaatattcatctcatgtgttttcaattttgtgtaaagcgaatccaaagtcaaagtagacatatcaacggactcctgaatagatgtaactttcatcttccaaatagacatatcaagaccattcaaaaagtggtgagaaatctcatattgtgtataattaacatcataagaagaatcaacagatctaagatcactcaaaattttgttaaacctagaaagatagtcatccaaagcttctccaggtttcatctcaaatttaatgtactcctttttgaaaagatctcgacgaagctcttttatgttatttgttccttgatgaaaatactcaaagcaatccaaatctcatgggaagtttgaatatgagcaacacgatcataatccgaacaagaaatcccactcaaaagaatattgcgagctttacaattttgttcaaactcagtttttaaagcagcggtattaatttgttcatgaatcacataaggatgagaaacttttctccaaatatcataatcctcagccataatgtaatattgcatcctactacaccaatgagaaaaatcagttccatcgaaaacatgaggcttagttgaaaacctaacagccatggcaaaaactctagatcagttaaaatccaaagaagaaaaaaggctctgataccacttgtaggatcgaatcacaacaactaagccaaccagaggggggtgaatggttggtatacccaaaaaacaaaaaaaaattacggaaataaaagttaccctcaaattctacggatcgcattctgaccgaaggtgttgcgccggtctgatcgctggttgccgacggtctgaccgatattgtatctccggtctgaccgccgagatcagctcctgtcgcttgtcactgacgccggtctgaccgcccttacaccgccgtggtgccaccggtctgacctccgatgagccgtcggttagaccgctgaaacctcgtgaaacacaaatcgaataactcttaaagtggatgacgactttattgattctctctgtgtttacaaagtgcacaaacaacactccttataaaaatctctaggaaactcgaaaccctaatagaactatcaactaaaatctctcaaaagcgataccgggaagcctcacgctccctctctatttatacccaaggtaggcaacctaaagcccctaaccatactcatactagaagtcctaattcccctaagaaaccctctagtaaacgaaacaaactttacataaccaatcacacc

SEQ ID NO: 72778 - DNA, 1321 bp, Oryza sativa
atgtaaaatgacatgttccaattgagaataaatgatacaaagtaataaacattctggagcacctgaagattgttaggtctcattcaggtgaacattaggatcttttttgcaatagatggagcaaaagttgaaaggactatgtaaatgacatgtcccaatagataatgatataacataataaattgttacagagcacatcagaattggttatatctttctcacctgaacattaggatctttttgcaataaactgatataacataataaattgttacagcgcacatcagaattggttatatctttctcacctgaacattaggatctttttgcaataaacggaaggcatccaaaacatttctatgttcccttgtcagaagagcagttgagttgagagcataggcagcaggttcaatccagtcatctgatcctgatgaattgccagatgacgaatgtactgaggtggacaatgctgattgctcctcagtttcataagaatgcgcacgaaaaggatcaccaaataccctgaatgcaaatggtagcctgatcagatggagcaaacaacacagactacatctaaatggctcatgttcagcatagatgattgacagtatattgtatgacagctccatctaaaacaatgttcttcttgtcttcaagattatatgagtacagtacggagattagtttattagtttagatccattttcaacaaaagatagcaaacttgatcttttgtgtagccataagcccatgaatatcatcggttatgacaagaacacagtttgttaggtcgcttctgaataatagaagaaacccaaagtgtataagaaactcagccatgggattggaaaaggctgcaagcaaatcttgaatgttactacttttccagtcataattctgtatgtaactacaggtatatatcttgaattttgataccctcaataggtggatccatgtattgtccaattttaatcctttaaaattccattcagaaatcacctactttctccgtcccaaaatatagctactgaattagacacaacctaccctctatcctgattcgtactaataggttgtgttaactgtgttgccatattttgggacggaggaggtatagtactacagcacatgccatggaacagtccaaattttcaagaaacgtatgccctttaacgaactcatgattgttcattcatgaactctgcacggcaagtgttccaaggtccgttggcatctgtccgtgcagatcacggaagtacacgatgcttccccaggctcacatccaattatggaggagaaaccaaaccaaccaattgcaaac

SEQ ID NO: 72779 - DNA, 7031 bp, Oryza sativa
gggttctccggcgccgaagaagaagaggtggtcgctggagttggaagaagagcacgaatcttgaagcacatccagttgccggagtttgggttcaccggcgccggagaagaagaggtggtcgcactagtacaaaaacccctataggtgctggttgggaactggctataggtgccggtttctttgtcggcacctttgtctcaactttctttgtgccggttctaaaacccgcacctatactattaaaaaaataaaaaaaatggcacctacactgccgccggccttctccaccgccgccaccaccacctcgcccggcctccacgccggcacctagccatgcccgcctccgtgccggcggccaccacccaacgtagtgctggaggggggaggtcccccgggagagagggggctggccagatccagccctcctccaccaccgccaccccagggtcagctgccgcgcccgcgcccgcgctggccagccctctccaacgccctgccgcgctggaggaggagagagcccgccccggccggccttctccatcgccgtgccagccgcgcccgcgccggccggccttctccaccgccgcgccggccacacccgtgccggccagccctctccaccgccgcgccggccggccttctccaccgttgcaccgccctggaggaggagagaagagggagggcgtccgggccagaaggccgccgccgctactccgtcgccgctgccgcgcaaagggagagtggcgagagagagaggggggttccaattatgatccgtcacagataaacataaccaacgatgagttaaaataactacccgtcacatatgaatgttacatacgacggattttggttacagtccatcaaggttaactcttaccattggtgggtcttttaatccagagttatcagtgatcacttatctgtgatgaggacctaacgcatcgcaggtaagggtatgagtccgtcacatatgacctgatcgtatagtgtgaggtcatcctctagtgtactgcacaggccggttccctcgtgggctgcttgtgaagtaaaacaatcgtgttaagcatagttttttggtagtgtgtttcatatttatttttcacgcgttgaaataggacaaaaagttgtttctcacattaattttcacataaattgtatttcactgtgattttgatccatatagtggttttcactaacatgaactcattgtgggcctgatcgattgagtgacctgtacaccggtaaaaaagggttaattggatccatgccactacaaatatgtgaaattagaaaaatgccactactattcacgatattatagttgggtgtcactgcaattttagaaaattagatccatgcaactccgtcgcgtttttccatccactctctgttaacaccgtctctccgcggtgccgcttcgcattttcctgtgtatggacgccgccgccgctccactcgatggaggtcaacctcgccgtcgacgacaccatcgcggagatcgaaggcggttgcggccggccggggcccggggtctggacgcagccatcgccatgtgggacgggaagacggggccgatggcggcggcggcgccgctgaccacgcgaagctctagaggtcatcgtcgctgccgatggcgccgccgagcagcctcgtggcggcgacggagtagtaggggaggccgtcctgttcgaatgaatcaatctccctgaccccgtcatgtcgcgcgggctcacgcccttcttgccgaatgccgcgacgatgttgctgttcaccgcagtgttgctcgccgtcatcgagttgcgccggcccggcgacacctcccagctgctcccgcgcaacaggacagagcacattagttacttgcgtgtgcagtgcagagcatcatggccatggagatgcatgtacacttagcgccatggccatgcaggtttatgcatgtatatatggaccggcgtgagcagcgagagcgaggatgtcaggaaggagaaaggagacaacgctggggcaagatgagcctgatagtcgccgccgtgagcgtgagagggccgcgacgctggtgactacaacgcccgtagctggagctcctcgtcatcttcgtcggttcatccgcctcctcgcgtcattgctgcagtgctggaagaggtcgatcggcgggcgaggtgcggcattcggctgccgcaccatgagggcgtcggacagtctggcgacagccgcgcgcgctgtcaaattggcttgcggccgtggccgtgacgaggcggccgcgcgggctagacggcgccgtggagtacgggctcaccgccgtggccgccgagcacggtgtcgattggccggaggtacctcgacgccggcctgctaccgctgccgccgccgccggcggcatgcggcgaggtgagatcgtgctcctcgtcctccacccaaggcgcatcgtcgccgcaccatgacctcccggccggcgtgcacgagccctcagggacggccagtgggcgcccgtgggtggcgtcgacggtgtagacgcagtcgctggcgctgcagtcgacgtcgtctgggaagtactcatcatcacaaaagtcgaggttgccggcgtcggagtaggcgcccgtggaacacaggaaggcaaagccaggagtgacgcagagagacggcgtcaacgtggagggatggaaaacgcgacggagtggcttggatctaatttactaaaattgtagtggcacccaaccgatatcgtgaatagtagtggtatttttctaatttggcatatttgtagtggcatggatccaattaacccgtaaaaatatgcacgacgctgtgtgtgtatttttcatttctaataaagccagggtggtacttatctcgatataaatatttggctgaaaaatatcgctgttttatattctaggattaaaaataaactttgatcaaaatttaacttgtaaaaaacagcgtactatataatgctaaattttctccgagagtaggcctcactacttagaaaaaagatttttacaagcggccaagatcattcttactatacggacggctgttccacctgtagggcctatgaaaattgacgattttcgcagacggtccgcctgggaagattattttcctaggtggattgtaccatgatgcgccacctgggaaaaaaagggagagcacacctgtgataagaaggagccgccaccttgggaaatatgcgccaacttttgatttttcccgccaaatttttaataatatttttttatcaataatgttgcaattaattaattaactaatgcatacacaatattaggaactaacaaacatttaataccgacaaaaatacatatattgcattagtgaaaagtatcgtgaatatgttacaacattttttacattgtcactgtggttttcactaacatgaactcattgtgggcctgatcgattgagtgacctctctatatatatatactcctagggaaatggttctatactcctagggagtacgtactcctgctctcatccaccgttcatcaaaagcagtaccgatcctggatgttagcggatgctattgttgaaacccgttttgattttcggtaaaaacaattcccgtaatactttaattatcccatgtttatcggatcatgaaaactgaccgcatatatcaaatgagtcccagccattcgtctttcaccggcgcgacgacgacggcaaaatctaggtgggcatctccatcgtcggtggctggtttgctgatcgccaccacgagcggcgtacccctcgtcgactctccacgacgtgcaggttcgtttgtttttaacgcgtttgttttcattcggaatttcggatgatcacccgatcgcttgttctgattccgtgccgtctcaggatcatggtcggggcaacgagacatcaggcgctggtgacatcctggcactgcttgtagcagaggcaacgggagttcaccccgatcgcagatcagagcagcccatccaagcggtggagaaattataagtagtgagggcaactccccacaattgtctcgatgatggtaagaacaagactttccagtccgatatttcatttcatattcatcaatggcggcgacgacaacacggcatcgatcgatttgcgaagcctatgcatcacggcatcatggtggcggcgacggcaccgccgcagcaatcgaaggagcagagaggcggctgcaccacagtgcgccgctacgactcctcgctaccgatgtggaagaagaatgatgaagctcctaattaactagttctttgctccatacagatgcatgacaaatacaccattgatggtggccaacaccgggcagtattcgcatagttgcatcgattagctgatgtagatgcagaaaatgtggatttggcagtatgaaaattctgtccaaagcagcttgtgcaggtcaagaattgggtgtactgtacattcatttttcttctttttcagaatggctaaatatgtatgaatccatatactgcctgcattattgcaagttctcttgtgatcagactatgcttcaatttaatctaaatcgaggaaagaactttctattctttaaaatttcatgttcacacctgaaatcagaaaatataatttgtggaagaaattaaatagtatatcagtacactcattgaaagaagagtagtacaaacttgtttagaaaagaactcgggatatactcgttccaagaaattaaatctagtatatactcagttccaggaaaaaaaaagtaagtatatcagtactctttgaaataacagtagtatatactgatactcacctaaaaaaatatactgatactaacataaaaaaaaggtactacttacttaaaaaggtatatactgctctactaatttaaaaagtacataccgttactaattgtagaaaaggtatataccgcttctaacctaaaaaggtatatactgctctactaattcaaaacagtatataccattactaacttaaaaaagtatatacttaacttaaaaaagtacatactgtactacatatatacatactggatattacaataaaaaggcatatactccagcaaacaaaaatctagtacatgctagatcataaaaaaaacaatatatactagatcctgaaaaagaaaaggtatatatatactccttcaaccttggttctggtacgtacataccgaaatgcatggatgaattattgactagatacggatgcacatcagctgatttatgtgccttcgttgcccatgcatgcgggaaaaaatattttgatttttgtttttcgaactagctcatcagttagctattggataatccactagggggagggagtacctgcacctgggtgtacagaagagtcatcatatatatatatatatatatatatatatatatatatatatatatatatatatatatatatagtaaatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgcccgggcaccatggtgccccatatgagtgtcctatatatatatatatatatatatatatatatatatatatatatatatatatatatatataaggaaggtgacaataggcatcgatccacagagagtaaattaacatgagatatgcatgcacatattaattattgatcagataggtagctgcaggccagcacgacacactcgatttgcatatgttctcgtgcagttgacggcactcctgatccaaagcactgtaagttcagacttcagagtatctatcgctagctaccagctccatcgtttctttttaaatatctgtggttcagctagctagaaagaaattaagatcgaagcccaagtaccgtatcgaatctgatataaggggggaaatcagtgatgcaggcgctgcagtcatttcagcgtgtctggtggcatatttgtaggtgtataactgaggtgcacatagtagttgcaagtttcttgcctggccaactatggtaattctccatggcatatctatggaaataagtttaaatgtgttcaaaacaacatgataagtatgatccatatccatgataagcttgtcaagcaaggcaaagtatttggcatatataaaaagataaatagatccatttgagtacaaacaaggtattctaattattccttcattagaattacatgtgcaaattttgtaaaacaacatgtttgccgaaagcttgagtttcaatatattcaaagggagggagggtacttgccttgattatgatccttaatcgggttaactatttactcaacctccttattgatgacatccactagtacagaaaccccctataggtgtcggttgagaaccggcaataggtgccagtttctctgccggcaccaattggttggcaccaatgacactaggttattggtgtcggttatagaactggtacctttgtgctctccccgaatttcttttaaaaaaggaaaccacctccaagccgagccaatgctttctatgtctcacatatcacagaacgtttttgatcctgaagatttaggccccgttcaaacattcgcaaccgaaacagcgtgtcagcttgagatgcttttcgctccatcttatttcaatatgatggagcatctgattgtccacatcgtccctcagattatcgaaattggtcccctatacgtacatcagatgtgggcgtctgagaggtacatgtcagttctgaaagggtatgtcagtaacccaggtcatcagaaggaattga

SEQ ID NO: 72780 - DNA, 760 bp, Oryza sativa
cgtgttgtttttggtctcaacggcatttgcagcaatcagcaccggtagttagttgcatgaaaacccatatcgtaactgctgttggagagtaacaagccccaccacacgtgggccgtagcgtgtcgatcatttcactggaggaataagtttattataggtccctcaaccacgagcccctcgacatggctccgggtcgatcggacggtcgctgctccggcgcacggctccggcgacggcgggagggtgccgttgatgatggagctgcaggagtacgtaggcggaacgacagtggacgacggcgcggcggccggggacgcgcgccagcctgaggcgcggccgtggaggaccatgaggtcgaatagcatcggagaaggagcgcacggacaagggttgcaacgacgtcccttggcgccggcgaggtgtccgccgcggaggccgaggccgaagacgcggagcggaggaagggagcaccgcgcccgcggcggcgatgggagaggatgtgagaaaagaggaaagagatagagggagagggacgctgacatgtgggaccccacgatgactcagcagtgcggactaaatgaacgtgccatgtcagccaaaaccacttagggagttattttgcgccggttttaaaagttaaaagttttaggggttaaaatacctggtattagagttaaggatacaaattagattattactagccacctagtcatgcttcgcgtgacggtaagcattcgcataacctgcgtatagaagttga

SEQ ID NO: 72781 - DNA, 1224 bp, Oryza sativa
ttaatatgatattttaacatttgggaagcgtgtgcgcggagaacgagagaaatctcctctctttctccattgatcaaaaatttttgttgatgaggaaactctcatcaaatagtaatctcataaagagtttgctcggttatgttttaccatgtccgcaatgcagttgcaatcgacaactacaattaccgacgtcaacaaatgaatttcaatacttggttgttgtagctgctataatggttttattgtaaatcgcataactaaactggattaaagatgatacatagatgcggtgagcgtaataagaaaaagaactgcacataatgctcttctctctctcatcacgcatacagagaaaccctccccaatattttctcctttattcaagagcatttttccacatagtgtttaaaaggtaaactcaaatgatatttataaaaaaagtatatcccagtagcatattttattcgtccactcgtttttggggtgaggaaaaaaaatcttgtattgtgctcgtcattgaaaatacgaaacagaaaaaaaaatcacctactcgaaattaattaaaatcttcttgtttggttccacgcattcagcttacgtggagcaaccattttccatgcccttggctcttcgttgcaccatgcttgatgcttcctggtcatagggtagaattcatccacgtcgctttgcaggcttgctgcacctgactgctacgtgcacccggagtactactcataaaacaggatttgtcagacacaggcacacagcgaacctaaacgacggaccttttcaggccccacccacgtgccattgctttcacggatcagatactctccgcgtctccacgacgagcagaaagcaccaactaatcagctacagcgtgcgcaaatctcaaactagcaccacgctaatttaaccttctcagtcgatttatcattacaaaaacatgcgcaaaaccaatcaaatttacgcacgggatcgatacgagacttggttcttgcttgtgacgaactcagaacgacgccagctagcggcctagcgcgcgtggctgctgtcttcacgccaccatgcaccgcgcctgtatcgaaaccgtaacgcgaccagctgacacgtacgcgtacgcgcggggaggggacgtgcggcgccgaaaccgcagccagccatgcccgaggcaattggatagcgtgcgacgatcgagaagagagggtgcggcggctcgacgag

SEQ ID NO: 72782 - DNA, 4343 bp, Oryza sativa
tctatgcgaggcagggggtaaggatccttaggacatgccttgttaaggtcggtgtagtcgatgcacatccgaagcttgccgttcgccttggggacgaccaccggttcgccagccactccggatggatgacctcgcggatgaatccggcctccagaagtcgcgccacctcctcgcggataaaggcttgacgttccggggcctggcgcagcactttctgccggaccggcctcgcgcccggccgtacggcgagacggtgctcaatcacctccctggggaccccgggcatatccgccggtctccatgcgaagacgtcagcgtttgcccgcaggaaagagacgagcgcgtcttcctatttgccgtccagaagaccaccgatccgtgtggtcttggacgggccgtcgcccagggcaacctccttgaccgggacctcatcgcacgtgactacccgctgcctcggggcggcgggggcggatgtgccaaacctctcgtcgccaccctcgggcttggtcacgacggcgaggcggtccgcgcgctgctccatacaagcgagcgcgactttgaggtcgccatggacagagatggggccatcggggcccggcatcttcatctggaggtaggcgtagtggaccgccgccatgaacttcaccaacgcgggcctccccaggaccgcgttgtagggcagactgaggtccgccacatcgaagttcacccgctccgtgcggaagttggcgggtccaccgaaggtgaccgggaggtcgatatgacctagcggccaagtgtgccccggcgtcacaccgatgatcggctgggacggccggagcatcatccccggggccttgatggcgtcaaaggctgcgggggaaaggatgttgagggctgctcctccatcaatgaggacacgccccagcttcacgttgcaaacagtgggggaaaccaccattgcgatctgtcctccccgggcaacgcacggtgggtggtcggtctggtcaaaggtgagggcaacctccgaccgccgcgcccggcgcgtcgcctcatgagtaggggccgcggccaggagctctcgcttcatggccttgaggctccggcaagaaacgtgagcacacgctccccatcgacagtggcaatggtggccccaggctcttggaaacctaggtcatcatcgccatcatcgatgtcctcggcgggggccttctgcttggcctcacttcgccgattgccggaaggaaccgccggggactttccctctcggcgctcctgcctcctctcctcctcccacttcctcgtccgctcagccaaacttttgactacacggcagtccgcgaggtcatgaagggaagtgttgtggacggtgcaccacttgccggttgggcgctccctgctgggagcgccggcctctttctttttgtcacccgcaggcctcccctttcgggtggcccgcggagcgccctcgacggcgaggacatgaccctcgtcgtcggtatgggctgacctcttcttcctcctcctatcacgccgccctgtctgagcggcggatccgggggcggccgaagctgccacaccggaaccggaggggttccaggtccatgcctcctccttacgagccactcggtccgcgagctgaaaaagctccgcggtagtctggggctctttggaggcgatcttttcgagcatgcggttgtgccgcacaccccccctgaacgcgtaaatcaccgcgtgtgcagggatgcatggtatggtattacggacttgacagaaccgctgaatgtacgagcgaagtgactcatcatcccttcgctgtactgcgtgcaagtccgcttcctcaccggggcgcggatatgtgccttggaagttcatggtgaactgttggcacaaatcctcccaagagtggacagacgcgggtggcaagttcattagccaaccccgcgcctgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaagactcgccacaaaggctctacagccgacaccaccaaccgggggcacggagggctgattcccgcgtccgtgttgaggtgacactctggacgaggaagcgccctccgttgcgtgggcagcacgtcggtcattacgccggcgctcgatgctggtgcgggcgtccggccccccacgcagatcttcccgggtcgaaggagtcgacgaaggagtggcggccgaatggcgaacagcggctgccgctcttcgtgccctccgtcttgacgacgcggagccggtggtagcagcaccagaggccttggtggcggaggaccgcccaccagcacctaggcgctgccgtgcagtcatgaccaatttggccacatcgtccagccaacgttgggctggagactccgggtcatggacgacgggcgggtgacgtaggagcgcgcctgcagcttggagcgcgccctggggcgtgctgccgtcgccgtagacgaggaggcgacgctccccatctcgccgcccttctccacctcctgtggatgtcgaagtcgcggatccttcagccctctcgagcgccttctcccgcctaggactttggcgtggagggggcggtggagtacgagctcgacggcgtgggtttggctccccgtcgtcaccgctcatactcggggagaggtcgtgcgcctttgctggctcggccattgggctgaacagaaaaagcttggcgcacacgaaggagtgcgagagctcagaagatcactcgcagagtcccctacctggcgcgccagatgacggagcgtggggctcctcaccgggagaccgcgcaggcccccctttgccggttcggccggggaccctgggtgagactctaagctcccaatctgtatgtggaaggttcgcgagacaggaagcacagaagacgccggcgatgtatacaggttcgggccgcttagaagcgtaataccctactcctgtgttttggtggattcgtgtgtgaaagagctacaaagtatgagccagcctctcccttgttctgggttcctaatctggaaaggttcagtccaagaaaaagaaaaaccccctctctcggtgggcaaggtcctccttttatatcttaagaggataccacatgcaccatttccctcttttttgtggggacctcccccaccttttcataaatggacggagatttgtatagttgccatccgagtcaccttctgatgggacggcccacaactacccccactttcgccgggagcagatgcgacgtggaatcgtggccgcctgctgacgacatgaccggagtcagaccagtcacgtcggtcattcttgtccaccacgtgtcagcttagcaatctacatgtccgcccttcttcacacaacatcttgcttgtaatggttaggatgaagcctggcatatatctgatcagggctaacgtgccatctctgggaggtaacacgctagctccagctggggacgagcgcctagaagccctcgtcctgacgggatggggcgaggcgtgtgtcagatcgcctgtggccacctaacccgcgatctgaccggtctgtgactggtcacagaccggataaacgagtgcactgcactacgttgcatgcggcgtgacacgctcagtcaaaccgcaataaatgtggtaggtgagccccactgtgctcacctaacccatacacgcggagcaaaaaacccacgaggggtcggggcgcctcggccctcggggccgaggggggtgcagcccgaccccctcggggggactaggaggagggcgaacacatcaccctcgggcccgacgtcccccgagggtgccaggccacgtgggcgattgcgtctgcctcaaacctctagtcatgatactcctgatcccatgtcaccgacagtagcccccggcgttatgccagggcgatcgccctctttaagggaagcggtcgggcgtgacgccactcctaaggcctggtgacaggtgggaccggtctccacaattgggcagaaacccaacggtcacaaatcacgcacatcggcagtggtaactcggctgtcaataatgagcggtctcttcaagactgccacattactcgagtagcacacgaatctggacatggcgattcgtttcgtttggagatatggtaacgtcgctttggtcggcgagcgtaattaccgcgcgcacgatatgatctatctcgactgccacaaccgcatatccacctcatgcgccgcaagcgggcgaatgggattagtggaagcatgggcgcgagaa

SEQ ID NO: 72783 - DNA, 990 bp, Oryza sativa
catgtcaaccaagattggttgatgtcccactcccaaacaatgcattgtctgctgttcaagctacaacatccgaagtgtcaaaactgatcatcccaaccaaccaatccttgcagctccatgatccaccctctccaaacgaaaggaccaagaagacgctgctggacagtcaaaaaagctgtcgcatgcggcacatcccttgtgtaatgaggatggccaagttagcgcaccaggacttcaggggcagcacctagcactccagagagaacaaatggtgggcaccatggtgcaaggaggccttcaccagtaatcatcatcgtatccagaccaccgtgagcgggatccacttgatctatttgactgccacggacgagggttaaaacccctatcatactgtttggtgtaccgctgttcaggggacccgtgcatcctccctcccttggagactctttttgtagcattcttaaattctcttcgatatcatattcttggcgctgcaaaaggaaatcaggtgaactttgttttgcaggaaatttaaattaaaaaaacaatggtcattttataacaaaatgaaacttcatatttctgccatcaataagcactgtagcattgtagcaagcacatccaaattttccaaaatatggtaggtataggcttctccattactagtatgtacccagagtctgctcatagtggcattgcccattattattattatttagagagaatgtgcaggagcagtaaagattacagcatccacgcatctagatggtggatcaaccaaaaagaaaagggaagatatagagtaacagagctatattctcacaaagtatctggcgacctaaaagcatccttgcagaatgtttagttgaggcttaaattttgcaaatatgttaccaatgctatcttggaaacttccaggtatgaaaataatgaattggtcgagatttgatccattgaaaaaatctacgatgagtgggggatcctctagag

SEQ ID NO: 72784 - DNA, 740 bp, Oryza sativa
acttgctccttgttcaaattaatcaaattgacataatccagtgccatgttggcatatttctgcttagttcttccctttgggataaattgttaatgttgttacatttggaagcatgtttaaacagaagtaggatggcaatatctttcggtgaagcgccagagcagctgcgggttttggagcacaggagagcagattgcactgtgatgtagaacaggaaacaacaggttggtccgctctgctgatattgcctttgttttattgctactagatgctttgcccatttttttcaatttaacaaattctgtaggcttttcaacagaaatatttgggtgaatcaaatgctgacaagtgtagtataggaagttccattgcttattgcatgattccactttgttgatcatcatgttggcatccaccaggagaacaaaacaagagcagaagtaattatatcatttatatttgttttcttgtcttcagattccatgactgttggaatcgttggtttgctggaatcattggtccaatattgcatctatactggattctttatgcaataaattaatgctcatttctctagtatgattaggatgactagtccaaggtgtccatctcccggccttaactcatttgatgtcatcgatggtagtgtttcataatcaagttttgaagagttaatggcaagcaggcaaactcatagactcgcattcttttcctcttaacggattatggattatcgggca

SEQ ID NO: 72785 - DNA, 26666 bp, Oryza sativa
tcagttgaaagcacatgttcctgatcatacaccggtctttacttctcttcctcaccctgtggttttggatgccgctgacgtttgacctgaagaaatactcgatcgtcggcttgtgaaaaagggcaatgcagcacatgttcaggtgttgattaagtggtcttctttaccggcgcatcaggctacctgggaggattatgaagtgctcaagacccgctttccatcagcaccagcttggggacaagctgtttctccggcgggcggtactgtcacgtctgtaccacacgcgtgacgagctacaacgccaggatgacgtttacagtaacgtgtcggatgggtgtgtgagcatgtgtgttgtgtgattcggccaagcggccaggctggcatatatgacctttataagtaaggaaccctgtaatgagataagtgtgaaatgaagaaaggaaaaacgaatctctcctctcaacaactctgctctgcccctttcttcctcgactctgtctcctcctcctctgttcttcacctctcctgctctagttctttctctgctatgatctagtagtgttacatataatgacatttatctgaatagatatatttgcaatggcacatatcaaattaaccctagatttttttttttgagataaccacttatgtacattgcatgtgaggttggactaaacctcttccgcccatctgctgcattgcgtgtcttgcacgcatgatccttaactcgcatggattattagttatgtgtacaaattattttcaaaaaagaaaaagttgtgtacaaatttgttctgagttagacctactgcctactggcatctcaaaccttaacatttcctgctttaatgtggtacaaatttttgttttgcgcttttgtttttcacttattccacattttttctatcgaattttgtatggctgctagcttgtataaccctgagtgacggtgtctgaacaaccattttcctaactcgtacaaagcacttcctccgtttcacaatgtaagtcattctaacatttcccacattcatatttatgttagattcattaacatcaatatgaatatgagaaatgctagaaacatttcccacattcatatttatgttctatctatctaattcattaacatcaatataaatatgagaaatgctagaatgacttacgttgtgaaacggagggagtatatacacacaagccattcggaaggtcctgctgaatcctaaaccatccgcaagtacggaggagggtgtcaaggctgaaggtcatactccgacattagaaaaaaatcgagtactaacagaaaaggttccaataagcacgctggatattgcccttcaaagttcaaaccaacacttcagcatggttcttctttccttgaccagaacaagtgtagcgaagaacaaaaacgcattcaacaacaggcaatctgcataaacttatacatcatgttttctttgttgcccattgagaggcactcagcatatggtacatcatccaaattgccggtcaacaagaaaacaaaaccctcaacctcggcacacgcgacagtgtctttcgtcctactatcttcaaagaatatatcttgcaccggacaaaactatatccttccacgtatagggagcctgacatttatatccttcatgttagcatttgatgttggtgttagtgttcaggcaggctcgagaccatatcatgtcaaccaagattggttgatgtcccactcccaaacaatgcattgtctgctgttcaagctacaacatccgaagtgtcaaaactgatcatcccaaccaaccaatccttgcagctccatgatccaccctctccaaacgaaaggaccaagaagacgctgctggacagtcaaaaaagctgtcgcatgcggcacatcccttgtgtaatgaggatggccaagttagcgcaccaggacttcaggggcagcacctagcactccagagagaacaaatggtgggcaccatggtgcaaggaggccttcaccagtaatcatcatcgtatccagaccaccgtgagcgggatccacttgatctatttgactgccacggacgagggttaaaacccctatcatactgtttggtgtaccgctgttcaggggacctgtgcatcctccctcccttggagactctttttgtagcatttcttaaattctcttcgatatcatattcttggcgctgcaaaaggaaatcaggtgaactttgttttgcaggaaatttaaattaaaaaaacaatggtcattttataacaaaatgaaacttcatatttctgccatcaataagcactgtagcattgtagcaagcacatccaaattttccaaaatatggtaggtataggcttctccattactagtatgtacccagagtctgctcatagtggcattgcccattattattattatttagagagaatgtgcaggagcagtaaagattacagcatccacgcatctagatggtggatcaaccaaaaagaaaagggaagatatagagtaacagagctatattctcacaaagtatctggcgacctaaaagcatccttgcagaatgtttagttgaggcttaaattttgcaaatatgttaccaatgctatcttggaaacttccaggtatgaaaataatgaattggtcgagatttgatccattgaaaaaatctacgatgagtggcgcatgaaaatattactcggttaccacttttcataagcatatttaattgtttttttgctttaccttgtcagagtctgaaagaacattataagcctccccaattgctttaaatagatggtcagcatctgcatgaacctccttggcgacatccctccaaaacccatcatcaggcttttcattccttactagcaattgtgcagcctgcaggtcaaaatagtgttacagatgctttctgtgtgaatccaacaagaaattctctgaaacaatgtaaaccttatctgggtgatgcctcagtgcagccttccggtatgccttcttaatatctgctggagatgaagatggttcaattcccctgcaaaagagggggcaggagagaagagaaacaactaattaagctatctccacataataagagattattaatttgcttcgtctcattaaaatatagatgattcgccaatagttagaaagggtgacacccaattaaaataagatcatacaagtatgcaacataatatgacatgagcagctgtactcatcacaatggagttgatgtcctaaatcatgtgtgtgactgtggctagatgaagtagcaaagtattgattctcctataaaacagctgtcttgtgctatcgagaaaatctaatccaacacatgcagcagtgctcttggcaaggggaaaaaggaatcactacattatagattctagattaatttgttccactagatcaatgagaacagtaggtaaaaaatcaaatgtcagagatatgcattgaaagcaaatattaaggttggttaaaaacctgggggcaaaaacaacactttaataaacaaaaagaaggtaaggttaatttagaaaaaacttacaagattaaatacaaattcaagggagtatctctttttgcttcatcctctacagataaaagtcgggtgcgcgcctgcttcagatcgctatgcttgttcaaaacttttggtgacaatccagagttattagcttgcttttcaataagtgatatgagcttccgtaaatcattagcagcttgtccataatccctgatcatttcgtataaggtggctcttcttgaaattgcctgaaattaagaagccattaatgaaatccatgcacaaccacataaggctaaaacagtccatatataataaatgtatcacatattatgcatatgtaaatgtgtgcaaaatgataactgtgtatcataaaacaagagctactgcactttaccttcagataagttgcatcaagaaccatggctagtgaacaatctgctatagcatcagtaacttgaccgagtgcttggtatgaagcagcacgattgcaaaaacagacagctgaaaaggggcgtgaatcactattacgtgccaatgctgctgaatattgttctacagcctctgagtatcgacgagcttgaaatgcttcattcccagcagcctaaaaagcaacatgagcacaaaaaatattaagttatcattaacaaaaatgaaaggctatctaatcggtttcttgctcattctgtgatgttgcgtcaaacataggaaatagagatgcactcatagttactaattatcctgggagtcaataagttgtttatttcttgcacatcctactcagtaaaacagtagaagttgctaaagttgaataaaaaatgcagttctgactgcaagaaagaaatcatgtatcgatatgatagacagcaaagtactgtcacttcaaaaattatgcaacatttcctgctgagaaatatcatattccttaaaaccagaagggaaaagcaattatagttctggacagagcaaatttaaatattagaacagactcaataaagaacataggtagatatgacaggacaaatatcatcaaagttcatttcccgcaaaatatgttaaacaaatggagcataccttatgggaaagaagttccctaatggtagtagacaaagatgagaaacattcctgagatgttctcccttcactgcaagagtagccccattcaggagttaaatataacaagaaaaacttacaaaggaaaaaaaagaaagaaatgcaactcataggacatgagaaatttacctctctttgacatttgtcacttgctggtgcttatttagcaactcgagagcatcttcaagtttgcctgaaaggaagtaagtcttgcaaatgagatatgtccgccagagcctccctgaccattccgtagtttcagatgcactggaattcttttcagctaacacaactgtttcctggcatagttgaatgacttcttcatatttccgtagctgtacagtgcaacaaccatattagtaagcaggaagcactaagacatacaatagtgtaatagttcacaaaaaaaacatggatataaaacagcgaacgagaagaaattacagaccgtcagtagcgcctctgctttcatctccattagtttatctgagtgtgaacttatgtgcaatgcattggagataaattgtaaagcagttgttgcttcggacactgttcttttcttaagaagttcctccgatagcgatatccaatccaccacactctgaagtatagattaaatgatgtcattgtatcaacaaggtatgatgctataacaagcagaaaaagaatacttgttttttctcgaaaacgcaggagagctgcatttcatttcattaaggggaagaaaaaacaatacaaaaacacaacacaaagaaaaaaccaaagtaggagtgctcgagccctcctaccaagacccacacacactagacaacccggggagcttagttgcctagattagccgtcccactaaggagcttttgaaggtgagaagctccagcgacaccccaaagatggccctcattttctatcacttgcaagaccgtcgctactctaggattggcgttattgaaaacgcagtcgttgcggtgcttccaaatctcccaagctactaaggttaccaaggagttaatcccttttcagcacctccttcggccggttctttgttgcttggctccaccacctcagaaagcggtcggtagagggttgaggcgcagcctcggctaaccctagtctcaaaaagattgccgtccaaacttggcgagaaaaaacacaagagatcaaaatgtgttggatggattcttccctttgatcacaaagggggcagatcactgtgtgctgcagcccacgcttagctagacgatcggctgtccaacacctattattgatggccagccaaatgaagaatttgcaccggaggggagcccaacacttccaaatacgtttccagggagcaaaatgaatcgaacccaagaaataggcttcataagttgatttgcaagtgtaaacgccatctgcagtaagcttccaaacatgctgatcctggacatcttgtagcagcaccacctcttctactagatcccaaatggccaggtactcagcaagaagctggaccaaaagccccccttggatgtcagcaacccaacttctatttgtcaaagcttgtgccacagaacgttgctttcttgctcttttagggattaaggcgaaaagattaggggctagctcagcaatcgtctttccttgcagccatctgtcactccaaaacttggtatgttctccatttccaaggatagttttgacagccacagcaaaaagagagtggacatttttgggcacattgatggataaaccggcccaaggcctagatgagtctgttttatgcagccaaagccatctcatgcgcaaagcccaccccatcttttcgagattaagaataccaagtccccctaaagacaggggtcgacacactcgatcccaagagaccaagcagtttcctccatttgcattgtcactccctttccataaaaaaccacggcgcctcttgtcaatggctttaagcacccatttaggaagatccagtgccatcattgcataaatagggatggctgaaagaaccgccctaacagctgtgagccggccagctttattcatcaaggaagctttccaacccgggagattgtccgctactttgtccactaaaggcagcaggtcagccttggttggtttccgaattgtaagaggaagcccaagataattgcaactcaagtatatcttaacaaaccgaggtaatatcaggtgcaaacagataattttggcagaataagcatttactaccaattccttccattctaacaatgacaatggtttgcttacggacttttggtgtctggtacagaggataacgactggcatcccttggatatcaatacaaggcaatgactagtactccgtgaaagcacagtcatcattcgtcaataaaataacttccactaccagaatagaattcctttatattatcatgtgtatttagtccctatgatatcctcttttattggacataatggtgcatgtgaaaatgattaaacagaaactggccaccattaagatgttagatgtgcaaacgggaaagagaacccaatagtgcgagcatcagattgatcaacagattaccagtgttccgcggtgatgtaaaaggctagataatagagcctgctaatacagtgatatgaacagaatgatattggaaatatagtaattgcaacaaagatcagaatgttcatgaaagctgtatactgaatttctatagtaagacatgatgggccgtagttgacagctcttcctaggatagtaaagacaaagataaatcttcgtagaccattactatgtaaaagtctacgaaggttgatcatctgaaatcagtataattagatttgtcgtgaaaaaacttcatatatcagtgggggtggcccatgtataaaatgtcatacacttcatcaagggtaccttttacaatcctaattcagaatttttttttcctaattttcatttccggcaaactgtttgctaagttgtccaactaactgccattaatcgctcggtcggtccctgagggcaattttaggccatgactcaacatgaacacttagttggtcaacttaagattctttgattaatcatcacgtccggaagaaacaccaggaacagatcagctggaagggacaggaaggcagaggaaaggaagggggagacagaagaggttttgctgtcatggcgtcatgactcatgaaacaacaggtaaaggtggtactagtgattgatgcaaacaaaaaaatgaagagaaaggaaggaaatgatgagataggccaatccagctcagatttcagccctcaagctatgaagttcaccacgtctatacccatgacactgacctctctcttgttggctttctcctcccaacatcactggacagtggacactccttaatatccatatcagctttgtcctgttagtcggccagatctggtgaccatgcaaatcggggtaggagtcctgttagcaaactgtaggactgtataagatccgaaaccaatcttacggtccaaacagccactggcaagctttggagggtgacagaggtgtagttgtgtagagcggactgcgggagaaggcaagaagcagaaacagaagcagcagcataacaaagaagtcaactgcaactgtgcaacagtggatggtagcacatcgcttcacgtcctacttaggctacctttctctctgctactctacttactcaccatcagcagtatagtatacttatcaggagctgaaagccaagccattaccagtacctagtcaacaagttgacctattaatgactatttggcaaattgcctcctagggactcaaaatttactacttactcccaagtaacgactatggctgtagatggttatatgaaccacaccactactccctgtaaaactattctttgcatgtgttccactaaaagtcaatttttgtgaggtgttgattaaagtaactaagaatagttagggcttattcggttcataggatttccaaatcataggaataggaaaagtaaaggattaggacgacacatgcactccaatcgttaggaatttttccaagagctctcacctcatgcttagaatcctatggaataaggttgtaagactacaatccttaggaatttggtactccctccatccctaaatataagggattttggttagatgtgacacatcctagtatgatgaatctggacataaagcctgtccaaattcattgtactaggatacatcacatccaaccaaaatcccttatatttagggacggagggagtaggatctatttctatgaaaagaatgatgcacatagaaaaaaattaggttcaattcctacaataatcctttggaaatcttttaaaccgaatgagcccttatagttctaaaaaacttaataaataacaaattagtaattatatattctttgaaatttccataaacgaaaagtagatagcaaaaggaacaaaacacatggatagtaattaacacaaaataaagaacttaaagtgatccctgagcagaaatatagcacacctgaactctttcaagaccatcagaagcctcagcgagcatttttctgtcagaaccagaagtcttactggacgttaaacaggcagtgtaactccttaatgcatcttcaagatccccgagtgcaagttgacagctgcatccatatacggtaccaagttagataactaaatcaatgagtcccatcacagaaacggctcaattcctacaggaatccagaaaaatcccatggcccagacaaagttctaatgggcctgacagagtgatagtcaaaacagcatgggttatacacatgcataataaaattagcctacaaattccttagaattccttagaaggtatgaaggtggtatcttcaatcaaagtaacaagagtgaataacctctccagagtaatccagtacaacataaaggcacatgtttcaagggaaaaacatcagtggactacagttcagtttctccaaagcatacattagttatatagtgaatatttgaatattctaattaagacagtactaatacacctggaacatgcagctctggttttacaagtatgcgcattacaaaagtatttagatatctattgcatcatcttccatgataaaagcagtacattccactatgcagggtgcttaccagaaaaagaacatataagtgcaccttgttcaaatgaagttctcaatcatactaattgatttgttatcactgaataagatatactatttcgtttaaacattaaaagaattagttgggttgctgtagcaacttcttactttgcagctctaactttagccttgagaaaggtaggatcaattgatgtagcaatcaaacaatcctgaagagcttctctcattctcccgagagacatcctggtagctgcacggttgctgtagcaaagcatcagtgcacgggaacagtatccagaagaatcatgaccggaaacagaatttattccacgggtataatactcctccgctgtagcaaagtgaccatttgtgtaggcttgatttccactggccaaaataaaatgaaaagatatggtatatcaaaatcaaatttgaatgatcacataatgccatgtaaaaagatatatatgacatgaaaaagacaacaacagacaaacagaattaaactgtgttcatacaaaccttgtacgccaggtttcacaagtctccaaggctgcagaagttgatgcacctcttgttgactgctcatctgctgaatcccctgctttatttttttcaggggaaaactgcatggtctttttgtcttgtgatgattttggctgtacataagcctgagtaactgaaggcttaggcagttgaccagacttagttcttaccttccttctagtgttacgtctttgtgttgacacggagctttggggagatgtagaagcaccgaaggtaaagttcagcccactaaaatcttctgagctttcttggaaagtggcatgttcaccaatctcgtgcgctgttctgtagccattctcttcataggcttgcccttgattgttgagcctataagcatcatcccaaacttcagctggggctgatttaggtttaccattagcagtgtcatgcatattggaggaagaaggttgtggtgcgataggtatagttacttcttcatcaaaactagaaaagctgctagcaaagctgttcgcagatgtgtctacattgggaattctaccttcatcttcgcatgttggaagatctgcatcaataaccaagtgctcagttgcagaaactagatcttcagcacaactggagctctggtttgagacaccataatcatgtatatgaacggactgatcagacatcactgatgcttcttttgctacctgttcaactgtagctgaataaggagaacaatccattggtgagtagtcacctgctaaatccatgtctggcccagtggtgcatgtttcttgagaagcaaagtgatggggttgagcatgctgctttaacttggtgggccttttatttttccttgcgtttttatgcgcttcctttttatctctatatgctgattttatatagtcaataccaaataagctctctcttgaacaccaggctggctcttgtctgactgcacaagattcaccaggaatagtatcacttgctgtatttgtagttttgaaactgaaagatggcatatcatttccagaagtagagaagctagatgaatgatttgaatgtgaaaatgcgcgtgactccggaacattgggctggggaatagcaccaaatactggaatggcttctgctttacttctgaacacaaattgggaagatccattcactttagtagatccgactgaagccccttccctattgatgtttaatttcttgatgtcctcttgtaatgcatgttctgcatatccttcggaaggagggacggcattgctaccactactgaaaacaaaactactaggcccataaccttgatcattatctgatctagaatgtgtaatgtttccaatatcctcattagccaagttccctccattaccctttagttcaaaggatacattagtttgaatgcttgtgaatggcatgcttgctgcctgggcagaagaaaaggttgtggctgcattagttccaaaaccagatacttctggtggctggtgagcagtttcatctttattgttgttggatggggctccatggcctaagttcagttttgtcatcctggctggaagtgtgctctccatgttaccatgaactgaggtaaatgcctttgaatttgcaccagtgacaaaattgccacgatcgtccattaccttttttgaagagtgtgagctcaaggaagcatcacttccaaatacaaatgcctctgatggataaccagaattatcactttgtttgcactgtgtaactccacctcctatattcaaacatgatggcaactctggaggcaaattattaacactactaggtggaacaaaagcatcactgttggcagcagaggaaaaaacactgccctcattagaagtactcccagagacaaacgcttcggcttgacgactactacctccacttcccttctgctgaaagggaacatcacttatcttctcaggacacagacctgtgccatcagtaacattgaatgtatcagatggattggtattagcaccagaagaaacatcattagtcctatccgcatggtcactggatacgttccctccaaacacaaaaactggtggtgcatcattggtagattcagtgcccatccttcccaaaggcgcttgattgcctataccatattgtgtcagcttctctgcaacaccatttgcattggcagaagcatatgaacctgcacggtggacatcagaactagtaccatcagaagaaggcccgcttccattgcctccaaacacgaatgtttttggcacgtcattatcaccctgcaacggcactctggtgcctaaattcaactgcgtcaatttctccgggagcacattcacttcactgttgagaaccaaaccaggtatatcaactccaaaaatggagctcctatccttcttgttggcattgacgctactctcaccacgagtctgaagattcatcctccccattttctcgggcagctttgccgaaagccgcccatccctcgtcgaaccgaggcaagctgtccctgacgctcccgaacacgaagggggcttctccattggatgacgccactggaggctgctgactcgtggcagaagccgcaccgccaaacacgaatccgccgtcctgaccctccccggcgccaacaccaacgccacccggcgcgatccccccgatcccatcctgccccgatgcgtccgtaccgccgccgccccctccgccgaacggattccacggcgccgcagcgggtgacgccggtggcggctggcgggagcgggaggaggccgccgcgtggcgccgcttggccagacgcggggcgcggcgggaaggaggaggcggtcccgcggcgtgatcggaggaggaggcgaggccgagccccaggttggggttgcccatggcggcggcggggagcggggtgccgctagggttctggcccgtggtggggtagggggctggcgctgctaccgccggcgtcatcggccggcggcggcggcggcggctgcggcggcgtgggattggaggggaggggagggtgttatgggtgggtccgatttgggggggagaagcggaggagggaggaggaatggggttgcgtggggaacgcggcgaaggcgatgcggtgcgggagagaggagaggggtggcggtgcgtgtcgcgcagttgggttgggcctattctgttctgtgtgttggggattttgaccgtttgggacgtgtccgtaaagctgtggacgacgacgatttttttgaatttgggtgcggtggggtggggttgcctggttttttttgtttgtttgttttgtttttttttcttggaggatgaacaacaatgaacccgtttgttgattcgtttttaaggctgtgttctttttgatagagttctcaacccaccgctcttattttcgatgtgcatgttttctaaaatattaaacatgtgttttaaaaaaattctatacgaaatttgttttaaaaattcatattaatttatattttaaaaattagtaaatacttaattaactatacactggtgattcgctctattttacgtgtataggaatcgtgcctcagataagatgtttggtttggtgagattttcttatgcggatgtgcacttcttttatatataataaacaagtatgcacaagaataagtttggcgagaaagaatgcaaattcagaaacagaattatcttgagagttctatatactaatcatgagagaattttatatttgtccccagatgttaactgattctcttatttgccctcgcaaacttgcctctccctctatttgtccccaattcaaaaaaatgtacatggcttgcttgctgttagaaggcacatgaaaggataattttgcccttgtgatttttttatatgacttactaaaccttgttgaataataatttgatttttttaatgtagggattaggacgcatattagtattagagggtctgtttagatcccaccttaaaattttacaccatatcatatcaaacgtttgaacacatgcatgaagtattaaatataggctaaaaataactaattgcacagattgtgactactttatgagacgaatattttaagcctaactgctccatgatttaacaatatggtgttataggaaacacgtgctaagacgtattaattaggcttaataaattcatctcgcggtttactgacggattctgtaattagtttttttatcagtgctcgaacaccccatgcgacaccctatataataccggatgtgacacgccaaaacttttgacccctgtatctaaagaccccatagtaatctgacattgcctttttttttcggggcatccatgtcggataggatgaattgaaaaataaaaacagccacctggtcggaaagtggaaaaaagtgacacatatgtgagagaaattagtggagatcaggtggcaaatgggaaaaaaaattttaggagggtggcatttgagaactagttttctgaaaggatgtcaaatagtaaattctccttgatgatttcaagtaaggcaataatgaatgtaaagtactaaaatatttatatttcttaatgattaagtttgaaggaataatgaatgtaaagtactaaaatatttatatttctaaatgattaagtttgtaatagttagtagttagttaatcacttgctaataagttttacatgaagcagaatagcgcaactaaacctctagttcaaatggactctaaggctaagttcgaatgtaagggttcgaaactccccctccctcacacacgcaaaaccgtaatgacttactagcacgtgattaattaagtatttactaaaaatttgaaaaataaactattattattttttacaccaactttgctatagaaattcttttgtaaaacacacattgtttagcaatttaagggtgcgcatgaaaaatgaggcaacatatcctatgcacacaggccctcacgtgtacaccaactaaaaaatgtcaccaaaaaaatctagaaaaaatcatacacatactttcaattgtattacacctagggttaaaatcataacgtcaaattcattatattttagccgtaacaaaaaaaacaaaaaaatcagacagttttaaggttgcaattttgtcagaattttatcttttttgttattctctatgtagaataaatttgaagatgcgactttgcacgtagatgtaatactattgaaagtacatgtatgaatttttctagaattttttgtgataatttttagttagtgtacacggtgtgtacacgcgagggcctgtgtgcataggatacgctcccgaaaaatgaaggggcaaaagttgggacctaaggcacccaaatgaacgcacctaaagcatctgttgagggttgttaaataccaaattaatgacgtcaatacctacataaaaccataaatataaaacatacaacatagcggtaggatttatttctaacaattttcacgagtgttggtgtacatttgtatgcaggaggcaaacaccaaagttgatataaaatatacattaaggaggaggagaatcaaactcaaatccaaacttatggagttttggaccaaaaacccaactgaacacctccaaataggccaaacatccatactagtagaatgaggggcccaaaatgagtatccatgccgaaatccggggccaacggagctggccaggggttcgcccgaaccctgacacaggccgctggcccaagcccaagttcggttcggtagcaaaccgcttcccaatgacggttatggtcgttttcaccggtagaaaccgttatcagctggacacttgccaagaggagaagggagatgctttttggatgcttaagcatctccacattcccaaggcacctctaggcctataaatacccctcctctctctcatttacaacacacatggagctgaattacatgagcctctattatatcttttgtacattataaaataggtagagagtgaggggaagctctggaggagtacccgaaagtttggcactctctccaacttctaccttttctaggaggaattctggaggagtaccagagctgtcggtacactctgctccgggttcggagaaacttcttctattaagtaagcattcaggatctttttttatgttatttaatttcttagtctaagtgagatagattttcatctttacgggttcattgtttagtatccgtactaagtgctctagtactaggactttggataaaaaaggaagttcctgcgcaagtattagagtagtaattaataacttagacgtggtgtctaggttagagattacctttatttgttgtgtatcccactgatttgttagaggtagacggcaggtagtgacagccctgaattccgtcctagtaatcctccacatttggatatatcatagagttatagccggaaccatggtggcagaccaacaagggtcgatgcccgaagtaacagatagaaaattacctttacttagtgtagataattaaaacacatagaaagtccactctagcctagctagcctaccattagttgttgttcttggatagtcttagccttaggtagattacacgcgttccctgagttcggtatccttttggggtcacccgaaagtgaagtgctacagtggtatttcgtgtgtttgcaaatttatctgtggtcgtaagaaataccaatagcatccaaagtagccaatgtcgagcgaattcagatggctccacataggaacacatttatcaaaccaaaggcttgtttagaatcctagacatttataagaaactttattacaaatgccacatgaaatagtttgatgtgttcaattgccaagctataaaaccaaaagcctttttcatcaaaatccacaagaaaaaaagaaagaaaagcaaagcaaaggaaaggagcatctttatattcgaggaattttaaagttggtgcgcatgctaggccatcaattcagaactcgatgaataagtttgtttttggtccctcattttgacgtagtttaaaattcatccctgaactgcaataccatatataacacgtttcttaatttgcaaaaccatgtcaactttcgtcccaaggcagtacagctctcagtttcggctgatgtggcgctttaactccggttagctgtgttgagtcagcatgggacccaccacgagcctcacatgccagtgtccaactttttttcctccctttccaatctcttccccatcctctctaggccaatgccaagcggccaaaggcggcccgactgcgccgcttgcaccccaccacccatcgtctctctccgtcgtcgcgtcgtcgctgtatgagcgtctcaacggtggtcacatacttcttgcccccgcgccatagccaccaccatcaccatcagcttctaaattcacgcaaacggtggggatggggtcaagattttgagaaatggcacatcaatgctgaggaggaccgggaaggaggaggagggccctggtggcggcgacgatggctgacgaggtgggtaaggcaagtgtgcgagtgagcacgagtaaaagaggtgggtaaggcgtgcatacgagcgagcaagtgagacacggctagaaccgtcgtttgtctctcccctttcttctctacgtgcggcctgtcgcggctgacccaccagggcaccacgccccatggcttttccctctcctccgcagcgcgccacaggctacaagaggtgagcacgaggcgactagcgcgagatggctcctccctggccgccaccgctctttctttccgccttatcggctcaagtggccgtggtgctcctgagacgaggaggcgtctagccgactgcctgtcgggcgagttactccttgagaggtggctctcccggatccccgccgacggttggggcatgcatctcgtcagcctctaacggcgatgacctcaacgagatccccatcccttctcttcctcctcctccaccattgcccatctccacgctgcagtgcttgctcccgtgctgacaacctgatgtcgccaatgccaacgcccaagcgaagaggttggctagagagggagaaaaggatgtgtcactgacatgtagggcccatcattttttttatttaaaccaaattccctgacatgtgagtcctcgatgacacgcccgccatgtcagccaaacactgctctgggatctcgggtacactgagtttataaattgagagacacgttatacttgaatattgtggttttgggatgactttcaaactccaatgaacttattccgaactcgaccgatctgagcccaattaacatctgacccaggagcggcccataacggcagagagcccaagccgaaggcctcctcctcctcctcctcccccgtcgccgacggtatcggcgtcaccatgcggcgtctcacctccgctccgctcccctcccctctccatttcgaaatgggcgcggcgcgagagaggccggctcgccgccgcgccgctccccgcggcggcgtccagccgagttagcaccatgtgagtatcccccccccccaccaccaccaccagtccccacgtctcctccctccacagcgccgcaccaccgtcacgcggtgatcgcggtgggggccatcgctgattgctggaggcgccgcggtcccggtatgtccggctttcagcatcatcgtatgccttagggtcgcatggcgcgctttgtctggatagcagggaccggacagattcgctttccgcgtgcttcgcgataaggggataataggtagtcgaactgtagaaggttcattgtactctgcacacgttggttgaaattgtgggggtacagattgcacgtgaaactatcatatgcggggaggaattgagctctggctagccgaaatcccgttacgtctagcaaacgagaagttttactgtccttgcgaaagtaactcgaggtactaaattttacactaaaaaatatggtgccttacggtatcttttgcaaggatggtaaaattacccctagcaaatactagttgattttggttagttaccagttgatccttgattttagtgcagtatgcctttatcttaatttgactacctgcacgcttgcagcctaccatgtgcttcgttaggcaactatcattcaaaccgacaagccccacagcatttgtgccgcaaaggatttagtactgctggttcatgagttcgaggttgatatgtcaaatatgctaagtggatacaattattgtttatctggagttccgcgaccacatactgcaaggtgcagtgctgatgtgacaaactactttttccgtgacctcatctgttgataacccaagatcaaacgcatttcaaagccttcatgatgcttgcctataggcatgcttgatgagaggactcctttggatgtctggcgtcaccttttagctgctgctagaatggataagatggattagacattccattgactagttgaaatgaggtccattaccaatagtagttctggccccgggcctctcctttggtttcatgcaatggactgccttttgttcaacaggtgacacttttcatggttattgaataattcaaatgagtatgatacattgttggagcgtgttgaaaacatatcggcgtgctacttatattactatttttagtttctgatttttgtctgtatggtgcggaatctttcaatctaccaactacaacttatctagaaagttaagatttaatacataactaaggttaaatactttacactacccttgctggttgctgaaatatacaacacataaaccaaaaggtaagaatttatagaatataaaatttcatcactaatatgttattcttttttttgtatacattttgatgttttacactatccaattgaaaaggcatggcagtatttctgctcagaatgttgacataagttacactctgatacgagtttatgcttcataataaaactaagcatgaaacttgaagcagctttctttagatgatttgtcgttactagttttatgaacgaggctatggatttaaaggtccttttgggttatctaactataagctttagtgtttacgctacattattgtgaaaagtgcaaattatagtactacacaataatatcttctgaaaaatgtcagttcagttccatggcaaagaagttggaaaattcaaaataaattgcatgccactaaaccttcacttctactacctccgtacctaaaaaagtgtgtttttagctatgatcctggacagtatttgtcccggttcattgctaaaaatatcactgtttcaaggatggagggagtagtaccgtatgattgaggaattggctcattaaaatgaaataaaacaatctgaatacttgaaggaacatattaataaattattatttaaggacaattagacaaatatggatatcttcttgatttttgagatgtctgcttttggcatgtatttcttcttattgttactttcatcaagttctgtgccactgaaatgaaagtatttcctgtagttatagatggaatttgcaatctaaatgcagtatcaataagaacttgcaaggaaaatcacccaataaacatgtatagttgtacactaaacaatagctatattaaactcatatttggtatggatggttgaacggagtggatcaattcgacatcctcctatcatcaatgatattggccagtaattaatatttggatacttctgcaattataccttttgttctttgaagaagccactcaccatgaattttcttattgtttcacttgatggggatgttagttcagtcaggtttttttttttaaagaaactctttactttcataaagttacttgtactttgaatttcagcaaagttatcttctccagttgatcttgctaacttccataggtgtgtgcttaggtggcaagtgtgacatgctaatgctgatgatgatatctagttgggtgaaacatttaagttgatttggatgacctttgagccactctgtatcacaattagggatgataaaagcagactaaagctagctttcacaaaatattattgccaattttgttaattacttgttaaattaaatgtgtatcttgaacacttcctgtaagataatgactctgcagtcatcacggtgataggcacttattatgctatagtttcctgcttaacacaaaaacatgtgatcttttgcccattggaaattgaaaataggcacaagttctctacattcttgatctacctggtactgtttggctgattattttctgttttctgctgcttctcttcctcatcaaaggtgtctggaccattgattactccttaaacccctattcatagaggtttaaactttagagatattaatgatataatgtgctgattgtgttaatgtcttatctgtgacgcatatgcctttttctactgtagacgcatatgcttttgcaaatgctttatgggcatgttttattatttggtcaactaatgtatctcttttcataagttgtttgtctcttgacacttgacaatcatatctaatcaaatgaattcatatccttgttgatcatatatttgtgcatcaaacttttatcctcaaccttttaacaaaagggggaccatgttcattggggaacttatatttttcaagaatacctcaaatcttttttattgttagggcaagttatacttcagagaaaacaacaaatatttgtactttgaatcagtttcttacctctgcatatattatgtgcaatctcaccatacctctcattttttatgcacccttacaaagtttgattctgtttagctcaagaaaatatggtgtgttattatattgcttgccatttagcgtcagaacctcattcactagttctggtttctggggactttggatcatccaaattatatattataagtttcatattaaattgtgtatttctgcatgaaaacgtgatatgttattcctcatggaacatgcatcatgctaaatgtgtatacaggcacctttgatggtcaaatttatttgccaatcatcgccccacccatagctgctttttgctactgtcgtcaattcccacagcactcagcatgagttcctcttgttagtggttcagttcatcattgcacagcttatctttctgctgtaagtactgctggaattctcattttgcttggattggtacaatgctcaaattattgcttccaaagagcttcatagaaaattggaagtaaggcaatgctgctctcctttaatcttcttgatgagaatgttcatgagtgcaccactagttcactgctgatattcagtagttagtaaactgtgttgcccatgctacagttaattgccttttgtaaaagaaattttacctacagttctgtacaaactacaaacgtttgctcccaggaaataaatatttacattagatactgtcatgagggcaagggtagtgacgctgatgccttttgaaatattctttgtcctggagctaagatggccaaggggtcataggcttttttcctctgttgaaatgtgtcccaccttgcaccaaaatgggactgccactcctgttctgtggtatagtttgggagatactgcttcactccaatacctgccttgtcagagaactctattatcctgtagttcaggtccaatgtatgtttgatgttatgggggccaagtgctgaggataggaatgccaccaggtagaaaacttcctcatctggtatgactactgatgttctgttgtcccatctgcatgaaatgattaacaagaatggttattcacttaatgatgcatctccatggtatctgtgattcagagacaaagcttgttacctggatttgttcactggatagagtaatatgggaccattgttactgtctttcaggattttcccaaagacctccttcgcaaatttatggatcatgcttcttggaatgatgatattaagccatgggtgtgggacttcccacatgcccttagctctcaacttcatctcagaagagtgtaccctatccaagaactctatgtatgttacatccgtgtggaataaggaggaaggcatatatctaagttgagacagcagtgtgttgacctcctgtaaacatatatacatacagaattcaaccactcaaacttgacctcattttacttggtttataaacatctttagtgacataagggtaatggttggctcacctgttccatgacatcagcctcgtcagggttgaagttctttgtcatctcaaggcagaagagcacttttccatctgattcaaactggctagaacgcactgggtcctgcggattgaaggacgacctccagttgttcaggatgcctgtcctatttatgatgacaaagccctcgatgtagtcaaatgtcttctctgctgaaatgagcatttcctggtcttcggtgaagcttgtgaaatccaagtagagaactcgtagccaccttacctgtcatccatctgattaactcatgagtatgctattgaaatgctaatatcatcaagctgacatgacttaattgtttcgcttaccatttttggagcaggttcaagaggaatcctggctcttgtgatgacgccaaactgacctaggccaccaagggcagcatggaagagatcagagttttgttcaggtgagcatgtgataacatcacctcttcctgcatttgccagtcattatagagagttagttacattaaattgttcaaatcgtcatgctatataggtctctctcataccagtcacaatttccagctcgttgacattgctgatctgtgggccatgccggaaggtctgcccactgactcctgcattcgacagtgtgcctccaaccgtgagatggagatagtccgtccacgactttggtgctaaaccatacttcagagtctcatgcaaaacatttatccagagttctcctcctgaagcatcgacatagggtgatacgccagggttcaccctcattgtgttactctggagggattccatactgatgatgattccctcagcagcctgggactgcccatacagcgagtgcccatgtccacgggctgccactgtgagcgtggagtgctcacccatcaagaacacatgcctgatggttgtggcaatgtcagccactgagccaggatgaagcaccgcaaccggcgggaagctggacaggttgccaaagtcctgtgcagcagcagacacatcgtggaagctgaaatggccatcaagggtgagttcctccagggatgatggcacatcttgtttaggcacatgcatggtggtgacaccaccaagggcaagtaacaggagcagcttcagatactgcaagagtgatggcctcatggctcttctacgtgtcaagaatgaacaatattctgtggcaatgttttgagaggaagacaaaatgtgcaggaggacagttgttcactgccaagagcagagggatgggagtggagatggagggagagaaggagatttaaaggaaaaccttgaagggtatgtatgtggactggtgcaggaagtggcgtggtcaaaccggtattgggcactgtttggtagactagaaacccatgtgaggatgtgctgcttacaaaatttggaagaatacatgtttcttttggaggaagctatgttgcggtggttgatggctctatttgagatgctaatgttctttcttccttggcttctgtttcaagcatggtgcagcatctgtcagtaagtgattggatgcagggaaaaaatgatgcattcgtttagtaaactcagtctatcacagtacatatctttcactacagcttgttcagaggaacagtgacatagaagagatcaagcaggtgcagtgaacagagatgggttttgagcgtgtatctggtgtggatctcagaaggattgagattctgatgaagtcatatgtagggaaaaagaagtgatatcaggtattcaagtggcaaacctggttgctcctgagcaggcctgcttgatccctcaaattcgatttctcatgcaaaaattcatgttggtctttgcgaggatgagccaaagtgctatctctgtgctttcatatttacaagtggcaagcctcctctcaagcatatctgattaagtttcttcccatatttctttttcggatgttggggcctgttttccaactgcatgaagatcaatttcttgcagaacatataaacaggtaacaaagcttctgtctggccatttttagacaagttgatacatcaatgatataattctttctcaatattttgtggttcaggaatttgatattttgtgctagctcaattgtatggacatggatcacttaaatgtttgtccctttttagtgaccagaaacttttgcttgataatgtagaattcctttgcccacatgcatgctgttgccatcctaaggtttatccaaaacaacactgccatgttctcggggtaatttttttccaagttgctgcctgttagagtctaccatgggaatcaacggatcattgtgttctcgtatctgatcatatctgtctgaaggcaatgtgaacagatatgtgaaacaaactgaatgctctggcatgtctgctttttacacttaggagcttagacaacagtttatgctgcagttctgaagatatctggtaaatccacaagcataggaaacctaggttggacagactttgtaaagcaaagtggaaatgaggggaccgggaaaactaagtatttaccttttttagggataagtttatgcctaacttttgtcacagattgtccttgtgtgaataatttgatacatgcgccagtgaacttatgttatatcagctgtttacttcgattattagcaatcgggattcaggcatggtgtttatttgagttttataggtatcatgtgcaaaattcaaaaacatgtataattcttccatttttgattacgatgccggctctggtatccttttataatgcacaatattcagactttttttcgttctacatagtggttacttgaattggggggaggaaattagcaaagctagatcccctaaggtctgaacaacaaattggtagactctttgcattactatccattcagaattgatgcattgtacattttaaagggtacatttgaataaaccaaaatgttgaacactgcaacaaataataccatgtctacccgacctgtccaccaaccagaaatttacaggaacatcacactctgtcaattatatttacgtagttcttggcaaaataacatcctgttctgacctttgactgcagaaatgtagctgatgccatgcctgcataccacccatgagtggcatacctaatatcaatatcaaggaatgacttcctgtagtgctcttcttccttgagagcacacgcaataagctatcaaaagagtatacatcttttccaagaaaacgaaaggtagagatttttttatcaaacatatcaacacatgacctatttgttgacttgaaag

SEQ ID NO: 72786 - DNA, 7355 bp, Oryza sativa
atctatttttaatattatgaacactagacatgtacatatgctatgtaatatatatatatatatatcgatgtttctaattgtgcttgtataatttatatgtaactttacgattcaaaaatacacaaaaaataatgagtacgtacattttcccaaacggttagcaattgctagggtgactgcacgaatctattatcccgtgcggtcggcctagcacatgctagccgactaggataatagattatcctgtacggtcgacataactgaactgcacgggataatctactatcctgtacggtccacttaacataacgcatgggataatctattatcccaagaggtcctcttaactcgatcgcacgggataatcgattatcccgtgcagtccacgtaacccggccgcacgggataatagagtatcctgtgcggttgggctgcccgcacgcgataatgttgatttttgcaaacacctaggtgcagatggcgctacctccgcatggaaaaatcggttttgactacatggaaaaatcgaatctgtagtagtgtgacaacactctatttgctgcccgctttagaatctccgggtgcataatcggcagtgaaactgctactagcacctaatgttacagtactacaagaaaaatgttttgtaagagacatttttctagtataatagaggcacttttcaaatgcctttacaacaatatagaggcattttaaaacatgtctaataataagtgtcttatggtgaattctctctataaacgaagagagattttataaaatgtctataagattgtagaggcattttctagagacattaaattgtaccacaaccatataaaaccagtccaaaaaagagaatataataatatccttgcttttgtcaagccttgatctcttgggtaaatcattttaatcttcaatgcactaaccaactcacctccatgtcattacttgtatgtttgtttctttagttacacattatcattctaaaaagtatctctacatagtttaaaatgtctcaacaaaatgcctttacatattaaacgcattttatagtgccgaaagaatgcctctataagataagatctaacaaactgagctaaaattgtctctagagtaaaagttttctagataatttttgaagtgtctctacactataaaacttatgatcttagaagcaatttgcaaaactcctctacaaaagtgcctctatacgaggtttttgttgtagtgttaataccacttaagctgtgttcgtacatgtgagtttccatgcgcacgtttcccaaactactaaaaggtgtatatttttgaaaaaaaaaatcttgaaaagttgcttaaaatcatagtttttaaaaaatccattttagctgatacttagctaaacatgtgcaaatgagtcgctccgttaaatgtgcgtgggggaaaagttccctaagtgagctccctgaacgcacatatgataatttgctttccacaaacattaatacacattggcatatgtgaaatcaaagtgtgttttgattattatttcatgataaacaattggcacgagagataattgatactgatatttagagatatatggtgaaatggttttggtgccagtcacaccgggtgtcacgcccggaatttctatccaaaattccaaacgcttacatgtgtgtgaaccctcgtccaggaatcagccgaggcacacaataacaaattgataatagagtacaattattactctaattaataagcgtataaaatgtcattacagaggtagatagttcctctcaaacaataaagatctaagcagcggaaaataaaataaacggcgcagacggctccactccacaggcagcttgaccaaggctactcctaatcctccactccatcagcctcattgtagaactcttcctctgatgaatgattgcaaggtgagtatatgacatactcagcaagccacgtagcaaatatgcaagtgcacaggataacaaaggatggcataatagggtttcatttgcaaaagcagcatttagcaaacatttcagaatttaacaaaacagttaattaatttaacaatattaatccaacgctatacaacataccctgttgtataggcccaaccattctgaacaaccatcccggctgcacagttctatctccaaaccaggaatgtaccattccaaaccaggagctaatcaaattattaccaattatagcatcatttactatggtgagaagtgtgaaactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaagagttgtgacaatacccctcgcataacacaatccactgcagcgcaccttcctggatcataatcacccccttataaacaaggcatggactccccagcgacccccgtgggcttatctccgccacttctcagtctggtgctccgcaatgaaccatgctatacaaaagataaagccgttgcccatgctggcttgtggttggcacggttaatgtttcacaaccgaaactcgtgaaccggtccttaattatcatgagcacgaccatcaaaaccatgtgctcacaacccaccattatcaggttttagttggcacattaattaattaaccaatcacaatcgaccatcatgaactatcattaagccatcatgaaataacagtgagtcattaattatcccaatagtgtgctaatgtttctaagcagggctaagcaattatatctagtatctagttgaaccaatataaataaagctcaactagtcaaattataataacccaaggtatcaaggaataaagtaatcaagaacaaaagggctataacaaagaataggttgattccacccaatgacattcgaaaataaatgcaatagttgaaaagaaacaatagctttaaataggatcaacatgctcaaaggattgtttgggatctgtgtgacttgccttgctggccttggaactcttcaaactcttctccggcgaaaacggactctccggaaacgacggaatctaagcagaaaagagcaaaatcaccaaaacagcacataaacaagcatgaacagtacatgtggatatttttaacatgtagatctcaattttagaaaaatttagagacttgaaccaactaaatcggagctaagatgaattagttatgaatttttaaagattaaaccggattaaaacacttaaatcggttaaaattgaattatgacgcaataatgaattatttttgaaaaggaaaagagggtttattgcgtcagcggctagggttttggtggaccgggcgcacgggcggcggttcacgcgaacggacggccgagatcgatccaatccaaaacggacggccgagatcgaacggtccacgaccggctcacggcggacgaccccgatgacgtcagcggtgacatcaccgacagcggtggcggctcggcggaacggacggctcgggcggcgcacgctcgccggcgaacggcggcgcgaggacgcaaacggagggcaccagcacgtagaggacgacgcggcgaacacaccggtgaccaaaacggcggcggaagaacaacggacgacgacggcgacgaggaggaaacggcggaaaccttcgggttgacgacggcgacgaagctccggcgatctccggcgacggcgaaggggcggacgaggacggcgacgacttggcgaccacgacgacggtcttcccgagcgacggcgacggctggagcgacggcggcgcacggctggagcggcggcggcgacggcaaagctagggcacacggcgctagggcttttccgacgacgagaggcgaaggcgaaagtggcgacgggtagaggagacaccgggggtccttttaaaggggctcggaggcggcggcgaaggcccacggcgacggcaacggcgaaggaaagctcgggaagaacaaatccgagacgaactcgaatccaactctttccaaagcgatttagccaaagattccaaaggagaaaaggtagaggagatcccggagaatgtttcccctctattgattcggccggagaaggaaaggaacggccggatttggaagggaaacggcggcggcgcgaaactagggtttcgggcggcggcggccgaaggtagacgacgactgacaggtgggccccacctgtcagcgacagcgagggcgcgcgcggctgcggcggactgggccggctgggccgaggagagagaagagagattttgggccgactttcagcccaaagccaaaagaggactttttaaaacttttttcaattaaaattatttcttaaatgcaattccatttattaaaaatactttcttagctcaaataaatcccagaaaaatctaggaattatagaattaagcaaagtatttaatgaaattttatctgggcccattttatattggaatttattaattaaaattagattttcttttcaagactttttaaaattatttctaaaaattccatttaaacaacaatttataaattttgaattttcagggtgtgacaaacctaccccccttaaacagaatctcgtcctcgagattcggaagaactggcgaacaattgcggatgagctgacttcaattcatcttctcgttctcaagttgattcttcttccgagtgattactccattggactttataaaaacggataactcgattcctggttcttctctcacttgtttccaagatacggattggtttctcaacataggtcagatcctcttggactcctatctgttcaagattagcttcttcggtaggtacccttaaacacttcttcaattgcgaaacatggaacacattatggactcctgccaaagattgaggtaactccaactgataagcgacttctcctcttctactgacaatcttatagggtcccacaaaacgcggtgccaattttcctttggtacgaaaacgatgaactcctcgaaaaggcgtgacacgaagatacacataatctccttcttcaaaactcaaatccctacggcgattgtcggcataactcttatgacgagattgagccactcgcaatctttcctgaatgattttcaccttttcttctgcttcccttaggatatccgtcccgaaaacctgacgttctcccgtttgatcccacaaaagcggagtgcgacacttccgaccatacagtgcttcgtaaggagccatctgtagactagcttgataactgttgttgtacgaaaattctgcatagggtagattcttatcccaacttccaccgaagtctaaagcacaagctctcaacatgtcttccaaaatctgatttaccctttcggtttgtccgtctgtctgcggatgataagcagtactaaaattcagcttagaacccatctcttcgtgaagtttcttccaaaaatttgaagtaaactgactgcctcgatcagacactatcttcttagggacgccatgcaaacacacaatccttgccatatacaattccgccaatcgacttccagaataggttgtctttaccggaatgaaatgagccactttggtaagtctgtcgactattacccaaatagagtcatggcctgatgacgttctaggtaaaccagtaataaaatccataccaatttcttcccatttccattcaggaatcttcaaaggctgcaacaaaccggcgggtttctgatgttccgccttgactcgctgacaaacatcacatactggtacgtactctgcgatttcacgcttcatacttgcccaccaaaatctttccttgagatcctggtacatcttagtactaccagggtgcatggagtataaagtatcatgagcttctttcagaattgcatctttcaaatctttgttatcggggacacagattctttcacccaaccatacagttccttgctcatcctccaagaaaccgatagcttttcctcttctcatattcttcttgatttcttgaatatcaggatcattaatttgggcttctctaacttgatcaattagagtgggcttcgcttctaaggctgcaacgaaacctctattgacaattcccaaatttaatctttcaaattccttgcataactccaatggcaactgtcgtccttctgtagcattgcaataacctttcctgctaagagcatctgctacaacattagcctttcctgggtgataatgaattcccatgtcataatccttaattaattccaaccatctccgttgtctcatgttcagatccggctgagtaaaaatatactttaaactcttgtgatcggtgtacatctccgtacgagtaccgaaaagataatgacgccaaatcttcaacgcatgaactactgcggctaactcaatatcatgagtagggtagttcttctcatgcggacgtaactgacgagatgcataggcaaccaccttgccatcttgcatcaaaacacaacctaacccaagtttggatgcatcgcaatacacttggaaacccttctttggatcaggtaaaatcaaaataggagctgatattaagcgacttttcaactcttgaaaactctgctcacattcttccgaccacttgtacttcacatctttctgaagcagtcgtgtcatgggcttagcaatcttggaaaaattctctataaacctccggtaatatcctgcgaggcctaggaaactgcgaatctctgaaactgtctttggttgtttccagttggttacggattccacattactaggatcaacggcaactcctccggctgagatgacgtgaccaaggaacttcacttcagacaaccaaaattcacacttgctaaacttagcatacagttgatgctctcgtagcttctccaatgcaaggcaaagatgttcttcatgctcttctttggttcgagagtagataagaatgtcatctataaagaccactacgaacttgtctaggtattccataaacaccttattcatcaagttcatgaagaaagcaggggcattggtaagtccaaaagacataacagtacattcgaacaacccatacctagtggtaaaagctgtcttaggtatatcttcctctttgattctcaactggtgatatcctgatcgaagatctatcttggagaaaacagtggcacctttaagctgatcaaacaaatcatcaattctgggcagcggatacttattcttgatagtcacatcatttagtgcacgataatccacacacattctctgggtatggtctttcttttccacaaaaataaccggagctccccatggtgatgaactcggtctgatgta

SEQ ID NO: 72787 - DNA, 1382 bp, Oryza sativa
aatatatttgtaatataaacgagctccactgaaaatcaattaaatacataagttacgttagaaatcaaggaaaaacggttaacagataataaagttcatactcaactaaatttaactgataataaataagccaccatacataagtagtttgcatggtctttaaaataaggaggctaggcttggattgataataaatgacacagccacagatttctctcccatccaaggaacacttcgaaaaactgatagtgtctagttgcaattactaggatcccaatggcagaccaattattttgtgataatgtcttatgcaattgtcgcatagtattgcagaaaacaatgaaaattggtattcaattgcccatgttgcagtaagtacatatacaaaataaaatgaagcatgatgtcttacaatcaattttgtcatcaattggagcattgggatgaaacacagaaagagcccgtgcaaattcttcgaatccaagaatcccattgtgcttcgtgtcaaacaaatcaaatacctaaattgattaaattgaaaacagcgcacttttgagttgacttcagatgatggcataaaggaatgtgcatctgcatgtttaaaaagtaactaataatttataatagggccaattgcatatttgccactgatttgaatcggtattgtgaatttgccattataaaaaacgtaattgcatgcttgccataaaaaacgattggaacccatgatacttgccattagattcacggctgggaataacaccgttaaaagatgggttctcacaaaaaataggacaaggatgcccctccctgctgctgccgtctccgggcgcccgccattgttgctgctcttgctgcagccctaccaccttgctggcttgctgctgctatcgtagggagttgttgcagctgctgctctcgctgcaggcctgtagtgagctgctgctgccgcgtgctcgtgctgcagccgcgagcgttgctgcttccgttgcaacgtgctgctgctgctatcgcggcggctgccgtcgacttcctcgcacctccggcaagattacccaaaaaaggtgagattttccctacccccgttgcccgtcgtcgcaaggactccaaccaccgccgacatgcacgccggtcgccgtccgctgtccgcctggccacatgtcctcctgtcgtccgccgacacgccgcccgtcagcgcgccctcccatcgattgtccatccccacgccgccctcaagccctctacctgtgcgtggccggcagccctcccgccattcgcccacatgcctgcaagtgagagggcggcgagccagcgaggatcttttccggttaggggcaagatggtcttgtcatgctccttatcttttaagttagttttatgaa

SEQ ID NO: 72788 - DNA, 7074 bp, Oryza sativa
cggatttgaaagggaacgccggcagcgcgaaactagggtttcgggcggcgcggccgaaaggtagacgacgactgacaggtgggccccacctgtcagcgacagcgagggcgcgcgcggttgcggcggactgggccggctggcccgaggagagagaagagagattttgggccgactttcggcccaaagccaaaagaggactttttaaaacctttttcaattaaaattatttcttaaatgcaattccatttattaaaaatactttcttagctcaaataaatcccagaaaaatctaggaattatagaattaagcaaagtatttaatgaaattttatctgggcccattttatattggaatttattaattaaaattagattttcttttcaagactttttaaaattatttctaaaaattccatttaaacaacaatttataaattttgaattttcaggtgtgacaccgggcaaatattgtgaacgctgatctgaacgcagccttagatgcatttttagcctaaacaaagcaaatgataatttgctttccacaaacataaatacacattggcatatgtgaaataaaagtgtgttttgattattatttcatgatgaacaattggcacgagagataattggttatgatatttagaaatatatggtgatgaagtggttttggggctgggcagactgggcaaatattgtgaacagatatctgacgatgaacaagtttttctgctggagtggaccggtcagacaggacccttgctaagcgagcgtagctcaactggttaggtttcttttagtggaaccaatccacccgagttcaaatcctagatttgatacgagtggttgcatttatgctaattattctttgtttctcaaaagaaaaaaaaattacaaaggcaccctgtaaacaaacctcaaaataatagtatgactaacctcaatattccgagtaaacaagagtaaagcaagtacattgcatctcaactattagttgatggagacgttggtcagttcaacatcatcttctctattaccacatgtatatatcaaacactaatttcttggtgcacaaaaaagtacactattttgctccgacataatgaaaataatttcctgttgcagtgtgggtgaactgcaatgggacatcaattgtgcagacatatatacacaatgcatgaaaatgtaaaataagtttcggttactgttgtaatgttactttaatcagaacatgtcatccaactttcaaaagaaaacatgatttctaaatgatttggatttttcccatccccaaggcttagtccgaaatagctgctcagaaaatccataactcatgtttatagatcacattagagactacctatatatgtatttttatatatgtatttgttgacaaattttcactactatgaaaaccgtttttgtaaacgggcaaaacgtatttccacagacgatggcatggaagaaaaggtctgcaaaaaacacaattttcgcatgtggacacttgagccggccgcatgcgaaaaggataaatcacgaaaaaaataaaaattccaaaaattgaaaaatatacccaccgccggtccgccgtcgtcctcctgtcctcatcctccagctatcgctgtcgttctcaagccgccgctgacgccggtggatctgggcagggagggcggcggccggcggatccaggcgggggagggtcgccgccggtagatcggggcgggggagggcagccgccggcagatctgggctggggagggccaccgccgtggccttcgcccagcgccgctgccggaatctgcgtcgcagggtggcatcgctaactcctggccgcccgcactgcagcggagcccactcccagcacttcctcatcggccgcgctgcccgccgctcctggccgtgaatgcagcggcggcgcccgctcccggtgccttcttgtcggcctcgccacccgtgatagaagtgagagaggagaggaagagaaaggccttcgttagttgctagacaaaaacttttcaccacgtcacgtcgaatatttggacacatgcatggagtattacatatagacaaaaaaaactaattacacagattacgtgtaaattgcgagacgaatcttttaagcctaattgcgcaatgatttgacattgcggtgctacagtaaacatttgctaatgatcgattaattaggcttcataaatttgtctcgcagtttacgagcagaatgtgtaatttgttttgttattagacaacgtttaatacttcaaacgtgtgtccatatatccgatgtgatacgcaaaaacttttcacccctgaacgaaacagggccaaagagagggagagaagagaatgaaagagagatagaggtgaaggaagagagggtggaaaatatcagaggggagagagaggagaggatgaaaggtgaaaaattttgaagcggtgaggaggaaaatttttttgctagcggacccttaaaagatctgcatgcaaaaataaattttcgtatgcggacctttaagaggcccgcacgcgataataggctcatttttatttgcagccccttaagaggctcgtctaagaaaatagatttttgcatgcgggtctattaagtagccgtatgtgaaaatggaggtcatttttgcagacgccgccaagggtcctcgtacagaaagtttgttgttgtagttgtgaatttctttcaaaaatttgacagatataaattatagtataattgtggtgtaattttattttaacttacatgcaattatatttgcacatgtaactacaatatatcatgtgcaaccggtaaatattttactcatggatatacccaatatataaatacacatgtactacaggtaaatgcagcatattaattaattgaacacggtgtgtgttataatattcatatagaccggcaactaatacttttattttacatcatgaagtgatgaaacacgcggatgggatttagaagtagatgggggtttcagaagtggggtaggatagacagattttagtattgtctataacaaacacacatagatttagtgatcaatggatatgatagtataacatatccagctaataattggctagatatttttattaacttggaagcatctagtaaatatcatgttagtataggtacatatatgtaaacatatcagtagcattagagcccactcgagcacaacagtagcgatccatgagaacatcaggattgggtatttgcaagctaatgcaggtttctgaccaacgtacaacttcttgtcatcaacaaactttataactggacgcggccgaatccttgaaatgtgccacgcactactagaaaaaatatttttcatggcggtactctatttgttttactggcggttatataagaaatctgcttgtgaaattgtaactaagagatggagagtttaggaccgccagtgaaaatgaattgtcgctagcgtttgcttaaagtccgcttgaaaaaatacctatgtttttacaagcgatctcttaaaagacagccagtcaaaatactgattttcgctggcggttactaggcagcatcgtccttaaaaaaaatccccgcacattaaaaaaaatcaccgtgcgcgtttcccttaaaaaaaattgccgcccacctccttatccatccactcgcttctcctcctcctcctttttttctggttcctctccatccaaatccatccactactctcctctcctcctcccaccccaccggcagcggcggctcacgtaggcagcggcggcggccccgacggcagcactcggcggcacggggcggcgggggagggggtggctcggctgcggcacggggtggcggtgctcggctgcagcggtgcaggggagggggtggctcagcagcggcgcggtgacaggcggccggcaaactgcgatggcccacgcctcctctccctccccccccccccccggtctcccaccggccttccttcgctgctggccgccacgacaacgggggaggctggatccaccgccgtgacgatgggggtggccagatccaccaccgcggcgacggggagaccggatcagccgccgcagtgaccgtggacgccgaatcagccgccgcgacaatgggggaggccggcggggagggcagcgacggtgacaggagggtgggtgcggatccggtggcggcgttgctcgggctgtccttcacaaccgtgaaggaggtggatccggcggcggctgccacaatgacaacgatgtctaccgcgccgaggacggcaaccacgataacgatggcaaggctattccaaccccctcccctctacggtttggaataccgtggtgcgggcttcggtaggcggcggccatggtgaggtgtcgcgacggcagccggcggtgcttccggctgtggcggccggcggcaccgattttgaaatttttttatacccaaaattgttttcactggcggtccattttatctagccgcttgcaaaaatggtatttttgctagcggttgtcttagcatatccacttgcgaaactcgattttggctggcgacgagccacccgccagcgaaaacacaatattctcactggactttactcatgtcgcaccataaaaatcttaaatatataaattgttgtttaattagaattattagaaatgaattttaaaagcctagaagagaagatctaattttaaataataaattccaatataaaattgggcttcataaaattttattaaatactttgcttgattctatagttcctagatttttctgggatttatttgagctaaggaagtatttttaataaatggaattgcacttcatgaataatttaaatgaaaaagttttaaaaatctctcttttggctttgggccgaaagtcggcccaaacctctctctctcctccccggcccaggtcagcccgcagccgagcgccgcccgcgcgcgcgcgtcccgctcgctgacaggtggggcccacctgtcagtcttcgtcttcctcgcgcagctgccacgcccgaaccctaaccgagccgcgccgccgtctcgttccaaattcgttcatccctttccttttccggtgaaattaatagaggggaaatgatccccgagatctcctctatcttttcacttttggaatcgtcggctaaatcgtttggaaatcggtggattcgatctcgaatcggattcctctctctctccgaaccctaacctttccatcaccgccgccggccgccgtgggccttcgccgcggccccctagcccctataaaaggacccccggtgtctcctctacccgccggcaccctcgccttcgtctctcgccgccggtagagctctagcgccgtgtagcctagcgccgccgttgccgcagttcgtccagccttgcgccgtcgccgctccggtcgtcgtcgtcgctcgggaaggccgccatcgtgatcgtcaagtcgtcgccgacctcgtccacccctccgtcgtctctgtaggtcgccgaagcaccgccgtcgtcgtcaagccgaaggacgccgccgcttcttcctcgacgccgtcgccgtccgttgatcttccgccgctactttggtcaccggtgagttcgccgtgtcgcccgcaacccgtaggtgccgtccgttcgcgccgccgcgccgtcgttcgccggcgagcatgcgccgtccgagccgtcgccggtgatgacgtcaccgctgacatcatcgacgccatccgccgtagaccggtcgtagaccgtttagatctcggccgtctgatttggatagatcgatcccggccgttcgtttccgtgagccgccgccgtgaaccctagccgctgacgcaataatctctttttccttttcaaaaataattcattattgcgtcataattcaattaaaatccatataaatgatttaatccgatttaatctttgaaaattcataactaatttatcttagctcggattttgttggttcaagtctctaaatttttctaaaattgagatctacatgttaaaaatatccacatgtactgttcatgcttgtttaagtgttgttttggtgattttgttcttttctctttagattccgacgttcccggagagtccgattttacaggggaagattttgaagagtttcaaggccagcaaggcaagtcacacagatcccaaacaaccctttgagcatgttgatcatgtttaaagctattgtttttattcaactactgcatttatttttgaatgtcattgggtggaaataacctattgttttgttatagccctttttgttcttgattaccctattctttgataccttgggttattataacttgactagttgagctttatacattggttcagctagatattagatataattgcacactagtgggataacttatgcttcactattatttaatgatggcttaatgatagctcatgatggttaatcatgattggttaagtaattaatttgccaactaaaacctgataatggtgggttgtgagcatatggttttgatggttgtgctcatgacaattaaggaccggttcacgattttcggttgtgaaacatttaccgtgccatccacaaaccagcgtgggcaacggctttactttctgtatagtatggttcatagtagagcaccagactgtgaagtggcggagataagcccaccggggtcgctggggagtccataccttgtttataagggggtgattatgatccgggaacggtgcactgctttgaattgtgttatgcaggaggtattgtcacaatctctattcgggtacttgttaagtatcgcgacgcatggttgacatgatgttgaggttgtgtcttgtgggtacagtggtacacctctggctagagtttaaactattcgaatagccgtacccgcggttatgggcgggtctaacaatgtctttcgtgattagtttcacacctctcaccgtaataaataatgttgtaattggtaataacttgtttagctcctggtttggaatggtatattcctggtttggagatagaactgtgcagccgggattggttgttcagaatggttgggcctatgcaacacgggtgtgttgtatagtgttgattta

SEQ ID NO: 72789 - DNA, 4748 bp, Oryza sativa
atacttaatatcaatatcaaggaatgacttcctgtagtgctcttcttccttgagagcacacgcaataagctatcaaaagagtatacatcttttccaagaaaacgaaaggtagagatttttttatcaaacatatcaacacatgaccctatttgttgacttgaaaaggaggattggttatactttgggtttcttggtccttaagtgggaactgggatatgcaaactgacagctccttttctgtttgtggtgcagggaatgacagagaattgccactctctaacccaagaaatatcacacaagcctcaatagaaccacaggtatcgtgaagcaaatcactctcaaacattattgtttttttttattctgttctaattttatctggttaggaagtgggaactgtcgggtgctggaatattgctgcttcttttaagctcctttttttttctctgtcacaaaaactatttcgttgaagtaaatggatggttaaatcgaaatgtgcccatcttgacaaaaggagcctagcactaccctcacatggccatggtaggctgagtccagaatagagattagattccccaatccatgacatgcaattcgcaaaggtgacattgatccgcatctgactgcatgctttcagctgctcctttgctgtttccttccgtgctgtcgattatcagtaggctctgcccgcagtccccagcaggagtcccccacacggcatgttagcccaccattggcctagcctgcctctctatctgctgtgaccaggcccctctggacgttggaacaacactttcgggccagatttcccaaccaaagtcacagcagagggtttgcaaaaccaattggccaccgaaaaccgcccccgagtggttttgtcaatagctgactagctatctatgaaaattggtgagtttcaaataatcatagtttgcatgtgtgtgtgttttaacttaggtgatttatctagcggttttgaaatgcaaaccggctcgataaggctgataaccacaccaagataaccgagcgattatcgtcatgttttgaaaccctgcaagtctgcaactaaggccttcattcacaactcaaaaaattaacctgacaagggagtatggtctttatccttaaggccttgtttggctaataggttagggaaataatttcccacacaccaaaaggcatctttaaatcctaaccattcattcttcctatttcatttaattctaacccttcatttatttcccaatcccaatcttacacctcatttcccattatccaaacatagcctaagttgtaatcttccaaaatcaattttgagtcatattcttctaaaaccaatatccagtgcgaaaataagcctagcatgaccacatccacatacaccacatatgtgagtacgtgacacatacaattgcccaagcccactttccaccaatatccagatcagtgggcaggagagctagtggacagtaggttggttggagccaacaatgcccacttctggtatatgccaccttggacgcccaattgcccaaggctcaggctgctattcagccgtgatgccgcggtcaccagagacgtctacactacacttgcacttctgcttttgcttggaatgattctggagatcgagatagatcgagatagcttctgccaaagccgtgcaggatgacagggccatttcttttctttctttctgagttctggaatcatgcggtgcgtgcagcggttgtttgtcgggctatgttttgacagaatttttatagaaaaactctcgattccttaatgaacaagattgactttgaaatgctgtcactggcctaaatacgtctgcctgtctctattggccgctagcttgttgttggcctataagctgcagtccgaatttgaattctataactttaccttttagagttgattttggttttttttttcgttatttagcttgccttttggacctcaatcaaagaacagaagtataaaaaccttaccctaaagttatttttgatttgcttcatttatttttcttagcttataagccgtagctcagacttcaaaagtgtttaggaatttggactccagcttctattggagcaattgtggtcgcccctcgggctgtagcatgccacacggagccactgcctaggagcaacattacgcaagcaatggtcttatcgtggttgggtattggtaaaaaaaaactatcgcaagttttttgaaatgtaaaatctttgccattaagatgcgattgggttaacctcaaaccatcccaaaaaagtcctgaagtcatgcaaggaggggaaaaaatagaccttaaatcccaaacaagtccttaagctgagttcgggagtgagggttaggaactgtcatctcagcacgcaaaataaagtgatggttatcgcatgattaattaagtatgaactgttttttaaaaaatagattaatatgatttttgaaaacaacttttgtatatatatattttttaaaaaacacaccgtttagcagtttaaaaagtgcgtgcgtatggaaagtgagggagagtgagggaggtgcattgaaaaggaaagaaatggactcagccttaggtcacagcaacaagaggaagtccccaagtggaaagaaagttctagaagtgataaaccacccttatccttccaatttccaacgtgtagctactagctagtagtagcatttaaggctgcgttcgataggatgggttggggacctatctcctccgcacggaaaacggaatagtccattagtgcgtgattaattaagtgttagctaattttttttataaaaaatagattaatttgattttttaagtaactttcgtataaaaacttttttaaaaaaacacaccgttagtagtttgaattagtttgaaggttgggatccttcgtgttcgaacgcagcctttagcatattgtttatgtacatcttcctcagtgccaagggagttcatggtccctcagtcccagccatgcactgcaccaggggcatcgcatcggcgaccgaaaaggggaaggaatgctgccatgggcgcgatggtcgcctgtggcccggccttagaattgcagttaagtggacacggatgggcccacactttttcacgtggcccacttgacacatccttcggcttttttgggggcgtgggccttttggcttccgtgtcggttcctggaaatggaggcaggagccccaaactttgggggtttgcacagcatagatgcttttcaagtccttttagaacaggagacccggtcagtgaaccaaccctgtccactgctacgcactcccttcgtcttaaaatatactcccttcattttttaatatatgacgctgttgattttttaataaatttttagtatttaaaatttatcttaaaatataatatcttcatatgctctcttttatcaactaatcataataatattgtattaaattttagtttgcacctactctaaaccaatcataactatttcctatttaattctactaactttttaatctccgtgtaaaacctatttatattttgggacgaaaagaataccgcttccactttgcaacagtaaagcaaacaacggaaaaggcagcactgcttcggctacaagacttaaacctcgatgtcacgtgcaccctttgtgtctcgattggctagttcatccactgtgtcccctacttgatcagtaacatatgtctatcgtgtagggagtatcttcttgcacgcttcttttgtaaaaacaaatgttgtgctttttgtggtctatgcgtgctgtgggctacaggccattgcaggaatgaattggataaagataaaatttgccatcctaaaaaacaggctatatttaaatattgtgatctttgctagtggacaccatcaaaacgtagctttacttggagacatctaaaatatgagacatctaaaatatggtaatttgctagaggacgctgtagttattaaaatacaatatccactcaacttgaagagcggagagactaggtgggggtataatccggttcaaactagatgtattgcctcgttcacacggatgagaagggcattctagttattttaaaatatttctcttccatacaatttgaaaatgatgaaataaccgacacggtgtcatctattaaattaccatgtttttattgtgaactcaggtaaagccatgttttgcgcgtgtccaacaggaaagacaataatttttttatgtgccttggataaatacggcgaaattgaattgaatgagtacttttgcaagtcagatggtgttgagagaatacttaaaccatttagaaaatagatggaaatggtacctgttgcagcggtaaattcagttgtatgactagtatatttgctttgaagctggctggttcgatttcatgtgccttgtacaattcacatcttttggagataacccaaagaataaaattaataattgagattacgcaattccaaggtaaagttgcaagctctccgcatggaaaatatggtggtttattaatgcataattaattaagtattaaaaaacttaaaaaatagaataatatgatcttttaaagcaacttttgtatagaattttttttttaaaaaaaacatcgtttagtagtttgggaagcgtgcgtgtgaaaaatgaggatggtgaggtgggaaaagagggggaaggacataacctaagatgatttagcataaatgctaggaataattgagaatacctgagatgatgtggataactttatga

SEQ ID NO: 72790 - DNA, 7974 bp, Oryza sativa
ccccctctccatgcttgcgggtgcatgattcacacacatatattcacactcacatgcacaaatagacatatgcaatcacatgagcagagttttcaaatatcaacttctcggtgctttaaattattccatgtaacattgactactccacattcatacaatgtgtactacatcatacgtgcttcattaatcatgatgtgtaaaactaggaaaaacgataaagtgattcagtagtgcagaaaggctagaacagaccaaataccatgaacaacatcataaaaacttcattaaacagaactcaattagctagccatacccgatcagcaaacatgctgtcttttctgttggtcttaaacagtgccagttggaattcttcctgtcaagacagccaatgccatcagctgagttaactagttcagatgccacggaattctaattttgatccatggccatccaattcacagcaaaggaaactagcagaaatactactaaccttattgatcaagccatcatcaaccacagcactgctaatcttcttgaacagctcatacagcgcctctatttcatttacgttaactgcataaccaagcagaataaactcattgacgaataaacggaaacagaacaagaataccatctattaagaatatatactgaaactgattccgtacacatcgaatcatcaaaaagaaggggagttggaaagaggaatcttacaaactgtttccctcgccaaccgttcaggatcctgcaggccgttgggacgattggagctgtcaaggctgcagcacttgaacagcaacgcggcgagccgtcggagcccttccgaggaatccaccatttgcaattgcaaactacaaccagcagctccccaatcaacaagcctcacacctgcaacgcccaacaacaacaacaacaaggagatcacccaatataccgtaggaatccaccgcccacaccaagtcagcaaccaccatcgcccccaattcggcaattccccgccggaatcacgaagacgtgaaccgaaatccacatatcccatcatcgatcacgccgctgccccaggaaccgaaactcccggatcccacccgctgcaccccccaacccaaacacgaaacgaatcctctctcccacggctacgcggtggtggccgccccatccacgaacagaattcccagcgacgacgacggcgacgacgaggccggcgggggagaaagagagggctacggggaacggggggattcggggagatcggcgggggagaggagtcacctcattgggagatccgcccgtcctcctcgcgcggcggcggcggcagcggcgacggcggcggtggcggtggagtgggggaggagaggatcagaggagaggctcgtcgtgggatgtttctagaaggcgatgaggagaggatgtcgttgtgttcccccggattctggggagagggcctttggtgtgagttgggctgggccgctgcccgctggagggctttgaagtggacccatggcccataacttatcgtgggggcccgatattctgtcttatctcgatgaccagagagtttgggcctgttcggctatctgtctgcggtggctgcggctgcggctgggccgtgtgtgtgcagcagcacggttggtgccgggccctttgtagtgagagtagagttttttctacatctcaaaagataatggattttggttggagatatattgtagtactacgaatttttgactagacatataaacatacgtctcgttcaaccaaaatatcttatagttgaaacagagggagtaagacgatgggtagagtgattgaaaagtgccactcccgctgtttatattatacaatgttttggttacaggtatgtagtttgatactaaatttgttatatttcgagatgaaagacgtgctccctccgtcttaaaaaaatctaacctaggaggggatttgatcccttctagtacaacgaatctagatagaagtttgtccagattcattgtactatggggggtcacatcccctcgtaggttgggtttttttgggagcagtatagctagcgactctatgataagcactagaaaactgtaaaatgaacttgccaaatttacatatagtttcatcgtagataaacaaccttaattctatcttactataaagttaatgttcactaactcctaaagctcaatatgcaagtgtttcacatcagcatccactagcaattattatctagagtattttaaatcacatgcaagtgtcatatcatcacccactagcaattgttatctagagtattttaaatatctttcaaatatgacatatcacttgcaattttattgtatttttagaactcaatatgcaaacaatgtcaaatcattatctccatgacattttcatattttttaaacatatacatctatcattttctataatgtataacatacatttattaatatatctcgcagcaaagcacgaggtatcaattaatgaattgcacaagatgataacagatcttaattgaaaaccaatgaccctattggctactcatcagttagtgcctgtagtcaaaattaaaattttaaatataatttaaattcgtcattttattgttttctatttttcagccttaggcctcagcttttaaagcgctaacattataagtataaaaagtcattcctaaagttatgtatgtggttgctttgtttatttctatatcaaatgtggtgcttgcagatgcatacatgcgtcactaatgttgtttgaatattgcggccagatataaaaacaaaaggatttaaatgataatggtggaataaaatgaacggtgttgggacaatggtaaaagcgacatgaagcatttcctgatgacaagggcagtaatagagcttcgtggggcaaaaaaaaaatcgtttctcgtgttttcctcttttttaaattcattcaaacttgacaagcacttgtaacgtcttggagagttgtagcatgcaattacatagaattttttttttggcaaaagtcatccataagaaattaattgtttatcgcaaagaagaaaagttatggaaaggatgatcctcaggtgctgcgtaagaatcattggccgtttttcttctgatgatgtgaaatgaggagaaaaaaggtgcaggagaattttcaaggaagagccaggattgtgattgatggtatcaccggctcttttttgtttggtgtcaatcggaatcgggtaggcaacggaaatgctaatactcgttattcattctgtagattttgaatgatgctccctccgtttttcacttgtattttaaacattcatatcttcattgatctttttaatcacatgggcattattaaaaatgtaactacattttgattaatgtttcctatatatgataaatctactaatatcagtttttttatttgaaatattataatcccatgttaagaatttgagatttgaccgtaaatgttctagcaaatagctagtaatccgttaaaaaacagaggtgataacgaatggttcaacttccaaaataatatgaaaattttcaatgctatcaagagacatacaacacgaaacaatgtaatctactccctccgtttcacaatataagtcattctaacatttcccacatttatgttgatgttaatgaatctagacatatatatctatctagattcattaatatcaatatgaatgtgggaaatgttataatgacttacattgtgaaacggagggagtacatcataaggtttaatatgttcgtatcaatcaactctaagtcatagtatcggttatttttaaaacccgtttggctattagtcttggaaatattctcccaacaactaaacgtattcctcgactccttcccattttatgccaatcacattatccttgtagcctataattccaaaccgaacaagcccagatatattgcacacataaagcattatgggcatgtttggattagtgccaatttgtgccataccaatatttttggtagcttcaaagagtactttgatagcatttgaattgtgaccaattttgtctatctagtaataaatctaccctattaaatttggtagtgccaaaacttactaccaatattttaataggccgcaaactaaatcagccctatactatgaggcaaacaacccaaagtgattataaatttgcacccatctattggcacatctaggctgtgtttagttccacgctaaaattgaatttaaagaaattggaacgatgtaatggaaaagttgaaaatttatatatatagaaaaaattcgatgtgatgaaaaagttaaaaatttaaagaaaaaagttgaaatctaaacagggccgtaactgtctcctgtctgtcgtatatacgtatgaggtggtagtatctccgtatctccgtacccgcactggcagggtgtcgctgaggtggccgcgcggctagtgggctccaactgcaaagaccccgggcccacatgtcatccaccgagaaggaaaacccaccggcaaacagttatccgggcccaccgccgctgtagcacactgctcgttgattcgaccaacgcggcatttcttccttccccctacgaaattaccatcctaccctctcccactccctcctcctgaaccaagcccacgcgcctcgccgtccgatccacctcgagatccgcgccctcctgcgctcagctcctacaccgagtccacagagaaaccaggtccgcccccgcgcggactctccgtacacccctccccaccgcgctggcccccactccgaccgtccgttcccgcctcgtgattcgtgccggcgaccacccgcctccgtggacccggtccacggggagattacaccttcacccccctcacctcacctcacctcacaccacgcgtctccccccaccaactagctctctctctctctctctctctcgcgccgccgctacgctcgccgcgccgccgctacgctcgccgcgccgccgctacgctcgccgcgccgccgcgggtggggagatttgaccggcgttgactccgggatggacgggcggttcccgctgccgccggcgagcggaggggggcgggggcaccaccggcgggcgcactcggagacgttcctgcggctgcccgacgcggacctcctcctcgacccggagggggacttctccttctccgacctcgacttcccctccctctccgacgactccccggccatctccgacccgaccccgccgccgccgccgccgatggctgcgacccccgcgccggcgccgcggccaccgggtggggcgcacatgaggagcctctccctcgacaccgccttcttcgagggtttctcgttgcagggtgggggaggaggaggaggaggaggagggagtgggggaagtggtgggcataagaggagcgggtcgatggatggggtcaactcgccgttcgagggtgagtcggcgctctccggtgggctaccggactacgcgaagaaggccatgcccgcggagaggatcgccgagctcgcgctcatcgaccccaagcgcgcaaagaggtgaggaaatcgcttgctgcttcctctactccattttgagttcagcaatttctagatccgcagggatgtgccttttgccccaatcttgtacagtgatactgcgatttcccatttcgaagaatatagttggagtcagtagtgggattgctgctgttcttggtgtttcctttcttgatctgggctatctgtgccttgcttgatttgtgatgtaattggggagatgtattggggcttgttgatttaggttaagcttgtgatggcgcttgtgtgcagaattctggcgaacaggcagtcggctgcaaggtccaaggaaaggaagatcaagtacactagcgagctggagaggaaggtgcagacactgcagaccgaggccaccacgctgtctgcacagctcacgcttctccaggtatggaactttgtttattccgagcgccagataagcctcctatattgtcttatctaatcagcttagtttgttagtcaattgttttgtttgacatgtattagttgtgcaaagttagagtaggttacacgaaactttaatgttttgactcaatgattgtcatgcatgtgaagaactgctgtaagcaaagctactgcttgaacctttttatgtttttagaagcataatagtatgttgctgtatcttgtccctttccttctagctaaagcggcttattgattgtttcaagcatgtgtgctaagttgtggatcttacttggggtgtcaaaacgagctatttgtgttactatgataatgtgttgaagaaagtgtgcaggaataacacgtaataatagcatgtagctttgcattgcataacattctatgaatttcattttttttatacaattctgttgtgggccagctttatttaaaaccaaataacagtttataagttagtacacaataaataatttgtctgcattgaatgcggcagttcgtttccttttgggttagcaacttagtgtcctacagtaaacttccagtatctgagctcagagctgcagaaagtttaggaagtggaatttttaaagcatgatagtcactagaatggaaatgtacaaataagaactttgttagtagaccatttattctacacatattttaggacacttcataagctaaagcataacttagttcttttttatttcaaactgatgttccttatggcaccttatgcatctagcacctgaatttattagattgatagttgcctagatatatgtggctttgtaaaaactagtgatagcactagtattccatggatgtcaaatggacagtgagatgtatggtaaatcatttttttgttagtaatatcaagatattctgaattttgttatggcactttgcatggtgcacaatgtaggacaagctgtagtgtatgaacacaatggagaacataataatagatttgacaagagcacaacattttttttcctttatcattaccttgttgcctgtgtaattgttgtagatgcgacaataagagtaggaattgaagcacctaatggtttaagaggtataagtatgtttgtagcgtgaacgatcgatcactcaccaaaaattgggctagtgatgaaccattttagagtgcagtttgattgatggaatcagacgggtcatgttaggatggagaaataagtgaccacagattgtaacatatgatgtctcactttcaagaaaacatgctagtgcttatcatataattagaacaaagcagtcatccagaaatcccatgaataaatgatattctaaaatgcgcctacttttatcatgatccttctgaagtcagcttattttttgtgacgataacagacatttttgctttatcttttttgagcaatgaaataatgtcagtggcttgtatgttctttggaatcttatattccttcaaccctttatgcagttctgtttgttcattgtataatttatttgatgagattcagagaactagagtgccatctaattatttatttccctatgaatacatagttttttttacttaatgttgtcaacttttacgtacagaggatatggatgctaacttaatattgctcattttagtacataatttgttgcacgtagcatttgcgtaaatttagtccgtagattgtcaagctttgaatcatcctatcgcacaacaccattttttgcatgctgctgatagtatctggtaggcaaattactcgccaatcctgtaagccaacagtttcttttgttctgtttgtgtatgtgatgtgtgccatctggtagtctcgaatctgattttttgcaattcacttgaaacccacagggatacatctggtttaactgccgagaatagagagctcaagctacggttgcagtccatggaagagcaagctaaactacgtgatggtatgcccttatcttttgttacttcatcatgtagcctttagtatgttgtgcaatactactacatggttgcctatga

SEQ ID NO: 72791 - DNA, 1486 bp, Oryza sativa
attctaaaatgcttatattttgggatggatggagtactccatatggtattatggttgatgaattcatggtgatagaagtatgtccggtttaactcctgctcccttaacaggaacgttctcaaaattatcatgtcaatgatgaactctcacgttcctagaccgaaaaaacaatgatccaaaattcccaaatggacagataggcaaatctttatttgacaggagcgcacatacgctctccgttatctgtcgaatttgcatcaaattaaggtccacacacagcaacggtgcagcttttgatcagtagggatcatttgcactgtagccactagtcagtgggattatttggtcggcctgcagataccatatctctccatccgttggccggcttatccgtgatctggttgtcgtgtaaagctgtgtgcgtgcgaagaataatttgttgcttcaaattcgacagagtaatttgcactgaaaaatagaaaccagtagtacggtggtaaaaccgtggcgcatgacttttcattttgggagaatagtcaatgtatccttaaagtttcgctcgtttaccgaaatcgtcatatgaatataccatatcatcattcatatataaaatatatggtgaattgtctaatttacccttatacatataacaaaaaaaagaaaaaataaaaaaaagtaaggatgaattagatatatataccataggaaaaaagtacaacgcagaatattgtttcgagcgccgcacaacgctccctcccagtttttcccttttttaccaccccatctttatttcgcatcctacatctccttagttcgtttttttaccacccagttcgttttttttaccaccccaccattcgtgtttcttttttctcttttttatcttatccgtgctttattaaaggatccggtaaaaatattaaccatccaggattttcctttttagttccttctctctagtttttctgttttcatgttttagtaaaatatttactatctagtttttcttttcgagttttctgtttttccagtgtctccccacttttcaaaagtaacgccttttcaaaattaacgaatttactccgtggagtttttcatttactcccagcctcccatatctgcttcttaaaagtaacaaatttatctcgcatgaatgccccttcaaaagtaataaatttacatgcataaataccccacatcatacgacaccattcctagatggtcgtaaaagaattactaccggcttacaacgtagtaattcttttaccattgttataaatattggagtaaattgcattggtggtacacaaacttattaggtgggtgcaatttagtacataaatttataaaatactcgtttcagtacacgaacttgtctagttcgtgtgaacaaggaccaaaataacttggcaatgttaattttacaaaactgatgttgattagggatgtgacatgcatacgtgtagtgagtatgtataagacatgc

SEQ ID NO: 72792 - DNA, 4084 bp, Oryza sativa
actttattttttttactggcggctatataagaaatttgcttgtgaaatcgtaactaagagatggggagtttagaaataaatattgcaacattaattaacagtacaaaagaatagagaaatagagttaatagttaagtccgttttacccgagttacggtgaagggtgaaatgattgtaaggtggctggcaactcccatcaacatttttgcagccagagagtttagcacaagcgtccattggggcacggtatcagcataagttgaagacttttcttgccgaggtggatgggcagcaggtcgtagcttccacatggaatgtttcctgctgcaggagtaagcctagcaccgcagtaggggcgtagctagctggtggtccatatggacacaggactaccctagattctagcctagagaccttaatccccactatcaaaataaatttctttggccacaaagtttgctaaagcatttcgtatttacctttgagatttatactcttaaattgatttgctcttattcagtctttacaattcatggatcatttgcaaaacgaactatacttactgatatatcatgcttcttaaacttgtagttaacctaatactctagagtgttatatatttgttattgcatttttgtcaagctttgagtttgagtttgtttatacgattagattagagctagctgtctttttttctgtcatggtgtttatgttacgatggtttattcgaattgggcggtctttaacaaattttgtaaatgcatattagatagtatggcgatattaaaattgtagtataataagttggcacaagcagggacaaattttgtaaatattgtagtataacttgtttttcatcattctttttctatctactagggacttggtcacacctatttttttttacttggtcacacctatttttttcctccctcacaggaaataggactacccaacaaaaaaattcctagctacaccacttagcaccagagcacacatgatcaaactcttcgcaccttccatatttcctatctagttttaagtgatgtttactcgaggatcaacaaactaaaccaaaatggattcaaaggctactgctaatttgttgctctcgtctatgcggatattgggagtgaggcgcgtatttataggcgcagccaagcatctcacgaccaagctacactgcatgatgcagtgattatttaactaattggatcattaataactatatatattgtgcgccatatatattgtttgtttgcattagctgtggtacgtagtagctgcccatgtggatcgagcatgtacggtgttctgtagactgcaagttccgatttctgaaatattttagctgcacatgaggtgaacgtactggtatattaaagccatatcttctgccttaccagcatgtagctagtatattactggcctgatatagttagatgtttgttaaaaattttgctgaaaaaataattcaatcactactgctaccacgtaatgggctactgctggcttatcactgccggtcgggcgtgagcaacaccgctggttcatttttaataaaaaagcaatcaattaatcgctactctctcgctctctccaaatatagctttgtagtcttaaattttggaatggacggagtactacacaatacacaataggcagagtaggtaacactacacaaatcattttcctaaacgccggccctgtttggttctaggagggccgtaactagcgccgcgtgaaaaaaactcgaggaccggcgccgggccggcgcccgcacgagaagatgcattatcctgtgcaggccatttaatccgactgcacgcgatgatgtcggtctatgtacactctagcccgaccatgccgcttttattccggcgttttctctcgtaaactttgaaaaattaaggggaaggttttcgacctcaaatctttgattttgatccatatataaggtgtaatgcttgatcttctccttcatttgcttctatttttgttagtttttatcggtgcaatgcgaagaaatttacagttttataaatggagagtgtaggcactttttgttttttatttattttttgagctaatatgtattgtttgtatcacatgtttttcaaagtattccgtagtccgattcctttttaggtttgcctccattaatttaatttgtcattggataaaggctaagaaaatttacaattttttggaaatggacagtttttattattgattacaaatgttgcatgcatgtttaaattctccgtagaactttaatttaatttttgtttagttccctctgtttatttcaaattttttcagtggaattcgacaaatatattaggtttgcaaatctagtaattctaagtaatatttaatttattaatttaattttattggaacccctagaccatgaatagcaatataatgtccgtttaagttgtatttttttcatatgttaaatatagtacaattcgactcatgaaatatgttcttttggtagatggaccagcaaaaagaattcatctggcgttcttgaagaaagcatccaattttgttgatcaggcaaatgcacatgctttgagggagaacaagagggacattttctgtccatgctttgattgcaggaacgaaaagatgatgcaagacccaaatgatatttgcacattgtagagcgtggatttatggattattacaagatatggacttttcacggggaagtcgcgggtcgtaacgaagaggctgatgatttttgctttgatgcggcaaaaaattttataatcgaagacatgtcacagggaacgatcccagtgaacgtgcagagatgtagcctagagggggggtgaataggctttcctgaaattttctcaacaattgcatcgggtcaattgacagggcccggaacctcctggtgatgaacaccggaacttccgggcagcatgagtagcccagaacttccggagttcttgagccaggaacttccgggcagcagagataaattaaactgagatgaaaaacaggtcctagcaagagaagtttaggcacataggggaacaagataaagatcgcagaatatcagcagattcacacaaagatcatgcacaagagagacaaagacgattttttcccgaagatcggatcacacgaatcctactctccgttgaggtgctccaaagagccgggtctcgattaaccccttggctcacttatgcaaagatcccagaagagatccacaaccttcaactcaacacttctaggtcattttctagaattgagtgaccaccaagatccaactcaaaatttcttctagaaaagaccacaagtgcaagttgctctgcctaggacaacctctgaaaactcagcacaagaatctttactcagttacctcgtttccttccggaggtgaggaaaatcttcacaaactttcccgggacatccacaagatctttggaagctcacgggaaacacctaaccgtctatgagaagatctccaagagtaataagcccaagtgacagctcacaaggtatccaaatgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacttcttctccaaagcttctcttactgaaggggggagaaagatagagcaagaatgagtacaaccacagtactcagcaagccacaccggagatgcataattaatgcaagggagtacaaggggataataatataggggttgagttttgcagtaacagcctttaaaagtcacttaggtgcccaaagccattttataaagacgatcctagagctacacagtattattaaacaaggtcgttaacccttacgaacctgccttaacccaaagcctacgatgattcaaaccgaactgcaaccccaccctgggtccc

SEQ ID NO: 72793 - DNA, 2160 bp, Oryza sativa
ccacatcatacgacaccattcctagatggtagtaaaagaattactaccggcttacaacgtagtaattcttttaccattgttataaatattgaagtaaattgcatgggtggtacacaaacttattaggtgggtgcaatttagtacataaatttataaaatactcgtttcagtacacgaacttgtctagttcgtgtgaacaaggaccaaaataacttggcaatgttaattttacaaaactgatgttgattaggatgtgacatgcatacgtgtagtgagtatgtataagacatgcaatatttataattttggtcccaactgtcctttatcatggaaatgatgactttcgtatatttctaacccttatatcattgctcagttttttttaaaacttttttctactatcactatatcctattctatttttcattgaagaggtgtatgtctaatatcaaccttctcatatatatgtttacgtagtatcctaacagcccttaaatcaataagattagccatgtagtatccttttcgccttcttccgcacgcaccagacaagttcatataccaaaacgagcattttacaagtttcgtgcactgaattgcacccacctgacaagtttgtgtaccgtggtctgcgagtaaaacaattaccacattcctctcgatatagcccatgatctcgtagccactgtgtagtaatatgtttactaatgtgttcagtacacggtataagagtaaaaacttagacttcatggtctgcgagtaaaacaattaccatattcctctctatatagcccatgatttcgtagcaaccatgtagtaatatgtttactgatgtgttcaatagagtaaaaaactgatactaagaatattgttaatatgtatcacaaaatggtcgtacgaataaaaaaaaattacaggctcaatcacacacaagtgataaaaattactcataggtgaatcaaactagaaaagaaaaaaattgattcagccaaaatccatcataaaactaggatcctggtggctttgctagatcttgctataaggatggagatgctggtctgtatcttgtgacaggtagtggagtagggctgtcaacgagccgagctcgagcgagctcgtctgcctaggctcaagctcgatacaagcttgagccgagctcgagccgagcctataaaatattcgagccttccgataggcttggctcgagctcgactaccgagcttgatttttaagtaaaacaatatatatttcaaagataatctttaaaaaataattaatttctagttcatcatattaatagaagaggaaaaaagaataaaataaatatatgatgtcaataaaaggcatacaaataacatatttgatcttctaatttattaaataacaacaaaaaaaatcatatattattaggctcgttggaagctcgagctcggctcgacaaagctcgcgagcttagggagaggcttaggctcggctcgtctggagctcgagccgagctcgaatcgagcagctcgcgagcctcgagtttttttgacagccctatagtggagagagcaaccgggtggcaagtggtagtcgacgatggaaacatggaggggtgtagcgacgtggtatagagatgggttcgacgttgcgcagtagcaaccatccatcatctagcaagcatgaaaaaaatgaaaaaaaaacattctcgttcatgtcataaggacgacgagcaaaaaaaaaaaagcaaacaacctccatcaccagcggactataccctatcctctgcggctagcaatatggagcacgatgtgcaaatgtagggcctgtgcagcccatcaattcagatcaagtaatattggagattgcacgttaatttgatttgcaaaaagaaatggcaaaatttaccacagggcatcgaaaaaacgtgtaattagctcgtggacaccgcaagaacgagaatctgttgtcggacatcacaataaagtgtaattagctccagaacactcggggccttattttattatttcctgtgaatgtggagagagaaacattggtgagagtacgattttgcccctgccctcacaccagccagagcaccgccaccacctcctccgtgcggcggccggcgcggtgagtgcgctggggagagggggagaaaggcgagcccgctctgtg

SEQ ID NO: 72794 - DNA, 1222 bp, Oryza sativa
aattaaatttcaaatataggctcaagatgttcaaaggtggcttgccttgctcgagatctagagcttgatcctcgaaatcctcgcactgcggttcttcgggctccgaaactatacgcaaaacgggacaactcaacaaacggcgaaaataaagccctattaatgacctctaagcgtgccattagagagatctcgagatttgaggaattttggaagttgaacggagtcaaacggatttacggttgggaagatattgaatttctaagattactggatttttggtctaaaggaaaaggatttaattaaatcctttttgaaaaagaaaagaaaagaaaagaaaagaaaagaaaagagggagggaaattagacttttcctcgggcggctagggcgcggcctgagagaaaaggggcggctcggccgagctaaatgggccggccggcccaaggcggcccaaggcacgcgcgcgcgggaggggaggagagagagagccggtggaccgggctcaccacgcgcggtcccgggtgggacccgcttgtcggtgacacggttcaccgtgcggagcgagcacgcggcgcacgcgcgcgggcggggagggacgcggtgtacgcacgcggttcgcggtggacgcggatgcggcgggcccacgcgcagcctcacggctcgcggtggaacgcgcgcacggggagggactgaccggggtcggctcgacccggtcttggccgagctggcgccgacgtggcgcctacgtggctgccatgcgggccggcgggaggtagacgacgacgccggccggaacggacggcggacgacagcggcgagcggcggagcgaaccacggcgatacaggcggaagcgagcacaccgggtggttgcacgagacgaggggagacgagccaactgctcggattcaccggagggagcttgacggcggcgaattgcggtggcggcaaccggcggcgggagaagggggaaacggcgacgaggttactaggggccgattcccggcggcgagagcatctacgcggctacgggaattcgatgctagcgttggattaggaggaaacgcatcgagggaggccggcgacgagaggcgcttccgagctcgggcggcgacggcggcgagcaacggtgagtgacggcaacggtcagggcggcgccggctacctacgaggaggctactcaagctactacccgagtctaaggggaggagatggagcgaggaggg

SEQ ID NO: 72795 - DNA, 20789 bp, Oryza sativa
gggaaccgggagagggaatcacgggggtgattttccccctctttaatgcgcgcggggacggcggatgcggcgaaatccgcggcgccgccggcgttagggcacgggcgagcgccggctcggcgcgagaagaaaaacgacaggtgggacccacccgtcagcgagggcggcgggcgggcccgcctgtcagcggcgcgcgcgcgcggaagaccgatggtccgcgggggaagagagagagagggagggactgggccgagccggcccaagaagggagggggggaaaaggacttcttttagggatttttctttttataaaaccttttcaactttgtttatttcttaataattattatttgtgctctgaaaattccactaaaatttgagggctccttttagaccaaggagaatttaacaaaaattctccgggccacatttgaatttttcttgtacgtattttagtgtttgccaatttcttttcgaattttaattaattctattattccttttagagaatgaattttaattttgggatgaatttatcaggacgtgacaaatccaccccccttacaagaatctcgtccccgagattcgaggaggctagcaagaagataggttgggcggtcttctcttcttgtctgacttcttccgctccgtcttctataacaaacttgcctaacaaacttcttcactctggactgcttggctcgatctcctgttgcagatggaatcttctcttcacctgacttggaccagggtgcaccttttggctgactcagactaggttgcggtagttcagtgatgcttccgttccagaacttctcatgattcatatcttcggagtcaacctcagacaagttaccacttcacgtcatgcgtcaacactagcttgtcattactaggatactatgtttgtcatcataagaatatcatgcttgtcattcacttctaacttgccatcaactgtctcatattagctttcctggtctccggtgctaggtacttcggctattcgatgcaagggtcaaccactctaactataagttatgcttcccaagagaaccaatttatcccacttgacatactttgacgtcttctccaatggctttattgctggatttgttattgtctaatcattaccctgtcaaatctgaggcttcgttgttagatgtgcttttaatctgacctctgtagattatcttcgaacatatcacttgattcataactgggaatagccctcacgaacaagcaactcggattcactttctttacattcagtttacttccccttattatcttcaggttgtcctcagttagcattcaacgtattcctttacacctttaaccttgatgtgttctttcccattggatcatctcccaagtcatggcattgcctggtaaccggtgcttgcacttttcactccgtgtagcatctgataccgagttgaagatttcactctttgccttcataaaaacacttttacctaggtcatcttgcttacttaatgacaaggtgactgctgcggggcaattacaatcaggggtcttccttgagcggtgcagagcatgtttctgtttatcaatcacctttcggcctacttctttcatgctggagaacatctttgccaatctcttttatcaatcatcttccggcttatctctaacaggtggtattctttgatgtggattgcggacgcttctggggacgatgaggtcctttggcttgctgcctttccgtgaaaccttgatgtggttcgtcaaagactagactgacgattgttgcctttgatccgaagagacacatctgaaactcttagtccaaacaaatgcctctttggttgatcacttgattttcttcgccatcaatcgctagactatttgattcctaacagattttgggtttacggaaatgagaccctaggtctccctaatcaacaacaaaatgtgcacaactcacagcacttgcactcttaacatggatccttcataagcttatcaaactcattcattatctcatgtttctctgttattacatgattgacggggaacaactataaaacaaaagtatttgaacactgatataagagtattatggttgcttctgactagcgctaggcttatcaggtactgtatttgctccagtgaccacttggcgattggcatgtctgcttccttaacaggtactacagtttgtaacagacaataactttcttacgctcgggttcttcatcttgaacttgatttctttggctgctgtgctggaacatccaaaggtacaatgccgatactggcctctgtcttgtcaactgatggctggggctgaaattgagcattgacaacttgtggtaatgcactcgctggagttggagctgttgcaacgcggtctataggactgcttcgggatgcatggatgacaattcgctgaggagcaagcttctgattgcaaggagttgcgtggactgacgtgctggcagctatgtttctcggtctggggcacttgtcggcgaaatgacccattccttgacaattgaagcaacagatatcttcccggactcggcattttcttttctatcatcaggttggttattaactcgaggttggaacatagttcctttgaaatgagaccctaggtctcctttgacagtaaacacataatcccatatcagcatcttccgaaagaatcctcttagaacttgtttttattacaaatttctcccattttacatgaatacaaggcactgtcttaaacaaaaagggaaggtgcttaacatcggtacattgtatcctcaacaggaatcatccataaacatagcaagctcactgttttatagtcatgaatatatttatttattacatgattgctgcaaactttctattacacaatgataagtagcgaactgaaaaccacaaacggggctgctcattttgattcaggagagatatagctggcattgtcctagtgactgcatccttgattggttctgtgatgatgtggtaggactgcgtattgctatcattcacaggagaaaaattccttctgattgctggttgaagtgggtaacggtcttctgcttggtatcaccctcctgatgttgatttcccttcgctcggcctggagtagttcggggagagaaacaacttcttccatcgacgacaattcattgctgaggctgtcggtgccgagaatggttggtgctgaagggtattattgctatgatttattgcagagtcaggtgcagcaggaggagcattggtgctgtggatgatatcgtcgatattgctgttggagctgactagctgacgagacaatcgtagggtcgttcgttggatttctgcggtcttggtcaacaacacactgagttggcatccctgggcacatggtttgtaccttcgcatagaaaacatgtgaccttgcgggtggacactcccctggtggatggtcttcttcacaatgagggcagagtgtgagacacacgccaccaatgtgtccaatttctccacaacgggggcatgcttttgattccatctcttcctcgccgagatgtgggggggactcatcttcataatccgaggagacttgatctgacccttcactatcagatactctgccaccatggcttaggaggtgctgggtcaactgtcgtgcacctcggaaggtatttcctcattgacgtctaagaatacttatccctgctgtagccattcggtgctggtaatagtcatcttacgtacttcttcttcaattcgcatcggcgcttttctcttctgattcttactcttcttgcctttggcgtgcttaatacgtgaccccacatggtacgaaaggctaagaggagagcaattcccaggattcaatggattctcttcattgggctctctgctttgcacactatgctggaagcttgtcttggtgtgaggaggctggtttagcgatgtcttgcctgctaaaccaaaagaaggggcttctttggcatatacccatggacaactcagggcataatgtccttgttctctacaatcgtgacaaaaggggacattctcttctggcattggaagctcattgacctgtgtggcttatgctcgatcaaacacatactgattttggtcttgacttccaaccaatggtagctgtgaactaagcggcatgcttggaatggaccaagggtgtgccctggttaactctcttgaggccagtggtggattgagttgaaaacttgagttacttgaggcatacccgctgacattctttcctttttctctgttaaacatctgttacagggattgaggtgagagaggaaacaagccaggaaagaatagaccagaactagagacaggaccttaaaggaactaactcttcttgctgatgtgttgtttgtttcacttattctgcaagttgattaagcaatcaacctagcatggttacatcacaacccaccgatgcaaaccacgcgctacacacacaagcaaggaacacacgactaacaacactaccctacagggtggcttaggttctgcgacgggttcccaagatcttcactccttcacagctggcttcacttcttccttcgcttcgctagcggatcctgcagtcttccggagcttcggcaaacaactgacgacatcttcttcttcgcaaagctgaccatctagtactagttgaaatttgaagaaggaagaaaagggaataaacactttgcaaatagcacaggggaaaggaggaaaaagggactttcccaaatagtttcatttttaaaaaatggccttaagttttatccacttggcttatcctacagtcgagaaggctctgataccagcttgtcgcgaccgggaaaattgccttttcccaaacgctagtgtattaatccccggcccaggaaaagccggggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacttcttctccaaagcttctcttactgaaggggggagaaagatagagcaagaatgagtacaaccacagtactcagcaagccacaccggagatgcataattaatgcaagggagtacaaggggataataatataggggttgagttttgcagtaacagcctttaaaagtcacttagttgcccaaagccattttataaagacgatcctagagctacacagtattattaaacaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaatttgaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaatcctgcctacggccggaacccccgggacaggcaggcaggactgagccccaagcagcagggcaccaaccctctgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtacccgaggtacgactagcaaaacccaaccacgcacctcgagcccagcctaaaaccaatttggggattttgaatagaaggagcggtgtgaagccaattccacaataaccaaaccattccatagtgtccaggtgatatgaaaattcccaaagtctaaagttataaaattacctaatgttgcctaattaaattgcgaagcatctacctaaaattaaactagtggtgccatgagtagagtgtccactagttggggttttgtttactctagggtgaacaaggaaataataacaatagcaataataataaggtcataacaaaggtaaataggcatggctaaataaaacagtgataacgcgggaatttaaataaagcgataatgcattaatttaaattaaaaataattttgtaaactgggattcaatatgctcaaggatgatgtgacttgccttgctcgctttcccaaatgccggcttcaacttccacgaagagcggatcttccgaagctgcagcgtctacacgaccgacggaaaagaaaaggcttttacgctaataaactccacataacagcagaaacaaagcacaaaaatgggttcttgacttcttaaggaaaaattagagacttgaacggtccaattccgagttcaaatggccaagttatggccatttgaagtttatatgctctttaaatggatatttacgaatttcttcatttaaattttaattaaaaacccatttattgcgtcagccgagggagagggcgcgcggaccgggtccacgggagtggggcccacgcgtcagcctctcggtccacggtggaccgggtgcacgcggctggcggcggccggcgccgtgggtcccacgcgtcagccgcacccgcgggcgcgggcggctgacggccgggccccacctggcagccgcgggaggcggccgaaggcggcctcgccggctcgaccgacgggagacgcgcgcccgcgccccgatggtcaccgccggcgaccaccggcgcggcggagcggcgcccgagagagcggagaggagagggaagcgagagggacggtccacggctcaccccgggacaacgaggacggcggaaacgacggccggagcggaggaacgcggcggcgcggttcgggacgacgaaggcgacggagctccggcggtcggcgggcgaagcgaaggggcggacggggtcggcgacaacgcggcgaagccgatggaggtggcgccgagtcgggaggaagaccggagcgacgacggcggctaaccgaaggtcggcggcgacggcggagagagaggagaacgtcgcgagcacgaatccgaaggcgagagcgagcggcaagcggcggaaacggaagaacggagctcggggaacgattatatagcgccgagagggggagagcgcggccggagagggaggaaacgggcgcggagatctcggccgccattgattgcgccggcgaggattgcgggcgcgattcgaacgaatccgagggagagagagggaaaagagggggaaacgggagagggaatcacgggggtgattttccccctctttaatgcgcgcggggacggcgggatgcggcgaaatccgcggcggcggcggcgctagggcacgggcgagcggcggcgcggcgcgaggaggaagacgacaggtgggacccacccgtcagcgagggcggcgggcgggcccgcctgtcagcggcgcgcgcgcgcgggaggccgatgggccgcgggggaagagagagagagggagggactgggccgagccggcccaagaagggagggggggaaaaggacttcttttagggatttttctttttataaaaccttttcaactttgtttatttcttaataattattatttgtgctctgaaaattccactaaaatttgagggctccttttagaccaaggagaatttaacaaaaattctccgggccacatttgaatttttcttgtacgtattttagtgtttgccaatttcttttcgaattttaattaattctattattccttttagagaatgaattttaattttgggatgaatttatcaggacgtgacaccaaagtgctcaatcaaacctaatcttcaagccatctccaaaacactcctacactctcatctaatttcccaatctcacaagataggctctagatttgagtggaggaagcaaaggaagcttgggagtagctagaaaaccctagaacatgaaagaactgaagtggaatggaaaaagggtgacctggggatgaaatccatatatataaccgctaggtgacgtcatctagccgttactcacatgtttgaactggaaacctgccatgaggttccgggcaaaagtgccaggaacttccgggcagcacttaggaaaatttttgcaattaaacggcgcccggaagtttcggccagaacctccgggtagccctctctgtcctggggagaaaatcatttttcaaaaatgattccaaaaatcttttgactcatggatatgactaagagcactttgtataccatagaaccacacttgaaacccctcttaatagtacggtttttcctaaactcaatttcgaaagtgaaaaacctagtctaatcacctacggtgattttcgcacttaggaacattcgaattggggggtctccttgcattcttaaccatcacaacttgctttgggactaaactcctgtgaataaacttgataaacatgttagtcccctttaaccaccttgtcattaatcaccaaaacccactagggggtttaagtgcatcttcaatctcccctttttggtgattgatgacaacatggttaaagtacacaaaaaaataataggatttaaatttagaatgatgagagaagtgtgaagctccccctaaagatatgcatataatgaacttgaaatgaatacattatgcataagatgaaggaaagctcaaaagaaacttcacactatcctcatcaaataagagatgtagataaaagtgcttgaatgatgagtgatgcaaaaagaaagactagatgacaagccaatcactcaaaaagatgaaaagaacacaacatcacatcaaaatgcaacatccatatggtctaacttactgacataaacgaaaataaagcatctaatagtcattacatccaaccataatagaatacgattacatgtccatatagagagagataatagagaggaaatctgcctggccggaacctctggatcacaggacccggagcttccggccaaatgaccagacaatagtcaaggtagcaaaaggatttaaatgacccccttcaattcacaatttctccccctttggcatcaagacaccaaaaagcgagaaactatgagaggaagaggatcactcatcttcatctccatcagagggaacaatctcggtatcgccggaaagatgagactcatcggactgagcagcggtatcaccctcatcaacatcagtgggagcatcctcagcagctgcctcggtgtcaccctcatcaccatcatcatcattatcatcatcatcagaatgagaagattcttcattgaagtaggtggaaggaccttcaccagcaacgttgcgggctgcctcataagcctccaatggatcaacatagacctcatcctcagaatcatctgacacttctttgctagcctctcttctatcttccttctgacgcctttctatcttcttcactttcttggcagtcttagcacacatacagaagattgcctgaagtgccttcttgatgggagaagaactcgaggaacttggtgaggcactagaagaaagaccagctgaagtagaaggaacagatctaggtagcactggagaagaggaaggtggagcacgagggcgaaaaggattgtggcgcccatctttgatgtagaacaccctggtgactgtctcaatcatcttcataatgaaaggagcatagatgcaaccccgcttaggctcaagaatggtgttggctatctcataccaaatcaacttcatcacactgaagggaggctgatggtagcgtatgcgactgagaagatgagcatgcttggatgacaaagcagtagcatctccaacctttggaagcaaggaccaacgaaagatggaatacaacaccttatagttgggatgcaaaccatgagtagatcccatgcaagtcctaggagcatcctttgcatacatgaacatggtcttgatcatggggaggggtgcttcactatgaatgttgggcctattgagatcctcttcatctaaccccagcatctcagcaaactgtgccatggaaatcttgtgcctaacaccctcagtcaaccacttcacatatggggttcccttccttgtagtaccaaagaatgctgttgcatagaactgtgcaatgacctcctcattccaatcatactccaaggcaagaatatctccaagattcttgttgtgtgtcgcgaccgagaaaattgccttttcccaaacgctagtgtattaatccccgtcccaggaaaagccggggtacaccacacaaacatgatataaaagacacatctttattatatcgataatatttacattattacaaaggcacttcaggcctgacaatcaaaaataaacagcagcggactagcgggcctacggctccatcttcatggcgctcaactagggtataagccaggactccacctaagacttcttctccaaagcttctcttactgaaggggggaaaagattgagcaagaatgagtacaaccacagtactcagcaagccacaccggagatgcataattaatgcaagggagtacaggggataataatataggggttaagttttgcagtaaacagcatttaaaagtcacttagttgcccaaagccattttataaagacgatcctagagctacacagtattattaatcaaggccgtgaacccacacgaacctgccttcacccaaggcttacgatgattcagaccgaactagcaacccgaccctgggtcccagctcgtcccaagccaacccaggccaaccattccacattttagttattaagcaggttttaagaatttaaaacactaacttgggtacattgctaggcttgcccataaccgagggcgcggctattcgaataggttttagtctgatcagatgtgtacatctttacccacaagagacgtcttcctcacgtgcaaccacgtgccacataccaccacggcatatggacggaagacatgacatagtttccaacccatcctagccatagacaagagtaccaacccaacccacctacggccggaacccccggacaggcaggcagaattgagcccctagcagcaggacaccagccctgtgccatgacatctcgactaccgggccgcagcccgtgtagccttcatttgtcctagagatgtccatcaacccccgacttcgtccatctccatccgtgtacttttgtttataaccagactgagccacaaactaagccttacccactagacatgtggaagtacggtagtgctttgcaacagaggcccgaagaccggtccttatgtggccgaggtgctactaacaaaaccatgcaccccgagcccagcctaaaaccattttgagggttttgaatagagggggaggtgtgcatccaattccacaataatccgaccattccaatatgtccaagtgatatgaatattcccaaagtctagagttataaaaaccacctaatgttgcctaattaatcagcgaagcacctacctaaattcatactagtggaaccatgaatagagtgcccactagttggggttttgtttattctagggtgaacaaggtaataatatcaataacaataataaggtcataacaaaggtaaataggcatggctaaataaaacagtgataacgcgggaatttaaataaagcgataatgcattaatttaaatcaaaataattttatagactgggattcaatatgctcaaggatgatgtgacttgccttgctcacagagaacgaccttctgaaccttcggtgacgaccgcgaaccacgcttcaagaacctccggaacgacagaagctacgcgaagcacacaagcaaagctacaagcctataaagaagcaataacaatacataaaaagaaagcacacggttctttaggttataacaaacattaggagacttgaacgggtcgattcagagttcgtatgaccaagatatgatcatccgaagtttaatgctgttacatggagatttacggattattgtaattaggctttgcaactataaaacatgtgtaagcgctagtctggaaaagacaggaaggctgcgctgttgacatgcagaccccacatgtcaacctaaaggaccgtggtagaccgggtacacagagacggtccacgggtcgacagaagcagatcccgtgtgtcaaccgaggcgagtggccgacaaacgaactccactagacaccacacgggctgcacacgtggaaaccacgcggctaccgagcggacacactaacacggtcaccacacgcacaagcgaacgactgccgacaccgatacacgggtaccggggccgacaaccgcacaacgggcatgggcggcaccgaaaggacgaggacggggcagcgagggagagggatccttaccaccacgcgacgaggcatgggaacgacaacgacgaacgggcgcggcggagacagctcggggacgatggaggcgaacggcgagggaacgacttcggcggtgatccttggacgaaggcgagacgcggccggcacaaggcttgacgacgcggagccgaggacgaagacgacgacggggatgctgcacacttgacgaaacgcgggcggtgaacgcgaacggcttgacggaaggacgaacgccacgacgatgaggacaacaagaggaggacgacgacgacgatgaccggggccggcgaggaggcgacgagggcagccggcagcagctgcacagatgcgaggacggcgtggaacacgccgcagcgatgccgacgacggaggtggcgccacgagacgacgagccgggcgaccgacgggacgtcgacgacgagaacgaacggaggcgacgatgatggaccgcggaggggtttggatggaggggaagcgatgccgaggacgaccttgccgctgcgatgccggagaagacggcgacgcggtcgaccggggaaattccggcgaggaggatggagaggccggcgcggcacgacggtggtctccggacgaatcagagggcaggccggggtggaggtcgacgcggcgacgccgagggaggagacggcgcggccggcccgcacctgagcggcgcggcaggggcggctggaggtggtacagtggcggcaacgccactggacgacggcgggaacgcgcctccggcggtcaccgcgcgaaacggagggcaggccgggggagaggaggcggctgcgacgccggggaaggcgacggcacggccggccggcgcacggtcgaggagggagaggcggctggaggcgcccggcgtgggggaaagagaagggcgacggcagggaggggtggtgaggccacgggagatcgcgggagggggctaaaacgagagaacggagtgagggggttccattttataggagaggagagggagccggccacggggaaggtcggaacggaggcgggaatggcggccggcggccatggaaagcggccgggaaagacgcgtccgttcccgacgattgggggcgccattcaagggggaaattggggggaattgaagaggaaggaatggggattaattccccccaatcaatttggaaagaagggcattgattcgcgtggatttaggggaggaacggcgctaggtttccggggagagagagacgaggccggctgggggaggaagacgggtccgacaggcgggacccgcctgccaggcgcggtcaacgcgcgtgggcgcgtgcgtgacaggcgcgtgcgcacgcgggaggagggcggctcgggcaggggcgcggcgtgggccgggcggccggcccaggaggagaggaggggaggggggcccgggggagagagggaggaggagggagtgggccggggaaggaggaggcccaagagaaggagggagagaaggagagggagagaaagagagggaggagagagggacttcggccgcgggccgagagggagaggggagaaaccttgggccacacttggcccaaagggaaggggagggttatttttaggtttttctttttaataaactctaataattatttttgttgcttaataattatttccggtgctctgaaaattcaagtaaaatttgagggctctttttagaccaaggagaatttaacaaaaattctccgggccacattcgaatttttcttgtacgtattttagtgtttgccaatttcttttcgaattttaattaattctattattccttttagggaatgatttttattttgggatgaatttatcaggacgtgacattgtggcacacttgcatcacttggttgaacacttcattgtttttcttcctcatgtaagcccaatcaatacacttcatctcaaccactggattctctctagccataatcactgagttataccaatccaattgagtgaaagtcctgaagcgaggatcctgtgactccttgtcacgcccggaatttctacccaaaatttcaaacgcttacatgtgtgttaaaccctcgtccaggaatcagccgaggcacacaataacaaatcgataatagagtacaaataaacagctatttaatattcgcaaataataaattattacagaggtggatagttcctctcaaagaataacattctacgcagcggaaaaaaaataaaagcaaactacggaacaactatggagactccactccacaggcaacttaacccggaccaagcctagtcctccagatcaccttcactgaagtactcctcctctgatgaatgaatattgcaagaatgagcatatgacatactcaacaagccacacagcaaatatgcaagtgcataggataacaaaggacggcataataaagctcatttgcataaacagcatttaataaatatttatgagaatagtaaaccagttgaattattaagcagtattaaataaacaccatacaacacttccgtgttgcatgggcccaacctcatctgaacaaccaaccccggttgtacaaatccaaactccataccaggaatataccattccaaaccaggagtcaaattaattatcacaagtaccattaatgaatagtgtgggattaatcacgaaaaacattgctcaactcacccataaccgcgggcacggctattcgaatagttttactctgattagaggtgtaccactgtacccacaagatacaatcccacaacatgtcaccatgcgcctcagcaccaccacggtacctcggaaaggaactgtgacaatacccctcacacaacacaactcaccacagtgcaccactcctggatcataatctccccctctaaaccagaggcaatggactccccagcgacccccacggacttctcgccgcttcacagtctggcacaccataacgaatcatgccatacaaaagataaagccgttgcccatgttggcttgtggttggcacggtaaatgtttcacaacagtagctcgtgaaccagtccttaattgtcatgagcacaaccatcaaaaccatatgctcacaacccacctttaatcaggttttagttattaattaattaacataacacgattaaccatcgtgagctaccattaaatatatccataattaataatgtgatatatataattcatcccttaatgagctgatatttctaagcatggctaatcaaatatacatatagcatctagttgaaccaatccaatatataaggtccaagctaatcaaattataacccataggaaaataaagttatcttcggccattaattaattgggaaaaggttcaccacccaatgacattcgaaaataatgcataagttgaaataaaacattagctttaaacgggttcaacatgctcaaagggttatttgggatctgtgtgacttgccttgagcttccacaaacacctccgaaccttcctcaactgaaacgctctcctcgggaacgtttgaaactagagcaaaaaaataaaatcaacaaaacagtacaaaaacaagcataaacagtacatgtggatatttttaacatgtagatctcaattttagaaaaaatttagcaacttgaaccactcgaatcggagctacgacgaattagttatgaatttccgaagttttaatcgatttgcatctaataaagaaaacttaaaaaaaggtttataacgtcatcacgtcatcgtcgccggccatggctcgggcggcacaaccaccggcgctaggaggctcggccgggctattagagggcatctacgcgtagaggacaacattgcgaactcaccggtaccaacgaacacgacggacgacgtcgaacggcgaccggcggcgaggctcgacggcggctcggctcggacagcggcggcgacggcgctacggcggccggcggcgatggctaaggggcggccgagcttcccctcttccatgcgcacccgacggcggtgagaggaggtggcggcgacggctaaaacgacggcgcggcgcggctggacgtcggccggcggcggcggcggcttggttggcgcggtggcggcgctacggggcacgagagagctcgggagatggggcaaacgaaagagggcgactagggggtgctatttatagccttatattggagagatcagactccaaccgcgagtaatcggaccgagaaaaactaggtttaggttttggggataaactcgaaaacgagtttgattcgggtaagatacgaagcgattagccccgatttttgggggatagatagaggacaacaaggggaccaaaacccctcaaacaatcggactcgatcgcgaccgagggcggcggaatcggcgggggatggcggcggctcgggcttgggctggctggccggaggttgaagacaaccccgacatgtgggccccacatgtcggcggctgtgaggaggagagggggccggcggctgcttgggccgcttgggccggcttggccttgcgcggggagagaagagttgggcccgaatcggcccaacgacttaggggaggatttttaagactttttcaataaaaataatttgtgaaatgatgtttcatttattaaaaatacttcccttgctcaaataattcccagaaaaatctagaaaatagataaacaagcaaagtatttaatgaaattttatctagctcaattttatgttgataattttccttgattattagagtttaacttgtaggcttttaaaataatttctaaaaatgatttaaaatacgcattattaatttagacgatttttagggcgtgacactcctcaggctgtgactctggatcaatcaaacgatctcgtctacacttggcaagttgatgaaggtagttggacttgggtcttccaatgtggtgcataggagtggtgtcaaaaccaagagtcttgtagagccgaacgggattctcacgagatcctacagggaaatcatgagatgcccttccagccccagaactgcgaccaccacctctcccgtgacctcttgtattaggggcatcacttccttgaccactatcaacatccctaatctgaacaggacggttgctggattgccttgtaaatctgggagaagtacgagtgccactgccactgccgccctcaaccactttctctttacccaaacgaccacgaggataccgaataggaggactctcatcaccggacacatcctgagaggctttctgtcttttctcacgagtcatagtacttactgcaacaggaatcaacaaattggagtgcagtagttaggcaaaatttgagagaaacaagaatggcaggctgaatggacagcgcccggaggttccgggtgcaagaacaccggaacttccggccggcaaaaatgaagaacagaggtttcaaaaatagccagtgcatgtgaacaaatcctatagatcagtgatcaacaaggtagcagaaacaagactatccaagtggttttctcccaaggttcacagatttagagatcgggataaaaacacaatgaaccgagagagggaatccaaaagttctaccttgagagaagaaactgcgaatcgatcacagaaagaacctcccagccaccaatgtggatgaatccacggagaagaaacgaatttgattggacgaaagtgaaaatcgccactaggagcactatagcggcggctagggttggcgtcggggagagagaagaaatgaggagagagaatggggcttctaactccccctgagtatatatactccccgataccccgaggttccggacaaggaggcccggaacttccggcctgacagataaagggcagtcaggaccaaaaacaaggaagagatgagaattcaacgcggggaaatagggaactatggacatgcagagacttatgacgtatatgaccagcctacaatcaacattacataaccatggtcaatatacaccacaagaaggggataaaagccaaattttcgcaataaaaggcacagcaaggaatttgcaaaaattttcacaaaaggggtttttggatatagggtgaatgtttgagctttattcctggtatcaagaccatcttctaccaagaagtgatctcaggatgtcacaccctgaaaatttaaaatatataaattgttgtttaattggaatttctagaatttattttaaaagtcttgaagagaagatctaattttaattaataaattccaatataaaatgggccaagataaaatttcattaaatactttgcttaattctataattcctagatttttctgggatttatttgagctaagaaagtatttttaataaatggaattgcatttaagaaataattttaattgaaaaaggttttaaaaagtcttcttttggctttgggccgaaagtcggcccaaaacctctcttctctctcctcggcccaagccggcccagtccgccgcccgcgcgcgcgccctcgctcgctgacaggtggggcccacctgtcagtcgtcgtctaccttcggccgccgccgcctgaaaccctagtttcgcgccgccgccgtttcctttccaaatccggccgttcctttccttctccggccgaattgatagaggggaaatgatcctcgtgatctcctctaccttttctcctttggaatcttcggctaaatcggtttggaaatcgagggattcgagttcgtctcagattcgtttttgccgaaccttccttcctcgtcgccggccgccgtgggccttcgccttcacctccgagcccctttaaaagcctccccgagctctcctctacccgccgccaccctcgccttcgcctctcgtcgtcggaatcgctctagcgccgcaagccctagcttcgctgtcgccgccgccgctccagctgtgcttcgccgccgttccagacgccgccgtcgctcgggaagaccgccgccgagccgccgccgccggggtgacgtcatcgctgacgccatcggggtcgtccgccgtgagccgccgtggacccgatcgatctcggccgtccatcttggatcggatagatctcggccgtccgttcgcgtgaaccgccgccgtgcgtccggtccaccgaaaccctagcccgctgacgcaataaatcctcttttccttttcaaaaataattcattattgcgtcataattcaattttaaccgatttaagtgttttaatccggtttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgccggagaagagtttgaagagttccaaggccagcaaggcaagtcacacagatcccaaacaatcctttgagcatgttgatcctacttaaagctattgcttcttttcaactattgcatttattttcgaatgtcattgggtggaattaacctattgtttgttatagcccttttgttcttgattactttattccttgataccttgggttataatttgactagttgagctttatttatattggttcaactagatattagatataattgcttagccctgcttagaaacattagctcactattgggataacttatgactcactattatttaatgatggcttaatgatagttcacgatggtcaatcgtgattagttaattaattaatgtgccaactaaaacctgataatggtgggttgtgagcacatggttttgatggtcgtgctcatgacaattaaggaccggttcacgagtttcgattgtgaaacattaatcgtgccaaccacaagccagcatgggcaacggctttatcttttgtatagcatggttcattgcggggcaccagactgagaagtggcggagataatgtcacaccccgaagttttcctcccaagccaaattgtaaattacaaatgaccccaagaaaatgcagaggaaatcaggataaaaccctaagaaaacaatgcaaataataatcggatttgacatgtggaatttttcttgaattctacatgtcgaaattcattaacaggatttttagtggaattttcagagctctagaaataattttaaccaattaaaaatcactaaagtgcaatttttaattccagggaaaatccttttcctttttctttttcttttccctccctttttcctcctttttcttttcggatgggccgccggcccattccccttg

SEQ ID NO: 72796 - DNA, 10884 bp, Oryza sativa
cagcaggcggccacaattccacgacgcgtctgctcccggcgaaagtggaggtagttgtgggccgtcccatcagaaggtgactcggacggcaaccatgcaaatctccgtccatttatgaaaaggtagggtaagtccccaaggagaaggggggatggtgcatgtggtatccccttaagatatagaaggaggaccttgcccactgagagaaggagagagctttttcttggactggacctttccagattaggaaccgagaacaagggagaggctggctgatactttgtagctctttcatacacagatctcccaaaacacaggagtagggtattacgcttctcagcggcccgaacctgtatacatcgccggtgtcttctgtgcttccggtctcgcgaaccttccacatacagattgagagcttagaatctcacccagggtccccggccgaaccggcaaaggggggccagcgcggtctcccggtgaggagccccacgctccgtcaaatagatacacataacaaaatctagtgcaatcatctattagtgtcatgaaatatttctttccccctttagtcaacacgccattcatttcgcacagatcggaatgaacaagttctagaggtgcaaattcctcgcctcagatgccttgtgaggcttgcgaggttgtttcgattgaacacaagtatggcacttggaacctttgaccaaagtgaattttggatttaaactcatgttagccaagcgcgtcatacaaccgaaattcacatgacaaagtcgtgaatgccacacattggactcatcattctcgttaatatggttcacaacattattattattacacatgtcatccaaagaaaagcggaacaagcctccgctgtcataaccttttccaataaaagttccatatttagatacgacacatttattggattcaaacacaagtttaaaaccttctctacacagtagagagccactaactagattcttctttattgaagggacatgctgcacgttcttcagctgcacagtctttcccgaagtaaacttcagatcgaccatactaacaccatgaacagccgcaagcgacccgtttcccatcaacaaggaggaacctctcccgacctgataagaagaaaacaggaaaatatcagcacatacatgaatattagcacccgtatcaacccaccaatcaggtgaatgaaaaacagagagaactgtaggtaaaattttaccgtaccccgatgttcctccgccctcgctaatgaccatgttggcagacttcctgtctttgtgctcaggacaatccttggcccaatgcccaggcttgccacacacaaagcagtctccctttgcctttcccttgcctttcttcttaaaattggttgtagccttgggtttgacatcatgcttgactttcttgttgttgtgggatgcgtgagggttcttcttctgtaccatattggcactagaacctccctaaacctttttgccccagatgtcctttgccctcgccttctcctcaacacccaaagagccaatgagatcaataacactgaactcttgtctcttgtgctttagagaagtggcaaagtccgaccaagaaggtggcaatttggcaataatgccacccgccacaaacttgtccggcaactcacagttgttgttctcaagttccttagccagcatctgaatctcatgagcttgttccactacagaacggtcatcgaccatcttatagtcatagaactgctccatgacatacagctcgctgccggtgtcgaaaactccgaacttggcctcaagtgcatcccacatgtccttccctgaaggcatgtgcatatacacatccactatattgtcagcgagtacactgatcaatgctccacggaacaggcaatccgaagcctcgaacttaacctcttcctcaggagagagaggtggttcacttcgtttaccccgtgaaacatagaaacattgcatcgctgtcaaccacaatagtgcacgtgctttccacctcttataatttgaaccatcaaaagcatgcggtttcagtgttgcagcaaagtcaactaccgaaaatgacctatcaggtttttggattgttggaaatatggtcatatatcagcatattttaatccaaaatattaaggcaataaacatgacatgaacaatgtgaggtgatctagtgataaaattaaacataaccagaagcatgcttaagataaaataagcatcaacatcatttagagaacgcaataacattgcgactaatagatgtaacaaaaacaaaaatgcagtaggatggtataccctgtaaaggtccctccgctggattgtgaggcagaactgcctccgttggtgttgtcgatcggtgcgtctccagttcctggcgcacctccgttgacgccgccaccagtagacatcgccgcgacgcagaccgaacagaaccaccgacgatgatgaagagagagcagtcgtgcggaagcactctccaaaaacctgatcacccgcctacccggtgcagatctcaggcgaaggtgtggtttcggaggccctgctcgttccgatcactcgtgcgcgtaagcgatcagaaccggggaagcagaagcagcataggcgcaagcgtggaggaagaaccagcgatgggagaatgcgtgaagatctgattgggggtctctgtttgcgcgtggaggaagaaccagcgatgcgtgaagatctgattggggtctctatttgcacgtggaggaagaaccagcgatgcgtgaagatctgattgggggtctctgtttgcgcgtggaggaagaaccagcgatgggagaaagcgtgaagatctgatcgggggtctctgtttcctaatagcgcaggagaggaatccacccgttgcagcagtaacgacgcgatcaatgtgtattgaatcacctgcctgttacagaggcaatctcgcgaattctgaaccgttgcaaaagaatctcgagagatgtcggacgcgacgcacaccacggccacggctcggctcagggcgtgcgcgtgtgcgcgtgtggctttccgatccccacctcaaccggtcaacagggagcctccaataactccctatttaagttgagattcttaacttttaattcccatggtggtattattatcttcaacatttattatgggcccttgagattttaatagaaaaatcgggcctagcccatttattctaacagaagtttcctagcgaaagctcagctcttcgaggcctgttcttgagcattgtaacctcctagaggcattatcgtggcttccgttcttcgctggtgaatctttaggtgaaaaccatgtcccgtttccctgggacgggcaatggcagtgtcctcgcgcattgtgaacttcttggaggcatcatttgatgctccattcctttaatctttctccagacgatcatcttcttgtagtgccacttctaaccttcacaagatggccacgttgtttgtatgaggtagaacgtatccattttatctctctcactctctccctctccaaccaaaaggtatggcgtgccagcgattcaacagccatgatttggggagagactatgataccatgtgagagaaggcggggattgaagatgcattgagttaaccctagagggtaatataatgtacatgagggaaagggaaaatacttgaatgcctataacacacatgtatagcactcatactctaacagagaagaagatggcgatgactaactaaagcgcaaaaattatataatgtcctattgtgtgttaaaatgctttaaatttaggttattgttttggctgcctaattttgtccgagatgtgcccatcaaatccaacgaataaatgagtcatcggttgcatttactcttagctcaatcgtttaccctttagcttatcagtcatagctaaaattcgaatttcatatagtttattttttcatcgggttttaagtagctaatataagactgcatatataattttttttagtcacaagttacttactcactctctttttttaatatatgatacatcatacatttaactttttaacacatgttcgactattttcatcttattgaatttttttttgcgaatgtataaaatgtaaattatgcttaaaatgcttttagtgataaaaccactcatgacaaaattaatggtaattacattaattttttgaataagataaatgatgaaacatttatcgaaaatcaactgtgttatttatttatttatttaaaagaaataaggtagtataatcaactagctatcgagactgttttgttgatggccttacgaaaagactcaagtgtaacccagaaccagagccggcgccgccgtcccgggcaccggctgcgatgcacgagctgcacgtacggcatgcgtacgtgcatgccacacgcggcggcattcctggtttctctccccctccctttcctcttgcccgtccattgcccaccaccaccaccctgctctccccccagacgcgcgccaaatcccaaaatgccccactacatgcgccacgccgcgcgcttcccgccaccgccatggccggcttcctgcaccgccacgtgctccccccgttccgccgcccgcctccgcctccgccgccgccgccgcccccgcgcggcggcggccgtggacgccgcggcggatcctcgacccgggcgacgacgtggtgctccggtggaaccgcctcttcctggtgacctgcatggtcgggctgttcgtggatcccatgtacttctacctcctccacaccggcctcaagtcgtgcgtcaccatggacatgcagatcggcgtcggcgtcaccgccgtgcgcaccgtcgccgacctcttctacctcgcccacatgatcctcaagttccgcaccgccttcgtcgccccgagctcccgcgtcttcggccgcggcgagctcgtccgcgaccccgaccagatcgccatccgctacctcaagaacgacttcatcatcgacctcgccgccatgctccccatcccccaggttacctgcatccgtatgcacatgcatttcacaaccccaaacgaatttctctttttcagattgtaatatgtacgggaggtgcattttcacaattctttttttttcaaaatgtgataagataaataaatatgtggcatatcacttcacaaaacgttcatggttaaatttgacttgcacaagtagaaaaaaaacaaaagaaaattgaagtgcgtacttatgcgtacttgcacaagcacaatccaaaatgagtttatttttttcagattgtaatatgcacattatctaaaataaatagcaatatgcaacttctctgaatcctgatcaatgattctcttacataattcagcttatgcaagcagaatatgtgtaaacaaaactgttattttataaacaaagcagatagtaaatctcctgcttggaaatgagatcaaatttatcctgaatcatgttcacttgttggcctgtcagatagatttggatgggaatttatatgtgtaacatacatgcaggtgattatctggtttgtcataccagccgtgaacaactcatctgcaaaccacaccaacaacacgctctcgatgatcgtgctgatccagtacatccccagagtgttcctcatcgtctccttgaactccaagatcgtcaagtccagtggagtcgtcacaagaactgcctgggctggcgctgcttacaatctcctactctacacactggcaagccatgtaatgcatgataccatcatcttcagaacaattttcagaaactagaagttcataaaagttcctttgccacttcccccgtttcaaattacttggctttgtgctaagtcacttacttttaattctataaattagatagtatagtttaataacataagttctatgtttttaaactagattcaccattataaatgctttcaaaacatgcaatccacatgttgttaaaccatacgaattttgagaaattgatggtcaaagtcagagctgtttgacttaggacaaacatagaacgacaagttcaatacggagggagtagtagagattaaagattctaacccgaatataatgaattcatagtatgcatcatattgtgatgcaggttcttggggcgctgtggtatcttctgtcgatagagaggcagtacacatgctggatggacgtgtgcactagggagaacggcacgaacccggcgatacccaagtgctacatgagctacctggactgcaagacgctggaggatcccatccggatggactggcactcgcgcagcgagatcgaccaccagtgtctcctccctgaggccacctacgtctacggcttgttcgccgatgcgctcaacctggatgtcgccaaggtgaacttctgggacaagtatctctactgcctctggtgggggttcaggaacctcaggtatctctgaattcttgcattcttctcacctgatcgcagattgttgttgatacagataatgatgcataattttgtacattgatgtgttttttttcctgcgaattgtttgttagttcgtatggacagaacttggagaacagcacatacaggggagaaaccattttctgcatcctgatatgcatcatgggactcgtcttcttctcacatcttattggaaacatgcaggtatatagcttatgactgtattttgcctgaaggttttgttactgaatgcattcttgtctgaaaattttgttactaaatgcattcttgtctgaagattttgttactaaatgttactgaaaaacgcaattttacaaactcttgtttctgcttttgttactgaatgcacttgagaatatacatagttaaaaacaaattggttattgtttctgattgcaaagatgaaacatgaatgaatgaacattcatttgatttggattggtgaatgtagacgtacttgcaatcgatgacggtgaggctggaggaatggcgggtgaagcggcgggacatcgaggagtggatgcgccaccggcagctgccgctggagctgcaggagagggtgaggaggttcttccagtacaagtggctggcgacgaggggcgtcgacgaggagtccatcctccagtcgctgccgctcgatctccggcgagagatccagcgccacctctgcctcgccctcgtccgccgcgtccccttcttctcccagatggacgagcagctgctcgacgccatctgcgagcgcctcgtctcctcgctgagcaccaaggacgcctacatcgtccgcgagggcgacccggtcagcgagatgctgttcgtcatccgcggcgagctcgagagctccaccaccgacggcggccggaccaacttctttagctccatcaccctccgccccggcgacttctgcggcgaggagctcctcacctgggcgctcatgcccaaccccagcctcaacttcccgcagtcgacgaggacggtgaggtcggtcaccgaggtggaggcgttcgcgctccgcgccgaggacctcaagtacgtcgccaaccagttcaagcggctgcacagcaagcggctgcagcacgcgttccggtactactcccaccaatggcggagctggggcgcgtgcttcgtgcagggcgcgtggcgccgctacaagaagcgcaagctcgccagggagctcagcaagcaggaggagctctactacatgcagggccagggcggcgacgacggcgacgggcacgacgacagcgacagcgcgccgctgctcggtgccggcgtcggcgccggcggagaccacagggacggcgccgccgccggcgcggcgcacctcggcgcgacgttcctggcgtccaagttcgccaagaacaccaagaagagcgccgcggcgcaccacggcaaggcgaggatggaggacgtgtccagcatcaagttccccaagctggccaagcccgacgagcccgacttctccctcagctccgacgacgtgctgtgacacgccggccagcctctcgatctcttcttcttcttcctcctcctcctctccggcgatcgatcgatccatcgatcgacgagagagatgtactcaatttttttttcttacacggtcatggaatgggattagctagtagcgtgtaactagatatactagcaagatgcagaaatggaatcgcatgggatgcatttctgcgtcatctttgtactactgtatactagtgccgatcgatgtaacgtggtagaagttgaccaatatacattcagttcaggatgttcttgccaagttgccatcgatctctctctctctctctctctctctctctctctctctctctctctctctctctctgcgctttgtcaaaaccatatgtctctgcttgatgtttgtaactttgtattagtacaaagcaagtgtggtgtgtgtgggtgtatcgtgtatgcttcactaggacagttcgccttaacagccaaattcagttcaattcgaaattaattttcgtcatcatttcctgttcaagaagaatcggaattttgttaccgcgaaacgtgttgtcaatctttcacatttttatcacgaggatatgaaaaaaaaatagcctgaaagatatgatgacatttcttgtactaacgaggtataaacgaatgaccatataaggttttgagttcaaaatctctataaaaacaaatttcagattagattgtttgagaggctaagttctcaatttaaaagcctgcatatatccagttgaatacagaggttgggtaaaaattactcttctctaaaaatagctaaaaagttaaaagattgactcggctcagctcaatctgtcgtgactatgggttcacaaaccgatctgaactgagctcagtacaagacgatcagagtcatgggctttgacttttttgttcgcccctacctgagcatctgtggtaaaacaaaccatgtagaaagagttactcctaagtgcgacagaagttgagtcctcaacattgttttgatctttgaggctctgttaacagtgcgcatgaaaaacagagtggtcaattagctatgattaattaagtattaggtatttttttttcaaaaatggagtaatatgattgtttaagcaacttttgtataaaactttttaaaaaaaacgcaccgtttagcaatttgggaagcgtgcgcatgaaaaacggagaggaagggagttgagaactagcacttacgaacagagccttaggggaagttagggcctatttagttcacgaaaagaaaatttgtgggtgtcatattagatatttgaccggatatcggaaggggttttcggacacgaatgaagaaactaatttcataactctcctggaaaccgtgagatgaatcttttgagcctaattaatccatcattagcacatgtgggttactgtagcactttatggctaatcatggactaattagacttaaaatattcatctcgcgattttccccctaactgtgcaattagtttctttaatctatatttaatgctccatacatctgtccaaagattcgatatgatgtttttagaaaaaacttttgggaactaaaccaaaccttagtaacgagcactcatctattacatagtagtaccacataaaaggttatatacatgcatttctttttgcaaaatttatagtagcatataggttataaatctacaaagttacatgacactccaaaaataaagcagaactaaaactaatctccatatttcccaacaaaaaaaacgcaaacttagttattggtagtgactgccaaaacatgcttgatgttttaaaacatgcaatcaaacaaaactctgttaatccaatctaatccaatttattgcttgtgttctgcgtactgcgaaactgcgtgatccgcggaataagcaagccgatgggccgccacgtggcacgcaaaaaataaggcccatcaggcttcaccctagcctgtgccctccggcccacgcagaaaattcttatgagaaaaaaaatgaagagggtttttgttaaaaccctgcgcccaactgcacagcccacccgccgccgccaccgcctgcgccgccggcgagagaccccggcccccgccgatccaaaccccacccaccacccgcagcggccatgtcccagctcgtgctcctccgccgcatccccgtccgccgccactgcggccccagcagcagccgcctcctcagctcggccgccgccggggcaggcggcgtggggcggcggggaccctaccagcagcagcagcaggaggaggaggagagcaaggcggtgaaggtgtccgtgtggtgggacttcgagaactgcaacctccccaacggcgtcaaccccggccgcgtcgccccgcgcgtcaccgccgcgctccgcgccgccggcatccgcggcccgctctccatcaccgccttcggggacgtcgtccagctcgcccggccgtcccaggaggacctcgtcgccaccggcgtctccatctcccacgtccccaacagttgcgtccgctctcctttccccacttcgatccccccctgcggttctgatttttgacacgtatcctctttgagttgttcttcgtctctagagatgtaatcatgaattaggaaatggtattgtcgcctttgctacgagtgatgcgccctagtgcgtatttctctggattatgcgttgctggaggagtgattgatatgagtttccatattattagagggttaatgagcaattgatcattcctttttgtgtagaaatggatcatgggtagctcatagggatgaatgatgcggagtacaagagctatgctctccttctgtttagccttacaaaggctacacatttttttttgtcatgggctcagatttgtcggctaatttttctagtgaagcacaaaataaaataaatctatttggttaatgtttacctgattttggtgtcaattagcttcaa

SEQ ID NO: 72797 - DNA, 8366 bp, Oryza sativa
cctccttgctggttaaggtgatgtccgacgtccggcgacaaggcccgaagaagcgctttgcctcaaccgccaccggccaccgccgttaaccgccacggtgtcatcgtcctcctccatagtgtgtcaccgatctgtgggctgggatggtggatcgattcagatccggggaagttgtttttatcgaagtaaatcatttactccgataatagtgggagcatgatgacaggacgtggggtgggatcggaagtagggaagttgtttttattatcgaagtaaatcgtttactccgatatcaatgggtgcgggatgacgggacatggggtgaggtgggcctggactaatacatgtttggcgctcggaatactaaggaacgcactgcgctcctaatagtactactcttttttttttacccttttgacatatattttttactcttacatacaccatagtttttttccttttcctataatatatgtaagggtaaattggataactcattgtagattttgcatgggagggtgataccgtttgtgcgtgtggcgattttggtaggttcaagaactatattaacccacatgataaatttgaaggactcgtttggacaatataaaagctaaattaacccacgaatagaactttagggatcatgataagtctcaggaccaccttcacattctcggttctgtacacaggtgtacgggacaagcatgtgccaccggaactccattcgcttgcgtacttgcacgggtagacgggtgatcaagtttctgggcaacgttacgcgtgactactcctattcatctttgccttcaccaacgtgtcaacggagaacactgaagacaacgaggtgaacggaaacgacaacaacactggagacaaggaggtaaacgggaacgacgtcgacggagaacactggagaggaggtgaacgggaacgacaacactggagacgtgaacggaaacgacaacaccaacagagacaatactgcctcaaactccagcggcggagtgccattcttatgatgctccaatttatcaactgcactaattcataccctaatttatcaattgcactagtttatatcctatatgcgtttatatcctatatgcgtcatgtttattgtcttaatattttagattaaaatatgtcaaattatgactaaatttccaacatgaaaccacatcgatatcaaatatatatgggcgtatcaaatatatatgggcagcttcacaaataggcataccctaatatacccatgttcaacatatgggcaaatccgtattaaaggtcctgtgggctgtggatgtaaagtgtattcatctgtgtcttcaatgtgcaagtttcaggctgaaacataccttaatcttgcatcatcataaatattgctgatatttagtaggggattttcggcatttcagtggtcgagtgcaacatgaagatatttaatatacgacagcataattcagagcataaaaacacataacactagtataatatgaacttatagcagtgtaaatcacaatactaagaaccacacttcacaaatatcattgacgctttaaccatactgccacatgatacaggcaactcaagcgtagcggctgcaaatcacactactctgggtttaatcaagaagttaaaatggctggtgcagcagcagagccacagacacagacttaaaggaacaaacgaaagcctcttcaagtagagtatgctgcaggccagtggccagcgctgaaactggctcattatttgtagtaacatgagataatgagagaataatatgtggatatggtattacttaagctcttctgataggagcatcagaagggagccatggttgcttaagaacatcctcaagttccaagctttgagcgaagaggaacagacttatcatgcccatggcatcatcatcaaatttctgggatcctctccaattcctgaaagcaaagcacaataagatcagccagaatatagaacaaaagatactgcaagaaaccaatctgaagagtacaaacattttaatcttcttgcaccgatcttttggatgtttcagggtcttgtcccggcccgacgcggtcagggccagcgcaggctccttccggaccgggattgatcagagtttcagttgattgctattcaaagtcttcatagtcggcctcatccagcatgtcgtcatcgtcatcgttgaaggcagcgacgtcggctgggtagcgcaggatcccaccgatcccaccaaagccacggcagaactgtgatccttcctgcgacttgttggtgacaaactccagggtgcagccatactgctggtaattctccgcgaaccactccagcagcaacggcttgtcgatgacatcaaactctcctgatgttgcctcgtccacaaagttgctctgatctgcctcctggtcactgttgaggtacttgatcactgtttctcctgtggcggtgttcttcagctcgtatcgcctgacatcaaggttctcccacacaatcagtgtatccacagcacctatctcgagcgccgttattgtatcctgcacacctaggacatacttcccggtgtcctggcttatctcctcaaagtacttgccgatcagcttcttttcttggacaaacttgacatcagacagcacctctgcagacatctcaattgcttggttgaagccactctcccctccatatgacacatcaagagtcttgattacctttgcttgcaagcgtggatcaaacatctcagattttcccagctcggtcttgaaatcggcagagccagcaagaataagcccagcgatgtttggctggttggtggctgaattgatgaagaactgggtagcaagctcagccgccttgcgcaggtagttgtgacgcctctccatgcgcaggcgggcaaagcggacagcagactgccctcctcgcccgtgcttcttcgggagatcgacgctgaacttgtaaagaacctccctgctgttgccactaagtgtaccatacagtgttccgttgccatccatgattatgaaaccaaacttgtcatcagactccagaagctcattcagtgcctctgtgtggaacttgttgtcacacagatacagcgaagcgttaatcggcctgaacggctcaaagtcgaaggtgaccttcttctctttgccgtcatcggtgacaatggtcccagtatagagcactaatccattcacgggaactcgactatacagcttcagcctctgttgggcagaagttatggcggccaacacggactgacggttgactctgctcttgatgttagaggcagttccatactcatcacccagcatcttggtgactcgggagacctgatcacgaggtggcatgataagcgaaatcatgctcgtaccgttgcccctggcagcatcaagtgccttgatcaatttcttgaccttccatacttcaatgttcttgtcggtttcatgtccctcgcccatcttggctagtgtttacagctctcttcgcctgaaagaataaaggtatggcaactttatttttttaagaattgattggtatgaacaagttaaaataagactgatacaaatacttttaatgaaccaaaactcatacagaatgacctaaatatgaatatatagtcagtgtaacatgtagacgtgcttaatcattgaaatataaataagttctggtcatggtgtatattaaatgaaaccacacccatatacagcaaaccaaaagaaatctatggagtaacttaatcaacattcacacaacacagcttttagttctcacaacgctacaatgattatatgcagcagactagccatccgatccaaaacagcacagacatcagaaacatatgcactgtgcgttgttccagttggggcaaacactcagataagtgaatgtaaagtatcagaaatggaacaattttagagtgtgggtctctgttttaacaaagttgtttttaccgccttcttgtaaataaataaaataaggtgcgaaccctgtagcttagtccacaggagatcagaaattgcactaagatcacagttcacaacaggagatcagaaattactgggcagggcattttgttggattcagacatgagcctatgacagaagggtgtgtttagttcatgtcaaaattggaagtttggttgaaattggaacgatgtgacggaaaagttgaaagtttgtgtgtgtaggaaagttttgatgtgatggaaaaattggaagtttgaagaaaaatttggaactaaactaggccgaagtaggacgtaatagagaatctccataaaaaagagtgtaatttttaagaggtttttacagaccagtcaagaaaacttcttgcaaactggaatgatatatcattaacagatccatctttttagcatcgatctgcatagagacagcacttactactaaatcaatagagactttgcaccctatgttttatttggtccttctgatccaacaacccaagcgaacactagcaagaaggtactaacactaggatagtagcgttgtctaaataaaatacatccaacagcgacgagatgaacctcatcatactattaaaagaacacaacaatcaagattagacatctcaaatatctctaaatctatccacgccgaaacacacccggcaccaccgaaccaaatcgtgagccaagaattaatatgttccaccatcttagagcacacacacaggaaaaaaaatccactgattttacaaactaaccgtgtaccgtgtagacgcccaatccaatcaagttgagaagaagaagaagagacacacagaaacagatacagatacaggagctggaaagctggaaggaagcgcctcaaacatggaaagaaattagagcacccttgcaatcatcccgccattagccacatgcgcacatgatgacacaaaagtactcccccctcccaaaatacaagtaaaaataagatcatataagacattctactcagtactatttcttataattttgtgacggagggagtaatagtagtagaagaagaggggaagaggcggcggcaaggcagccgggggtgcgcacctgcgtgaacgagcgagatggccgggcgccgcggcgcggcgagcgagaggttgcggtgatgttcgtgtgcgtccgcactgcgtgattatattggtgccgctttggctccgcgagctttagaagagaaggttttgagcgaggcagggacggtggtggcggagatcacgtcgtccaagagagagagagagagagagagagagagagaaaggttggcacacgtagcagcaggcgggagagccagagtatgtgtgctgttcaccaacccgtgcggcgtgggacaagtgtccccgcgtcgcgtcggtctcccgttgatcggttcggttctcctccttcgcgaagtcgcgcaacgcaacacctggcgcagcgaggcgtcggccaccgaacaaccgttgccgttcgcagcagcgagatatttttttgggtaggcacttttttttttaactttattaaaatttggtaaggttgaaaatgacgccctcagatcggagttttgtcagggtgttacgttgaatgtggttttgttataatgttatattcaaacgactctattttgctacactcctatttagaccaattttgattatttgcaaatgttttccactgtgatctgacttttttttttgcccctataactattttgttgacttacgtgtgacatatcgatcccaatccaattgtcgtcttcctctagatgcccctgtcgccaaacctagatctcccccgcgtgacagtgctccgccggtagcaagggacgtgggggttagggactgcacttcgccgccaaccacgccggcgccgcggcacaccaggcgctcaacctgaccgcgcaccacggcatcaccccattctccaatgagctcctcgacgtgggcggcgacctgctcgcggcggagctcctcattgaggcgagagcgtcaagaacaccatggaagctgctgaacctggcgccgacaacattgacctcgatgtctagcctcctaacgccatcggcgatgacggggccttgcgcggcgacgaccatgcgaggccagcgcgcgcaagccgtagtcagctccaccctgcagcatccagccccttgagtaggccctccacctcgtcggggagggagatcgacgctggccatggtggagctcgccattgaagagggacttcaaaatccaccatggagttaagccaatttgagtgggatttactgggggaattgatgatgaggatgagaggaaccgatttttttcattcaatttggggcgagagcaacctaggatggagatcaagagaagcattgtcgcatgatttcactggagaaagaaggatggtggcgggcagaggtggaagacgctcctccacaactgaggcaagggcatttgggtcaaaccaaataagaaaaacaacggaaaacatttgcaaataaccaaagttggttgaaatggcagtgtggcaggatggggtcgtttgaaaatagcattacaacgaagccacatttggtgatggcattctgacgaaaccctaacccgaagatagctaaatatcaattttctcgataccgtcgcgtgtccacggtcggctatgggttcacatcctccaccaattagaggggtgatgaatggcagaggcgtgtacagtaaaatgtaaaatgtgaggagcgtgtacagctctacagggaaattattgtagaaacatacaatataaaaaaaagacacatcagtgcctctttattaataccggtttgacaaaacctggcactgttagatggttttgaactaaaaataagttcatgataaaaacatgcttcacctggcattgataatcattcaatattgattgttcgacgacacatcagcatcgggtcttgccaataaccagcacataagaataacacatcagtgttgaatcttatatttatagtgagatgaatggacttttggcaggaaagtacatcagcgtcgggtctttagaatacagacccgacacttatgccaatgacatcagtgccaggtattctaatgaccgggcactgatgtcgctaatcatattagtgctgatttcagatatatgaacttaaccttttcgtatgaactcggattacgacaaagtttaatgaaaattgtagctctcgacaagatctatgattttatagttgacaacttattcatttgagctattttagatactcaaattcaagattcaaatcttgcttatgaagactaagaaggaaaatatccatttactaacaagatagattgatgcgtaggtgagttggtaaggatagttgcatcatgcatgtgaggaggatggtgtcttgagttcaaatctttacagtggcaaaaattatattatatacaacttgcgaaaatagatattagtggttgtggctttatacatacatgagtaaagatggtaggagtattcaaaaatattttttagcctaaattttgaatttggatacttattatcacagatgaacccatttcagtgctgagtacagataagcccatatcagtgccgggtctagagaataccagcacacatgagtctatccagattctatctaggtgcttctaggcactgaacaaagggaatcatcagtgccgaaagtttggtgtcaggtatattcacttcactatcaagcatttcaagccaactgacattgtccaagtgcaggaaaaggcagtaagcccccatcttactcaagacattcaatagattatccttacatcgtcccaagactgctcatgataataacaatggtgcgcacaaacgacaaagcaaacatctcaacacatgtaaaccccccatctagatgaggtagaatggaaacggaatcaaatgatcgaacgcgaatctcgctaagttgtgagttccatgatggctgtgacgatgtcgccattggcagccttgagtgccttcaccgccttggacctcgacacggtggcctgggtcatcaccagctcgatgtccttcggctcgacaccagtctcgtcgacggcctcatcatcttcctgggctgctgtcgacgcctccggcttcgagagcatgctgctcagatccggcgccttgaactgctctgcagcctgggtctgcagctgcgagctcaggtcctcgatcttggcctcgccaaaaatgacataggtgtcggatgtagggctcttgaagacatccggtttggagatgacaaaaaggatctgaaatggggcaaaagaaatagcaaacatcaacaggaatccaactaatagaactatttagattggctagataagagcagtcgtaagctcacattcttgctcttcttgacagtaacacggctcacaccagtgataga

SEQ ID NO: 72798 - DNA, 556 bp, Oryza sativa
agttggtgactaacttgttagtttcagaggtcaatgagatagcgatgcatgaggttgtgacaaccaggtaaggtgattgtcacgcccagaaattcccgaatagaattccaagcagaatgtgcattaaaattcccgtccaggaccggccggggtacacaaacgacaaagttgacatacagatccacgtcttacaaacattataaaagtcttacataaatgtagcggaaaacttaaaaggataactggagctaagccttgacttggactgcagcgggaacaccactccacaggcatcctcgacggcacggacgaagcctactcctcggagaaaccaccatctaatgcatactcaaattctgggggttggggaaaatagagcaagactgagtactacccactgtactcagcaagtcataccggaataggggtatgatgcagggaattatcaaggggtagctataatggttcatttgcataaagcggacatttataaacagaagttgaaagcagtaaaacagttgtaataattaatcaatattaatcatccactgtccaa

SEQ ID NO: 72799 - DNA, 1914 bp, Oryza sativa
catgcctacattattaaatactactctatatccccatggatgacatagagtaatcgaatattcagaccttaaacccacaccactgcacctctctggtaagctaacccacaattataacaacatagatataaagtagaacctatactcagagaatgtaaactaccgaaagtatatccgctatgttgtattgatctgatgatatggttgtgaatatgcctttggagggctcccttcccatcttctacaggttgggggcagggttagaacggtaggaatacgacatcagttttcttcatctactttacaattttaccaaaccaggactacaggtcgtttccttgatacacaagcaaacgtaatacccgaggcccctataatcagtcggatagcccatccatctacgtatatggtaccataatctctacactgacaatttaaaatacatagatccatcacaattaaggtaaaagaaaagcaaaaaaaaaaaaacacaagtgtaagaatatatggatctaaccatggtcaaatgtttactttagcaccacattgtcaaatcatggcgcaattaggctcaaaagattcgtctcgcaatttacacgcaatctgtgtaattagttttttttgtctatatttaatactccatgtatgcatgtgtctaaacatttgatgtgacagggtgaaaagtttttgcgtgggaactaaacaggtcttaactcatgaggcattggcgtaaaacaaatgagaaagtttatttatttgccaatgatatcatcgcttatcgtatgctcatgtcctcaggacaagacaacatattgcaattatcatggcttattggaaatacaaagagacacaaaacaagagaagttgatagcacactggcttggatatcaggatatccaacttatttatgactactccaggttcatagcctcgtatgggcttcgatgtgtgtgaaaccctttctggttgcatgttgcgtttgattaggacacaacggtgacagtctgagcttcatttgtgcagaagcgatcgcatgcatgctcgcaacgctccacggcagcattcactccttcattggcagcaactgaaatgaaaaggaaaatgatcgtacgcattggcctttttcgttgaaaactaatggtgattcagtttcatgtttttccagcttacaagtgtttatcttgctgcacactgaagaagtacatcccagcttgcagaagtcaagtacatctgatttctctgcaaaaccatgcatttctatttatattatagtaaaactactgtcgcgaccgaaaaaattaccttttcccgaacgctagtgtattaatccccatcccaggaaaagccaggtacaccatacaaacatgatataaaaggcacatatttattatatcgataatatttacattattacaaagacactttaggcctgacaatcaaaaataaacagcagcggactagcgggcctacgtccatttcacaggcgctcaactggggtataaaccaggactccacctaaaacttcttctccaaagcttctcttactgaaggggggagaaagatagagcaagaatgagtacaaccacagtactcagcaagccacaccggagatgcataattaatgcaagggagtacaaagggataataatataggggttgagttttgcaataacaacctttaaaagtcacttaattgcccaaagccattttataaagacgatcctagagctacacagtattattaaacaaggccgggaccctcaccaaccttccttaacccaaggcctacgatgattaaaccgaactggcaacccgaccctgagtaccagatatcccaagccaacccaagccaaccattccacattttagttgttgagcacattttaaagaatttgaaacactgacttgggtaca

SEQ ID NO: 72800 - DNA, 923 bp, Oryza sativa
acatatgtgagtacgtgacacatacaattgcccaagcccactttccaccaatatccagatcagtgggcaggagagctagtggacagtaggttggttggagccaacaatgcccacttctggtatatgccaccttggacgcccaattgcccaaggctcaggctgctattcagccgttgatgccgcggtcaccagagacgtctacactacacttgcacttctgcttttgcttggaatgattctggagatcgagatagatcgagatagcttctgccaaagccgtgcaggatgacagggccatttcttttctttctttctgagttctggaatcatgcggtgcgtgcagcggttgtttgtcgggctatgttttgacagaatttttatagaaaaactctcgattccttaatgaacaagattgactttgaaatgctgtcactggcctaaatacgtctgcctgtctctattggccgttagctgcttgttggcctataagctgcagtccgaatttgaattctataactttaccttttagagttgattttggttttttttttcgttatttagcttgccttttggacctcaatcaaagaacagaagtataaaaaccttaccctaaagttatttttgatttgcttcatttatttttcttagcttataagccgtagctcagacttcaaaagtgtttaggaatttggactccagcttctattggagcaattgtggtcgcccctcgggctgtagcatgccacacggagccactgcctaggagcaacattacgcaagcaatggtcttatcgtggttgggtattggtaaaaaaaaactatcgcaagttttttgaaatgtaaaatctttgccattaagatgcgattgggttaacctcaaaccatcccaaaaaagtcctgaagtcatgcaaggaggggaaaaa

SEQ ID NO: 72801 - DNA, 597 bp, Oryza sativa
gtaggcaggccggcagggcggggcgaggcggggcgcgtcgaggccgtccggccacacgcccacacccgaagacgcacacgtgcgaggccgggcggagaaggggcggcggggggcaccacagccgcagcgtcagcctctgcctccacattcgccgccgctcccgacgacgcacaagcgcgaggccgggcggagaaggagcggcgggggggcaccacagccgcagcgtcagcctccgcctccacctacgccgctactcccgacgacgacgcagccagcgtcgtcaccgtcgttgtatctccaaagctcgcactgctgctagtgcccgtgtcggcgttctacctccgccgcggcgcgccgctgtttctcacgccgcgacgcgtgctgctggcgggcgtggggctcggcgtcttcaccggcgcagatgacttcgtctagaaacaaaaatcaaggctctattacactatttagctcatctatttgattggctccttttgttttctgcacaacacatgcatgcacagcatgctgtcaactatgtttagtatatgctgcaaggaccgaccctgccgttcgtcgagctcggctacaagcacgccg

SEQ ID NO: 72802 - DNA, 652 bp, Oryza sativa
cctgcagcccgttttgtaatgactttaatattaaatatacagttttgtggtctttaaccttaaatctatagttttgggataaatttagtgctaattctatactatttagcctgaaattttctctaaatcttttccagttgtagtagcacaatagtaaaaagagcttcaatttcaagttgaataaaagaaattcacgaatttcagtttgaaagcacgataatttgggacgatgcagttgaaagtggaagctccgaaaggtgagaactgagaataagcgatggttaagaccataagcgacctgcgaatgacaaccattccccaagatatcacaatggtcgttcattgggggttggcttaaaattttgcgacacctaatttcttgtacatgaaaatttgtgttttagtagggattacagccagtcccttcaaatagacaataatatgatttcaatatcctaatcgatctgcctaaggaaacagtgaaatgctaatcgaataattgtctggcaaatcataagtcatgtgcaaaagtagatcacaaaatcctttcgtcaggaagaacagtctcaacctccacagtaatgcatcaacaaatagtaacattcacgctccaaactttgctaagccagaggctcattgcccaaagcatcaa

SEQ ID NO: 72803 - DNA, 829 bp, Oryza sativa
atacatgctttcttgttcgttgagaagaatctccctgaaaaatattgaccacactagtactagcaagaaaatacatatgaaatacaacaaacaaagtgtacgactgcctcaaagacataccttagttggtgtaccgaaagtccttgctttgcaggtaatgctggatcaactgagagaaatggtgaaatggttgtgctttcagaaacaccagcattcttttgttgttctatccgcctaagagccagctcacatgtttcctgaacctccacggcaggatcagcagctaaactctcctcaagcaggggaatgctcttctccaggccaatagcaccaagggcttccgcagcctaatcaattgatatatatatatatatatatatatatatatatatatatatatatatatatatatatatatatatatatatatatatatatatatcacttctcacacggagagcgccgcactaaaaggagaagatggcctcacactcttatgtatcaccaccccacggcggacaattggatgaagtgaaagatctttgcgcactgcctctcacgcagggatagcctcaccctcgcgcatgcgcgcaagcgcacacgcaccctcgcgggcgcgcaagttagaagaaccccgcgcggctgagcaatgcatcacacagacaaatatattagctctctaacgctcctttattctagcacgctccatcaatgaataagtgtcactaaaccacacgctctatcattgatgtgagtgggtgagagagtgaggtaagaccttgggggagggcgccgcgggggccatcaccatggggggggcggagggaga

SEQ ID NO: 72804 - DNA, 5318 bp, Oryza sativa
ttggaaagactttcgataaaatccattgatatgtccacccaggcttccttaggaattggtaatggtgttaacaagccagggagcttgcagtgttcagacttggcctgctgacaaatctgacactgcttaacaaagttagccacatctgatttcagacctacccaagaaaataacttcttcatcctttgataggtagcagtagagccagaatgacccccaacaggagaagaatgaaaagcattaatcaatttcgtttgtaatccagtgttagctccaatccatactcgttcatgatgtctgattaatccatcatgcagagaaaaaccttgtgtattaggagattgaacagccaattcggtcagcaaagtttgagcagcaggatccactggataagaatttaacacctcctggagccagaggggagaagccactgacagtgcagcacaatgaggtataacaggcatcctggacagcgcatcagcaactatattgtcaactcctttttggtattgaaaagtatattgaaaacccatcaatttagtcatagccttctgttgcaaatcagttccaagaacttgatcattcaagtgacatagacttttgtgatcagtgcgaatagtaaaagggcagtgctgtaaataacatctccatttgtcaacagccatcattatagccaaaaactccttttcatagatagaaagtttctgattagctggtcccaaagctttgctataataagcaataggatgattcaactggctgagcacagcaccaactccataagcacaggcatctgtctccaaaacaaagggaagactgaaattaggtaatgctagcaccggggtagaactcatggctagtttgagctgttgaaaagcttgttgagcagcatctgaccagaggaatgctttcttttttaataacactgtgagaggtttggctataatgctgtaattcggaacaaatttgtgatagtaacctgtgaggcccagaaaacctctcaactcagttgcagtttgtggaacaggccaggctaacatcgctgcagttttggcagcatcagtactgacacctttagcagaaattatgtggcccaaatactctaattgagcacaagcaaaagagcgcttagacattttggcatataactgatgttgtcgcaacaacataaacacttgtctcagatgatgtaggtgagaatccaagtcagggctgtacactaaaatgtcatccatgaaaaccaatacacattgcgaataagagatgcaaatactgaattcatcaggcattgaaatgtagatggagcatttgttaaaccaaagggcataaccctgaattgaaactgcccatgatgagttttgaaagcggttttaaactcatcctgttccaccatacggatttgatgataactggctctcaagtccagtttagagaagtattgtttgcccgctaactcatccaataactcatcaaccaccggcattggaaacttactcttaatagtgacagagttgagtttgcgataatccacacaaaaacaccatgtcccatctttctttttgaccaacaagactgaggaggcaaaagggctcatgctgggagtaataagaccagaatcaatcatgtccttgacttggcattcaatctcatccttttgtaaaggagaatacctgtaaggtttactgttgacaggagcatcatcagggtacaagaagatagcatgatcaaaagtgcgatgaggaggtaaacacttgggctcttgaaaaacatcagcaaactcagacagtaatggagctactacttctgaaatggactgagaatctgcattgtcagtaggttcaagcaaaacagcagcccaaatatcacaacccttctgccatttcaatatttgagggtaagaaatagcacataattcagtctgggaatcagactcttgaacaccctgcagtgcgattcactgatcttgatagaaaaacttcagagttttagttgcccagttacaagacatatcaccccattgagccaaccaattcatccccaatattgcatcatggccccccgactgaaccactttcagatcataagagaatgtctgaccttggatccaccatgtgaaattagaaaccacatattggcaagagagaaactcaccattagctacctgaaccaaggaaggggaaatagggcacaactgcaaacccaacagctgagcaaaattgagatcaatgaaactatgagagctgccggaatccaccaacatcaacaatactttattctgaaccaatgctctcaaacgaatagcattatggcgagatgcaccagataacgcattcaaagaaatatgatactgctccttagcatcagaatcttcttcggtagccactgcattcaaaagatcatctggaataacttcagtgatttgcatagcttttaattaaccagtgatcacacactgatgatcaggtgaatatttatccccacatttaaaacagagtccattcgctcttctatattccttcaactgtttagctttccataattcagctccttcaagttgaatggccgatggctcagagacaggaacagacgtatccactttagcgccaacccctttgtatgtcaatttcttaagaggtttctgtccactgtctagtaacacactttcttgcactaaagcaattgcagcagcctgctgaacagtgtcaggtaactggaccagcacagctgagcggatttcttcctttagacccagaataaaacgatacagcagcatcatccctcccacagatggatcaaacacacgcacctggtacactagtgaatcaaactgggacttataatcggcaactgaaccagtttgccgtaaggtttgcagcgcctgaactttttcacgctgtgcagtactttcaaactcgagagcaaccgcataacgaaattgagaccagtcacaaatctcttctactaacttaaaggattggtaccactgtgctacatttccagacatatgcaagactgccgcagaaaccttaaacatagccggaatttggtacatgtcaaaataggtctcgcacatatctagccaaatacggacatcagagccatcgaaacgaggaaaatccatcttaggcaagcaactcttagcacgaacaccctgatcaaaaccctggctagactccgcttcgttgcgaataaacacaggacgagtatggaaccttggtggcggcggcggcggcagtggtggtggtggggaaacacccgcattgccaagagaaaccgcagatggggagcccagaatactcacttgatcggaagacgccaaactcttttgcagccgcgccgcctgaagctgatcttgctgcagcttcccaaccgcctccagagcgagatccaccttgacgacggcctgatcgagccgccctccgtgtttcgtcatcttgtcgtccatagcctccatcttctgagtgagtaactccaacttctccaacaatttcccctccatcgactcgagcgattggcataacggagcgctgagcttgatgggcgccgtggtgagcgttcgctccaaatccaaccgaacctgaaccggacttacagcagccgcacccgagggtagccgcctaccggagcatagggattttaccagtcagatcgagagaatttgaacgcatcaaccacggaaaacccgaatctgataccactgtaacactactagatcatagcagaggaataactagagcaggagaggtgaagaacagaggaggaggagacagagtcgagaaagaaaggggcagagcagagttgttgagaggagagattcgtttttcctttcttcatttcacacctatctcattacagggttccttacttataaaggtcatacatgccagcctggccgcttggccgaatcacacaacacacatgcgcacacacccacccgacacgttactgtaaacgtcatcctggcattgtagctcgtcacacgtgtggcacaggcatgacattataattggtatattcgtagctgtgttactcaaattttacaaaattagagccatgccatcgtcgtcacgttttccatcttccccatttgtacatgaggttcacctgttagattcgtcttcttccttcatcctctcatcttctcttttctttttcccatctctctccaccatttcttcgtttcttctttcttcacatgtagagcagaaggaggagaggagcggggtgccggtgctccagtggctgggaggtggcgacgcagcgaccgaatgtgttcccgagcttggctcactcgtggaaagtgtcggccggtacagggagctagggagatggccagaacaatggatggaagggcacaattccggcggcaaagaaggtgatggtggtggtgggatggggtggctaaaagagaggggaaactaggggaatgggttctccttggtgaggcaaaccggtggtgcgaagatttggtgtgaggggagccagtgagggagattgattgatgatgaggtggtgggcagacatggtagagaaagaagaagagagcgacaatgatggaactaggtgtggggtgcgtcggcttcgggcaaactgcgatggcggtggtgcgctgaggacgatgccctatcccccacgtggatgccgttgaggaagaggagctcatcatcgctggtcatctccatgaggagctcgtcatcctcttcctcatcctcctccatggacaaacgtgcgtagaggcgtggtcggggagagccccgtcgacgagctgctctggtggctcacttcctcggctcctcccacgaccaccatagatggcggcagaggttgaggttgcacggaggaggaggaggaggaggaggatgagggagcttgttgcgggtggtgccagcgagcgagttgatgtgtgggcgccgagtggttgtgctcgccggtgtaggagaggttgaaggtgtttgggttggaatgtctcctctccacttgcttgcagcacaacagcagcagcacaaggccgccgcagcgcagcctgctcccaatggcgccgaccacgccggccgctccgcgctgcccacgacgactcacccatggggaaggaagatgataagggagggtgaaaggaagaaaataaatctgacgggtgagtaacacgtgcagataggagagtagatgaaaaatgtgatgacgatgatattacgaatagacgaattataatgatatttatctaaataaacatatttaaaatggcacggatcgaataaacccaaacaagggtatccgggagggacgcacgattctacctgtttttgttatttttggcccat

SEQ ID NO: 72805 - DNA, 10286 bp, Oryza sativa
tttctataaatttgatcactaagaaaaaaaaatcaaaacgagttttaatatgaaatgggggaagtatacaagaacagacataaaaaatgaaaagtgcatagactaatgtttgtacaccaaagacataagataggaagcacaggcatcaggtaacattcagacattgtggattcgcgaagaacctcaagtttctcacttcttcaattatctccactagagctttgcacaacacatgtaaatgaattcaatcaagggaaataagactgtaagagtacctaaccagtttgactaaaacaaatccactttacacaaaacaaagcagattatgaacgcatataaacagaaaatgagttcaggttaagtcatatcaacagaaaatgagttcaggttaagtcagttggtgtttcattgctgcagttctgctttgaaccttcaagtctcccacttatttcaacaaaacacaatctcagaagatcactgtatttagttagtaatgagttgatgcataagctaccaaattatctaagcacaaatttgactacattcaaataaacaaagcaaatggtacccaccttctatgtccaaaaaggaaaaagaaggatgtgttcaggtcacaaaatctaagcacaaccattgcacatgtccacactgaaattcttagctggaagaatatgtaacatcttgaattatccaaaagagcaacagaacttaacaattgaagtgcatatcaattcaggactgaccaagcagaagcttaacagtttaagcgtacatcaacagaaacttaacaactggaattggctccttgcaagtgactttttataacaattcaggactaatctcaagatactacatattaatctttctgtcagaaactgatccttttccctatacttcagtgactaaatattgcatacaaattaaattcaggacaatctgcatatatcgcttcggtacaacgtaaagaagcttgaattgaaatgcaaatttatcgaaaacgcatggacaaactaagtgaacagtaggtcacttgtagaattcaaccactgaattgggacaatgtcatctcatcacatgataatactatcaaaaaccaacagaacattggcattgtcagaaaacagagcattgactcagaaataagaaatcaacatactactgacaggttagtttttcagcaagctctcagcaagcagagagcttctgttcttgaacatattcacttgctcattgttcaccatcctggttaccttgtacagcttcaagctgcgactcgaagtattcccaggcagcttgcccagaactgatgacctcttgagcacagacccaagaattttgacgaccatgttcttcatcctcatcatcttcattatcggactcttcatcatcatcactgtcagactgttcatctaagtcattgctcggcaacttgtcactttccacaggacctgaaaaattttggttccaattcagttgtccattgactccattcaacacatacaagccatttgaatcacagtgtaatatcataaaggaaaccagtgtcaaattaatcctaggtatattgtaaggctacatatcaatcctagcctcctaggtgttgcaagggcacatatgcatcaaccatcaatgttgagtaaaatttgcatctggttcagagttcagacaacataccattttcctcaaacatgtttgatggtaagagccaggagtgaagaaattgtgatgggtaacagaagtcagtgcgcatctccaagctcttggacatcaaaactctcttggaacgtatgtcaaaagagaacagcacatcttgttctataaagtatagtacagcacagtctgtcgggtcaatcatagcaatggcaggaactttgcccggcgtcagcccggaggtcttgtagatcttgtcgccccatatgtccgcaagaggtgccttgtactcaagctgccactcggggctctcactctcagaatagagtaaactccataagcaagcctctccttcatctaactgaacgtagcatatcttgtcttggctgatcttgacgcaacgccgcttctcaagattgtgacgcgatctgatgtcggggaccagcataaggcagccttccggaagagccacataagtcagcttgggcttctcaatgaacggatcgcagaaaagaagtcccaagggcaggtcgacgaaccaaatcttgttcatatggcttagcacaccgccttgactgccccaaactgggtgttgcaagcagttggtaaggggcttgacaacccactgggaacctgaggtgtaagtccagcagcgcagctccatgaactgcgggctcgaattggtgcaaacgaggcaagcaaccatagtgtagtctggtcgaatcggatcttggacgacgccgatgcttatgactgggggaatgaggcttggctccatgggggggattggcggaatcatggtggcgactcgtgtgtgcgcgtcgcagaagtagcgcacgccgttgaaggcggaggcgacgaccattccagacccgtgtacggcgacgacgaggggagtggttggtcttgggcgtgacaggttcacggagaagggcttggcgcgaggtacgacgaagttgaagaagccgatggccttgtcgacgtagaggacgctggtgccgggtggcttctccgacttgaacgccaaatcttctccgggtgggagatccttgacgcgggttacggcttgcagtatgacccacgagcagcgccgtgcaggagcctcgtcgtcctcgtcccgagcccgatcccgatcccgctgcgcgtcctcctcctcctccttggtagtcagatgatgagctcccggcggtggtggtgacgcagcgcctccccccttgaccatcggagtcggggtgcctccctgattggcatcccgcggctgtggtgcgtctcccccctgcccgtcggagcccgcggcggaggagtgcctccctgcttggtcgtcggaggcggtgccggtggtgaagaagcagctcctcctggccccttgcccgtcggagcccgcggcggaggagtgcctccctgcttggtcgtcggaggcggtgccggtggtgaagaagcagctcctcccggcccctttcccgtcggagctccgccgccatcctccgtgctcgccggagcacgcggcggcgagcccccttcggccatggcgcgcgaatggtggtgggtggtggcgatcgagggattgggaggaggaggaggggctcggagtcggaggcttgcgggggtctaggtggggagggtttatatctcgtctcgacctcggtctcggtggagtaacgcgcaagttgatggccggcgttataacggcggcgatgctacggtcaccgctacacagcacagacggaaacgggtagaggaagagaagcctagaaacttctagaaacttcgaggttgctgccaggtcggagtaaggcctggcggcccatgcaggcccagttcagacgccatagcccagaacttgcgcgtcggccacacgcaaccactgacaaacggagcccacccgggcggcagccggatatgcgcaaggcgtaaaggccctctgcttcagattttggaataagttcactttgggtccctctatttgtcgcccagtctggttttagtcccttgatcgcaaaaccggatacaacaggtcccccaacttacgaaaccgtttaaataagatctctcggcaatatttgaccctggttttggctgaggtggcacctacgtaacaaatttgactcggttttcatctgacgtggcattgacgtgtcgcttacgtggcaattcggtctgaaaaataataaaacctatgggacccacatgtcagtttcacatacacaataataaaaaaaggtggggcccacgtggaccccacctgtcgtccacactagacactaccccttctctctctatcctctctctccctcctctctctccagctggagcgcgcgggacggagcggcggcggccggagtggggcggggagggagtggcggcggccggagtggggcgggcaaggagcggcggcggacggagtggggcgaggagggagcggcggcggccggtgtggggcgggagggagcggcggccgccggagtggggtggccgccgcatcgcccggtatgtcgggcggtcgttctccgtcgactaccgccgctccccggaggctaacgcgatggcggcggcggcgacgagggggcaccgcggcagggaggctgccatgttgcatggcggtagcgccgtgcgctctcctcctcggcggccttggggccgggagctcccgcggggccctcgttgacggtgaccacggtctgggagatggcggcggtggcggcggtggatggctcctcagttgactcggcggaagggtatccatcctccgggtcttcgctcacgccgggtgcaaacgccggcgacggggcggttgagtctttgtctccttgtgcaggcaggacgcctccctcttctctctctcccgccgacgcagccggagccagaggcgacgtgcagcggccgagcgatgagggtcagcgcgcggcggccggccgaggaggggcgcggcggacgggcgaggacaggacggacgcgagttctggacagagcgtcgtcgtcgtcgtcttcggaaacaccgcagtggtcgtcgtcgtgctctacccgccgcccctctgttcctcccgccgctcgctgccgctccacccaccgcctgccgcctctcagctccatcgccgcccctctgtgccgcccgccgccgctggagagagaggggggatagagagaggaggaaggagggaggatagagagaggggtagtgaggatcacaggtagggtccacgtgggcccaccgtttttccattattgtgtatgtgaaactgacatgtgggtcccataggttttattatttttcggatcaaattgccatgtaagcgccacgtcaatgccacgtcagatgaagaccgagtcaaatttgccacgtaggcgccacctcagccaaaaccggggtcaaatactaccgagggaccttatttaaacggtttcgtaagttgggggacctattgtatccggttttgtgatgacgctctctctcgtggctcgatcttctggtgaggggataactctcgctttgatcgagtatgacgtttgcgacggagctaccaaccagaacaagtccaggacgccgtgcaaacgctacaccacaaacgatgtcgtaccaaccgtgatgcgcggttgatgatccttgcaatgcaaacgagagaacactgcaagaacaagataagatgcaatctaaagttcccttacttcctcatacgtggctctacagcctggcccagcccccgctcctcgcaccgcgcaaggcgcggacacaattggggggcctcggggtggcgcgtcaggcccctcggggtgctatgtcagcctctcggggtgccacgtcaggcccctcaggcccttgccctgcctggacccaaggcccttgcccagctgccatgtggcgaggggggaccaggctaggcggtcattaatgggcggtgccccaaccgtccctcgaagcatttagtgcggtcagggcggacgtgtggagccacgccactggcccgcctcaaatcgggcgtaaccggtctgtgaccggcctgtcaccggtcacatccgattgacgcgcggccatgccccacgtctcctttgtccccggtggagtggaggtagctatgtattgtcacatcaggggcatcatctggactcctctccacgagaggagggcagccaccggtctgcgctcatttaagagcgaatgacagggctgcccccccacccccccccccccgtgtcaggtggaggacggcgccgggccccaccaaagggccaaccgtggcttggcttccgggcgaaggcattcgctcgtttaagagtgaatggcagggctgtcccccgtgtcaggtggaggatggcgctgggccccaccaaagggccaaccgcggtttaacctccgggcaaaggcacgggccgcggattggccacgggagggtgcccccctcccttctccatggaagagtaggtagaggcggtgcatgtggtatccccttagactataaaaggaggaccgtgcccactaaacaaggggggatggttttcttgaatgaagccaaggcaagctctagcctcaagttggtgatgtccttggtgcagttctagagtcgatcaaagtagaataggagagacaagctctctggagctagaggaactcttgtacttccgatctatattcccacacacaggagtagggtattacgcttcgtagcggcccgaatctatataatccttgtgcttgtgtaagctttagtggctttaaccgcggataatcgacctcccagagtgcacctcctcctccggccgaactcacaaaaggggatctcacgatctcccgctagagaggattactcctcgacagcgtcaaatattcatgatcggagggagtattatttagggcaatccctttctaatgacatatgtcttgtacaaatacacgagtaatttgatttaaaaatataaatttgaatttaactggtttaccaaatggtttgttaactcaagttgactcgaagcctcgaaatttcatcaaaaccaagcgattttcattgtttatttttaaccctactgccaagagctagccaccagcctgtgctcaagccattttgaaggaaatgcttaccatctcccctaatttaatattgcaaaagaagctatatttgcttctttattaagattatgtctgtagttgtaacaagctaggcccatataaataaaattgggatatatagaatgagaaggtggattgagaataaagcattgattcgtatggtggttatgcacatgacgtgagaagaagcggaaggacgtgcggtatgcgctgtgagaggggatggaagatggatgactccacttgtacaataagagatgttgatattaaatcctttgtagtattcctcatgacgacaaagtaacccacgaaagcaatccacagaacaataataaggtacaagatgaccatcaacataattcatagaacaatattaaaaaaacatacttaaaacttcactacaaaactttttttggtggaacaagatatccccaactaaaaggacactacactactgagtgtgaaaaatcaaaaagcaagaggagaagagcaccattgctcctcttttttttttaactacttgggacaccaaagagacactgagatcaaaggcctggacttccagcagagagcgagcctccctttctcctgatgcacaaccccaaaccctccaccgaagagcccagccaacatcttcccctgagcaacgctgaagccgctcacctcacgagccctgagcccttccatcatctgggccccacctgccagtgacccatacctccccacagcgtcctccaccctgggccccaccacctcctcccccacgcgcctcaggctcagccacgcctcgtcgtcgtagctcacgaggcagctcgccgttgactccatcaccgccgtgaagtgggccaccgcgtcggagaagaactccgggaacggcggcggcgcggcgagggacggtgatggtgggttcttgctgattcgggatagctcgtcctcgatcaggatcaccagctttggttgaaggattgtgatcgtgccgaggaggagaagcttcagcctgctgcgcaatggcgtgttcgtcgtcgtcgtcgtgtcgtcgcatgtgaggatcaccggtggtgatgagctgccgttgcagatcatggcgagctcgtgatggagttcgtcgtcatcgtcgccgtcgtggacgtggagggaggtgtagcggaaggggaggtgcagcgactcggcgaactccgacagccaccgccgcgcatcggccgtgcggggcgtgccggcgccggaggtgatgacgtccgtgaggtggaacagcggtggcggccggcggcggcgaggtctgacatgagcgacgaccactggacgccctcgccgacgttgaagtcgacgacgtggacgtcgaggtcatccgccgtggcttcgaggatggcctggttggcggtgaagtgggcgaacttgacgaaaggcgtcagctcttgcagcatccggtacgccggcgacgaccagttggccgccggcggcggcggcgacgacgccggcgtggccgcaccggagatccggagcttgaggcctcgggcgaagtagtaggccaggtgatcaaccgggcttgttgcttcacagcttcttctgccggcgatgtcggcgaggaggtcgtcaagcctcgacatgatcgccgaggcgtggacagcgtctccggcgtccacggccatggcgccggcgaggagaaggtcacctgcgctctcctcctgggttgccaccacgttgccgttctcgtgccctgccactgctaatctctcatcaaattcaaagctagctgctaatggatcagcattggggacagagaaatcatcttgcagttgcagcaaatcattagcagattcttggattgccatcatttccaagaactcatgatcttgatgaatctgatcgtgagagtgatcaccatcaaattcattagcagattcttggatcaccatcgtttccaagaactcatgatcttgatgaatctgatcatgagagtgattaccatcaaattcattagcagattcttggatgaccatcatgtccaagaactgatgatcttgatgaatctgatcatgagagtgatcagcatcaaattcatacatattggcattctcatgaggattttcttctgcttgaggagaccataggaggaggctactgctactgatctcttcaaattgtgtggagaagggaatgagaagggagcaagggtatgacatggtctccattgatttgttttgtgatttgagctgttaactcaacatgaattgcatatgctctggtttatgtggttttacacagtttatgtagacaaggatgaagcgggtgttaggaccatttctgaagataggagtgaaataaatttatatgtgtggacctaggatcttcatggctaatgtaagctgatttgtctgatcttgaagccccaaatgggacattcatatgacaaaggttctttttttgttgcctttttgtgtagttccctctaccaactttgtaagatatgtgagcaagcaatcgtgccaatttttctgattgattagaatgaagtagcagaggaagtgagcgtgtgcatgccaggcaatattcctgaatgcttgttgctagatgtcagcatgtggtttagttttgaatcatatgagaaaaacgattctatgcatgattctacaacctgtggacaacagaaatcactgacaagattcaatccaaggaagaagaaatttatgctatgatcttaattttaagagtgaaacaaacagctccattactctgtcatctggataagtagatgatgtctttcagtcagaaccagcagaaatgtttcagactgaaactttacatatggcctgcatgacaagtacagttattattcttactcctcttgtgttaatctgtgctcatttttttaaacagtgtccagtaagcccatgacacagacatgttcattctttatgcatatgcagtagtgtattaccaatcatgcagcaccgttactgcaaaaactgatattaaactcgagcagttttgttatatagctggtagagcattgattctaaaatgttgatatttaaaagagatgcatgggatgcaaccaatagagtgtagtaactcacttcttgtctgaatggggtagatgtgatgcagcagaaagggaaattaccaaaactaaatgcgactcactgagatattcttggttccaagatgataactcttgttcttctatctgaacttttgatttttttctccctggtagtttgacacagtattagattcagtaaactgataaatcttcagaatttgatcattcagcaacgtttcagccttctacagactgattcacatacacacacacacacaaaagaagcaacgcgattaggtgatttgatcagcttcaagcaatggactatgaaaatgaaacacaaaaaagaatatatattttttgttttctgccagacgtttggaagtgactggtattagaagacatataagcattcatgacccgcacgagaacaaacggtggaattaggggaacctcacgattgtcagataagatttctttagtgtcagactgtcagtactcaatagactcgtggattgtttatcacgagcattcatc

SEQ ID NO: 72806 - DNA, 1173 bp, Oryza sativa
taaactcaccaacttcctaacactcaaaagcaaacaaacacatgcaattacatcccaccactgatgtaaatcacatgcgagccacacacaagcaaacttaaagcaaacaaactaacacaacgatctaagacaacgacttaacaagtcactctagttcttccaagcattggaggtcgattgaaggctcgttcggctcgtcttcatcatcttgggttgcgacccactcaatcttggaatggttgcgcttggattcttcttcttcatcacttatgatgatgaccgaggatccgcttgggatggggcaacttctttctccaccacacggacctttggcgccaattgatagcgagggacaaataaagctctcttccttgcggtaagacgaatcctggccttctgcggcggtgcttctccctttaacgcggctaattccttttccaaacgatccaccttgtcttctaacttgcaaatcttaccacgattccggtcttcacgatcttgagccgctaacacagtctccgcacgaccttcatccatagcccacagcatctcaaccaaatgccttgtggtagcatcattctcaattccttcagtctaagtagctgccacggtcacttccctggggttgacgaggatggtagcgatactcagtgtcggccaactgatcactatagcgatcacggagctctcctatggcaatccttgccacttcctgacatgcatggatgtagtttcttcctccagcttcgaacatcactgaggggatctcttcactattgctgttcaaggtgactttgactcggcacttctcttcatgacgatcatgaggaatctgggcataaaaaggggcagtcccaaatccaatggcaaaggacatcgtacgcaactcctggacaaaaccctcaacaccaaacaggtactcaagcttgtagcgcggcatctaaagacaagtgaaaggagggagttaagacctttatccattaatagcacaagtttttggattaatttgaataaagtttagaaattcaaagtaaaaggtaagtgaataaagtaaaccaaacttgcaagataatttgaaatagttgaaaacaaggttacaaattttgtactttttaacaacaggtttcaaaagaaagttataaaatcaacatgctaaatttattttattgcagc

SEQ ID NO: 72807 - DNA, 2450 bp, Oryza sativa
ttttaaaaaattatgtgtcgtactgtagtagaaagagaagaaggggaggaggaagggggagaagagggaggagtatagggggaggccgggcaaaccgatcgctgggcgatcgccctggcgatcgatcgcccattagcccccctccttcatcgtagttcattcgtcaaatccaacgatccagaatcatccaatccaacgtcttcagtcgtcccacctacctcggttttactaattagcgcgtacgagacttctctaagtcgcacgcgtgccacgtggcggaccctcatcgtctgcgggtgggtatggtgggcaccgcaagttttccttttttttcctaggatttttttttggagatgcatatatccaaagtaactaacccggacagttttagataataacgataattaaggtaagaattttctttttttttcaagattttttagtaacagattgaaatggaatctatacatgaagtgaaattttgaaacctttcaacttgaaatttgaatttttttaagtcaaaatttgaaaactttcaacttttcatctcaaattcgaaaaactttcaaaccaaatttgaaaactttcaacgcaaaattgaaaactttcaactcagattcaaaaactttcaagtcaaattgaaaaactttcaactcaaaatttgaaacttttcaactcgattttggaaactttcaactcaaatttaaaaactttcaacacaaaatttgaaaactttcaattctacatttgtaaagaggtgtgcgaaagattgaaaaaaagaaagaaaaacacatctggaggtgcaaaaatcgaaaaaaaccaaacagaaaaaagggcgcgcaagaaggggggccaacaggcgcgcgcgccagctaatttgctgaagtgtacgcatgttaacagcgaaatttggtaagcccttaagagaattaccatgtcaccaatagtcggattcctgctatattcggttaaggaaattaatctattaaaggaagcttatccagaagtgaccgagttcaaggaggatgcgacatgatagtttatctattaattaggcagtatttgttagtttcttttatctttaggaaaatgtgtttagtgtcctataaggattttatgttttccttttatctttaggaaagtttctttcttgtcctacaaggacaagtatctccccacgggtataaatatgtacacccggggtcattgtaaactatctctagatcaatataactactctcagcgcatcgtcaccctctttaccgaggtttttacttatcatccggcggaacttggcacctgacacgaggctgcatcggttttcgatctccggcgaaggagtaagtcatatgttctgccggccctggtgaatctatcggctacgtcagtgttgttcaaggctgcatcgcttcgatctcttggatcgctctggtttggttgatatatttgcatacctaatatctcaattatatctctaattgcattgtgtttagagacgcatcggtttagttgggctgtctcggttaggtttgatcttctgtcttagccgatatatctctacaatcacaatgctattgtaaatagatttgttatgtccatcacattagacagatctatcagctcatcgagtattagattatcatatacaatctcgtgctgcatcggttagtttcgacctactagattattgttgataatataaatcttgttgagccgataagttcatactagtgttttatcgaggtgctagccgataagttatctagacgttgcatcggcttataaggattgcatatacatataagttggatttagccgatgacaacaaaggtttcattgatttatctaatcttgtggattttatgacatcggacctctagccgatgtatgctttaacaatcagatcagtacttgttctatcatatcatattgttagttgattggtttctactggattatattactgttatattgcatcatcatcagccgactgcctttatatcattatctacattggacatattatcgatagttcaaaaccctattcctatcggctggaattactccatcggcttgacaaccgatcggctgtttgatctgttgtttacatatcttgtcagctgtaggatcaaactgactggcacacccgcacctcaccaagatttggacatgcactagagctaagcagatctcctaggccagtgtgtgttttttgcgtcaacaggttgatcggtttctggattcaccgtggcacgagagggggccgcccgttgcctgctggggacgggggcgaaacctgaggtgtggtacgattggttagagggagttatgcgaaaggtcctatcatctttctatcacgtggtggcatgtcggcgtacggaaacgtatcgtggggctgtgtcttgtgggtacagttgtgcacctctggccagagtaaaactatttgaata

SEQ ID NO: 72808 - DNA, 10982 bp, Oryza sativa
  unsure (1)..(10982): unsure at all n locations
ccgtcatcccaaatggtgatatctttggaacattttcattcaccatggtggatagatattaaccatccccgtcacctaataggtgaattcaccgcgggtgaacggtgaacgggccccattgccatctctgagtgagaagcgggggtgtcagcaacgcggattgcgggcaaggttgtcagtatcctgattcgtatcctagtatcttacgataatacgatcctaccaagccgaaatgataccgatcccacttagtatcctaattttcatagtatctcgatcctactattcattactacaccatcctataaaatcgaaatcttaagtgatatcccgattctacgatccctatgatactacaaaatattatttaaaataacatggtttgaaaataatgtaaataaatatgctcaaatttatatgaaaatcagttaaatatatcaaaaccaacatagtttctcttgataaatgtctctatttgcatgacatatatcattactatatttttttatatagaatggctatatataattaatataaatattaattaaacttaaaaaaagaaaatctcatagtatcccgatactacgatacgatcctacgatacgatattactttgagcaaaacgatactacctagtatcccgatcctaataaccttgattgcaggtacatgtacaacctcagttccaaaaatatagctattttttacacggtatcttgttctaaataaaagttatttctccaccgaccttcttctgtcaaccaattacaactattatattttatcaattttatattctcaaccaatcacatattttttttaattattcttatctactttcttaatacttatatcaaccttaaaaattacttacactttggtacggaggaagcaagggctagctctctggcgtcgtgacatcgccttcagcttcgtgccctgcgtcgcgttgaccatgcagtggacgaagtgatcaagaactagccagccgggcgggcgggcggcacatcatccggcccggcgccggcggtctctggccatccatgtcgccacctgagtagcaccacaaagttctctaagttcaaatttttataggagcgaatttcggatcagttatttaagggcttagactgtgttcgtttcattagaatgggaattaattccttcctcacagaaaatagagcggtccattagcacgtgattaattaagtattagctttttttaaaaaaaatggatcaatataattttttaaacaactttcgtatagaatttttttttcagaaaacgcaccgtttaacagtttaaaaagcgtgcgcgtgaaaaatgagaggggaagttaggaaccctggaaacgaacgtagccttagttctctgtttaataggcaaaatttatagttggatgtagaggtcgggtttttttaaaaaaaattgtcgccactaggtcaattttcccattttattttcctattcgcctcttctggtcacacaaagaccccaccccaccacacgcaaagaaaaggcaaccattgttccacgttaatgagttattgttgggtctaattttttgggcctctttgcatgcgcgtcctttggatacaaaactggaaatagttcagtttacacaccccttataactatgaattgagtagagttccatccaccactactagaaaaatcacttttgcatgcggccaaaagcaatttttacgggcggagggaaggaccgcctgcagaccaacgacggtgaaaatcatccagcccgcttgtaaaaatccaataaaaaacaaaaaaatcgcctcactaccgccggcgctgccctctggccatctctgggagaccgcctctcccaggccgggcccgcttaaatctggtagctttcataggtcatagactgccctcccacctctcccaggccgggcccgcttaaatctggtagctttcataggtcatagactgccctcacataccaacaaaagtcttttctacacactttgttgtcctcactcgtgcgcaccgaggccgggctcgcttacatctggtagctttcataggtcatagactgccctcacacactttgttgtcctcactcgtgcgcaccgaggccgggctcgcttacatctggtagctttcataggtcatagactgccctcacagaccaacacaagtcttttctgcacactttgtcctcactcgtgcgcatcgaggccgggcccgcttatatctggtagctttcataggtcatagacttttctacacactttgtcctcactcgtgcgcaccctgacattctttccggtcagtcacccatcccaaattgcttcaggccaagcacgcttaaccctggagttctttagagattggtttccggaaaagaagttgtaacttgtggcttaataggattaatagaacgtgaagggcccatggctcgtccgtactgtcgccttctaaagccacgaaagacaaaatcaccaccccaactgctaagggactaaattttgatagtaagggatactctatactcggttggttttgcaatcgagggatgagtacagtggacttttatggcctacattaattaaagagtccatttttctttggaattagtctattttgtccctcttatctcttgtctttggacaatttgtatccctcagctataaaaccgggtataacatctcctccaactttaaaaactattacaaattaactctttatgtggtatggaaagcgctttctactgacgtgacaagtcgatttggtccaagtgtcgtgacgtccctacgaagaggttagaagcgttttcaagatgattctttctttgtcgagacgaaaaagtcttttcagttgaaaaatgtgagtatgttttgcccactttatcccccatccccctatatcaaaatgatgaaaaaaggaatttaaaatgatcttatccatcattgccctgcttccaaattggcagagacccctgtggagaatgaagaggagtcaaggatcttactctcaagagtactttgataggctccactctcaaagaataagttaggcctgtgctcacaagaaatctcggagccacccattaatcgtaatgaactctatgcaaagttttcctctgtgatatgagttaccacccccttggtcacttatagtaccctaaacatccaactgcattttccaactaaaatggaaaatgactaccgaaatgaaattgtacatctagaatagacctaagaaaacatgatcccaggcggatacttaacatgttccccctcgcccaggcccatcgcaagggaaccgaaaccaagatttgctttatcgggtatcaaacgggccggaactgtgagcaaatataatacctttaaaaagtattactacaaccacatagattgtaaatgtataaatgcgatgtactactttctttcctcttcctactacatgcacggctataatcgttatatattctcttcttttctttactcttcgttttgcatctcttttcttctattgtgagggtagcctagtcatcaaaggaattgaaaatataagtgtgtcccacatgtaagtgacaaattaaaaaaaattaaaaaaaggtgaggtccacatgttagtgacaattctccttctcttcttcgtccattctattttttctctcccagccaccaccgccgtgcatgggcggagggcgggggtctcgtgtcatggcgatgaaatccacggcggagccgtgctgaagagaggaccaatgtggtggagaggcagtggtggtggcggtggccggataagaggagaggaggcaaagaggtcctcaacggcgcaacagcaaatgcttgctgatcgacgacgctggggcctgggggagaagcgagaggggttaggcggagaggtcaaggtgggaccgtggggtaggtgtacaaatgaagagtacaaaattaagactacaaacgaattagaaaattatagaaaaaaagtgtaagggctgatcacaaaacccatattgaaagctatatacatgcacagtaaagagttgcatcatactacattcgtcctaaaatataaaaatctatgatattttctataactacgaatctgtataggttatctgtccagatccataaatctatgatattttctataattacgaatctagataaattatatgtctagattcgtagtataagaaaatctcccatccgatttagattattatatttcggaacagatggagtatatgcgtagctagctctatcctactccatcggtcccaaaatataagcactttcaaaatagtgtcgaatcaaacatttttttactttggctattaatagcaaataaaaaagaaaaacatcaatcatgtaaaattgatgttattagatttatcattcaacaaactatcataatatgtaatgtaactcttttcatttaaaatatcttacttttatagatactgtaagtcaaaatagcatctcgaaaactgtgcggccttgtttagttcgggaaaatttttgggtttggttatcacatcgaatatacggacacacatttgaagtattaaacgtactctaataacaaaacaaattatagacccaccaaggaactacgagttaaaatattaagcctaattaatctgtcgttaacaaatgtttattgtaataccacattgttaaaacatggcgcgattaggcttaaagattcgtctcgcaatttacacataatctgtgtaattggtttttttctacatttaatattttattcatgtatccaaatattcgatatgatagtgtgaaaaattttattttaaaagctaaactgggcctatattgaaattcaaaaatgtttatacgttcggacgaagggtgtatatgtcatagtagtaactttttcacaagatgacactgtgtgtttggcctcatcttttactccagtacccgtagttctgtacagtaataaagaactactgtagtagtatcacccagcactcaacacagtgcattcattttcttctgggtggagtttgagcctgctgacatggtatactacgtactccctccgtgaaaaaaaagttaaactctgagttttaatgtctatctttgactatccgttttatatgatttttttatataatttatatttttattattgttagatgataaaacatgattaatattttatacgtgacttgtctttttaatttttttcataatttttttaaataaaacggacggtcaaacattggacacggaaaccagggtttgtttttttgaatggagggagtataggagtagactgtagctgcgtcgtcaagacccaagagcacagttgcacatgactctgtgagattcttccagggatgagataaccccttttcctcggtttttgaacatcacaaaacgacaagattccttggtcgctgcaagagagtacgtagtggaattcgtgatagtgctgttcagtggttaaaccctaaagcaaggcccatagtgtctgttttcgataagcttttctagatgataatggaaaattccataagtaaatcgtctttgaatactgtatgattcaacttgttttttttttttgattttcagtatctgtttggatgtgacaacttacactaggattttgattttcaggctaaacttttttttcttaaggacttttgacattaattattccatctgaaattcatgggttcaagttcaatgtactaacttggaagatctaagatagtgttccaaacgatgtaggttattagcttatgatcaattaagtactggagtaactactataaactttaaatatatttacttgaaaaatgcatgaaagaatcgagaggcagtccgacggtccgaccctaggaacaccttgcaaaacccttcgtccctttctagcttcttgtgcttacaggaaggaagcgaagaaggtatcaggagaagattaggagaaatgagataattaaatttaagaatcctcctgatctgattttacgtgatggtcttttaacgtgttttagttttgagtacggctttccaaattttttttcccaaaaacgtaacatcgaatctttggacatatacatggataaaagaaaaaactaattgcacagtttgcatggaaatcaggagaagattaggagaaatgagataattaaatttaagaatcctcctgatctgattttacgtgatggtcttttaacgtgttttagttttgagcacggctttctaattttttttcccaaaaacgtaacatcgaatctttggacatatacatggataaaaggaaaaactaattgcacagtttgcatgaaaatcgcgagacgaatcttttgagcctaattaatccatgattagccataagagctacagtaacccacatgtactaatgataaattaattaagcttaataaattcgtatcgtggtttctaagtgggttatgaaattagttttttcattcgtgtccaaaaaccccttccgatatctggtcaaacatccaatgtgacatccaaaaattttcttttcgcgagctaaacagggcctacgttgcaatatcaactatggctgtgtttagtagtttaggtgtaaaaatttttgcgtatacggacacacatttgaagtattaaacgtagtctaataacaaaacaaattacagatttcgcatataaactgtgagacgaatctattaacctaattaatccgtcattagcaaatgtttactgtagcactacattgttaaatcatagcgtaattaggctcaaaagattcatcttgcaatttacatgaaaactgtgcaattattttttttccgtccacatttaatgctccatgtatgtgtctaaacatttgatgtgacggatttgttgaaagtttaaagggaactaaacacagccttaggccctgtttagtttccaaaaacatcacatcgaatttttgaacgcatacatagagtattaaatatagataaattaaaaaaataattgtacacttaggagggaaatcgcgagacgaatcttttgagtctaattagttcatgattagccataagtgttatagtaacccacatttgctaatgacagattaattaggctcaaaagattcatctcgcgatttccagacgagttataaaattagttttttcattcgtgtccgaaaaactattctgatatccggtcaaacgttcgatgtgacacccaaataatttcttttcacgaactaaacaggccattacaattgaatttcacattttgttagcctaccggcctatagatgagtgctccctccctccggcctataaatgaggagatgtaacccttcttaaaacaaacaatatggacttacaggagagtcatatccctttccctcctgggttgagtttttttatggaggaaagttataattaatatatgatcgtttgtcttatttaaaattattttataattaatatttttattactattaaatgattaaacataattagtagttatatgtgttattaattttttaaaataatttttatataagatgaacgatcaaaacattggatttatgttttctttagttagggaaaagagaaaggtctctttttgctcagcaaagtgatgatgagctgatgccaactgacctgaggccatttacaatgcggtgaggtggcgttcagcctcactgcgccagcgcatagattccttgccacgttagcttctggcacacttttctcaagtccgcgcgtccaactttggtcacgtgttcctcggccaaatccagggcgagcggcgtgaggaacgggcacttgcgcgcattgtggaggtcgtgacctcgtttcgtcgttctcccgcgctcgcgtcgtcgtcgagttcatcctgccccgcgtcgtcgtcgagttcatcctgccccgcgtcgtcgttgagttcatcccacaggagagaagggaatccggcctctgcagattcaatcaccaaatactccttcagtttcgtcatcaccaagacgaacagaagaagagagaagcgagcagaagaaggaaaaaaaaggagcaaacatatatgcgagaaacagaatatttgagaaagaagagaagaataccttcgttggaggccatggacgacactaactaaacgggaggagcaattgctgccgatgctttcttgcattgaagtcgaccaaccgttgaagcagagaagaagccaaacccacaaacgccataccttntctctctggggntctgttctcnggnacacgttttttttttggccgggctggatctagccgcctgccgccgccgtctcgtcagcaagcgctgcccggaaggagagagagagagagacgcgcccgtgccatggggaggccgaagggcggcgccgcggcgtcctcctcgtcgaagaagcccaaggcgaagccgaagcagcgcggcggcgccgccgccgcttcgggggaggagagggtggctgcctcggcaccgtcgccacccgcgccgccgtctccgccgcgtcgccgctggcgcgctccgctgagcccgcctcggggtcgtccgccgctagcgcccttcgccgagatcgcctcagggtcgtccgcctccggctcccgcgccgtgtcgccgccggcgggccgccagatccggagggggagaggggcgacggcggtgtgtgggaggcgccggcggcgcactagacggagcagttttgtggcctggttggggaaggcagggagagagaggagaggaggtaaaaagtgaggagagagaagggtgggacccactgtgaaggaaaaagaagaccacatgcactgtggaggttgtcgcttgtaaagttcttagtaggtggcagtgttgcccctcaaaaattggtgacgcactgtaagtgccctcacgagtagtagacgcgtgggtgttgtactagctgtaggctatagctactactactagccccatgggagtaggagtaggaataggagtagcagcagtaaatactcgcaccagtcactttttcatctcgcttttactgttgcatcacttttaccacgtcctgacccttttgcaacatagtacccctgattgggattttcacctttttcatccttttagaaaacttattatacaaatagacccttaaaaaacttagggcccctttaatttggagaaaaaacataggaattttgaaaattttcaatcctatagaaaaattcctatgagtgcatttgaatcaaaagattgaattttatccgattctttgaaactcctattgtatggacaattctacagagattttggagaaaacttagcaagagttcaaagctcttagaaattttcctttgagtatatctctctattttgtttcatattttttcctactgttcaatcaaacagtcatttctatgtttttcatgtgttttacaattctctattttacacttcaattcctattagaatcttgtgttttttctattcctttattttttcattcccgcgattcaaatgggcccttattctaataatggatccttttcgcagggccaatgttattggcgccgtggttcaacatgatatcgtcaataacgttagcgtcatctccttcgcccatcgtggaagacaagtaactaatgtgaagagggactatttatagaataactttagtcactaatgcaaaaactaacggtgtgtttagttcgtgaaaagaaaattttttggtgtcacatcggacatttgaccagatgtcggaagaggttttagggcacgaatgaaaaaactaatttcataacttgcctggaaaccgcgagatgaatttattaagactaattaatctgtcattagcacatgtgattactgtagcacttatggctaatcatggactaattaggctcaaaagattcgtctctcgatttccatgcaaactgtgcaattattttttatttatatttaatgctctatgcatgagtccaaagattcgatgtgacgtttttgggcaaaatttttttgaactagacaagacctaagtcatgttagaccacatcgtcaataacgttagcgaagcgaaaaagataacactcctaaaataagttttttagggtctatttatagaataatatttttcaaaaggatccaactgtgaaaaattccagctactcctgcagctgcagtgcagaaccaatgaatgggagttgggagagggtcacaggggggaggcaggcgctcacatacataaagatgagtagaatccttttgaaaacctcagcttctttctcctcgctgtggctcacggagcagcggaggtccggagcaagcgaggctcgtactggtaggagtaatctaccataatgtcttctagtctagtagtagttctacttaactacacacatatcactctctgatcacaatataatgtgttgatccacacgcaccgatcgacacaaactgatctaatactagtatagtgtttttgtttgttgttttgttcagagaccaacaacacaagttgtcgatcgtcgccaggagcaagcaggcggtggatcgagagaggcaggcaggcagcagcagcgaatcggatcggagaggacgttcgatcgccatggcagcacacacagtgagtttgcatacataggatgtatagtgttgtagtatttcttagctagctaactccagatgtgatgttggatttctctctccatcggaaactcacttgctagctagagtagcattttaattgttttctctgtctttcctatgtgtgatgcaatactattcattcattcattcgttcatgctctctagtacgaaatcatacagtatgtatgtatgtatgatcgatcttgggcttttctttctttcgttcgttctttctttctgtgactgggttttgtgattttcatttcattattactagcaagtagagagtcgtgcattcgcaccactatattctctcacatgttaaatgttaagttcttaatgaacaaagtttataggaagtgcagttacagtttttttctgtaataaacaatattttcg

SEQ ID NO: 72809 - DNA, 6078 bp, Oryza sativa
  unsure (1)..(6078): unsure at all n locations
cgtgtggattgangtgcactgcgnnccacccgcannanntcatnacaatcacagcagataaagcctgagattttttcatcaacattgtgcatcgggttggggtacctaatcggatcatcactgataatggcactcaattcactggcggagcatttaaagacttttgtaaagacttcggcattaaaatttgttacgcctccgtggcacaccctatgagtaacggacaagtcgagcgcgctaacggcatgatactttaagggatcaaagcacgagtttttgaccgactacgtccctatgctggcaagtgggtagatcagctgccgtccgtactttggtatttacgcactactcctagtcgggctaccggccagtcgccgttctttttggtttatggcgcaaaagcaatgttgccgagtgaagtggaatttgaatcactacgatttcggaacttcaacgaggagggctatgaagagggccgagtagacaacatcaatcgactagaagaagcccgagaagcagctttaattcagtcgactcgatatttgcaagggttgcgccgttatcataatcggaatgttcgatcgcgagcctttttagtcggcgacctggttctgaggaaaattcaaacaacacaggatcggcataaattatctcccttatgggaaggaccgttcataattgctgaagtcactcggccaggttcttatcgactcaagcgcgaagacgatactctcatcaacaattcttggaatattgaacaccttcgtcgattttacgcttaggcatttcgtttggatctttcctctttgactgctaacttcaagtttttccttgaagttttcagtcagggggctactataataataatggagtgtgatttttatcaattcaatttgcttacttgatttatcattgccctgtttggtctttcaacttagctaatgaggactgaaggtttttaatagcttttgcgggttttaggctcaataaggcttcacaaaggcttttaagaaatcagaagctaagtatggaacaccaagcatagcataaattcatcagtattgtacaaattgagcctccaccgtcattgatcatcaaaatcattgttatatcaatcagtatcagttttttcatcgttggacttatcaaacccagtcggctgaaggtcgacatcttggaatctctcaactacatcagcagcaatcttgtcagcggctttctgcgcattactgatgaggtcaagcgcagcttcttcgctcgtcctgtctgcaaagccatcaatggcatccatatcaacccttggataaagggatttggttatcaccaacgccagacttgctcccatacttccagcttctttgatgttcttgaaataagtatctggagcgactcttagcttgtcgaagatttcggtagcatcaagtgtactcgaaccggcgttattgaagaacatggcctggatgagtggagtagcggcattagcgactttatccctggctccttcaagcttgttgatcttgtcaactaagacatcaaactgtgcttgagatttgatcttgcggtctgcatcaacagattcacattaatgaatcagcatatagaagataatggctttcgaagtattgattattggtaccttcaacctcctttaaagccgaatccctctgtcttgccagctcagccttgtcattttccagagtttggatctgcttctctagttgagatatcttggcagcttgcactacattaacttcggttaatcaagattacagagataacagcgcaaatcagttgggcagagtttgcgcgaaccttttgatgagccactcagttcgaaattggactcctagagctcagcaatacgatccctcagatcgtgttcattcttcttggcaagttctctggcctcgtgcagttgactcctggtggcttcgagggttccaagatgaggactattctctctagggtcgcggttttcgcctcgttcctaagatgaatcagcgctcgagccagatggcaaacaagatggctgaggtcaggcgtcaaggaacttacatttacaatgcgagtcgcttggttgagtgcctttttcagtaggcagacctcttcgtcttctttttgccggtttattacaattccttgaggttgcaagttgtcatcccaccacttgaccagaatgggagggcacgaatcttcggttgctcgtatacgggggatttcttcttcatcaccaatcattggtcctaatgtattcactgacaaaggttagacaattgatcagagttattcaggtcaacatggtttcagacaaagtgtttacccgtattgatttctggacgaggatgagtggattcggatgcctttaaaggagatccagatctctggttattgctggcgttttgtccgcgagggctgtctgcttgggtttcgacttctggaatctcttggcttggccctgcgtccgactggtttccagtcgggggctcctgattaaatccggcttcggcttcggccgactggtttccagtcgggggttgatcaccggattctacattatcggttgccggctgattgtcactcggatgatccccagcagttggcccggtttctttggaagaacttgtgtccgtgttagtcgggtcagagtctttcccagacggatctatattagatggtttcctgcaaatttgattatcagtattattgccgcaatgggtgtgcatcaatgcaagagagatcgttatatgagttgcacctagaagacttcctgatctttggcacagggcgactggatgttttcttccttggagtagcctgttttggtagtttcttggttgtctctcggtctccaggcctcctggtggtatcatcggcttcgtcatcacttagaaccagctttctctttcgagaatctgactggccgactggatcagaagcacttggttgagtttcagaccgaattcttggtcctccgctcccttgcccagtttgatggcggggagatcggcgttgagcgattgggggatccaacttcatcaaagcaaactcctgggtgtaatatccttcattgttaactgattcaacaagaaaacaagatcatattttgagaaaggttgaagtgtatgaatacgtaccggtggaggaggattgaatgcattgaacggtacgactggcagcaagtgtgagtagctgacaacgatggcgtttgagaagatcttatacatcctttccttcatgaccttgaagtcaagagaatctggatcttcacggtttgggtcatgcttgccgtcaaattcaaaggctgtgcgagatctttctttgattggagctaaccgacacttgataaagtgccgggtgatttgttctccttaaaggccctgctctttcagctttatcatcctctccatcagttctactgcttgtgcagcttcatctcccgttggcagtgagttccaagtatcccgataaactggaggaagacaggagtactcgggaagaacaggctcggggttttgaacataaaaccagtttgcgtgccagcctttatttgaggtcttgaagggcatggagaagtatttttggcttagtgttcccctgagttggaaaccagcacccccaacgacgcatggtttgctcttatttggctggggcttgaggaagaagatgcggcggaacaaggcgaaatgaggcctaatgcccagaaaagcttcgcatgcatgaataaaattggcaatatgcactatgaagtttggattcagatgatgcaagctaatcccgtagaagttcagaatgccccggaaaaatcttgaggttggaagagaaaatccgccatagaagaaatgagcaaatactacgatttcgtgtgtatcgggggtcgggaatgcctcaccaaatgccggtcgccacccaatgatctcttttgctggaagaacaccgtgcgccaccatttccttcagattgtcttccgtcacattggagggcgcccactgactctcgaagctttctctttcttccgccatgaatgtgaactggatggtctgatttagttcgagatatggctagaaagggatggggaatcggagcgatggatgcggggagaaattttgtaaagtttttgagagtggattggagcggattgatgaaccctagtttgcccggcgcagttttacactgtagcaggaaatggggaaaatggcgagagtctcggcggggaagacaaagagacgtttttcactttggtattattagggtatcgggagtactaatgggcctgggcctgtacagtacttcagcccaatactataatcagcgtggcctgttgtgatccctaaggacttaggcactttttgctttggcaatttgtgttcacaatggtgtggcccaatgctgttaaaatcctttttaacgcgatttaataattctttgaaattattatgatgcacataaaaaggtgcccgacagaaaggtgttatatccttttttgtaagctttattaggttgcaaaagctgtttgggttgatttgagatgactggtttattaatagtcattcttttagcatgttatatgcttattttggttatggtaagggtcacagcctaagctattagactcattaattaccatgattttctatcatgtttggtgggtcattttatgagatttttacccggattcctatcaaacatgtctatttctggacctttgagtgtttatcactcggcccttcttgtattttttgtccttggtgtgttcaagttgagaagcaggtggctgggtatcttactaagtaccatgcgtgcttcgctataaaaccacttggttcttgactatatgtttagtttttcaactaatcacatagtcgggggctacacctaattaggtgcatctactcgatgcaccatgttttattttcgcccttcacagtttttgatttttagtactcggcaagctagagcaagttgaattgaagcactcggactattgttttttgtttcgagaaggttatttcgtcaactgcgaaggtctcgggggctactgtggagattatggataccccatatctgtatgacagttatactttagtcggatatatggtaccaaatatagatagaatatctttatggggactcgggttagtttttaacttgtatgtcaaggaaatacccgggatcctagtcggttacgattgtattttatctataatcccatattccgttaggatatggactatattttgtaaagcggattccttcccctatataaggagggtccgtgtgcctcttgggggccggttcttttttccagtttatacaatcaataacacactcggcggaatcatccccggacaggagtagggtattacttcttgaataagaaggcctgaacctgtataaaattccttgtctccaaacccatccactttcctaacttgatagctacccccttttattattgtcgaaatcttgtttcgacagttggcgcgccaggtaggggcagcgtcaagtttttgccgactaagtgcgatgggttccgtttctgtcaccaacgacttcgccttccctcccgggcaggcgttccggttcggcagcctcaactttatcaccaaaaactttggcaagatctctctccttgactcggattcaaaccagtcggggagagaccaggtccccatgccgttcggtattccgaactcggacaaagcctacgccaagatcatctctcccgagtcggcttcaaaccactcggacgagatccaatctatttttccacgaccagatcaagacgacgggtcctatccctcaatcctgatgaaacttcctgatgatttggccgctgtcttcacagtcaagacatctcccactcgaagatctaggcgagctccggctttagccccgatccgatctagatccagggaggttggcgttatacttcaacctcttgggacagtctcgacggaagagttggatggctacctcagctcccccggcgtcagttctcgaccaaccgagatcctcgactacgacgactttggctaccactacgaccacggtgacctcgacaacttcgacgacagctat

SEQ ID NO: 72810 - DNA, 23844 bp, Oryza sativa
cgtccaaaccatgagacattcagatagaagcagagaccatactcctgacgaactcccttggccgtgggagacggtggtgtagccgtacccgaggacgtccacggcgagcagccgggggcctccccgccatcgcggcgtcgcacgccgtgaagcgctcccccgcgccgcggcgtgcgtcgacgcgagcagcgcccgccgcgcggcccagccgcagcgacaccagcggcgccctggccgcggcggcgcggcgagcggtgcagcggcggcctcttgagcaggtggaggtggccgagcaccggctggctcggcgctgcgtcgccatcacgcctcctcgtccgaggaaggatggcaaccaccaagaacagaacggcgatgacgatgaggaaaggggcggcgccgccggtcaccgccatggccgcgctcatggcaacctcgagactaccacggccgacagcaacagttaccgacagttataattacgaatacagaaaaaaaactactccctccgtttcgaaatgttcgacgccgttgacttttttttttttcacatgtttgaccgtttgtcttatttaaaaaatttaagtaattgttaaatatatttttatgtaggcatataattttatatatttcacaaaattttttgaataagacgaacggttaaatatgtactaaaaagtcaacggtgtcaaatatttcgaaacggagggagtactagcatacggaatactgtccgagctaagggataaattagaggataaggataccagttactcaattagttaattacgctttatctgatgttgttgctcctccctcaactactcgtctccgttttgtttttctttttgagataattaagatcagacagtagtatttcccataatcatttgtctcatataatcaggagacgagtgattatggaaagtctaggtcccatggcagcaggggaaacaaaggagaaagaaggctattggagaggacacctataagagcatgtacaatagtagactataaactagacataaactagatataattggagagagaagagcagcggactacagatttgtagccagctgcagcacggactctaagatacttgtgtgtatgacaggtaggaccaactataaattgtgtagtatatatttataggtaactattgtatgaatcggctattaaattgactataaatgatatggagtcggttgttggctatactattaaacttgctctaaggtatcagctatgagctacagtaccatgggtatcaagtatcacgtctgataccatagatatcaggtttggtaccataagtagcagatatgatacctataggtatcacgtatggtacctaagtaccaaccggtacccataggtatcaagtatcatagtatccaagagattagatctgatacttatggatatcaggtctgggaccccacgtacgcacgtacctggtatcaaggcactgacaagggacatgtgccactgctttgtcggctcgcaaaggtctaccgccaacacctcttgctctcatattcctttccctagtctcctcaacttcactgttccttccttgctgttgtgggtgttatcctgctgcagctgcgtcctgtgcaccctctcttggtgtccagccatcggtgctagcgccgctacttcctgctagcatcatcaccatgcgtgcgggagggtgggtacgtgtcctcttgcttcactcgttttttcactcatgggatttctcgtaggcggagaaaatgaaggggtaggtgattcattgaaatatcccattccacgggatcccgtactctagtcgctctccaatcttggtgcgttcagctacatgatgaaaggaatcaagcaagcaatagtattttaaaaaacaaaagtgctacaggatgttatcccgttcggacgggatggtacctctgagatattgactaatagtctgatacccagttcagacgggatgatacctttgaggtattgcttgataccgagtaggtatcgactgatatccaagtatcatacgatacctctaaggtatcatcctgttcgaatgggatacgtcctatagcattttcctaaaaaaacaagcatgtggtcggcatgtggccatgataggcacgagacgtccatctatcatctagtaagttagggcttggtttacatccattctgaaccaaatcatttaattgacagtgctaaaattttgtggcagtagctagataacattccataattttgtagtagtgagtactgagtagagctagggtttcactgtattcttatctaggccacaagggttaccccagctcgttaaggcttgcgagctagctcgagctagttcgttagctctaacgacctaaaatgccagctcagctcgttaggaaaatgagctgagccaagcgagctaacgatccatgagttttgtttcgaccccaagtactatgttttatgtacacatgtacttatatattctttttttaaaagaaaaatagtagcatgaaacatagcccggttatgttactgtgctccgagaagaaaaatatcaggcattgctgcggcttacatgtgcaatagaatgaccactatttgcacaaatatttgaaatttcaaaattaaatatatagttatcaaattattattattgattacttgcttgaatatcttttgtataataatcaagatctaaatattaattggttgattaattgtcttatcaaccactaccatgtttcatttatggagtgatgtacttatatattctaaatagaaacctagaacaatcacggttgttattgtggtccgaaaagaaaaaatatcagacattattgcagcttgacatgcgcaatatagtgaccactgatttgtacaaaggtttgaaatttcaaagttaaacatgtcattttcaattttttagagataatccgagaaatgccattgacaagcgtctaaatccaagatatgccatcgacaagtgtgagttacaagaaatgccatcgtataaatgattttgttccaaaaatgccatcgtcgttagggttttgtccatcctgtgtcgttaagtgctatatgatgaatagtgtatttaacagtgtggggtggacagaagcctaacgatgatggcatttttggaacaaaatcgtttgtatgatggcatgttttggaactcacgcttgtcgatgacatttcttggatttaaacgcttatcaatggcatttcttggattacctcaaatttttattgttgatcatttgcttaaatatccttttatatgataatcaatatctaaatattaattgtatttttcatccatatcatgtttaattcatggagtgatgtacttatatcttctaaatagcaacctggaacacatcacaaatgttactgtggtctgagaagaaaaataacaggcattattgcagcttgacatgtgcaatatagtgacccctagtttgtacaaaggtttgaaatttcaaagttgaacatgtcattttcaaatttttattgttgatcctttgcttgaatacccttttatatgataatcaatatctaaatattaatagtcttttccatcagtatcatgtttcatttatggagtgatgtacttatatcttctaaatagtaacctggaacacaccacacatgttattgtggtctaagaagaaaaacaacaggcattattgcagcttgacatgtgcaatatattgaccactaatttgtacaaaggtttgaaattttgaacatgtctttttcaaattcctattgttgatccttgaatatccttttatatgataatcaatatataaatattaattgtcttttcgactagtaccatgtttcatatatggagtgcggtacttatatattctaaatagcaccctggaacatagcgtggtcgttactgtggtacgagaagaaatatatcgggcattattgtggcttgactttggggcaatattgcggctattaatttgcacaaaagtttgaaatttcaaagttgaacatgtagttttcaaattattattattattgattctttgcttgaatatcattgtatatgataatcaagatttaaatattaatcgtcttatcgacaagtaccatgtttcacgtatggagtgatgtacttatatacccattcatacctttttatacagggtttagacttgactaagaaagtcatgaattcatgatacacatgaaactaacataaaattggaagttgagtgtttcttttattcgccattggaatacagtgattgctatagcacacgcaatctacaataccgaagccaatctgctattcacatagaagtagataggatagtcttgacaaactcccggggccggcagacagccgccaatggcgtcgccatcggcatcgtcaacccgccgccttcggtcatgtcgacgacatcgtcgtcaccgacctcccaatcaaagcactgcacgagcgccgccaccgacacgccgacgacgcgcacggcgagcccctccccggggcaccgccgccggccgagcccgaacggcatcatgggcgcggtgaccgcgccgccggcgtcgctgtccacgaaccgctccggcctgaactcctccggtgcgtcccagacatcgccgtcgcggtggatcgcccacgcgttcacgaggaccttcgtgccgcgcgcgacgcggaagccgcccaccgtggtgtcctccatggcctcgtgcgccgggatcaccgggccggcggtgcggagccggagcgtctccttgatgacacattggatgtaagggaggttcgccatgtcggcctcctccaccagccgcgccgtgccgacgttggcgtctatctccgccctcgccttcttcatcgtctccgggtgagtcaccagctgcgccattgcccactcgattgtcagcgccgacgtgtcggtgccggcgaagaggagcgactgcacaccatgatcgaatccattgtacatgttgatcacaatggagtagaagtgtagaagtgggacagtaatggaaaactgttttaaacactcaggtgcacgtctacccatttgttacatgttaattaaataattataaaaaaaattaaaaaaattgataagatagattaatatgtaatatatcactttaaaaaaatacaagttcaaatttgacgtctataagttgtaacaaaaataacaaatttaactgcgagtatacgttatatttgttatttttgttacaacttgtaaaagtcaaatttgaacttgcatgtttataaagtgatatattatatattaatctatcttctaatttttttgtttgaattttctcataatcatttaattgacatgcaagaaacaggtggacgtctacccgagagattagaattcatattcagacatcaatggctactcaccaagatgatgcctttgacgacattgtcggtgtagtggtcgggatcggtttcttgcagcgcgaggagggcgtcgatgacgcccttcttctccttgtcttggtcgccatcgccggcgctgccgctacgccattgccggtggtcgtcgataaggccggtgaccattgcgtcgcgccgagcttgcagcttcttcaggctgcccaccttgccgcggagacgatcgacccaccggagcgccgggaagaagtcgccgacgctcggcgtgccgttcaccgagaacgtctcctcgatgatctcctggagcttgcgcgcgtcgacgctggcgtggcggcggcgcgtcgtcgccgcgcgcagcatcacgttgagcaccagctcgaacagcctgggccggagcgtcaccttggcgccgccggcggcgtcgcggaggatggcgtcgacgagggacgcggcctcggcgtggcggtcggcggcgagcgcggcgaggcgcggcgcggagaggagctcgacggcgaggaagcggcggagcgcgcgccagtggtcgccgtggggcgtccacaggacgatggtgtggtcgtacccgaggatctcgccggcgagcgtccgcggcctccccgccagcgcggcgtcgcacgccgtgaagcactcctccgccgcggcgtgcgtcgacacgaccagcgcccgccgcgcgcccagccgcagcgacaccaccggcgcgcccaccccggcggcgaccgctgccagcgagcggtgcagcggcttcttcagcaggtggaggtggccgagcaccggcagcgccggcgggctcggcgccgcgccgccctcaccacccgaccaccatcgaacaagaacgacgacgacgacgaccaccacaaacagtagaacggtgatgccaacgagcacggcggcgccaccattgccgccgccggccaccatggctacctcgagaccaccagtcatgctcgatgcaggctacaatacaacaacagctacccaatgcaagaagcgatcgattcctttcctcgaggaagaactcaagctgggctataaaagagcaaggcccgtgtttatttcatgcgccaaattgtttttttaagtatacggacacacatacgaagtattaaatgtagactaataacaaaataaattacagattccgccagtaaactacgagacgaatttattaagcaaatgtttactgtagcatcacattgttaaatcatggcgtaattaggctcaaaagattcgtctcgcaatttacatgcaaaatgtgtattgatttttttcatccacatttaatactccatacatatgtccatacatttgatgtgatgaaaattttgaaagtttgaagggagctaaacactgctcagatctagtagtacagcccactgcttcaaaaattttcacattggcaaaatgataaaaatcattgtttaatcaatgcattgttagttaaactattattttcctcattgttccgtacgctctctcctgacacaagtgcactgcatggcagttaattggttgaattgctcgtgtctgcgttggagcgcgagtacagctagcgcttaaatagtcacctggtgatatactctctcacctccaactcactgctaattgctaaaactgatgtgacaggcttatcgctagttattgtagctgctataagggcatctctaatatgcatgtaatggtgaccataagcaataaaatacttcctccgtttcatattataagactttctaatattagccacattcatataattaatgaatctagacatatatatgtgtttagattcattagtatatatgaatatgggtaattttaaaaagtcttataatatgaaacggagggagtaatattcttagtacaactttatacatagaaaggtgtgtttggaagagaatattactatggctaatcttaagcttaaagctagccataagaaatataaaattactttatatcttattagcatgtatgttggtttgaatccttcaaactaaaagaattaatagggattattttttgaagaaattggaacgatgtgacggaaaagttggaaatttatgtgtagaaaagttcgatgtgatgtttttggggttcaaactttgaatctaaacacgacctgagtttgtgatgattggagattactagacgggttcgcgcggcgtgacgccgcacggaagtgtgaacaaacaacagtgattctaatttggtgtatacttcacaacagtgatttgatttgtgtatatagcattgaattaaaatctgatggtgttttttagagttctggtttggtctataggaaaaacatgcttagaggtgcgcgtgtatcagcttttggatgaatttatacgaaagagaaggccaggccatctccagtgttaatagatttatcaacatcaacaccaaacgaagtgaaagcataagtctcataaaatgattagaacagctagaaccatcaaaatgcatgggttctcccaaaggatgaggccattccttgaaaataggtagcgaaacacgccatcggcgacaacacttattgtaaacaataggctctccaggatggggcttgttctggtgtgtcctttcatagtaccaaaagacaacacaacatatagaacaacagtaatcagaacctccatagtaagagcggccagaataagaagctatacacaagcaaaagaaagaccacaataagaaagtgtaaaaagaatctaagtaataaatagaaaatcctaaaaaaaagagagaaaaagaagtacctttaagaaaatgagcatgctctttagaaaaacaacagatgaacaagtaaatatacctgtagagttaactggaaaaatatgccctaaaaacaaaataattatagtcacatcaatagttaaataaacaacatatggaaacttaaaggaaaaataaaagaacataccttataccttagttacgacgaagccggcggttattagccaaacgcctttttaaccggttagaaaatgcctccacgcgagaaatacgtaggaaactacgtgctaaaaaaacggtaggtgaacaaagaaaactatcgaacagacaaataaaataagattaaggagggaaaaacaactagccacacgcaagaggaggacgataacatatagattcatcttaaagctgttgacgagtaggaatggaaccaacggaaggacaaatgtgacctagcaaccgaaaatgaagaaaaagaagtacataaaaggcaaaaaaaaattttacacgaccaaaaaacatgcaaattttaaaaaaataaagaaaagtaaaaggaataggaaacaaacctaaatcgtgagcaagaaaactgaaacgagaacagcgtcttattgccccacggcgtgacctagcaaccgaagatgaagacatgacgaaagtgaaaaagagtaacagcaagaccgaacaagacacaaccacacaaggaagctcaacctgcaacggacacagcaaccatcaatttgagccatgaagaattaggagagagcaagccacaaaggaaatttagaaagaaaaaaaacaccaaccaaaactgatggaagaaaacacaagcttagcacatgcggaagaacttacagggaaaaaaatctggtttaggagatgtaatttgcaactacgaagaggcaatctgtcatgcttaaattaatatatagctgaaaaaatgacaaaacgtgggaaaaagtgaaatggctggcataaattaaacgaaccattgtgaacaccatggtgcccttccctccgtaataatatgctattatatcgtatgtagtgccaaattagttgtgtactatggtaattatcaagtgcaaacagtacaatatatggatggatggcatgggggcagcatgtgcacaccacatgttggcacgagcaaagcagtagttaggcctctcacagtgcaatctatagggtccatacccctagtctaaaaagttggcccaaagacacccaccctacagtgcaagcacccatatatgtgtggcttaattggatggagacacaggtaaaggaaacgaagcccacagtgggcgtgacctagcccaccaaatccacaacttaattccccaactacccctctctctctctgttcgtgccgtctcttttacttctccccggtgcgcaccgcatcccctcccgcatctcgcttgcatcgccaccgcttcgactccccttctccctctaccgacggctgcgccggatctcctccctccgcgcgccggctctgcttctcctctcctccctccgatgccggcagccgcggttgccggctcgcgcggcgaccgacgcgcgcgggaggcgccggatctcctccctctgccgccggtgccggcttctcttctcctccctccggtgccggcagccacgattgccggctcgcgcggcgatcgacgtgcgcgggaagcgtcctcgggaggctccggcgccagcggaagacgatgcgccgatggggatgtggtggccacggcggcggatgtggtagtcaacgccagatctcctctctccgccgctgccgccgtgaggaggaggtagtgttcgtcgaggaggacgagcagaagcaggaggagcagaagcagaagcaccggtgagctggtcctcctcctcgcctcccgtgcctgttcttggcgggcggcagcgagtcctccgccgatggcaggagcgatgagtcctccgccgtcaacgtcgctccccacctcgtcgtcctcgtcctcgtcggcggaatcggagcaggcgggggtggtgaagcaggaggagtccgatctgttgaatctcgttgtgatgattttgctttcgttttctttttcatcttgttgaatccgatctgttcttctcttccaatccctaagattttcttaccttttctcttccaatccaatatgtggcgggagaaattatgctgtggcaggaggggattttgggagggcgaatcggggattttgggtgctaggggcacgcgagcacgaggctacgccgtccacagcgcgcgcgtcccacatcttctcctcgctgcgtgccttggtcctggtgaggttctgttagctgccgagaaacctagctaaggcgcggtcgctcgctccacgtcgacgaaaatccgagctggcgcaactaggatccgcgccagctcggtgcactgtgagaggtcttagtgcatggactacagattgtggctgcatgcatggcagtatgcacagtacacatgcaagcacaaagcgtgcacaaacagctactccagaaatcgtttttttctgggacaaagactttcctccagaaatcgactctctttgtgggacggagggagtaaaagtctcaggatgagaactgactagcaaaatcaaaaggaaagtgaaaaagtactatgacgcacgtacacgtactaatccacgctgaaaacatagtatacaccggatacaagacatcagccgggaaccagcccggtcacactagaaaaaataaattacaacaagaaaaaagcaagccacgaggcaaatagcggaagtgccaggaaaaaaaaactcgtgtgtttagttcccgttaaaattggaagtttaattgaaattggaacgatgtgatggaaaagttgaaaatttatgtgtgtagaaaagttttgatgtgatgaaaaaattgaaaatttgaagaaaacgttgaggactaaactaggcctcaaaataccaggaaaatcgaaacctgaccggtgactactaggttagtattttcttcggttttcattcgtactgcactgctgtttgcttcgttactacttctccctatccaatccaacagtcttattttcatcccgatcaacatcgaacgggtaatatgtgttagatggatttggatccggtgcagtacactagtgtgactgcaacataagcagttacaccaggaccttttgatgtaaattcaagggtctaaaatctatgaagtactgtttacatttgaaaaaaccatagaactactgtagcagcaacactgtagcatcagatttagaccgttcattggaaaaaatagatggctgagatgatctcaattcgtctttgatgacgtggcctattcttacggtattttggattcacttttcacttggaaagatttgaagaaaaaaaagataaaagacaaacttttgtagattatagtagcccagccctgctaaatctgtccccgccactgggtttgagcatttgattccatttctaatataacaaaatatgataacgttaatggtttgagcttttttttctcccgattatttcatgtgaagagaccatcatcgaatcacccatgccggctgctgttcaccacggatcaagtccgttgccattgtagttgcggttaaattaatttcgcgcattccatgcatgtggcaaccccatgccggctgctgttcacgattattttttttattttaaacctttcaagtttttaattttaaaaaataaaatcacccgtaacttattttcagtcagactgacatggcgaaacaatgttggccacaccgatctctggctgacgtgataatattgttttaccacgccatcctggttagcgtggccaagcaatatcgtcaggcccaactctaagaaatgggaatgaaattcattcattttgtataattaagtttatatgataggctttttgacacatcaacacatcctatgaaatgctctcacctatcagactttttgacaacccattgctattatatttgttggcggatggcatgaggcccttcgaccaaatctgccgaaacccatggcgaagactacggagcaagaatggcaagaggcgaagggtcgtacgaggagtgagtaagctagaggcgtcccagacgaagggtgcaagatgaagagtatctgccaaaggaagacgacttcgtcgtggcgagttcgtccccgcgagggccaagaaagccttcccgacccatcaagcctaggggctatagggccggcgatcgcccaacggcccatcaggggcccatgagcctccgtaacgttgtgtacccttgtgaatgtccctttcgtaagggcaatcgtgtaaattcccctgtgtaacctaaaccctagcagtaagaacttgtaatggggctatatatagtcccctagggccatgtaatagggagacggaggaggaagaaattccaaaaactaacacacttcgtttctttccaaccactgttgagcaaccacgtctttcgacgtatgcggttgtcgtttcgacaacagctggtgccgaccgtggggacctccgagcgaaaccactgagagcaaatgccaccgaagaaggtcgtgaaggagaaggttacaaggcgaaaggaaagcgacgccgtagcggacatggccgccgaagagggagcagagccttcggcgttggtgaccgaagttggaggggcgccatctgcttctgcgcctgtgccatcattgccaccttcggcccctgccacctctgagcaggtgccgaacgtggccgacgtggcgaaggcggctgcagccgcaagggcacttcagaccagggcggagatcctttcgacaagccagctgctggtgccccaggccgctccgtcgtagccggcagcggcccaaactgcgctctccgccatgcaagtccaagtcaactctgaccctgagacacaaaccgaagccgacatggaagccatgcgacaaaacatgacacgactccaagacatgcttcgtcaaatgcaagagcagcagcaagcgtacgaggcggcaaggcggtccaaggtcgcttcggcaccaatcctccagtattcggcaggatatgtcccacctcgagtctatccgcaagtgccaccccagccccttccgccacaagtcgcgcaggcgtcaatgtacttcgtcgggcagccgacagctgcagcagtgcatctggccccccacttgcaactgcaagctcaactggctgcggcccaagtacatcctcaaccacttggccaagtgtcgcaagcaatggcagaaggggcttcggctctgcaggcacaattccaagctttccttcaacaaatcaatcaaccccacaacatttcgagtacaacctcctcgactcgtccagaggggaatgcaagtcaaggtgctctcagttggttgccgtcgaaccagccaagtctgggggcttcgccgtggagtcaaggaccgcagttcaacttcatcaatgctgcttaggcgccaaccgttcggccgcaagcaccaataccaagctttggaacaaagcaccaacccaggtcgccatgatgtggtcgcagccagttttcgacccatccatggcggctcagcaagcattaccaatcggagccgggcagccgaacaccatggcccaaactcatgcgcaagccgtaatttcgcccttcgccacgccgtacccgcagcaaggtgccgtgaacagggcgggaggcaaaaaggggctaccgctgagtgggggaatcaagacccgtccaatcccaccgtagttcaagttcccacccgtcctaggctactcaggtgaaactgacccgaaggaattcctatccatctacgagtctgcgatcgaagcgactcatggcgacgaaaatatcaaggcaaaggtaatacatcttgccctagatggcatcgcccattcttggtacttcaatttaccagccaacagcatttactcatgggagcaattgcgcgatgtttttgtccataactttcgaggcacctatgaggagccgaagacacagcaacatcactcggcattcgccagaggccgggagagtcaataagggaatatatgcgtcgcttctcgcaagcccaatgccaagttcaagacataaccgaggcgtcggtcataaacgccgcttcggctggtttgctcgagggcgaactcacaaggaaaatcgccaacaaggaaccacagacacttgagcacctacttcgcatcattgacggtttcgcaaggggcgaggaggattccaagcgacggcaagctatacaagctgagtacgataaagcctctgtcgccgctgctcaagctcaagcacaagttcaagtcgccgaaccacctcccctggctattcgccagcctcagccggtgatccagggacagccgccaaggcaaggccaagcccccatgacctggagaaagtttagaaccgaccgtgcgggcaaggctgtgatggttatcgaagaagtgcaagccctccgcaaggagttcgacgcccagcaagcaagcaacaattagcaaccggtccgcaagaaggtccaaaaagacctctactgcgccttccacggacgctcttcgcacaccacggagcaatgccgaaatattagccaatgtggcaacgcgcaagattcaaggccacagcagggagcaactgtcgaagctcctcgagaagcagttcaggagcaggcacccttagccgaacaacgccaagatgcacagcgaagggtaatccaagtgattacaagggctgacctgccaacccagttgtcgaaacggcagaagaagatgcagatccgaacggtccacagcatcacttcggcaggtgaaggggcaccgcagtatctgaaccaactaatttcttttgggccggaggacgccaaaggagttatgttgccacatcaagatcccctagtaatctcaaccgagatagctggcttcgaagtccggcgaatcttggtcgacggagggagttcggccgatgttatcttcgccgaagcatatgctaagatggggtttcccacccaagcccttaccccagcgccagcatcgctctgcggattcggcggagaggcagttcaagttcttggccaggcactttcgatgatagcttttggctcgggagagaatagacgtgaagagcaagtactgttcgacgttgtcgacatcccgtacaattacaacggcatcttcggccgtgcaaccctgaacaagttcgaagccatttcccaccataattatctcaagctcaagatgcccggcccggcaggagtgatagtggtcaaggggcttcagccttcggctgcttcaaaaggcgatctggccataatcaacagagcagtgcacaatgttgaggccgaaccgcatgacctgccgaagcacgtgccaaagcccacccctcatggcaagataataaaggtacagatggatgatgccgaccccacaaagctcgtgtcactagggggcaacatgggcgaggaagaagctgaaagcatcctggaggtgctcaagaagaatattggtatcttcgcttggagccctgtcgaagtgggaggtgtttcgacagatctcattatgcatcacctggcagtcaagccggaggccaagccaagaaaacagaagttgcgcaagatgtccgctgatcgccaagaggcggcgaaagccgaggtccaaaaactactcagggctagggtcattcaagaaatcgatcacccggagtggctggcaaatccagtgctggtgcgaaagtcaaacggcaaatggcgcatatgtgtcgatttcacagacctgaacaaagtatgtccgaaagacgatttccccttgccgcggattgatcagctcgtggattcaacagctggctgcgaacttatgagtttcctcgatgcgtattccggctatcaccagatccacatgaacccgcccgacatccccaagacagccttcattactccattcggcacattttgtcacctcaggatggctttcggcctgaggaatgctggagcaaccttcgccaggctggtgtacaaggtcctttgtaagcagttggggcgaaacgtggaagcttatgtcgatgacatcgtcgtaaaaagccgcaaggctttcgatcatgcgtctgaactacaggagacctttgacaacttgcgcacaacgggcataaaactgaatcccgagaagtgcgttttcggtgttcgcgcaggcaagctgttggacttccttgtttctgaaagaggcattgaggcgaatcctgagaaaatcaacgctattcagcaaatgaagcacccgtcgagcgtacatgaggtacaaaagcttgcgggccgaattgcggcacttagccgatccctctcaaaggcagccgaaagaggtttatccttcttcaagaccctccggggcgcgggaaagttcaattggatgccagaatgccaagcagcgttcgacgagctaaagcaatacctcaaagcctaccagctctgataagcccagcaccagggagcgaactgctactatacttagcagcttcgccagcggcagtcagtgctgccctcgtccaagaaacagagttcggccagaagccggtctatttcgtctctgaagcattgcaaggagcgaagacaagatacattgaaattgaaaagctcgcttacgccctggtgatggcttcgcgcaagctcaagcactacttctaggcccacaaagtaacagtgccatcacagtaccccttgtgcgaaatactccgaggcaaggaagttactggccgactcagcaagtgggcggcagagctatccccgttcgacttgcattttgttgcacgcaccgctgtcaagtctcaagtgctagctgacttcgtagctgaatggacatcagtattcgcctccgagctcgagcccgtcgaaaaatcctgggtgatgtgctccgacggtttgtggtcgcataagggggcaggcattgcggcagtactcatttcgccgaatggtgtgccaattcggtatgctgcaaggctgcagttcaacacaaccaacaacgcagcagaatacaaagccattcttctgggtctaagaaaggcgaaagcactgggagtccggcgcttgctaatccgaaccgattctaagttggtggcaggccacgttgacaaatccttcgaggcaaaagaagaaggaatgaagaggtatttggaggccgtttggtccatggaaaagtacttcaccggcataacagtcgaacacttacctagaggccagaacgaggaagcagacgccttggcgaaatctgttgcttatggcggaccacatttgcctggcatctttttcgaagtcctacttgcaccaagtgtgcccgtggacagcttggaggtcatggcaccgggcgaagacccacacgactggcgaaccccgtttgtaaaacatcttgaaactggttggcttccggaagacgaagcagaagcaaagcgcttgcaaatcagggccacgaagtataagatggtctcgggccagctctatcgctccggggtacttcaacccttacttcattgcatctcttccgccgaaggcgaggaaatggcgaaggaaatacaccaggggctatgtggcgcgcaccaagcggcaagaacggtggccttcaaagtgtttagacaaggagtttactggcccactgtgttgaaagtctgtgctgagcaaatcaagaagtgcgaaagttgccaacgtcatggccgaagccaaaccgtgccccactatgatttgcagcccattgcgccaatctggccctttaccagatggggactggacatcattgggccgttcccggtggcgcgaaacgggtataagttcgtaattgtggctgtagaatatttctctcggtggatcgaggccgaacccctcggagcaatcacttcggcaacagtacagaagtttgttaggaaaaacataatctgccgtttcggagtgccaaaagagttcatcactgacaatggcaagcagttcgactctgacaagttcagagagatgtgcgaaggacttaacctgcaaatcaggttcgcgtcggtcgcacacccgcagtcaaatggggcggccgaatgtacaaatggcaagatcctagaagcactaaagaaaaggctcgagggggcagcgaagggtaaatggctcgaggaaatgttatctgttctctgggcccttcggacaacccccacaagaccaaccaaatttagcccgttcatgcttctttatggcgatgaggcaatgaccccagcagagctaggggctaactcaccaagggtgatgttctccgagggcgaagggggacgcgaagtgtcgctcgaactcctggaaggggtaagagtcgaagcactcgagcacatgcgcaagtacgccgtaggcacttcggcagggacccctcgcacttttgcgcccatatcagtaagggcgaggcgaagcgtttggcacgccgttcgtgcggacttggtagttttcgccatctcccgcgagaaccgccgcgactcctctgcagcgctcgcttcggccttgctgacctcctggcgaagagcctccattttcggctcagtgaggttataataatccgttagcacggtggagtgagccttttctttctccagttcggccttgaggtgatcgacctcagccctagcctctctccctttctccaattcggattggagccgcttgttttcggcctgcgcctctttcagggtattggcgagggcctccatctccaaattcttgcggcctatttcgtcatccttggcccgaagacggtttttgaatccatcaagacgagcccgcatggttcgctctgtcgaacagtgagccgcaaggatctggatgcaaaatacgaacgccgaagagagcaaatattagttatgggacaagtaaagaagtaggggaaaactaagaatagagaaaaaaaacatacccgaaccgccaagcttttgatagcacaacacccctcatcgaactcgttcagttcggtgaacagactcggggtattggcaggtaagacaagattgcttaccccctccacaaaaggaaggaggtccgcccgggtctcgaaatcgctaggggcgaaatgaggcgccacaagcgaatactccgaagcagaagtctcgacggctgcccccttccccttcgcctcgattagcggcgatgcaaccggctgacgcagagggctgccgaagaccctcacggcagttgtcatgatccgttccgcggaggccgaagccccagcggcagcgctaccgccttctccgtcagcaccaagtggaagaacgggggcgatcgaaaggtccaggctacggccagcgggcgaagtcggagtcccatcagaagactcgtcgtcgctgaaaatgcgagcgacgtcgacgagtcctttcttcttagagatcttcttgaccggacctcccttcgtcgccttgcccgacgagaatgcaactagggccttcgccccgtccaaatctttttgtcgaaggggggagcttttcgactccaccccggtctcgttgtggccggactgggagtgggagtgtagccaggagtatcaacgcggtcttcgatcgcctcgctcgcggccttttcagccacggcctccgcctcctcttcttcctccccttcttcctcgccatcatgctcttcggcatcgtcctcatcatcggcgtcgaaatccaacgaagcaggagcccttcgcttcctaggggcaagctttacttgtccgcgtgttcgctttcgcgaaggtcctacatcgtcgtcggctttgtgggggttcgcccggggaggcaattcaccgttgtcgtgtcaacagctggctatactcgatgaccgacacatcgccgatcatcctgcgggcttcagtttcagcctggtcgagggttaacactgtaaaagtaaaggatgtagctacattaaaggtcgaacaaggcaaaatagaacagtcttactattcattccctcaaggagaaccagcttcggcaaactgtcaatctcttcgctctgatcaaccgtaacctgccatgactgggagaggggaaagatgcgaagcatacagaattcctcaaccaagtcacggcagctaaggcgagagcaaacctttcgtagaagaacgaaccgcgcctccatagcgccgtccacggcaatcttgggtttccggttcggcacaatcgccctgcgccggcaccaaagagctttcaccgagtcagaaccagcctcgaaggggatggtgtgatagaaccacctcgccatccaatggcggtcccacttcgacatggcggcgttcaccggccagagatcggaccgctcagggcgaacgttaaagttcacgctcccgaacactatcttctttgttccagccggggtaatcactgtcttcaagttcacggtggcgaaaaatatagcgccgaagagtgcggcgctaggttcaaacccggaagtccggcacgcccagtcgaagatggagatccgaaccaacgccgacgggctcaactgtgggagctccacctggaaaaggcgaaggatctccggcaacaacacgttgcacggaaaccgtagccccgcctcaaaaaagacggcgaacaccaccgtccgattgtcgacaggcttcggtactacggctttccccggggcgaaaccgcctcaaccaacgccccagagctgaccaatttcgccagctcgacgtcgtccatgagagaaacccccaaaaaggcggtgctatcatcatcaacccggccgggatccggccctttcgctgaaacagggtttggcttgcgaggggccatggcgaagggtgtgtatgtgatggcgaaggaagagaatgggcgaaacaccagaggggtcaagaaatgctgcggaaggaaagaacaaaggaaaagagtgcacgcggtaaaaatggcaagtgtaacaatgaaaaggacagaagggtgggaatatatagcccacccgggcgacggttcgcctacccaccagtgccacgtgtcgcaggggtaggcgaaacggtaaattcccatcgaccgagcagcatagtaaaaaagcccataaagggaaagcccaatattgttcccttcggcccggcaaaagtaaaagtatatatatttgtataccactggccatgggggcaaacagcggcaaaataataccagccgcacaagtaacaaactctatttgcaggaacaatgtaggtttcggcaggagcatcggtcgaaagggggcgccgcataccataccacatggtgtgcatggtctcggccgaagctccattctcacccttgcccgtgaggggcttgttggcggatggcatgaggcccttcgaccaaatctgccgaaacccatggcgaagactacggagcaagaatggcaagaggcgaagggtcgtacgaggagtgagtaagctagaggcgtcccagacgaagggtgcaaggcgaagagtatctgtcgaaggaagacgacttcgccgtggcgagttcggccccgcgagggccgaaaaagccttcccggcccatcaagcctaggggctatagggccggcgatcgcccgacggcccatcaggggcccatgagcctccgtaacgttgtgtacccttgtgaatgtccctttcgtaagggcaatcgtgtaaattcccctttgtaacctaaaccctagcagtaagaacttgtaatggggctatatatagtcccctagggccatgtaatagggggacggaggaggaagaaattccaaaaactaacacacttcgtttctttccaaccactgttgagcaaccacgtctttcgacgtatgcggttgtcgtttcgacaacaatattattcagtgtgaaccattaattatctctaattacttatccagatagtattgagcgccataatacgagttattatcatataatgaagtgaaaagccgatgtgaccggttttgcttttaagaagagctcagtgttggcgtaaaccatgaatcaaagtttaggttagtccattggtaaaggtcttttcttctatgaaagtttcatgagatattgacgtggtaccttctagactacaccaatgtcttacatttcctcgtaataataacatcattgttgttttggtcgaagtggaaacagtccgactagttgtcacacaatcctaattggtgtgggcgttaaacaatactgccacgcccattacgaatggcgtgataatgttgtttcaccatgctatacaggtagcgtggtcgaaaggttctcattttagaagtaaggccctgttcagtgcagcttactgctgcaacaactgtaactagccaactacactaacaacaccagtgtgtagaaataatgtagttgctgtagtggctgcagctgcgcagctgcaaaaaatttgcagcgaacagaccctaagttgtcaaatgattttatttttgaaatttaaaggtttaaaataaaataaagtgtcactgttcattggactactcctatatatagttgtcatatggcccattccatttagtgatgaaaggtatgtacaatcaagcatgaatgcacgagagacacagcaccattcatgctttgatgatgatgttcatcgatcgaaaagatgcatgtacttgatgatacggccacaagcaagggtcgtcttcgccgggatttggatattgtgactgcaacctaagcagtagcggtacgcatcgttggatacaaactgaacgacctagatcgtgtttttactgttcacactaccgcagcaataagcactgtagcacgaagtactgttcacctggttgctgtagctacgaatctagaccattgatcgcaaaaatggacagccgatgttgcgtgcagttgctaagttgcagttactactgcaactgcacctgatccgaattctcttcggcgagcaatcaaccaaggggacgcagctcctcttacagactgacacgttagagggaagtgcgttcttaattaataggtggggtctatttttatgggcccacatgtaagcagcatacgtccctctgatgtacgtcaaaggtgccttacccgtacgcaaggacatattttcacctgagaactgctttgtataattaactagatgaatatccagctgcgttgctgtggaaaattaagttgtataatatgtacaaataaattgtaatatgttttgtaaacaaaaataaaatgacttcatatattttatataatttacacatggttgtaaatttaattcatttatgaaacaaggaaagtatagcgagaaataattatcagttggaagttaacatgcacgcaatctatgcgtgtaaccagccacacgaccttttacattagaattttctaaaaagtttgtaatattcatagtaaatgttatgtgtaccatattgtttgcactagaaaacttttaagttcaaaaatgactatttttagggtgtttaaaaatgattataattctaagccatggattaattgttttgtgtaaaaccttaactcaaaatttaaaatgatttcaaaagtttgattagtaactgaaagcaagatgtgaaatagcatttgatcgactaaactgattgttctatcgtcatttggattttgaatatatttagcagattcattcaaggtattaattatgaatcctataaatctatacaagtgattctcaattagtatagttattactccctccgtttcaaaatgtttgacaccgttgactttttagcacgtgtttgaccattcggcttattcaaaaaaattcatgaaatatgtaaaactatatgtgt

SEQ ID NO: 72811 - DNA, 1095 bp, Oryza sativa
aatgtttctacttttcagcaatttggctactgaaacagaaacaaattatcaacaattccttctcagatatagttgtaaagatatttatgcatcatggttcaattgcaccttatgagtattgacatgaaaatggataagaaatatcttgcagagatgcttctactctgagtagcagcagacgtttacctgcatgataagcttccgcatccaaccagtagatgaagaaacacaaccaaattccactgcagaaatcttgcgtttgtagcaaaattccacacacggccttctacatattacttttggtgctcctcatatgcagcaggtgctttatatttcccttaaccagttgtcctggtaaaaagcaaaattaagacgccacaacatctagtcatatgtagataaatatatcattttagccaactaaaggtttggataaaatatcaagcttagcctacttaatcatggaagaagatttcagattcaggaaacagtgtttcttttacagtgagcaattgtgaatttagagagaacatgtaagcagagtctacttgccaagagcacctatcttatcataacagaagcgattatttcagaacatacaaccgtttacacgctagaacacctatcttatcatagtagaaatgttttgtgggcaaacagttctgttcttcagaataatgggatattgtgttgaatttcccttgaaacagttttgatgtgtgaaacagcagtacgctggaacactgagagcctaatgcggtactacttgcattcagacaagcagccctgcaacaagaatcttgtgtagcatgtagtaagaaagcacccttaaaccaatgcagcttgcagcgttaacctaataaagttgtgcaaatgaatgtcaaactaaaagattacaaagatagagaagcccttatataggcacaccgcacacatctacacttgaaatatattctgtaattaaatctaaattgatacgaaagacagagttgctcttgctaaaagattacattacattaaccttaatgtcttgtttaaatctgatgatgcagatttatagtgttcacatgaactggacaatacagcttgcatgcc

SEQ ID NO: 72812 - DNA, 1417 bp, Oryza sativa
gggcttgcaaaccggaactaaagagggtatccccacaagtaaatgtaagtggtcgttttagttgtaactaggctctattgagaagagaggagaagagggagggggcaacatgcatggtttttgtagctatgtgtagctatgcgatcacacgtcacgcgtctagaaatgcacgatcggtcacgcatcaactcaacccattaatctccaccaagtcgatcgtgtcattattaacatgtactaatatttattccattatctaaacaaaatgtgttaacttgtggaccgtcctcgtataagctgatcatctcctccaacaatgttgtcggcccaaaagctaattagcacttgttaacaatgaaatttgacatcagattcagaaaaaaggaaggaaattgaagcagatttggtgttgaatcaagccgaacttggagtcggaccgcacatcgactggatgccatatcggctgaaacaaagtatgaagctggttgaagcttgatgaagccgatggccgatgcagccgatatgacgtgacttgggctcgacatgggcctagattgggataaccatcattgccaataagagatagagctcgattaaggcaattgtatctattaattaggatattgagttggtttgttagaaatttggtaagtgaccgccatatatagtcttgtttgtatcttaagtttagaaaggtttgagtcgtgtccacaataccacccttttacttttctcgttttctggcgagttctttgcaagaggtaacctgtgtcaaaggcccgcgctatcgggctaacatgtcgctttagacatgttaggctcaatatcacgagtcattgctatcatatgtcttagttaatctatttttagcttctcaatttagctctatcggtcgtggctcgctttagggtttatacttgtttcgattaaattgtcttgctagattagattagctaagacatctaccatcctgaaaaatgtctaatttcttgattgtctagactacatgttccttttcatactttgagatgcatcatccctagtcgtgcttagaaccatgcaaattagcctgcaattaggcattataagaatagtattggggtttcagccgatcttacccaatatgcatgtttcaccccccctgtttaatgtatattcgccacttatatagatagatcgttttatataagcatatcaagctttagtcagtatcggttagattcctaacttcatgcttaatttctatttgatatgtttatatggatcaatctgtctatataagtttgtactagagtattagctagtacgttatttctcttgctctaaatattgtcacatcggttactttcataatacttctgttactttcataatactgtcttaaatcaatctgttaaactctatagatactattaca

SEQ ID NO: 72813 - DNA, 696 bp, Oryza sativa
ttaagcagagatccaaacattctggtaacagcgaagccacttcccgtatcataagaaatgaggacagagacaagttatgatctccactggcccacaaacaaattaagatctgcaaagttttaacaatataccatgagctaatgcaactaataagaaaagaatttgacacagcagatatattatagaacctattttcagatagtcatagggtaactgaacaacaaatgtatgtcagcacaatataagatactgataccgcaacaattctgacacatcaggaccaataggaagtgtactggacctaaaatggttaaaaaggagctatggaagaagcattaatggtcaattacactagatttttggaacagcatactgttttgaagctggcaaaagcattaacagatatagatggcttaaatgagttaagtaaaagcatgcagctatcatacaaacacaatgtccatataacaaggcaccagcgaatagaaccatcatttctcctcatctctacagcatagcagtcaaacaagtgctggaatagcagatatttctcaaatggttacaatgtaaagagaacaaatttaattttcaccaaaagataaggtatagttgactagaatagctttcaaacatgaatacccttgggtacaagagaacacacaaaatcaagttaagtattaacaagcagcatcacca

SEQ ID NO: 72814 - DNA, 657 bp, Oryza sativa
acaaagcacttccctagttagatgtaggttaaacttcccgttcgagaaactctaacttttacctgccctcaatttatgcacgagtaatgaatgcccctgggtggaagcgagaggggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaaacatttgttgctatctaaattccatttaaagtcgtaccttatcgcccagcatcatcttattctctatttgaattccctccatctttcagatacggatgtagccttggatgtgcccgtgcccaatgaaaaggaagagcgcaacatgaaaacgtaagtcaaaaattaccggacacccacccagatcccaatagaatccgccaaatcctgcgggaaattgaatcccattcacaaactcctacatttaattaacaagaaaacttttgtatttatctacacctggattatctccacctttcatt

SEQ ID NO: 72815 - DNA, 6580 bp, Oryza sativa
cgagtcattgctatcatatgtcttagttaatctatttttagcttctcaatttagctctatcggtcgtggctcgctttagggtttatacttgtttcgattaaattgtcttgctagattagattagctaagacatctaccatcctgaaaaatgtctaatttcttgattgtctagactacatgttccttttcatactttgagatgcatcatccctagtcgtgcttggatgcatgcaaattagcctgcaattaggcattataagaatagtattggggtttcagccgatcttacccaatatgcatgtttcaccccccctgtttaatgtatattcgccacttatatagatagatcgttttatataagcatatcaagctttagtcagtatcggttagattcctaacttcatgcttaatttctatttgatatgtttatatggatcaatctgtctatataagtttgtactagagtattagctagtacgttatttctcttgctctaaatattgtcacatcggttactttcataatacttctgttactttcataatactgtcttaaatcaatctgttaaactctatagatactattacatccgattgggcgtgtttagggtttattattctttgatatatccagtccatagccaatttggtctaactccatcggctgtgaccatcaacgatacactatcggcctatcggccgatcagctatcggttgactgattctgcttttattctttcttgctgattgcaggatcaaatcaactgacacgcccttgacacactcgaggctagccttggacctgcactggagttaagcagatctctcatgccaccgtgttttcgcatcaacaacgctgtagtagtaacatctcggaaaaagtatgaattaccccctgaagaattgtgagtacgaattacccccctaaacctgaaaaccagttatttttcaccctcacctatagataccggatgaaaaaaaaccccccaagcagctttgcaagcggttttggtctacatggcagcccagtcagcaattcttttctttttaaatcagtgggccccacatgtcagtctctcactctcttttacccctcacctctctttctttctcaaaatcctctctcttctccttccctcaccagctcacctcgaggacgacggagctcgggaggacgggaggagcacgggacgatggcgcgcggagtgggcagcggcgaagagggcgcctgcagccaacggcggtcgggacaacggggagggcggagtgggtggaggcgaaggtgcagctgatgcgatagcgcgtgtagggctctaccccgtttgtcagcgcgctgtccagtcccgcccgcaacgctcccttccccagtggtgaaggtgctgcggtggagccgagctcttcattaacggccagatttgaccaatgcgcagcggcgagccgacgcgggagcatgatgcggggatggaggacgagcgctacggacgcctcccagctccgcacatggctgtcttcgccgccacaccttcatcttcgactgtgccgtcgttgcctccgcggtcaccgtcctcgctgtcggtcgcgccgccagttgcgccgctctcgcctccgcctccatgcgtggcgcgctcgccgcttcgccgccggtcgcgccgctctcgcctccgcctccatgcgtggcgcgctcaccgccttcgctgccggtcgcgccgctctcgcctccacctccatgccgggcgcactcgccgccttcgccgctggttgcgccgctcttgcctccgcctccatgccccatgcgctcgcgcccctcctccatggcgagcgtgtgcaggagagcgggccggccaccgccgccgtgctattcagaaggggagggagaagagagagagagagggggggtgaggatctgacaagtgggccctagctttgttaaagaaaatgtttgctggctggactgccatgtgtgctattcaaaccctaaaccgctctcaactgtaccctaggggtttttttgtccggtattaaaaattcatggtgaacgatatctggtttttgagtttaggggggtaattcggtcgaccgctatagtttagggggtaattcgtactttttcctaacaactctaaggctttatctatggagaaaaccctactatctagtgtgctagtatggaggtgcgactagggtttactacgatttttaattgtggcagctaaggtttcgagatgagttgtctcacttccaatccatcttctactcataagcgtcaactcctactatcgccctatgccataatctatcgccctatgccacaatctctatgtaccaaaataagttgattttttaaaggcaaaaattagttgatttctaaagttgaaagtttatcccaaaataaattaatttatagcctcttagctaccctggttcataaatagaacatttttacttcttccatattcttttacttacccacccactaatattactttcttattaatgagcggcacattgattttcttttctcacggttatttttttcttgagtaatcgatttattttggatagagggtgctacaaatgatgatcccaatccggtagcttccctttgtttttttgttcatctcttctcagttttgctccctctgcggattttggcactcaacgtttcacccatcacccatagaaggatttaaaaatgagaggcaatcttaattatttcatttttttccttagtactagaaatgcaataacattatgaggtatctccagattactgagcgataatcctttatttaacgtgttaagttaaagagtccccaaggggttataatcttatgaccctctcaactgattaatccaaaagatcatcacttcatcacaaactaaatcctctaatgacactttatacaccggttcggtcatgatagtgatggcccgtacttgccttttcttttcaacttaacacattgttagttgacaaacaatcaaaaggactaaaacctaaacattaccgagaatatatatataatcagagcttcatccttagtatcccaggaattaatattttatcgagcaaaactatacccctgcacgttgaacccaacaatcgcaaatacaatctactaatctgatttatccattcaaaaatcacccaacatcattctgaagttaccagatgattactatatacacagaaccaagcattggaaattgacatcagaagagaagaaaacaagattttgacaaagaccacctaattttacaacagaaacgaaaatgactgtacaaaagcactgatttctaccatgtacacatctgggctacatgtatatgaatgacataatgctctgcttttttcttgttccattttttattgactaaggctaacctatatactccctctgtttttttatttgatgttgtttagtttatttttgaactaaccaacgtcatataaaaaaggaaggagagagtatatctgtgtctcatgcctactcggagttcttctgcctagccgatgaatatgcagctgcaaggagggcagcaccagtcccagatccctcctccatcaccctaagactaacagtggctgcaatctcctctccaaggatctcaactagagcttcattcagatactctctgaagaccgagtagccttcgaagaggccgccctcgatcgcgaccaccgttcttcttcgcacgcctcgcattgttcgaacctgagttgaaccacaaagggttccatcgcagccgatcttttgcagtatcgcgacaatcgcagccgctgctaggcgggcagctctccgggtgatgatgtcggagactctggcaacaagcttccgggtcttgaggggaacatctggtagctgcattaggaaagaaaaaaaaaagaaaatgtgagagatgtcagtctgaagaagctgtgcactgaacagaaagttgagattattgtgagcagctgtaagaaaccttaagatgttcctcaagtatcttgccgacttctctcaagtccggggaatcatcctcgcggatagcagctaagtttggtgtactggacgaaaaggcatggcaataagatgatcgattttatctttaagtaatctgacaacagagttttgtaaaactcgaaatgaaaagtacttgaccacgaaattcaaccaaaacatagccttggaatgaaaagtgtgatgtttcaatggctcaggccagctatttgacaggccaaattgaagagaactacctacctcagaaagaatctactatacacggaatgcaacgaataaactgatgttcattcccagatctaaggacaagcacaccgtctatgcagaaggtgaaaaaaaccttgcaagatgctatggaaatattcaattattgaaagaaataaggaacagctacaaaccataattagtcactttgttcctattccactaattatgaacaataaccatgctgcatttgtaacattattggacagaactagcaaatggtaagccgacagtgcaagttgataaagcaaataacattgacaaggaaatagatcaagtcaaagctaatgggaaactaaggaaccgaggagagtagcgcaaagagggtagaaattatcacataggagcataacttaaggtactccatattatatactccaatgttttagagttctgttgcaatggagataagagaaacctagcatatatttatttgctaaagcataaactgatctgaaagaattaaattcaagttgggcaccttaagacgaaaggggtcgatagaccatcaacagcagtaccaaatatatctgactcttcagccattttttggaacaccaatcttgcaatttccccaagatacacaccagagatcattttctcaaaaccctacaccaattaaatgacattaatttcggcctaattatcacaaactccaaacttcccatttttcagaaggtcttacctggtcataataattccatgtttcgttgttgaagcatatatcataaggagtcaattctatttgtggaggccgaaaactaccccattccacatttactacctgattcatggaacattgtaatacagaaaagaatcatcagagattctgtctccacattaaaatactgatcaaatcagagatttaaagaaatgaaataaaagattaaaactagcataccgttcgttcagaattggtaacgcgacccaaagatttaataattgcatcgttgcgttcaatatagcaagcattggtgccagctccaataatcacagcagctactgtgtcatcatcataataatgcccgagagctaatgtccccacagtattgttcacctatttgttgaacaatacattgtagaatcaaccagaaatgaatgtattttaatctactagtgagattacatgcatcacacttggaaagcatttttggatcacaaataaagtctcaacaaatatattcaccagagcaaaagaataaatgcaagcttaataaataacaattacatgatctcatcatattcatatatcatatgatcatgcgattattcttagaaaaatacaaaaaaagaggcaggagattacagtggggtaatatacaccaataccatacttccagcaagtgaccaattcaaggaacttaagaatcaagttggttcattttcttttcctagatcctagctagtcagtaatcttcaagccattgtttgaaatattaaacttgtgtcctctaaatgaacatgaagcatattgcttcctagcttccaagtcagttacatatgaaagagatattacactagatgaaatattagcagtcacataggaaatgaagtgattctatgaggataagccaagataagagattcacaaattatctattaatagccacattgtatactcccaaaaggattcacagttccaagtcccagaaaataaaggggcatattttctttacggaccaatgaatgtaaatttatagcacttttgttctttacacatgtgacaattaaagaatttttaaagttcatgctgaagatacactttttggacaaagttcccagttttgaattgcatgtacatgctgataccattttgaaaaaaaaaaacaaataggatgcattgcatagcatccagttgctccaaatttaaactcaagtccataattgaatgtaatcctgttgtcattttgactgaaactcagattgaactagaaaaaaaattagttccattcaaattagaaaagataccaacttaggtacaatttaaggccgacaacaggagtaacaggtcaatgttttagactgaaaactaaatcacagaggaagtgtacctcatctttcttctagcagaaccatagtactttttcgaaagcatgatattaaaaatagtgtgcgcacatacaatggatttatcagttacgaagctaattaagacagccaatgcataaagaagagattgccgatggaataaaaataatcaaaatataaatattcagacatgtcaaatactttttcctttatggaaggagttttttctaatacagtacaagcctgcaacgtaccaatacattgaccttcatattgagtccattccta

SEQ ID NO: 72816 - DNA, 9822 bp, Oryza sativa
aagtagccgatgtgggaacgaaacagtccatcaataacaatgaggacaccagtcggcggcgacgaaggcggtcgacggtgaaagcgaagatgcccaccaacgacgacataataggctagccgtgtcggcagagacaccagtcggcggcggcaaaggcaagccggttggtgaagacgtggacgcccatgaacggtggtgtgaccaaccaaccgtataggcgaggacaccagtcggcggcgacggaggcaggccggtcggtgaagacgttgttgctatcagcggcggtggcaaaggcaagccggttggtgaagacgtggacgcccatgaacggtggtgtgaccaaccaaccgtataggcgaggacaccaatcggcggcgacggaggcaggccggtcggtgaagacgttgttgctatcagcggcggtggcaaaggcaagccggcggagtggactcgcggccaattgaccgaatagctgggacgtctcgagtccatgaccagcatagatcacctagcaaagtcgaagattaaatcattcaactcgccgagtgtcgaaacatgaattcggcaataataaaagggggtagcgcacgagatctaaaagtggatggatgcggagacaagggatttagacaggttcaggccctctcgatgagaggtaataccctactcctgtttggggatttgaatccgccgagtgtgtattgatctgacgatcaggttgtctcatgcccctagagggggctccctgccctccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatatttcatatatataagttatcccctataactagtcggataatcatgccgtgtgggtatggggtacccataatctccacagtagcccctgagaccttcacagtcggaaagataatcttctctcgaactagattactccaaagccgagtgcttcaatcatcttcgccatgatctcccgagtactttttccaaatcagaagactgtggagggctgaaaaaataaagtcagatgcatcgactagatgcacctaataggtgtaacccccgactatgtggttaattgaacaaaccaaacatataatcaaggaataaataatctaaccaaccgagtggtttcgataattgtagtcaaccaagcgacttaatattaatatgtagcatatgcggtgtgaatccctgaataatatgatccaagtgatataccgactgctttgtaaaatatgatgagtgtaacctaaagttggctacatcattgaaaattcacatagcaaaacagctataaagaagcttgtatgttgtgaataaagaaatttccatagtattgggcatacgccatgcgcacactgctttaacagatgtgcttaagtccctagaagacacatggttccaccacacctggaaatatatggcatatgtggtataaaatccgagtaaataaactcataaaggattcaccaaccgcctgaaaaatgaccacaatatataatcagcctaagccataatattggtcaataaaaatgcacacttacgtggcgaaaagcaatgatattgtatccaatcaattgcttaaaaacccaaacagcaccatgactatataaaaaagtcagcgggccagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatataacatgctcccgagtaataaatcttccgggtaatatagaccaagcgtagctcatatgaatagcttctgatctgagtgattatcccttatgggatactccaaaatagatgtaacaattgaatcccgactggcgcaagtattcagttgataacccttacggggaataataaatagtccagtctttgagcatataaaatagacccatgatcatgaattcatgttgcatgtatccggagcaagtccaaattgaagatataatacttgtatttgagctagtaagcccctgagcacgtagtcacaattgttcatcgatggtagctgacgcagttggcatagagacaagacgaccaatatagagataatattgcccaacagaggtggcaaaaatattggtggtagtgaagatagtgataccaatcaaaagtgatgaagttgcacagccgtggaggcgaagaaaccagtcggcggcagacagatcaactaacaatgaagatgaagaaaatagttgacgacgacaaacgcaaccgacatgatgaagatgatgatgtcggcgatccagtcaatagcagtgtcgcaaccaatgataatgacaaagacgctcatcagcatttgcatagtaggtcaaccgtgaaggtgaaataataagtcggcgaaaacataatcatccattagcaacagcggagatgtcagggccgatgaagcagaggtgctggtgatgatgtcagtgacaataatccatcaaattaatgttatggctgttgtagatgcttcacttggaggagagttgatgttgttgtctaactcgtccaaaccgaaatatttgaagttgttgaagtagaatgtctgctccgaatcaaagatgaagataatgactcctggagttgactcgttggttgatgaattgatttcttcagcttgacataaaatttggcaaattttgagccttatatttgtgtagcccccgactctttggttagttgggaaacaactgaacatagagtcgagaattatagcttcttgtcgtcgagtagtcattgcttgattgaagatatgtgttgaagatgtccaagtagaaatcctgaatattggagagcctcttgttgtagtaaaacaacatggcatcgcatgccgagatgtcgaggcatgatgacaaagttgcattgccgtgatgaagtgaatacgagtcggcggcaacagaagcaaactggtagtgaagatgcgcagttgtgaagataaaagcaccagtcggcggcggcataatcagtcggcgacagaagatgatgatgtccatcagtagtggtagctgtataaaccaaatgtagaggcgagggcactagtcagcagcagacgagacgaccggcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgccaaacaacggcagcataaaggccagccgtgcaggcggaaacaccagtcggcggcggcgaaggcaagccggtcggtgaagacgtagacgcccaacaacggcagcataataggccagccgtgcaggcggaagcaccagtcggcggcggacgaggcggccggtcggtgaagacgtagacgcccaacaacggcggcataaaggccagccgtgcagacggaaacaccagtcggcagcggcggaggcaagccggtcggtaaagacgtagacgcccaacaacggcggcataaaggccagccgtgcaggcggaaacaccagtcggcggcggacgaaggcaagccggtcggtgaagacgtagacgcccaacaacggcggcataataggccagccgtgcaggcggaaacaccagtcggcggcggcgaaggcaagccggtcggtgaagacgtagacgcccaataacggcggcataataagtcagccgtgcaggcggaagcaccagtcggcggcagacgaggcggccggttggtgatgttctgactgatccattcctggagtgtaagagataagcttaaagccatgaatcccttttatgcatgtctggatctggatcctgcagaacaaacatataggatgagtagtatctgatataaatataatactcgagaaaaaatcaagtattttaaaatattgataaatatgtatttctcctcttgtcaattttgatttccccgagcagatgactctgtacgtttaaacactctgtccgactagtcatagcccccaagcatcgggagtcggcctaggcatttcccaaacatgcatatgagtgacatgagttcgtcattaatggaacaaagtttcacggatcagaatttactacttaggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattacatctcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtcgtattccctcggtggcagcagaagtagccgatgtgggaacgaaacagtccatcaataacaatgaggacaccagtcggcggcgacgaaggcggtcgacggtgaaagcgaagatgcccaccaacgacgacataataggctagccgtgtcggcagagacaccagtcggcggcggcaaaggcaagccggttggtgaagacgtggacgcccatgaacggtggtgtgaccaaccaaccgtataggcgaggacaccagtcggcggcgacggaggcaggccggtcggtgaagacgttgttgctatcagcggcggtggcaaaggcaagccggttggtgaagacgtggacgcccatgaacggtggtgtgaccaaccaaccgtataggcgaggacaccagtcggcggcgacggaggcaggccggtcggtgaagacgttgttgctatcagcggcggtggcaaaggcaagccggcggagtggactcgcggccaattgaccgaatagctgggacgtctcgagtccatgaccagcatagatcacctagcaaagtcgaagattaaatcattcaactcgccgagattgatttcctcgaccggactcactccgagacggagaaaattggtcgttggtgttgcactgtgtcactaggactaatcaagcaatcgacactgagatggtgaggcctccctgcagcagtagaagcagccagaagaatcggccagccagccaaaaaaacccagattgatcaaattagtagcaactacagaaacaactcaataagtatatatgttgatcgatgcatgcatgcaaatatgcaacatgggtttatccatcctcttgcaggtgctgaacgtgcatgcaagtcaaccctgtaaagaaccaatagtctttgaccagggccagggcgagcacacagcggccggctggactcctgacgtgatgcagtgcacccggcggcaactctcgcggcgccatgtagatggaacagttcgccatgcacaaaatcgatgcgatagcgatggtgtgcccacgtgcgctgttgagcatgtcatctcgcaaaacaaatcatcgatcaatctgttgttagaaattaatctaataataaaataaattggagcggcaaacccggatgaagatcaaagatttgacgagccattgaacacgttgaaattgatctcaacgtttcttttgaagttaattccatcgcacttctcgacgggtaatacgacgcaacccctacctggcgcgccaactgtcgaaacatgaattcggcaataataaaagggggttgcgtacgagacctaaagtggatggatgcagacacaaaggatttagacaggttcaggccctctcgatgagaggtaataccctactcctgtttggggatttgaatccgccgagtgtgtattgatctgacgatcaggttgtctcatgcccctagagggggctccctgccctccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatatttcatatatataagttatcccctataactagtcggataatcatgccgtgtgggtatggggtacccataatctccacacaaagcaaagcaaagaaaagacggcatcaacactgtgattgcaatttagcaattatgtagtactgttaattaatctgttttttctccataatttacctctacagaaaaaaaaaaggatggtgagggaggggtggttggtgaaacactgaaaccccaaaacggatattaactgaaagaaaaaaacatggaattgaacaattttgcaggaagcgtcacatcagctgccgctcccctccgccgggtcgtcgtcgcggcggccgaggaggagggccgcgaagctggcggcggcgcagagcgcagcgactgcgttgccctcgcgcagcaagacgcggagcgcgagccgcgcgatatcggccgtggcgcgccgcccctctgcgaccagcgacctccgcggctttccggcgaacgcgagtagcaccaacacggtgatccatgtgatgagcatggccggcgccgccacggctaacgcggctcccatcgacaggagcccgaagacggcaccgtacatcacggacgcgtagaaagccgccggccacgccgcgacggcgccagccccgccggccgcggagtagtaccaggcgcgcacggactccaccaggcgccacgacgagcagagcagagaggcgtacacggcgaggaagagggccgcccaggtgcgccgcttcctcatggctcggaggaggagggaggtcaaggggggccatgccgacaagccccatggctcggccacatcctgatctgccatggattgaccacggattgttgattccttgctaggcgatggtaattcctgaggttttgtgggttcgattttgctgggcatgcttcccttgcttttcctgggggtgggtcaaggcctcaagggagagtaggagcaatggggaggcatggaagggagcctgtctgtctgaatcgtcgtttgcttttacttttcctttcctttcttttctgtccttcgtttttttctaaattagtactccttttactccatattataattgctttgaatatattttaacaacatattcgtttttttaaaatactactatatttattaaaaacttaattaaacataaaacaatttaactggaaaaataattaaatcgaattataatatgaaccaaagagagtaataccagtcgttagtctgtggcatacatggaataatctcattaaccataacattaaaatttcaatcgtatgctagtcctggccgctaccgccgctccaatcgctgccgctttgcaccaccgccaccactagctccgccacccctcgccgcacaccggcctttactccatttccctgtatcctcgccggaaccaccatttcactgtgaacccgagctctaccaccgctttgacgactccggtagcacaccaccgccgccatagccgttgccacgtagcgcctccaccaccatcatctccaccgcgccccactgcccctcggccgtccctccgccgtcgcagttagtcactgaagcgccgccgcctccctctgccctgagctccgctggccgactccctccgtcgccgcgcctctcggtgaaccgccctccctcctcctcctctccatttattcccctccttccccgtttcccgtgccgccgctcggtgctagtgtcgtcgccggcggtcgccatttggccacgcgccgccgcctcgagttggtcggcgagccaacccgcacccttgccatgccgctcgtgttggtagcctgtggaccaccccgtggtcttggtccatggtgcgccgcccctccccttttggctgacgtgtggggcccacctttggtggactcggtccacgcccgccccactgctgagccaataacttttgttttcctttaagaaaaatatataataattgcgcaataaatcaataataattctagaaattcatttaaatggctcgaaacttctaaaatccatatctaattcatacaaactccaaattaaaccattcaacttgcaaaattcatctaaaattgagctctacatgtttgtttactttttatgtactgtttacttggtttttattagagttttttcctcgttttgcgtgccagcgagtagtttccgtcgttttgaaagatcgcggttgtgaggaaaatagttcagaagatcaaagtgaagaagcaaggcaagtcacacattctccttgagcattttcatcctaatttataaatgttttatcgtttgcaaataaaaattgcatgtcttactaattgcatgtgatcagggtttacctatctgctcgcttttgccatgtttacttgatatctatcctttgtcaaccttgggtaataaatcgactagctcatgttacttatgtgacctagctagaactatatgcttagccatgcttaattaccactagctcatttgatgggataattgcagtattagacctttcagtatcttgacgagctgcgtgctcgagacatctggccatatttcatggtcgtaattatccaactaaaatgcgactgaatggtgggttgtgggtgcatggttttgctagtcgcacccatggcaattaaggaccggttcgcttgaaacccttgaagacacacagtgcttgccacaagcgggaataggtaactgcctgacttgaagtatagctgtcacaccccgaagttctcctcccaagcctaaatttaatttataaacaaccccaagaaaatgcaggtgcaatcaagagaaaaccctaagaaagtaatgcaaataataatcggatttggcatgtggaatttttcttgagttctacatgtcgaaattcactaacaggatttttagtggaattttcagagccctagaaataattttaaccaattaaaattgagcaagcaatattttaattccagggaaaatcctttttcctttttctttttctttttcctctctttttcctccttttttcgaatgggctgccggcccattctctcctttcctcccccctccctcccccctccctgctgggccggccgcaggccgaggcccagccaagccgcgccgccctcctctcccggggtcgccgacaggtggggcccacctgtcgggtccttcccccaccttccgccgttcccgccgcgccgccgcgcccgcaaccgccgccgcgcccacgcctccgccttctccgggccacgtcagccacgtccgcgcgtgcgccgcatctcccgcgcccactcccctctctctcccgctcgcgcccgcgcccgagatggccggaattcgagttttgaatccccgctctctgttctccaccactcccccacattgaccggcgaaatcccgc

SEQ ID NO: 72817 - DNA, 753 bp, Oryza sativa
ttcctgcagcccaaaaaaaaaagaacaaacatgttaaaaatagtaattctagagacaaaagcagttgtaaaatcaatttttttataatataactgagtgcagatacactgtaactatttgtaagtgttctatagtatatataagcgttttgtaaatgagtgtaattgtaagttgggtctacataaatataaatctttgtgcagatcttacagacaaaaaataaagaggctgctatataatggaatcccgttttcgaacggaatgatcccgagtaggtaacaggtgtgatacctatcaagtatcagacgattctacacaacatgatgatcccgagtaggtatcaggtgtgatacctataaggtatcagacgattctacacacatttcaggtgacacttgcaagtatcatgtgatatttatcaggtatcatgcgatttctaccacgtatcgcgtgatactcgcgaggtatcatgtgaaacctgtcaggtatcagacgatttcaaccacgtatcgtatgatactcacgaggtatcatgcgatacctgtcatgtattagacgatttctaacacgtatcgcgtgatactcgcgaggtatcatatgatacttgtcaggtataagacaatttctaccatgtatcgcgtgatacttacgaagtatcggatgatacctaccaggtatcaggtgattcctactatatatagctgggcatcccgttgggggaggagcaccccgacacgtgcggtcggccccctg

SEQ ID NO: 72818 - DNA, 2066 bp, Oryza sativa
agtgaaataaaagggtgaaacatacatcgcttgtacccttagtcaaattttcggggataggctgatgttcaacttttcgattgatgattgtagaccctgcgccaagttctactttcaggactctaaagcttgttcctccaagatcaatggcataactgatgccttcctcgctcctggtcatgtcatgtgaactactgtaagacaattatccaatttcatatttcttagagaacttgtccacaggtggtagaatgtgatgcaatgactaatagatagaccaacatatcatatatgtaaaaaatcataatgatttcagttagggaaaaatatgatatgcatgaacactacaacattttatacaacaatatctacatcgaatgattcaaatgaatacgaggattacaaaatcattgatgaagattccctaaataaaattcccacaaattctggaaaagtaagttttgagttataagcttatgataagccgtaaaaagttgcattgccaagtacctcaaaatggacctgattttgcttacattgtatcaatgcaagatcaacaaaggaagaagggaaaacacgagtcttggtactgccacataccaatgtcaatgcattgatataccttaattaccatatatcaatgttagtacacacttaatttaccacatatcaatgtcagtacatactcattccagttaccaatttattaccaagaatctaaatctagatgttttggctgaaagttgtactacaaattgtatcactgagacgtgtgttggtaagaagcatgacacatcaatcccgcacttccccctccaacataccacctagcaattaacgtcaaaacagcatccaaccgaagaacaagtaccacaattctcaactgagtgtactatgcctagtggccattatggataccatacaacctacagcccgatgcagacaactgatgaaaggatgtgctggattcattaagaatatgacacttataacaaatgatccatatgattacagggctccaaggaaatcgtaatgtagcataagagaaacatgccataaaaactgttcaaagacttcaggaaattatccatatgattacagggatccgaggaattcgtaatgtagcgtaagagaaacatgtcataaaaactgttcaaagacatcaggaaatgctaacagtaaacaaagcaatggtattgttcagttcaataaaacggaaaatttgcatttcaagaaagttgcattgttttatggaaatgcaaaatcaccattgatcatctccacaaggaactagacaaattaagattctttacagaaaaatgaaaacggccaaatttgactagtgcccaacgcaatcagcactccactcgagggccaggccggtggagtgaaatcagcacaagaattggtaaagacattaaagatcaaagaaacaaaatgcacaacttaaatgtgctgagttcatgggtgacgaaataatagcggttcctttggaatgttctgttacaattacacacagaaggtcaaaaaccaagaaattctctttccccgcacccacaaagaaaaaatcaagaaattctcatcaattcgaaaccgttggaagtgccacattggaatttggaacaaaaacgcagcaaacattgttcgcgtgctcatactccgccggccaaaatggcgagtcggcaacgaaccgagattgcaagaatgaagacaaccctacgtacgacacggtacaacacgacgaacaaacaccaaaacccgagagagagagagagagagagagagagagagagagagaggggaaccatccatgatccggacgcgcggcaacgtcacgtacccgtcggggagcgcgtcgacgcaggtgagcagcatccgcaccttgctcccgccgtcggaggcgaggccggcgaacatctcgatggccagcgagttgaccacccgctgcagcagctccgcgggcgtggcgcaccgctcctccaggtcccgcaccaccgccaccgccctgttccaccgcaccctcgccgcccctcgcctcgccaccatccccgccgccaccgcgcacg

SEQ ID NO: 72819 - DNA, 637 bp, Oryza sativa
aatttaaatcattctacgatgactataaccgttctctgaacacacacaatacaaacataaaaacaaaggagtacgaagaggatataaatactgatgtggcatccctttcttcagtacatgaattgatatgtacactgagtaaagctatattttacatgtacttacatgatttatatccaggaagaggataccacccatacaagatccgcatctgaggaacggtgcatggatggattattgccgagttgtactgtacacgactggctaaaagaaagggcactccaatacgaggcccagcactgcactactagttcatcacccccctgcaaacgatgtgatggatggggttaggaaaaaggacgtgtaattgtgggatttaggaactagtaggaacatagaagcatctattaccttattagtcgtgcactagagaattagttcgatttctgggttggttttcttgagcttcttgcactgctttacgagcttctcgttgtcgcggactatgaagtatttcagtgaacctgggaggccatccttgggcagtgactggatggatggacagttcataatcattaatctcttgaggttggtaagtctatgaaggcccgcaggaaggcaccgcagcttatcgtag

SEQ ID NO: 72820 - DNA, 16632 bp, Oryza sativa
ttatcggaccttccgagccaaaaacaagggatagttttcataaaaatcgctgactcccaataacattcggtcaaattttataaaaataataataataaaatggtctgaattttttaaacttggtcgggaactaagcagttcgcgttctcgagccagtccagtttttatggaaattgacaaggttttgtcaatttatattaaactagaaaaagtgcccatgcgttgcaacgggaagaaaattaaggaaaatctcgctggcggattcggccgtttggagcagagggatgtgagccgctgtccatctcaaggagagcgtagccgatcggtgacactgaagatggcggatgtttttttttatgattttgggtgtgttaggtcttagatacgactcatatgttccgcttgttgctatgctcttttttgacgatttgtgttctgtcacaccctgatttttgtttcagggatttgtaaattatttctaaaatttatattaaattttattaatttacaagtgaagtttaatgtgagaaataaaatttcctaattaaaacatggctatatttaatcattattaaattctccatgattaattatattctttggaattttccaattatttactttaataatagaaagaaaattttagtaattatttaaacaattattaatgattaaatgatctagataaatattttgttaaatactttgagtgtccaactattttcataattttcttgaaattattcgagcattggaagtgttttttaaaattcaaagatcatttcggtgattaatttaaatggaaaagtaattaaaatcctccctccttggatcaatacccatgaagtctgttttctgtccctctcctcctcctttcggtctgtttgctttctttctttcccgttcggtccagcagcaacagagaaagtctagggagcatccctcagtccctcctctctctgtcgccgggggcccacgtgccacagtgtcatcttcctgaactcccatgctcggcgaagccggcactgccgcctcccctttgctccatccatcttgtgctaaatcccgcgaatttcggctcaattttcatcccgcgtacttggaataaacctagttttttttccatgtccaaatctcgtcattcccgagtcaggcttccccaattgacggacgaaaatcaggtgtgacaaaaggaaagttacgaatattttaattagttaagatttgatcgagattcccatgttgcaaaacacccttagactgttattagagttcttttttgaatgtttgttggaagagttagaagcgtactgacatgatgtttgaccattcgtatataaatagtttttttttttacttcttgtgatccactacatacgtgttcctcgtgaattgctctaaacattgacgttggaaaaaattcggttgttttttttggaacattttaccaatttagtaaactaagttgatgacgacatgacgtccaatgatgctagcaaccgaccgagctcgtcgatctccaaaattccaaatcatttcaccctacattacctttttttttttttggaaaggcgtttcactctttattacttgccgttgtatgcgtgagcaagtacgcaggaaccgaggaaagcagcgtacaaattgaggcgggccgggcttaatcattaactcgagcaaggaaaaagtacaccgaaggtcccttaacttgtcatcgacttacaaaatcgtccctcaatcacaaaaccagatatataacatccctcaacttacaaaactgttcattttggatccttcggtagttttgaccacggttttatccgacgtggcggttgagtcagtgtgggacctacgtgggtcccactttcagtctctctctcctgtctttctcttctctccttcctcgctctcgcacgggcgtggggatgctggtgacagggctggtgcccacggcggcgcgcgcggctggagggtggtgcggccggcgacggcggctcccagggtcttagcttcatccaggtggcagcgcgcaggctcagggcggtcgaggcggcgagcaggggcggagctagaaaaaaacaaagggggttctactcgcttgctttactctggtttgaatcaaatttagcttgatacgggtgcctaaatttaaactgacgggatatatatatggtgaaaatagataaactataggtaaaaaaaattttttgaaccgggttcgtgggtacccctccagctatactagctccgcccctggcggcggggaggcttgggtacggtggcgacggcttcgggtcccacggcacgccggcgagccgatgaccatgccgatggtgcagaacgcggtggcgaagaagcccatgaccagctgcatctccatcaccagcgcatacgtgacggcgcggccgccggcggcggcgtgcttgtaggcgagctcgacgagcggcagggtcggtccttgcagcatatactaaacatagttgacagcatgctgtgcatgcatgtgttgtgcagaaaacaaaaggagccaatcaaatagatgagctaaatagtgtaatagagccttgatttttgtttctagacgaagtcatctgcgccggtgaagacgccgagccccacgcccgccagcagcacgcgtcgcggcgtgaggaacagcggcgcgccgcggcggaggtaggacgccgacacgggcactagcagcagtgcgagctttggagatacaacgacggtgacgacgctggctgcgtcgtcgtcgggagtagcggcgtaggtggaggcggaggctgacgctgcggctgtggtgcccccccgccgctccttctccgcccggcctcgcgcttgtgcgtcgtcgggagcggcggcgaatgtggaggcagaggctgacgctgcggctgtggtgccccccgccgccccttctccgcccggcctcgcacgtgtgcgtcttcgggtgtgggcgtgtggccggacggcctcgacgcgccccgcctccgccccgccctgccggcctgcctacccagagaagactgagagagtaggaagggagagaagaggggaaaagagaggtgatgacgtgccaccctgacatatgggtttcatgtgggtcctacgtttattcatctgccacgtcaggtaaaacccaaagtgatccggttttgtaaattgagagcatatatccggttttacgttcgaggacgatttcgtaactcgatgccaagttgagggaccttcggtgtactttttccactcgagcaacaaacatatgggcttcgctaaaagcccaaacaggccggcaatatgttgcaccgtgggctcgcggcccaaccaggcagcctacgggccgagccatgcgtgggctcctgaagctggacgacaagaacctggccggctactgggtcgaaagtttctagagggaagtggaataagtccacttggctccctcgaatatagatatcttaataagtgaaatcaacaagctttctccaaggagaatgagccacatcattaaaattgcaaggaccgtcagattcaattggtaaaacgatatagaccgttgaatcataggagactcatcaatgatagtgaaatccataagatcagtcatgaagcttctagacgaaaggccctttggcagagaactcacgttcctagtcaaaatagcctactcaaataaaatatataatttttcataaacataatactatacaatacacaaatatagatggagagcaccagcagctcatctaagtgacccaaatgacagaacaccatccacccgtagcgccaattttgttactcccttcatctcaaaatatataaaattgatcctacttcgcatattccttcatttcaactaactacaaccatcttctatttaatttcttcatgtacttctttatctcaattaatcataaccttcacactttctatgaaaaaaaataaaacataactttcccatttaattttattgtcctctccttaatcccataaagaaaacgtaaaggtacctactctctatctacaaatataggcattacaaatgcttaaaatttattaaaaaatataaggatttatagaataacttaccttcaatctcacctctcattcaaatttcttttcatcttactcaactattttctcaactcctatcattactcggtaaagagatataaagttttatatgattgaacataatctttgttaaacaatatggaaatccttatatttgatgacagggagagtagtaaaaaaaatgtcatgtaattatcaagattggtcgtcaacttctatacgcaggttatgcgaatgcttaccgtcacgcgaagcatgactaggtggctagtaataatctaatttgtatccttaactctaataccaggtattttaacccctaaaacttttaacttttaaaaccggcgcaaaataactccctaagtggttttggctgacatggcacgttcatttagtccgcactgctgagtcatcgtggggtcccacatgtcagcgtccctctccctctatctctttcctcttttctcacatcctctcccatcgccgccgcgggcgcggtgctcccttcctccgctccgcgtcttcggcctcggcctccgcggcggacacctcgccggcgccaagggacgtcgttgcaacccttgtccgtgcgctccttctccgatgctattcgacctcatggtcctccacggccgcgcctcaggctggcgcgcgtccccggccgccgcgccgtcgtccactgtcgttccgcctacgtactcctgcagctccatcatcaacggcaccctcccgccgtcgccggagccgtgcgccggagcagcgaccgtccgatcgacccggagccatgtcgaggggctcgtggttgagggacctataataaacttattcctccagtgaaatgatcgacacgctacggcccacgtgtggtggggcttgttactctccaacagcagttacgatatgggttttcatgcaactaactaccggtgctgattgctgcaaatgccgttgagaccaaaaacaacacgtacgatgggcacggaaaaaggcttaagttgggtgagattttaacgtcaatcaagtcagttagtagtcagagatcatcaccggaatatgcaacgttcaaagagaaaacccaaaaaaaacaaaaaaggaaagcgaatcgatttcagtactcagagcgcttgacctctgatttaaccatcgattcatcagtcgaaaacaacgcatgaaaagcggccctaacgaccgatgtcaactcagtcgatcgatcgaccatcaatttcgtgaggcaaatgcaacaaactcactcgattcgattcgatcgatcggtatatgtgtttacttgattgatgatgatcgatcactggtgattggtcactgccgtcgccatcgttcgtaggatcggattgattgattggcacgccgccatcgagttagctgtagctagccatcgatcgcagatcgagcttctttttttagtgagccgatcgatggacgtcgacgccgcaacgatgatcgagtcgatgacaatcgaatgctcgatcagttcagttgagccttctcctgttcaccgatcgatctatccacaccgaccgcacatgcgtgcgtgcgtgcgttgcaacctagttcacacgacggcgacgtacgtccggtgatcatgtatgggcacttggcacctactaatgtcctccctccccggccggctttgaattgctatactcagcggcgaacgcagaaaaaagttaccagggattctttaatttgacctatgcggactgcggtagaattctcaggtgtccaatataatttggttggcgtgtctcatatggtatagatatataggctataacggtaaaaaaaaaaacatgcaggtatcccaaggacccctgttggaacttagtaggtacgcataggggcagatacagaacaagatttaagggagaactcatctccttctttcttcttcagtcccccctactatttattttttcactattcttctcctttcgtctcctcttctatcaatggtgatccagcggggtaggagggactcgagtcccccagcacccatgctggatccgcccctgggtacgtacgcccctggctatatcctatagctcccgaatggagaaagcgtttggattgtctagctagttgtaatttgccttgttaattttgagctcacctttttactgctacgatcgctttaagattcgtgtggcactcttaatttagcccgctccatcgcctccttccccaccatgactcacttttgtgtaatcccggccgcccgtgtgctaccaacctctctccattgctagctccttcactggcacctaattcgacacctttaattatgttcgtaataagtgtgaccatacttactcatcatagtcactcatatctctttagcagctggcattttatatttgtcacctccattatactgccgccacatcttaaatttaccatcaccacctattgtccttacctgtatcttggtcggacacaaatcttctgcaattctgcttatacaatgtgtgactgataggtccgcctagacacaacacatatcagtgatagctactatagggagtagtattacattggatcttatcggccttgctaatgccactcaagtgctcctctttatcctatccaatgacgacctaatttaaccatttcatagaaagagatgtcattttcacaaccgtcttcgtattgattcaagatcgagaagacaacagcttcgtgaggttctccttctgcaccatgttgtcaacctcctagcacaagctacagtcacataaaatatgtacaactaatatattcaatactgagtgaaggcacgcgtatactctacttagcttaattagaacatgaatcacataccatggtatgtaaaattaagctggcctcatcagctagagattattacatagtttcaagtaatagtgttattgtaataattagctatagtttctttgaagtaaataccggaatgaattacattatctaaaaattggtgttaatgttagggtgacaacccctttaaaaaatctataatgatttgttggcttgttttaaaattattattccgtttttaactattccttcaataattgacctcaaattatcgatagtgttgatgtgcatctgtttgggagcccatatcctataagaaaaaccataattgattaaccctgacaaataaatttccaaataggtagagataacatgccaataaatcccggtggaattgtggctataccagagggcccttgaagacattctctgcgttcattcgtgttttgattatttgtgtcacaagttaaatttggcgcttatttgtgttcctagtacgaatttgtgaggttgactcttgccatttatctattcggtatactttaaaagatgcatacttgtgggtgtgtacatgtgctgtttgttttgtgtagagtaaattgaatcgtcggtacacgaacttgttaggtagatacagtctagtgcacgaacttataaaatgctttggtgtatgaacttgtctggtgcgtgcggaggaaggcgaaaagaacactacgtggctaatcttattgatttaggggctgattaggatatcatgtaaacatatatctgagaaggttgttattagacatacaccttttcaataaacatggctaattttattgatttaggggttgattaggatactatgtaaacatatatctgagaagattgctattagacatacacctcttcaataaaaaatagaaaaaattgagtaggatataatgatagtagaaaaaagatttaaaaactgagcaatggtataagggttagaattataccaaattcatttttttcatgatgaaagataaaattagagaccaaatttataaatattgcatgtcttatgcatactcactacacgtatgcacgtcatatcctaatcaacatcagcttcgtaaaattaatattgccaagttatttctatcctcgtttgcacgaactagacaagttcgtgtattgaaacgagcattttacaagtttatgttctaaattgcacccacctaacaagtttgtgtaccaccaatgcaatttactcttttgtgtaattggatatcctatctttctatatagttataaagaaagacatgcaagaagccacatcatcaacaattttaaaccatcttttggataaaaaaactacttattcatccaattcaatcatttattaattacccattcatctccctttgcttcaccttatagtcacacatagcactgttacatattttgtggataacaccatatttttcgaatacaattcaaataattgtttaatatgtgtgttttgttttattgtgcatgataagatagcatatatttattaggtatcgttacttgaatctattttcagaaaaaactttagtgaagtagagatgcaaattgtctaactacaacgatacccatattgtgcatgaaaataatattcatatattataacaatataccatgatccttagaaaaataaagcatgaattttatttttaataatataaggcatatataaatccacattatcatatattttatatatacttagagttgcacctaaccatttaaaactatgattttgtttgacgataaaactataaaacccgtgtcaaagacatgtggtgctaattagttataataatacctcttatctgaaattgatagtctaattacttaagcatcgggttaattattttaatatgcattcatactattgcaagaaatttattccatattacttaggaacttaattaaacctcataaagaattacaaactcatattgcattatttctacgactacttgacaacgcactcaactgtcgccaccacgtgatttacaagaataataatattatgccaggttatatcatacacacatatatagagagaggatcagtacgaagatcaaaccgttgaaaaacattatagagttgagtagtataagcaatgatcgttaactagcagagattcgacaggtagtttaactgatcaggtatgaaacttttctttttttgaacggctgatcaggtatgaaactgatgcatatagaataaattctgatatgactagctaatctgtacttatcccatcttttttttaagtacttatccagttatgttaccgttaggaaaaaaatactaaagctagttagtttgtcaagaaactgttgaaaagaaggtaaaagcagaaacagttatctttgaccggtttggccgaattaacctttttcctttctgtattttctttctacagagcctaaccttttctctaaagaactgttggcgtaactttatttggtatatgggcctctaagttttagcttaaattaatcaagatggtaagtttcttttctcgtatatattatataagtcatgaaaggtgtagaaaattaatcatgaaagttttagctcgcacggtgattgtcaggactctgtctccgattgcattaggctggatgcttcctttcaccgactagaacggacggcacaacagataaattggatcaaatcgaatctctatctctactattataaaaattaatatgtttttttttcgatatttctgtacgtcatccgtgtatgagtcagtttttttagtttgttcgcttttggaaatatataaggaatcgtataagaaataactatcggacttctaattgtagctcataatttcctaacaaaatatatatacaagtgaatttatcatagtgaatttcaccttaactaacccatatctctatctctactattataaaaatcgaagatgtttttaccggtattttggtacgtcatccgtgtatgagtcggcttttaagttcatttgcttttggaaatacatatccgtatttgagtcggtttctaagatcgttcactttcggtaatatagaaggaatcagaaggaatcataaaagaaatcatgtcacggagagatcctcaatagcggggaatcgtgagaccccccatttgtgagttcggccggggacggaggctcatctcttggaaatcactcgctcgtccctaggatcaccggcgagcttgcacgcaaacggattatacaggttcgggccgctatggagcgtaacaccctactcctgtgtttgggattatggatgagttttacaaaagatttcttgactctagcaagcgcactcgcttcctccctcctggagtttaggtttttttctctacccccccttctcagtgggcagggtcctccttttatagctcaaggagataccacatgcaccgcctctacctaccctctatcggagagggatcccactctacttttcctgggctttaaaccgtgccttctcccggaagctaagcaacaaccggttctcgagtggaaccaggcgccgccccccgcctgactcgggggacagccctgtcattccctcataaatgaacgatgacctgtgatagcccttcctcgagtgacgctcggacgtgacgggtcatacccacccccactccgccgggtacaagggcgacgtgaggacatggttgccctatccgtcggatgtgacggtgccaggccggtcacaaaccggtcacatccgttagacagaggttagctaggcgcgccgcacgtctgcccttaccgcattaaatgcggtgagggacagttggtgcgtcgcacatttatggctgtttagcctgtgctctcgctctttccctccgccgcgtggaagccgggtgagggcctcggggcgaagccgcgggatagcccgagggggtgacgccatgccccgagccccccccccccccgcggcttccacgactcgcgtgacgcgcgaatgaggctaacttgcagagtcacgtggccggagggaaagtaattcccctctacttcacataccccctagtccatatctccgatagtagcccccggcgctatatcaggtatcgatttcctgagatcgttctgacatggtgcctcacgactcctcgagctggggttgtgggcccggtaggggatccaaaaggatatcgccgcgtggccaagttggcatgccaaccataacagcggtttgaccgccactgatcgcgctcatgatgaagatgcttgaggcgcgataatcccggggggtcagtcagaccacgcctcgattctcccgctcgctactcctgcggaggtagtggtgatggtttgctcagcctgcgctcatagccgttgtgcactccacctcgaatgcgccactgacagacgcactaaaggcaggaacagatagaacgggcgacgtgatgagtgggcgcaagatgcgaagagacaaatgcgggcgcgagaatcgtgggggcaagtatgggagcacgaaacgaggaggcaagtgcggatgaagcgaggataaaagggggcggaggcagagactctgcccctttcctttcgccaactgcccactcgtcctttcgcttctcgaaccctaacattctcgccacctcatactgtctcgcgctccacgctctccgccacttctccgccggttgccatggcccaagacaccggcgacgcagtgctcccttcctcccgcatcacagcagacatgcaccttagcctttcccgcaagatcatgccggacggtgccgtcgtgcgggcgggagagtcgcggccgtgaccgcgatatctggagcgatccatgcacctcttgtccttcgccatgacgggcttgattccgcctttctccagattcttccatgaggttctggatttctacgaaattcatgccttgcatctcgcacccaatgccgtgatgacgctggccatcttcgcgcatttgtgcgagatgttcattggggtgcgactgacgatgcggttgttctaggccttcttcattccgcagctgttgcaaggcgcggtggtggggggatgctacttccaaccccggccaggcacggcgggtcagtacatcgagagccatctctgcaagaaatgggaggactggaagaaggattggttctacaccgcgttgccggaccatccgcgacttcgagttcccgctagccctcctgaaaggtccgccgcatggctggcaacttcggagctgggcgaggaatacgacgcggtgtgggatcgccttaggggcctgcagagcctgggcctcacaggggcgatggtctttggcgattacttttgccgtcgcatcgcacctcttcaggaacgatcccgtggagcgtgggaatacattggtcccaacgaccccatgcggacgcatgtgggcgagcgctgggactggggtgcggaggacgcgaagagggtgattcagcgggtgctgggactagactccgccgagccaacactaatcccagatgggattcttcccctctgctgcgaccgcgaccgggagagcattctggccgtgatgtctgccgtcggcgccggtaggagccggtccagccgaggcggcgccagcggtagcgtcatcggcacgggtggcggtggtgcgaccacgggcgggagccgggccgaaggtccaggcggcggtggctcaagggcgcctggatcaagccgcggacccggagacgattccgccggcgacccaaaggggaactcctcgaggtccgatttgccagatttgcccacaacacggcgagcaactcctcgagccatgaatctccgtgcttcttcaggacgttgtacgtcttggtcttgagtcctttgaggatttcggcattggctcgctcgacttggccgttgctcttggggtgggcaagtgaggcaaagcacaatttgatacccatgtcgtcacagtaatcgccaaacagctcactagtgaactgggtgccgttgtctgtaatgatacggttgggcactctgaatcaagacgtggtgcccctgatgaacttaagagcagaatgcttgtcgattttgacaactgggtaggcctcgggccacttggtgaatttgtcgatggcgacgtacaagtgctgatacccgcctcgagccgccttgaatggcccaaggatgtccagcccccaaactgcgaaaggccaagatagtgggatgacctgtaaggcttgagccggctggtgggtctgcttggcgtggaactggcatgccttgctccgctggacccattcttgggcatcttgtaatgcagttggctaataaaaaccttgccggaaggcttttccgaccaaaattcgtgaggccgaatgggctccgcactcaccctgatgagcgtcggctatgagctcgatgccctgctctcgagaaatacacttcaagagtatcccgttggcggcacgccggtatagggtcccttctataaggacgtaccgtttggagatgcgcgcgagcttttcaacttctgcgcgatcctcaggatgagtattgccttcgagataagcccagatgtcggtcatccacacgacctgacgaggggggttagggttgaccccctcgggccccgaggggcgcgggtcgcccggagtcgagtcggtgggcgtgtcattggggtccctcaaagggctcggtcgcaccgatggttgcgcgagcctttcctcaaaggtccctggggggagtgggactcgtgccgacgcaacacgcgacaactcgtcagcaattgtgttgtcgcgtcagggcacgtaccgcagctcaagtccgtcgaagtggcgttccatgcgccgtacctcacggacgtacgcttccatttgcgggtcggtgcactgatactctttggatacttgatttacgaccagctgggagtctcccaagaccaggagacggcggatgcccattccggctgccgccctcaatcccgcgaggagcccttcatattctgccatgttgttcgtggctcggaagttgagacgaacgacgtatttgaggacatccccgtttggcgaggtcagcgtgactccggcacctgcaccttgaaggttgagggagccgtcaaaatgcataacccagtgcccgccacgaatgttggcgtttggatcctcttcttctccgggaagggaaaaagggacattggacggaacaggttcgtccaccggggtccattccgcgatgaagtcagccaggatttgacttttgatcgcgtgccgcggttcgaagtgcagatcgaactcagccagctcgatggcccattttaccactcgtccagtaccctctcggttgtgcaaaatttggccaagagggtatgtcgtcactacggaaacccgatgcgcttggaagtaatgacgcaacttccttgagaccattaagacggcataaagcattttctgggcctgcgaataccgggtttttgcatctcgaagtgcctcgctaacaaagtagatgggccgctgcacctttcggcggggccagttcgtgttgtcaggggctgatgactcggagcgtgcctgttcggaggtctcggggggatcccggactgcctcgggatcataaggctcggggccacctgccaaagcctccgctcctcccttgggggcctcggggtcctcccgggggctggaaactttgggcgctaggccttcgggggatgaggggccattgcaagccgaaggggcctcccgttcgccttcctcacgctcaactactagggcggcactcaccacatggggggtcgcggccaagtagagtagcaatggttcctccgatcccggggccaccaagataggggggaagtgaggtaagctttcagctgattgagagcttgctcagcttcctccgtccatacaaacggcccggagcgcttgaggagcttgaataggggcagcgccctctcacccagtctcgatataaatcgactcagggcggccatgcatccagtgacgcactgcacatccctaagcttgctgggggggcgcatcctctctatcgcgcgtattttctcaggattcgcttctatgcctcgggaagagactagaaaaccgagaagtttgcccaccggcacactgaacacacacttatcggggttcagctttacgcgcgtggacctaagactatcgaaagtttcggccagatcttgtagcaacgtgtcctggtggtgcgtctttaccaccagatcatcgacatatgcctctacattgtgccctatctgattacttaaggtaatacgagtcatgcgctgaaaagtagggcctgcattcttcaacccaaaaggcatagttgtataacaaaaggtgcccacaggagtaataaaggcagttttttcctcatcttccctagccatacgaatctgatggtaccctgaatatgcatctaaaaagcacaaaaggtcgcaccccgcagtggagtcgactatttgatctatgcgtggtagagggaagggatctttggggcatgccttgttgaggtcggtgtagtcgatgcacatccgtagcttgccgttggccttcgggatgaccaccggttcgccagccactccggatggatcacctcgcgaatgaaatcagcctccaggagccgcgccacttcctccctgatgaaggcctgccgctccggggcttgacgccgcactttctgccggacaggtcgcgcatccggccgcacggcaaggcggtgctcgatcacctccctggggaccccaggcatatctgacggcttccatgcgaaaacgttagaattcgcccgcaggaaggagacgagcgcgtcttcctatttggcgtccaaggttccgccaatcttggcggtcttggacgggtcgtcaccaagggggatttccttgacaggcacctcgtcaaccgaggtgaggcgcttcttggaagcgcgggacgcaggggcttctagggcctgcggctccgtggccaccaccaagttgtctgcgtgctgctccgcgtaggcgagggcgatcttgacatcaccaaggacggtgatgggaccagcaagacccggcatcttcatctggaggtaggcgtagtgggtggcgaccatgaacttcaccaacgcgggtctgcccagaaccgcattgtagggtagattgaggtccgtcacatcgaagtcgatccgctcggtgcggaagttggtggagtcaccaaaggtcaccggaagctctacatggccaagcggccatgtgtgtcccggagtaatgccaatgattgggagcgacggctggagcttcatccctggggccttaagtgcatcaaaggcagccgaggagatgatgctcagactggcccctccatccaccagcacacatttcatcttgacattgtggatggtcggggagaccaccagggccaactcccccccccctgagcaagcaccgtcggatggtcactctggttgaatgtgagcttcacctccgaccagcgtgccttccggaccgcctcatgcgtgggaacaacggccagaaactcccgcttcatggccttgaagcttcggtgagaggcgtgagcgcaagcccccccgtcgagcgtgtcgacggtcccctgaggtatctggaaatcctgatcctcaccgtctcagccatcatcagcaggggccttggtcttggccttccctcgccggtcaccggttgaggtcgtgggggcttttgccttccgtcgaccctgccgcttttcctcattagcccttcggaaccactcggcaaatttttgaccgagcggcagtcggcgaga

SEQ ID NO: 72821 - DNA, 6717 bp, Oryza sativa
ctcttcctctcaaatctctttcttttcgttctttaggtcgtcccggtcgccgtccgccgcgtgtcgacttccctccgtcgctcctagtcgccggtcgccgccgtccccttcggtgaggactccctccccttttctttacttccccgattccccgtgcgtcgccgccgcccgcgctcgccgtcgcctttggtcgttgccgccgtccgctgccgccgctttcgcgtcgcttttgcgccgtcgcctctgccgccggttgtcgtcgccggcaacgcgttcgcgcgtgcgccgtcgccgctagccatagccggccggtcggctttgatgccgagccgagccccgcggccacctccaccgccgcccgtccgattggcccgagggcgatctgggccgtcggtcccgtggaccggcggtggaccacccgcgtggtcccggtccacggtgaaccgctccccctgagccgctgaccggtggggcccgcttgccggcgccgcgccccctccgtgctggcgtcagccctgggatttattgcgcaataaatgatttaaggtttttcttgtatagtaataaacacagtgaatcttctaaaattcataactaattcatccgagctccgtttaagcccactcaagtctcagtaaatcaagaaaaatgtgtagaatccattaaaaatggttttgttctctgtttcagtagtcttatagcctgtttgcaatgtttgctttgtttgtcgctagattccggttcctccgacgctccggtgtacttcgaaatagtcgccgaggtttctccagcagcagagcaaggcaagtcatgcttgtcatttgaacatgttgatcctatattgcaaatgctctattgttttctttcaaatattgcattgttttataatgttactatgggatgtttacctattgttacagccatgctattttgataccatgctcctttgttagcttgggttataacatgaatagactttggactaggaattgcttagccatgcttagttcaactagttcacaatggggaaaatcacattaatgtttagactgttggttctaatggctttgttggattagtgacaccgctttggtgttggttaattaaaataaaccacatggtgggctgtgggtgcatggtttagcaggtcgcacccatggcagttaaggaccggttcgcgggatgccctggaagaacttatcgtacttaccacaagccagcgtgggcaacggctaggcttgtagtgtagctctcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtggggtgtgcttggttagagggggttatgcgaagggtcctgtcacggcctctttccggtgtgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtactcttatgaaattggatagtttaggtggatggttgggcctgtcgcaacgtgggttagcgttggacagtggatagttgatactaattaattattacaactatttaaatctttcaacttctgtttataaatgctcgctttatgcaaatgaaccacttcagctcttctttgatgattccctgcatcatacccctattccggtatgacttgctgagtacagtgggtagtactcagtcttgctctacttttcccaaccccagagttcgagttcgggtcagatgaaagtttctccgaggagtaggcttcgtccgtgccgtcgaggatgcctgtggagtggtgttcccgctgcagttttagtcatggcttagctcctgttgtctttcttttcttccgctgcatttttgtaagacttttatgatgtttgtaagacgtggatctgaatgtcaacattgtcgtttgtgtaccccggctggtcctggacggggaatttaatgcacattctgcttgaaattctattcgggaatttctgggcgtgacaatagctttcctctggctaacgttcctaggctagggtgggcgtgatggagttgggtcggctggggtgttcggttgatcggcttccggattcactgtggcacgagggggggctgcccgttgcctgctgggggcgggggcgaaacctgaggtgtggtgcgattggttagagggggttatatgaagggtcttctcacaatcactcgacgtggtgacctgttcatcatgggcacatgatgacactgtgacatgccggtggattgtgtcttgtgggtacagttgtgcacctctggccagagtaaaactattcgaatagccatgcccgcggttatgggagatcgaccagattcaccgtgattagtctcacccctagtaaatcgactcaatgcacttattagttcaggtgggaatggttgggcctgttcaacatggtgtagcattgttcagtggagatttaatataaccttaattactctattgttttactgttttgctcaataaaatgctttacaactgcctttatgcaaatagccacaagccgtccttgtatccccttgcacgtctgcatcattagtgtggcttgctgagtacggtggttgtacttagtcttgctatggttcccccttttcagaagtgtagtgcttctgagctgaagacgaagttagaggaccaaggctcagaccccagttgagttttgcctgtggagtagagctgaagccccgctaggatcgccttttccgctgctgtcattctatctcagtgtgaggactaagtgcctcttctgtaagtattttacgctttatttacgtttggatatgtatatttacttgtcgttttgtgtaccctggctggtcctggacagagatttaatacacaaaatagtttggaaatttgggctaaatttctgggcgtgacaacaagcttgccagcaaatgattggcacaaagaaagagtaaacattccgtagtttacaatgacattaatgcacatgttgacaagagtcaatcaaatcccactcacctctttgctgcccaaaattcacacacactacacattagcgccacaaatacagacaacagttgttcaaaatttaaaacttgatgctcagaaccagcccaccattttcactcccttgctctcactcacaggtataaaaaccaaagctctcaattatactcatattagcaacctattacaccaagagagaccctcaactaatccatggaagaagaggaatatgagattcctgatctcaaccttgatcctggtgtgcaaaaagtgctgcaagatgaaggtgatgggatccctgaccttaacttggatcctgctgtgaaaggagaagatgccttccaatatgaagatgaagagcttcctgataaccaatgttttgctgctcatgaagatggacaaccagaccctgccatgcaagtagttgaactctccaatggctggagtgcacaagaaatttgtcatctaaacatgtagccaggtacggaatcataatcttaatgcaaagcaagttatcctctcttctgctgaaataacagaaatataaatgttgaaagtagcaaagtttgtatgatcaaattttatgaacaaattcataaactaacatgcccaatattacttctttgcataacacagagctttgcagctttgttgttcgtgtcagtcagttgttttttttgactgaaagtactgctaggtctttgcccaacagtgtgattttcatttattgaaggaataattataggtaatatttacaggaagaaacaagagaaaatgtaaaaaaaccctataaagattgtaaccaattaacaacagatcgcttcaggggtccttcattatgtagagatgcagaagaatctcatttgtaaagagagacttccaagaatggaaggttggctgcaaatttctgaagatgagcccatttcgttgtttccaaatgtgccaggcagccatgaagaagatttcctgaaaaccaggctgattgaactgtcatcttgcaaaagctattctttagtaaaattctagattagcattccatgaaattcccagaaattgccaacaagctgtgctaaatggacagttaaagaagagatgatctctggtttccctttggttagtgttgcacagtacacatgatagatcatcatcttgtttggcacagtgcctcctatccaacatatctcttgtattcaatctgtcctagaagaatagccaagcaaagacttttattttcatgacacacttggtcttccaaatccaaatcagaggtctgggtgcttgaattgcagcaaaattgagtttgtagaatcttttgggggtaaaacagctgttattccagatgaaacaccatgaatctccccttccttgttccaggtgaagatgtgtcagttcatcttgaaggttgagatactcacaataggcttgataagagagttgtaacatgaaagaatcttccaatggtctggcacacatagcttgtactgaatcgtctttgtgtagagatgaagcataaagatgctgatattgctgacatttgaattgatcattccacagatctgtccagaatagtactgtagtgcctgtccttatgttgcatttggcagttcctctaaaaacatcaaccaaagcaataatgtcctttaaccaaaaggatcctttgtttattacatgagggactttagctgccaggtaggaattagccacaagattaacccagggaatgtcagctgcagagtaaattttaacaagatgtttcataagcaaggctacattttggacttttaggttaaccatacctaacccccccttttcttttgggttaaaaactctttcccatgaggccaaaggttttctggtggattcagggcagtttcctctccaaagacaattccttcttgcagtatcaatggccttgaacacagtgacaggtaattgtagggagcacatgtagtatgtgggtattgatgataggacagaaattattaaagtcaatctatctccttgaggtaagaacattgaactagctgttagccttctttccaccctatccacctaggggggcaaaatcaatcactcttggccttgtagttcctaggggaagccccagatatgtgaaaggcagttttctaacagaacatcctggaagtcttgcaattagatctgtcttttcttagaaagattgagtggataaagacttgattttgcataactaacttttaggccggtcgactgagcaaacatgtcaagaagttccttgaagcagaagatttccttttgtgaagcttttaacatgatcaaagtgtcatcagcatattggactgaaaaccctgtttactattctttaacatgatcgggaacccacttccatcattttcattaattggctttgaaattaacccaagattgaaagccctgtttactattctttgcaagagttcagcccctagaacaaaacgaagtggagacaaagggtctccctgtctaactcttctcttgcagttaaaagaagtactaggaaccccattcaacagaactgcagagcttgccgaggagaataccatttgcacccaattgagccatttttgtgggaaccccatgctttgcattacagataagatggctgtgtgttcaattgtatcaaaagctttttcaaagtctagcttgaggatgattatttctctttttgactgctaacattgatgaatgtactcaaaagcccatgctaaacaatccttgatggttcttcctttgatgaatccatattggttttcactaaccactttgagaatcacaccttgcaatctgtcagtcatcaattttgtaagaaacttaagacttgatcccattagagaaattggtctgaaatcattaactgtttccggagagggtttttttggcacaagagtgataaaagaataattcaggatctgtaaatctgtagactcagcatgaaaatgagctgcaagtctgtagaaatcttgtgcaatgatatgctagcatttttccatgaaataaccattgaaaccatctgggccaggggccttgtcaactgggattatagagatgagattatcaatttcttgtgtgtagaacatgtcaatcaagcactccaaatctattctaggaacaaaaagctcgttcaaattgaaatctatagttggggagcaagagatacccatcctattcttgaaactttgatagaacaagtttgccttttgatcatgcaggttaactatctgaccactttgattcaaaacttgagaaattgtgttcattctgtacctttctgtggcaatagattgaaacaaattggtgttttcttctcccagcatcatccatctattagtacaatgttttttccaatatattttcctgtattccaaaagttttaagatatgatgcttaactgcctcctgaaattccactcaaataaagagaggcttctgtcttcttccagaagatcatgaaaatcgatcactttatttgagttattcaagagaagcatgattctggacagattcttactccagagcttaagctttttccccaaaattttcaacttgaaggag

SEQ ID NO: 72822 - DNA, 5104 bp, Oryza sativa
  unsure (1)..(5104): unsure at all n locations
atacaactaacaatattaccattcaaaagctaacatcatttgctttagcatgcaggagtgtgggggcaaattgagtccataagccacaaaaagaaacaattcattccatgatattcattagaagttctggcttacatcaacttctgtagaatacaaccaccatctcatactaaataaagagagatgtgaaggaaggacagggaaaaaaacaaccagagacccatcatgataaccctaaacaaagagcaacagcaattcagaactcttaatctttcacctaaagttagttttgaccggagactatcaccaaccaaaagcacactggactgctaaaatcagaataaaatcactctcaattgccagagaagaaacccttcttcctcgctgggctccgataaattagtatcgctataagagaaagaacagcaccaccaccatgatcccttaccatgtggttgggtgcaggatgagaaacacccctcctggttcttccacaaggcaccgacaaaaaaaaacgccagaagttactaacaactacctactaccatatatctgaataagataggtaagggttcttcacaataggcctcctcagggatatggaagaccatgtgaattccttaagcttcctatttacaggacatttggaatttgcaaagctccaaatcatcctcccttggctctttcttgctaccctacaaccatcaaaatgagtcagtagcactggcactgcaagaagcaactatgaacagacagcaaatcacttgaaatctcgctgcagtgctccgctccacgcgacgttgtcgtctgccttctccaacgcggccaccttagcactatggcattggagaagaccaaccttgctcttctcgccatgaggaagctcgacggtctcgctgatggatccagacttgatgtcggtgggcgggatgaagcaatcgatggagaggccagggacattgaacgcgacctcctcgatgctccatgcctcctccatgcgagtcttggtgtggctcatggcaacctctccgaaacggaagagggtcacagcggagcgaccagcgtgcgcaaccattataccctccaccgggcggtagtcctcaatgaacgaattgatggtggtctcccagtaaactgcgtcccctccggtggtggactgaatcctggtgaggtgagaatcctcaagatgcacaaggaggccagtcttctggctgaaatacccaaagagaacatgccggatgatctccgcaagcccctcgctgcgcgcccttagcgtctcagggtccgcgcacagcttcaggatgaagcaatcctccccattcaccttcctctcgccaatgcaccgcgcaccggcaaacatgctcgccgcggtcagaggatccaagccctgaagatacaatatgaaccaacaacaatttcagttagactaccaccttcttccaccatatacacacaatggcacatttcagacgacatcaaactacaagacatggcaggctccccggtgtgctacctggagtgcgcggcggagagggcggacggggcccttggcggaatgcgcgccgagccacggcgtgtggcgccacacgagcttgccattgcagccggcgtgcaccttgctcccgccgacggcgagctcaatgtaccacatctccggggccatctgccacagcacgaaccggccggactccgtggcgcgcgccgccatgcggttcctcaccacgcggccgccggtctcgaactccgtcgccaccatcctcaccttgcccatggcgtacgagttcctcaccgatgacagcagcttctgccccccggaggcagccagatactgctgcagaatgtactgcgccgacgaggtctcctgcaagaacacatcgtaatggtaaaacttacagctacaacaaaatactttttacaactacatcaaagagttgctgatttcttttttctttcagtaaatgggtaactgaaagtgaaatggtagaacactacatgaggaataaaccgtttgtacagtggatatgagaaaatgtatcacatccaaacatcacatcaagaaccagttcttcttctttctttttcttttttttttcatattgtttcttcctaacgaaccagcaggtttttctagaagaagaaataattgaataggtggcgactttagaaattaattaatccaagaactcaaaatccacaaaaaaaaattcaccgaaattttcactcgagaggatttcacccaagagcacttacaatgggggtgtccttgatgctgaggtgggggagcggctcgccggcggcgacgtgcaccggcgcgagcggcgcgcccatgacgccgagcagcagcctcaggtcgttccgcctcgccgcgccgccgccaccacccgccgcgaccaccgccgcgccggccgtcgacggcgcgcgcgacagctggccgcgcacccaccgcccccacccttccctcctcgccgccgccgccgacgacgacgatctcccgccgtctcccgactccggatccgggccctccatgagcggcgccagcatctcccccccaccaccacctcccgcgtaccgcagcgccgcggccacctctgccgcggcggccgcctgcgaccggcggcgagcgcgcgccggcgagaggccgcgggcgacctcctcccggagcgcggagaagaagccctgcttcttgtccatgggagggacctgtttgtaaatacgagaaaacaaaggggccctcgcgcgcgtgaagaaccgtgagggggggaggacctgaatgtaaatgtaagagaagccgagggggctacgcgggaaatggcagtggagcgaggagtgtgtgaagcgaggagactgcggtgggcttatacggttgccagtgtgctgcagtgattctggtcacctcccatggtgaactcaccccccttttataacattggnggnnntannccanncccatttnaannccnnannccnntanantttttggtattttacctagcactgtaatttttctttttcaccttcttctactcttggggtgaaaagagtcgatgtcgattaatcggaatgacggaatttatgcggtcggggaacgagtaatgttgacgatatcaacggtacataatgggttgctcactgaacctgtattaatagtcgtactgaattgtcttattttacgaccctagcttagattagatagggtattgtttggagtggttgtggtttctagtttgactttgattgaatgcgcggaaggattctggagggggttaaatcttgaattatgagaattttaattagacatgcaaccgtacaagaaatgtagggtttgcttaagcttcagaacacgcttcttcgattggataataagacacacaactcaatcaatgttttgtcatgtcattctgttctactatataaattatattttggataaaaccaaaaggatgacagtgtatatatgacattagtatacatattaaaatgaagaatccaacctactcttaaaagaaaaactaaacctattaatctttatgttgagacacatttttttataacgatcctcataatcaaccatactattttaacacctaacgtctgtagacagtgttctaatggcggttagaattttccaaattatgaattgtaaaacgaaaagtaacatctaattagcttctggttgtgttttattgtcctaactgtgttatgtataaaatcaaaacaatgacatgtagatatgatgttgctttacataatactagaatagaacctaacctattaaaagcaaaactaaacctattaacctttatgctgagacacatttttcaaatcaatccttacataaaaaaactatatatataaatattttttattattttaacaccaactactgtagatagtgatgtaagggcagcttagaattttccaatatatgaattgtaaaacaaaaggtaaataaaagaaaatgacaaaggtgatggagccaaagcctacccatcaccctagtgaggtgagcatagcacactagccagacctgccaccgtgggccccacactggggctcgccgtcccatgacggcgccgttagcgaagcttctgatgccgggcggacggaaaagccaccaattaacgccgttagcttagcggcagcacgtgacacgcacgcagggctcacctggaccggacagggtctcttttgctccctgtttccagcttccacttgtgaaatccgtacttagattagattagattagattcaaagcactttaattagctttcataagtgcctctaattagctttgcttagctttgatcactcaaagctaaaaagaggccacaccctggtcttctttaccccttctaccaattatggtgtttcatgaagcagatttacagatttatatagtgtgaagatgctgttcgggttctctttgcaaattatcgagaaaaaagaaatcaccaaattaggctgtccatgaagaggcaaagtcaagttaaacaagaatctaaccgtacctaacactctcaaggtggtgttaatatatgcgacataattaacaatgaataacgtgcttacgtatagaaaatcataggtgtgcttcttagaagctaggatttcactcccgaccgttggaggacagcaagaatatttttttagttgcttcgaaatgtgcacaaatatgtataaatagatttttaaccattacgaggctgacacgtgggttcaggttaacgggggctgggtagaactaaactgatgaactcaccaaccagctgaactctaataattttgacggattttgtccgtaccctctagcgcgaaaatattgtgtagatttagtatatttgatgctactcgtggtgtctagcgtggggttaattatgtatttagctattgtttggtggttaattatttcatgagtcattacttagccaatgaaactatctccatcaaggagggggacttggcgtgcgtgcaagctaggttgattaataattagtagtacttggtttggttggtgatgctaattgatcatcaatgcacgctcaagggcatgatcataagagagtgtgttagtagggtcacatgataattaagcagagcatgcaca

SEQ ID NO: 72823 - DNA, 1135 bp, Oryza sativa
tgcaggccgtgtatttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaataagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggtac

SEQ ID NO: 72824 - DNA, 5340 bp, Oryza sativa
caaaagatcattgagatgaggtatggcacatttgaagcttcttatgataatttgcctcgtttgttagccaccattgcccagaggaataataatacgtactatgacctacatacatttacatcggttgatgatcgaacaaagagtgtgctgcaaagagtctttttctcattgggtgcttgcatcaatgcttttgtgcattgtcgacctgttctatgcatagatggaacttttatgacaggtaaataccgaggttagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacataatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaatcaagagaagaaatttaatgagttgtgggacaagttggatgagttgacaacgaagcaaacagatgagcaatctcgcagaccactagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtttacaactgggtaatgcgaggagttcgggtacttccattggttgctattgttgaattcatccttcacggcacgcaagcgtactttagggatcgatacaagaaaattggtccgtccatggccgataacaacatagtgtttggcaacgtagtgacaaagtacatggaagataaaatcaaaaaggcacggagacatcgagttgttgctgaaggcacacaagtgcatcggtatgaaataatgtgtgttgataggagcaggcgtggtatctatcgcaagcaagccatgcaggaatgtgtcttgaaggcggatggtggatgtacctgcagttgtatgaagccgaagcttcatcaccttccttgctcacacgttcttgttgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattctagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtcaatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgttgttgtgatgtaatgagtgttcggactaaatacttctatcgtgtaatttcaattcaatgttgttgtaatgagtacctccgactattgttgtactagtagtattgcgaactattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttcttttttttcttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttcctggcaacgtgcagccgaccgtcctccctgccgaccactcgtgagttcggattgttcatttctaaatttttaggcgaattacttcatcgagccatataatttacctctcttcacaggttgactcgacggggacagctagcaggcgcaactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgtcgctgtcacggacgcgtatcccacgcaccgtgaccgagactacttcgtggcggtacgtccaatttgtattacttcttacaattatttcatttatcttgcataatataggacaactactgaattttttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggcacctgtttcgcacggtactgctcagcccagaggtttcttaagttttgtttctgtttttctacgaaaacatcaccccgtcgtaacttgatgttccatcctcgcaggacctcgtttgccttcgagcgccccaagcttcggagcagtgcgacctacagcaccggtttcgcacggtacagttcagcccagatattagttcatttttgtttcagcttttgcacgaatatgtcaccatgttttaactgcacgtttcctcatcgcaggacctcgtctgccttcgagcgcgttcgcaggcacgaccggcgcttccgcgagctccacaggggcgttcgccacctcttcgggcgcgttcgccagctcttcctctcacggagcgtcgatccctcgcccacacggtactttactttttattactactgttaaatacttgtacgaaactgatggtccttgtccagcaggatttgcagccgggatcttcggtactggggcctcttcgtctcacgccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaatgacgctatataattgacaatctgaaggcaacctcttcatatcttctttcccactagcacaccacacacgaaaatggaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacaatccaaatatgccctaaaaaataataaaattgtattttaccagtcttggagattttaatcttgtatagttttcaatataaaaagatttgataactattgatatttatacaaaaatatagagcgcagtataaaatcgccctcccccagggcggcaagggggccgcctgcaaaattccatgccccctcgccgcccatttgcaggcggcccccccacagtacaaaatcgccctagcggagggcggcaagggtgccgcctgcaaaattccatgccccctcgccgcccatttgcaggcggcgccctagcggagggcggcaagggggccgcctgcaaatttcgttgacggccgtcgcccgagagcgaacggccggctgccacgtcattttcgccgccctctgggagggcgatttttaaaaatcgccctcccagagggcggtaggcgactacttccgtcaattttcaaaatggaaaattatttttgtaaaacttttaataaaaaaaattcgtgaaaagggtagcttaggtagctgtgctttttgtaaggcccaaagtacagtgtgagtttcctggcccatgtaggataggcctttgcactttgg

SEQ ID NO: 72825 - DNA, 10315 bp, Oryza sativa
ccgtcctgctggtcctactaggtctccggcacaccagccgcttcgcatcgttggcgctggtcctgcctctccccaccggcctcctcacatacacccacctccccgctactgtcgcggcgccagaggacgggtccgcgccagccgtggtgaactgggcagagacggcgaggccggcgacgacaacgatgccgtcgcggcccgcctcgcggagcacgaggcgggcggcggcgcaggaccgcgcgcccaccggccttgcccaacggcctcctcccctcctgtcggctagcctacgccgccctcgccggtggcctccgctccttcccccgctgccctgagattagagagagtgagagaaatgagaagaggggaaaagagagggtaggctgacatggcacgatgacatgtggagcccaggtgggtcccacgctgacttagcggccacgtaggacaaaactgggatcaaaatcgtcgagggacctatcgtgaccggtttttgtatagttaagggacccgcggtatctggttttacggttcgaggacgtttttgtatctcgatgataagttgagggaccttcggtgtactttttcccttctgttggaatgagttcgctttaagttcctcgtcttgaactccgggtttgaatcgtgtccttgaaccgtagcaccatatataatgcgttcttgaacttgccataccgaggtatccaaggtcctagaacagtattgtcgcgatttcgactaacgtagtagtgagtggccctatgtggtgtcccaggacagtattgtcgtgatttcgactaacgtggcactgagtcaacatggaccctatgtggtccccgcaggttagtggtcagtcttcctcctctagatctcctcttgtttctcttcctcctaggccccaagtggtcatcgacagggcagaagtgcaatgtctgataggatagcagctggacggtggcaccacgctaccgagctggactagtcgtcagactgcagtttttcaatatttgttggttttcctcgcttttttttagcgatttttttatgggggaggaggcaagaggaggaaaaaggacgaccatgctttttaagtaattaatatatgaaaaatcgctatgccgcttactcattgcgcagaggaagatcacggatgttgcataattacttccatagcaaccaaatggcaagaactttgtagctactggatactgtgtgtgagctactggattaagaaaaaaacggatggatccagtacttgcttgatccacttcgtcgacccattctcggtcatatggtccacgaaaatttttaatctccattgaaatgcacaggcaatctaaagtttgcaacgggacaaacaattgactaaggatagactttcaaatttgccaccaagctaactttcaaaaaaaaaatgttaccatcaagatatatgttgccggcttcgacacatatatagacataacattatgttttcaaaaaataagaaaaaaaaacataacattatcacaaatcaatgaatatggacgtcaaaattcaccatatataagcatcgatcctggctttttttttatggtggaaatctagctacttggcaagtcaatattctggctcgatcgtcctcgatcttactggctacgtacggtaatttccactggtcacaaaaatatgttatactattctggatatgattcaaatcaaacttgttgttttttacgtggtttatatgccgcagcttgagtatatctcacccaatgacccaaacacttgataatgttacgaatttattgtctacttttacaaaagaaaaggaaagaaatttagtgctgaaagttacaattttggcactaaaatatccaaaaatggtatgtttttctgtggtaagagaaaatgacccccttttttttaagaacggtataagggcatgtacaaaggtagagtcggatatgagctctacgttatctagagactagcatcctacaacagttagagacaatatggtctctaatcattaatgtatcaaaatattttttcttacttttctttcctttgtttcaccatcatgcaaaaaaatttgctctaataaatgctaagagtcgactctgagccgttgtcatgtataacaaccatactcctttctctttcttctatgtcaccaaatttacttgcatggcaatagagagagaccactaataaacaccgttgtatatgccctaacacatgaagatgcttctatatatgcatgttttcgttgatgccggtgcgaatctagctgagaatatcatctggatcagcaccattacatacacgatgaaccttgaactgaaaaaaataatgttttaccacaaaacatttggaaatttcaattcatgcggtaggctgaccccagaatctagttagtttcatcctgagcagagctagcattcactagcggatctagaaacattttaagtcccatgcaaaacccactagcatagataatctgcattgtacaatactctactaaacaaaagatttttctggacaagcatcttaataggttgcagtcgagcgataagtgtctgaatctgaccagttgactggccgcaagcgatatacattatcgtgtgtggtcgcttaagagatccgcacataataatgcagccgcatcacatgtggtcctcttaaacgatcgcttaaaagacctgcatgcgatcatggaccatatatccatcccctagaccgagctactaccggttgaacctgacgtttctctctctaaaacgaagcacaaaaagatgatgttttcaactcgaaatctttgcttgcctgcgaagatatatcttcgcgtgagaggttgggccgtccacaagcgaaaaatggtgatcttcacatacacctgggagcagacggaccggccaactgcacatgaaaatgtttttcggccatctagagaaaaccctttctataatagtgataccagcaacatgccattttcatttcttgccttgtgtaagccagttagggccactatctaggatagtcacattggctctatcagggtctagcatggcaagtggcgacatctttgatagtagctcttcgagtcaacttgccgtcaactgttcgtctgttgccacccatttcttacccacatgattttcttggatatgtgagttcatctgaaccgttaaatctcaatcggacggaggaaaaaaaataaaaatcaacagtgaatattttgaagttttctcacataagaagatttatatgctttatatatgggggaagatgaggtatagctttacgtgcataaaacataaacgtttaattattcaagttcgctcaacaaggcgcgaaaaaatggcgcgaaagctgttcgttctcgtgctcatcatgtgttcgaccaccgccctaattacttgcaccaatggcggcgccggcgacggaggcgaagggctccacatgaagctcacccacgtcgacgccaagggtaactacaccgcggaggagctcgtgcggcgcgccgtcgccgccggcaagcagcggctggccttcctggacgccgcgatggccggcggcggcgacggcggcggcgtgggcgcgcccgtccgctgggcgacgctgcagtacgtcgccgagtacctcatcggcgacccgccgcagcgcgcggaggcgctcatcgacaccggcagcgacctcgtctggacgcagtgctccacctgcctccgcaaggtgtgtgccaggcaggcgctgccgtactacaactcgtcggcgtcgagcaccttcgcgccggtgccgtgcgcggcgaggatctgcgccgccaacgacgacatcatccacttctgcgatctcgccgccggctgctcggtcatcgccggctacggcgccggcgtcgtcgccggcacgctcggcaccgaggcgttcgcgttccagtcgggaacggcggagctcgccttcgggtgcgtgaccttcacgcggatcgtccagggcgcgctccatggcgcctccggcctcatcggcctcggccgcggccgcctctcgctggtgtcgcagaccggcgccaccaagttctcctactgcctcaccccttacttccacaacaacggagccaccggccacctgttcgtcggcgcgtcggcgagcttgggcggccatggcgacgtgatgaccacgcagttcgtgaagggccccaagggctccccgttctactacctccccctcatcggcctcaccgtcggggagacgaggctgccgatcccggccacggtgttcgacctccgggaggtcgccccggggctcttctccggcggcgtcatcatcgactccggctcgccgttcacgtcgctcgtccacgacgcgtacgacgcgctggcgtccgagctggcggcgcggctgaacggcagcctcgtggcgccgccgccggacgccgacgatggcgcgctgtgcgtggcgcggcgcgacgtgggcagggtggtgccggcggtggtgttccacttccgcggcggcgcggacatggcggtgccggcggagagctactgggcgccggtggacaaggcggcggcgtgcatggcgatcgccagcgcggggccgtaccggaggcagagcgtgatcggcaactaccagcagcagaacatgcgcgtgctctacgacctcgccaatggcgacttctccttccagcctgccgactgcagcgcgctctgatcatccaagccgccccgtgtcataatttcgtaaataaaaccatacaaactttttattaatcaatcatgatataatcattcacaagtaattaatttgtggttaaaaataaggcagttaatactgtccgttattcgagaatggaggtggtaatttgcctagatgtttcttcagttacgtaccctaagacaaatcttgatcgatcgagatgtaatacataattgaagaaacatccactgtctcgatggtgatctagcggggtagggggaactcaagtcctcccaacaccccacgctggatccgtccctgagtagggcagagagggagcgacagtagtccaagctaccgtggcaatggcggaggggtgtgatgtcgccagatctgcctctccccaaccctatcgcatgcagatatatcctttgtcacaatcctccatgattgcatcctcattgagctctatcggttgccaccgctgcctcattaagcttgtagccctagactaccccttgagctctatcaccgcctcctcgtcgagcatgatgacaatgatgagcggtcaccgccagctcagcctccccctctggccctctttctcattctctcaaatctctagccttttctctcattctctcaaatctctagccttctctctcattctctcattctatctcggctcattgagaggaagtggatagctagactcttggagttggagcttagtcaaacaatttcagttccactcaaaataatagtgaagctaactggagtgctataacaaatgaactaaagagatggagttgggtttaggctgctcctcaactttactccagacctagctgttggaattatattaggagttggagtcctactaaataggcccaaagaaaagcggatttactatttcacttacgacaatttttttgtggctcttatatttcactttttcattcataggatgttacatcaagatctgtgttcttgtatctaacttgcagttacatttagttccagtgcacttacactcagttacagtgcgccaaaaatagatttacagtagttttttctttagatttatgattcttgacatgtttgtcttttttgttattggttgaaaatagatatattagccgaaactgtcacgtggacgacatattagccgaaaccaccctcaaaacaactatgagagtcgttttgcaccgatttaaatacttgacggggaggggatgatataccctttttacggttaagagatacgaatcagattagattaggtagaatggactttctgcacgtctttgtaataaaaaaaacaagtaggcatgtgggccatgttctatgggccgtttcttacgggagatagcttcgatgggctctatcttttgggcctcctgtgacctacatgggccgcacttctttctatgatgggccgggggcccacatggcggcatcctctctctctctctctgtgcaccttatcccctccaactccgatggtgggcagtggaatctgctcccctcaaaatcacctccccaccccccacctcctcgccgccgccgccggccaccgccgccgccgccgccggaggggggagggggacgacgacggaggcgcacatgctgggcacgacggccgcgcagccgacgagcaggcggggcgggctctccacacctcgtacgttccccccctctcgttcgtatgcttgttcataaaagctttttgcgctcgcgtttctcatccgcgcggtgggctgtcgtcgaaaggcacgaggcatggatttgggtgcggcgtcgacaagatgaatcgtctgcggttggcgattccctccgcttcaaagaatgtgagccgctgtgggaagcttgctatctgcagagcacaaaggtctttaacttctaatctatgatgtttgtattcttcaggcaaagtattttttgagtctggatgtagagctaagctactcctagttttatagtctctagatagatatagcatttcatggtagagactagagaatgaatgacaggagtgccctcttaacataataataatagtattattacctaagtggatttgcagtatagttgaattggagtcataaactcaagtgattctatatccccatgtcctatttctaatcacagttgagtcgaacaccgccacaatggaacagaattactgtgatctttatcgaagatggatatggccattggtttgatgcatcatattcttcagtagaaaatgattgctgcaactctaccattgcaagtaggctgattggttactttgtaacttttagatagtggagtctggggagctgcttcattaaatggcatattctccttcatgcacttctttggataggtcttgttacatttggacaatcttgtaatcaaatattcttctataatatgttttcagctgcatgattatagtatttgtcagaatgtcctgtgacagttgatgtgatttgcttgtacagtgaagattctaaaggtgggggaggattcttgactggatttcttatagggggcgcaatcttcggaacattgggatatgtctttgctcctcaggttttgtcaaacctttttaaaaaaattatgcgtggcatcggcacatgtgaagtagataaagaaacccctcatatcaaatgttgattcatcatgtttattttacaatacactgccttactctctagtgctgtagcgaatagccaatgtcttgttgagcaatttagaagattatgaatttctgattttaacaacctaacatatccatgctcgagttgactaggtggagtgctaagtgctaactaaaagttatgcatctgatatactattcaccgataataatgttgttcataagcaatgctttgtgttagtcttctatggtcatgctcggcgctattgttatctggtttgcaaagattgttaatttggaattggttgttaacaacatagcgttcttgagcagatcagcaagacgctagattctttattagatgaaaatggacaagacagtgaatctgatgaacatggccttgtaaagccacggtatggtcgatattatgatgaaggtttagaggtaagaaatcaaaaatatcgctggactattctacttgtaacatgctttttctggcaactaaaactatgaattggatccagaaaacccgtcaaacactgggcgacaagataagccaactaaacttggcaattgacaaagctgcctcccggttgaagcgcgttgctggcaatgtggaaaaggaagctattaatgatgaatcagaagtagagacttcttagaacttgtaccttttcaggagttctgtttgctgagtaacaaatctttttgtaaattattcgtttcctttacactgtatgtatatgttaatacacaaacccttcatatgcataatttcacagacttgcatagtatattctagattattgccacaaaaatttgctcccaagattcaactatacaaatttgttgtgactgctattttctttaagcctccgtatgtgaaattaatgactactaatttttcttgagtctccatatgttaactatattaccatcaatttttctaaagcttccctatgtgaactgattgagtattcactgaatttgcagatcgaaatatcttcattcaacgataatgagcttgtggcggaaaacttgaacgagcaaggatttgtgcaaggtgaaacagcaacgtagtgtatgtttaaaacaggcagcagagcagccgagtaaagccatcagcgcctttggaacagtaagtagactgcagaatcccaaattgaaaaaatgttgtagccaatccatttatattgtggctaattttggggacattttttctgcaaacatgtagctgaactggatggcctgtccaaccgattggcagcatgaaatgaatgaaacattttcgtatttgtgcccttttccctgatactccttcagtgtttttgtgatccaagcagatattgtgatttgcgaggtagatctatctctgttaatcgtaaggtacggagaattaactcgaaatcctaggcctaacccctagatagctgctgattaagggcttggttgacagctacagatcctatctccaaatccttcatgatcccaaagactaaacaaaaacgtttggctggataccaagctccaaaactccatgcatgcttaaacaagtatgaaaacacttcatttatgaacatgaaaacacttctggtgatgctcgttacccaattttgctgttcaaatttaaattttatttgagatttgctcccccctttccgataggatgactttgaaatcgtataggtaggagaacgctatttgagaaaaccgtatttttacaagcgttgagaaaataataattttatgaaatacaagaaatttcatctacacaactacacaagaaactccaggatgtttttttttcttttcgctgttgaataattgattgtataggaaacacatataacaatgatataaataacagctgtacaatggaaatgcaagtgtgtgtgtacacaacttggcggatgaaacctacttcaattcttccccattttgaaacatacattaattctcctttatattgccaccaaaaattttacaaaacctatccctaataataaccaagccatcacactaagtagatcaactgttagggctcaagattaaccagaagatgatgatgattttgccagtaattaccactccctccgtcccataaaaaaccaacactcgatgcgacacatcctagtactacgaatctagacatatttctatccagattcgttgtactataatgtgtcacatacagagctagattcactttttggacggagggagtagaccatatccatggcgtcgtcgcgtacagcgtgtacttctcccaagagcgagaggaggaagaagaaggagagatggtcagctaggacaccgaatgcctcgtgttccgcgacggcgtcgacctcgtctcctcgccggggctctccgacgtgtcggagctgctgttctcgccgctgctcgccttgccagaccacagcttgctcagtatcttcttcggcatcagcccgccgccgccgctccccttcgctgacgccgacgacggcggcggcttcttgcaggcggcctgatcgccgccgccgccggagacgccgccgttcttgttgttggcgaggctcatcgaccggaaggaggtgacgtcgacggacgtcgtcgtcggcggcggcgcccactggtcgtcctcggtcgccgtcgacctcgagctgccgtacgagttgccgtcctgctccctggggaggagggagcgcgctgccggcggcatgtcggcggccgccgccgccgacgccgacgacgccgcccggacctgctcgaagaagaggacctgcacgacgacgcggagcgggaggcgctcgttctgcacggcgtgcatgctcgcctccggcgacagcttcttgcagtccatcagcccgcacagcctcttcttctcccccttcgttaaacccggatgctcctgcaaaaatgtcacaagctgacaattagctcaaaagttttagactgtttgaccaaatctcgtgctaaatgttactccccccgtcccaaaatatgagggtttttaggtga

SEQ ID NO: 72826 - DNA, 649 bp, Oryza sativa
tgtcgtatccataggttaacttaccatctttacaataagctcatttgttatgaaccgccacatttccaaggaggccaaatttgttagtcatcctcttccgtggcacatgtgggtgctggtgttacttgtgatattatttgaagcatgtctttgtttgaaatgtcaattatgatttcatagcgtgaacatttttatatgagcatatcctgtgctcctgtcagttgaacctacattttagcgtgcccagtgttacctttggtgctaggtgcgggtatgatggcaggccagcacctagcgccaacagccaccaaggcgagttactgactgcctaagcaggaaaaatcagtttgtcagcctaggcgggcactgttccccttgttgactttataatgcatgttgcattgctagctcttgtatcctttaataatgaaagccttcagggcattccaggaatgttgtgtcttaaacttatttttgccttgttttaatctctgcagtactacattgatccagtcagtggatatgaatttcgctctctgaaggatgtgcaccgttttcttaaatcaggggacatctataaatgcattgtaaggccaagaaagagaactatccaagatccttgtactattgaaaaccaatctcatgtgag

SEQ ID NO: 72827 - DNA, 596 bp, Oryza sativa
tgcgccccctttctgatacaataaatctgacagatctaccccagttggcccgtaacggacgtttcctggtccatggtaaacttggaatatttgtttgttcgacatatctgtcaacgaaataactagatcatattactctttcatgcaataaacatctacaacgtaatatcttcttatgtaagccaatgcaacggtaatgtattgattccaaactagcagatctacgtagttaccgatatctacaatacgtacttctagattagtataactaaaaccctaaaaatataatgcatttattcaaacaaatttttaaagaatacacactatttaactcaatagtcacatataggatttatgaatattacctgaaatcggcgtctgaatccggcagggcttcgccccttcttctcttctcctcccctttcttctttttttttcactgaaattgaggagagaagaatgagggctgggggctgggcagcaggccttttataggcagcgaggcctgccgcccggccagagggcggcaaggggccgcctgcaaaatagccggccccgactggcttttttgcattcgggccccttgcagccccacc

SEQ ID NO: 72828 - DNA, 8380 bp, Oryza sativa
gattatacaggttcgggccgctatggagcgtaacaccctactcctgtgtttgggattatggatgagttttacaaaagatttcttcactctagcaagcgcacttgcttcctccctcctggagtttaggtttttttctctacccccccttctcagtgggcagggtcctccttttatagctcaaggggataccacatgcaccgcctctacctaccctctatcggagagggatcccactccacttttcctgggctttaaaccgtgccttctcccggaagctaagcaacaaccggttctcgagtggaaccaggcgccgccccccgcctgacacgggggacagccctgtcattccctcataaatgaacgataacctgtgatagcccttcctcgagtgatgctcggacgtgacgagtcatacccacccccactccgccgggtacaagggcgacgtgaggacatggttgccctatccgtcggatgtgacggtgccaggccggtcacagaccggtcacatccattagacagaggttagctaggcgcgccgcacgtctgcccttaccgcattaaatgcggtgagggacagttggggcgtcgcacatttatggctgttcagcctatgctctcgctctttccctccgccacgtggcagccgggtgaggacctcggggcgaagccgcgggatagcctgagggggtgacgccatgccccgagcccccccccccccccggtggcttccacgactcgcgtgacgcgcaaatggggctaacttgcagagtcacgtggccggagggaaagtaattcccctctacttcacatacccccgggtccatatctccgacaaatccgtttaaaaaaattcacatgctaacttgagacgatcggactcctaattgcagctcatgattttctaaaaatatatatatccaagcgaactcccaatttcattttaactaaaccatataacaataataagattaaaataaacttcacccgttgcaacacatgggcatttttttctagtaatcctaatttttattgacttttgggtcctgcaatttgagttttattgatcaatcgtagcaaattaattaactagtaggttttccgcactatttgacgtgaaactagatataaattagaattatatttgattaaactattttccttatataaacaccaaggcaatagctaggaattaaaggaactggtgcgaaatacataatgggatctaaaatttgacagccaaatttttacaatcttgttatcgtgatggcctatcatgatgactcatagagcatgatcacacctagctctattcggtttagctttacctattcgatcggcttaatattgtgtcctactacttttaattagttatggcttttagtcgtgcctttagtcttaaccttctgggtttttgtattctacttatgtcactaattaagcatgctcccagcttgtttggtaactcgagggaaggggattgggagtttacacgagggaattgatgatgagattatgggaatttgatttttaattccaatatcttgtttggtagaggtgatggaaattgatagggagtttagttggagattaggttattaataaaaacggatggctaagatttgtttaattacctgcccctacctaggtattgaaaaggagggagtttcttcctcaattccccatctccatcccaccaaaattcccatgtctcccgaccaaacaaaacacttaatagcctcatccctctaaaatcctaatcccttctaaaaactccctccaaccaaacaggccatccatgtaattaagatttggggcctctaatttttaggggtcctgaacaatcgcacatcctgcgcatgccttgttctgcgttacactatgctctgccttaacaaacagggccggatctacattattaggtccggtgttagacgatatcgatgactttcggcaaaacctatagcaaaactgcttatccatatattataacactatgatccaagcataattagtatattatgacaccgctagacaagttataacaccaataaaccgatgaaccacatgagttggttaaatgtgtgggaatagagggcactatatcaatcgatatatgtttgtatgcgtatacccatgatgattgatccagggtgtaaatctttcagttttgagaatttttatatgcctatagagtgaacgtacggtgactcattttcgacatctcttaattaatacatatagatgaatcatctaattactaaccactccaaaacttgcagtgtcatgcgtgcactaaacttaaagccgaagttgttgacgacgtaatatacagttacatcattacacataatttaaggtgacaaagacggtgacagaaaaaggcaatagaaacgtatgactgcaacatagggtcaccggcacccatggtattatcttttggcttatacttctacatatcaggcaaaatttttaaccttaaatttgaatctgattttcaggttattttttcattgaagtttatttttcaacctttacttttaaatcgataagaacatatacataaaagttttattcacaaattagtttccgtttgtaactatgttgtttagattatttcacaaataagccaaacgatggcaacgttattatgcacctcttaatataaaaatagataaagtttatgcatgtaagttgttaattaataacgtacggttagctttacaatttttttaaaaaaatgtagaatattattttccctcatgttttgccttaatttctcaatctggtctattagaacatgatgttccattaattgcaacccccctcccccaaaaaagaaatgtccatctctgagtatctcaaaaataccagtttaattttgaactgacaaaaaaacttttcttgtggaactgacggttgtttgaaagctcgggctggtggttaattctgaactgtcaaaaaaaactatgaaccaattagctctgcttttacatataggagtataatttttcttgtgaattggtgtgttactatatatgcatgagtccatcaattattattgtgggtttgaattctacgagcaaattaagattatgaacccaaaataataattaaacacatctatcagtgggacccacacaacagtgaccgttgacactagctactattaatgtttagtggcgtgctcatcaactttgacctcctactgtggcctagcttccaccttatccttgaattctctgggagtagatggcgatcaaattgaacttaatttataactgctaaaatttgatcgggattgtaatatattttctaatattcctacattattgttggtccaatttccgttggcaaatggaattatggcaacatcaatcataggctctgcattctgcatagcagaaagtcaggagcaccttaatatggggttcagcaaacaacagttttcagccaccaatactataactcctgattgcaattagcatctgcaaattaataatcactggtcagtctactttgcaaataacatagtctatcaaaattaattattgaagctgagatgtggggctgataaaaggggggcaaaagctagttagctaagctctgaacaatcataatttcagtgcaactatattaaagctttgccattgatttttcttcagatcttctgagattgcagatattattactgacgacccatgtttaggcctgaatatctaaatttcatacacatatattcagtaaaggatatcattaatttgtcactttcattatcgttgagagggcaatgatgtacgtacctggccgggtgaaaaaggtgttaaagctaaagtttctgatcgagatatctgatcaaagtttatctgcaacaaacatagcagtcaggcaccaattttctcatcacaaccgattcattcatgctatatgtgcagaagcaagagagaatccaagccactttattgagcagctaacattagtacttttaggtaagcctaagacatcatgggagagaccagaccaccggttccagtagccatttaaaaccatatactatacgtctatcaaatcatcattagcttaattgtattgttagagcagccccatatatacaaagtttcatcaaaattaattaggatcgatcccatgcaatgcatgcattcggattaaaagctggtataattagtagctaggtagtagtagttacctgtaagataatatccccaatcaattgaacttgtctgattgagttgctccagcaaccaattcactcaattaaaactaatccagaaagatcgaacaacatgatagcaatgtattggcaaatcaaagaaccctcgtttgcacgccttgtccatcgactatatactgtctttctgcctgatatattaattacgttctgactctccgtgaattggtaattaaattaataaaaaccttaggttaattttcgggcatcagattctcacctatgctttcgtaaatcatataagagaactttaattaaaaaaaattcttggtgtagaagatccagcattttgatttggatggaccatatcctcaagtggatggatgatgccgaatacgtagtacagagataaggccccatccgaatttagtggccaaataaattttaaaatctaaaataaccccccaaaatctcgagcaaaatacgtgtggacaggatcgtctgcggcctccaagaaaatggcgctttcagcgcacgtcacttcgggccggcctctcccagccgatccgggccacccggcggggacacgttgtacggcccacatctgtccacgtcatcgagaaacacacgcacatgggggccatgcatgcaacgttagcgaggcacagttgacgcagcagtaaaatcttttaaattttttctttttttttctcaaacgcctacgtgaggcaaaatacctcgacgtacggcgtacaaatgtacagtattacaatctgtgtacgtacaaaatacacctcctaagtacgtacatatacatgtatatatattgcaaccctctctatatagtaatagtaatctaggaagggaaaatgggggctaattcgcctaccacagcgtaccgtattttgtacctgtagcttcccttctatacataccgtaataatacggtatatatataatatacccaatatatatactatcgcgtacgcatctgacagacgtacacttggtgtacgtgtcctctcagcggtcgcaagccaagccctctgtacaatactgtaatgtacaggtacgtgtacgtgtatactacactacctgcggtcacgtatacgcatacgtatgcgtatatgtgtacggaatgcatcagaagctgatggggtagacgtgctgcatgttggggtagaagaggccccaattctgctcgacgccggcgtccttctggttctcgttgaacatggagaagacgtaggtctcgatggcgccggggtggcgcggcgtgccgcggccgacgtggttgatgaggttctggttgtagatccgggcgttggccggcgaggcggacatgccgccggcggagggccagcctgtctcggagacgacgagggagacgccggagccgccgtgcttggccatggcggcgtagaacgcgtcgacggtggtgtcgaacaggttctggtacccgtaggcgccgtcctggacgacggtgccggcggcggtgaagagcgcgtaggagacgtcgacgctgccctggctgtaggtgtaggagaagtaggggtagatgttggcgagcagcggcgcgccggtgcgggcgaggaagctcaggacgggcgccatgaacgcctgcgactcgccggtgaactccgcggcggacggcgggctgtacacggcgaggagcgcctgcgacaccgacgtcgtcaccttgatgtggcccagccccgccgacaccagcgcgccgcggacgttctccatggccgggaccaggctggacgtggcgccgccggcgacctcgttcccgacggcgacgtaccggaacgacaccgacgggtaggcctggatgttgttccgcacccacgacgccgccgcggcggggctggcggcgaggttggagagcacgtcgttgggcgcgccgacgacgacgctgatccccgtgccgcccaccgactgcagcgccgcctggtccggcgcgtacagccgcatcgacgtgatgccgttggagcggtacatccccaccaccgagctcgccggcggcaggttgttcgcgctcatgccgtagcacaccccgatcgcctccgcctctgcatcaccatcatatcacgttagtaaaattttttattactttaattatttacagcaattaattaactattactaagcttgtggttgctttatttttttcgatgtgcattttaagacttgtttatgtgcgtttgtctagtacggacttatataatactccgtaattggttgtagctcattgagtaaaggctgggattctattctattattaaaaaaataactaatttatagagctgtaaataattatgtttttatgtttagttactgttaatgaacagtagtgcatgggtgtacatgtattactgtttaatattaatctcgttttaaatcgggaaatgggtacacatagcaagaaagggcggccggagagtagtgtagaaaagtgacagaatgcgatgcatgtactactattgaagaagtacaaatacatacacatcctttttttgacttattattttttcgatgaataataatttaaattttaatcttaatctcaagaaaaagacatttaactgaaatttgtatgcgcgcttggactagcttgatttaatttgcatattttttttgtgcttctctctctttctctagactctactactggcagacaaaaatgggatgtttttagctttgttttactgaaaaatattatactgattaagttggtgtcaagtgcacgcacactgacgaggaataatatatatttgcttcttgcttagttgcttgaatgctgcaggtttcctgcttctctagcttgacctagttgtcactcgtgactaaagacgtgtctaaagtgtgtaataactttaacaagtatgctaataagctagctcgtgaccaaggataaccttaaacaacgggataagcttttgaccctaagtggattaatctcttactagctagcaatctcactctactacctaaccctgaaaattaggtctaatagttgaaaactctcccctgatgggtcacctcaggcatctagctatagctcttgatgcaatttttttttttgactttggaaagctatcaagtgtttatcctacaacaaatagcatgtacttgcacgccacttgtcagctaatttcggagatggacaaggaatatactacccaagaaacatagagaaattgagagagaaaaaatgagatagagaaattgaaagagagagagagagagagagagatggagatgtaatggtttggtccaacgtcagcagcatgaccgttggatagtccacgtaaggtcgatgtggccaaaggggaagctagctagctaactaacaaagcagcatctaataagctttagctgaagcttagtttagaccacccgtgtgctaatagtcagtgagtgcagtggagtaatatgcaactactcaagaaacgtacatgtccaattaaatgaagcacacccctacaacttactaattgctccaatttgtcaggtcataacatgctttaggacaacataagcaacacctgtcctaactaattaatttctgactactggtgatcatggatgtgccatgtgtttactactactctctttacagtttagttgcactatatgtgtcaatatttgtgttagaacaagactaatagctataatatgtagtacactatttagtagtatatatccatcattagatattgttagtgagtgagtgagttagttactagctagtacaacatgcatatatcttacttaaagaatggaacagtgttggtacaagatatgggagtttgtgtcaacctggaggaccattggactgggcaggtacaatatcatgcatcatttgaaaaatgtcaagcgatagatatatatatatctagagagagaaaactaaagacgacagataatgagatatggtgtggtgttgggttagggggtggttaagcagttgttgcaaccgaatcaataagggaacaaacgaagcggtagggatcaagagagagatagaaaagcttatatttgtgagagagatagcacttgataaattgaattaactttcatgaatgtcaaaaacaaaaaggctatctccagtagctgaattcttagcctaacatgactactgatgagagatagaaagaaagacagatcataaagctaggttatgtg

SEQ ID NO: 72829 - DNA, 1629 bp, Oryza sativa
gatcacttggtgtgtcgttgcaacctctctaaattagtaaattataagcaagcttagctataactggtcatagctgattctattaatcatcagtttggagcatccaaatgtatctggccgttgatcttattataatgcaaaactgatgtgtggataggaaggaacatggtgttgctatcagtggagtgccgttatgcaactgctttctagtataactactaatgaagagataatattaggtgcaccaaatgtgttcatacaaaaactagcctgcagtgtctactctcttgtatagattaattacaatttcatatgtatacaatacgattaggacctttctatggatgaattaatcatttgatcaacatcttgtgcatgaactggtcaagttcattgtttgctatgggcatttggtagattataacatagatatacagagagaagtttcctgttggctgctaaattagcagcctcctagctttatgacatgtatatatatgctaaaaaaggtttaatttgacatgtgccttttggggactgtttaatataattgatcaaattatataggtaaaacaacacacattagggtgaggcgatgtttctcgatcgacacaattcgtcgttgttgtgttaacacaggtctttaattcattattcttatagattttgaaaagattgaaaagaagcacatgtatgcagttttcttgttgatgaaagatgaatgattttaaattttgctgcgggtaggtagttagttcttgctgtaaattatttcaagcatgtgcccaaacattgcctaagcaacttacaaggccacattaaaaaaaaaaaggtaatcagagagcacaactaggaacggttcattgcttttgacatgaaggggagaaaatgatggattaatatatgcagtgtttgacagtatatcgaacagagatgtcaaaagcatctccctttggcaaaccacaaaccgtcaatttggaaagggacgatggcatttgcatttgatccgaacatcatagctgacctctggccggctaaaaagtacaaaacatgtgacatacaaagcccaaaaattcaacctatagttttgtcctttcagtgtactgaatttcatcttaattggctatttttctcatcgtagcaggaacatgtcaccttctcggttgaattggttactcgttacatcgttttgaaattttttttttttactattctccgtacaaatcttcagttggttcgaagcaccgaaacacaagagagtcacacaaataaacataatgcatgctacacggagtttgattaattgtgccccttagcaatttctcttgtcccaatcaggttggttaccctgcgctttttggctcctacgtggacaccaggtcaccccttgtcctgttgctgctgtctctttgagtggatgggaggccgggtgcctagtcggatacatggaggccagaggggccacctggaaagttcactttatccatactcctgcttatgtggacataggagagccaacatgtcatgtcagcatttgtggcatagtggcgactcctcctattccattggatttgcatgtttcatgatgattttattaggcactatgtgcacacatggcctccatgcaaa

SEQ ID NO: 72830 - DNA, 8647 bp, Oryza sativa
  unsure (1)..(8647): unsure at all n locations
agaatacagtggcacctttaagctgatcgacangatcatcgatccgggaaagaagggtacttgttttttatggtgacttcattgagagctctgtagtcgacgcacatctcttcgtctgtgttttcttctctacaaaatcacagaggcaccccatgggaaagtactcggacgtatgtaccccttttctttcacttcttccagctgtttcttaacttcggccagttcatttgctgccatacggtagggtcgcttgtacagaggagtggttcctggagcaagatctatccggaactcaatctctcgcttggccggcataccaggtagttcttccggaaacacatctccgaactccctgacgatgggaatttctgacagtcctatctgatgaagttctgaacttctgacagaggttgggggtgcaaagaaaacaaccggttgttccggccctcggtacagagtgacagtgcgtctcgcgcaatccactactccttggaattgagccaaccaattcatcccaaggatcacatccaagttcttggtgtctagaagaatcagatccgagggaaaaggaatcccctgaatttctataggaacagcagggctataatactttgctgtcataacccctccaggggtggtgatgagcagagggttcctaagcctttctacccccaattgatttctccccacgaatggcatagatataaacgagtgggaagctccagagtcgaacaaaatggtagcagggatggaatgaatgaggaacgtaccaacgatgacgtctggagttgtcagcacgtcctcggccgtcacgtggttcacacgaccccgaatgacatccttaccaccgttgttggagcggggaggcgcttggccttgctggcgcctcggctttgggcatttatccgcaaagtgcccaggctcgaagcagttgaagcacagacactgcggaccttgaacgtccctgcggccttgaccaggctgcacggctggcgtaggaggacggggcgcacgggtcccttgctgactctgctgttgttgcggctgtgggacgcgcaccacgaattgaggtcggggcgcggagcgaggttgctgctgctgttgctgctgctgtgaggaggatccccctggatagggattggtgtagcggaccctttggttagccccctgttggttgcggaaactcgccaagcgacgcttgtgcgactctagttccttgtgcttggcttccaagcggatgctcttgtccaccagacgttggaaatccggatagtccccggagactagacggacggacagctcagggtccattcctgccaagaacttctcttgcttctcctcatcttcccgaacatcctccggggcgtaacgggccaggttgttgaactcatgcaaatactccatcacggagcggttgctttgcttcaactctcggaattcccttttcttaagggccacgactccggcgggcacatgggttcttcggaaagcggcggtgaagcgggcccaagtaataggttgcccctctggctgcgtagcctggaaatggtcccaccatagagatgcgggcccctgcagttggtgggcggcgaagatgactttctcctcatcgctgcactgcacggtgtctagctttttccccacggcatgcaaccaatccaacgcatccacggggttgttggagctagagaaggtaggtgggcggatgcggaggaactcggcgagtttagagtgttggggaggtggtggtggagcattatgttgtggtggattttggaggtggtggaggaaagcattcatcatgttggcttgctgggcgaggatttgggtgagaatggcgttggtgtctggtggtggtggtggaggcggtggtggaggtggaggtgggttgccctggtggttgcggttgctgccttcaggttggttgccatcaccggtattagcatttctcctggtcgtcaccatctgaaaaccccacacagaccagcaaacagagagagctgacaattaaaactaaccacccacgactaccataattcttgaatttattactgttattaaattggttcattaaagttcaagttgcttaagcaaataaaataaagacaggctccgacatatttataccacacaccggcataaccatgccccatacgactctagcagaaaaacaaacaagaaaaacacacgcgcaagcctactaactgcttgtctacagctgcgataggccaggacggaaggtgagcatcagtgctgccaacgccggaggctccatcctcctgaggaaccacgggcgcgggctcggcacgaggggtctcgacgaaacaggtccacgccagggactgacgaacaagctcgggcctggaggtactcttgtgagcggtgatcttctggctgcggcagacgcggcgacgcttggggcgacagacctctccctgggcgatcttgagctgacgcagctgcgcctccactgcgtctaggtccttcttcagctgcagattctcctgacgcagctccaggatcttcatgttgttctcgaccaacccgcgacgcaccatctgatggaagtcgatacgagccgcgtcgtacgcctccaccatgcgcgctagatgcatgatggtagcgtcatcctccgagctagcatcccggaaggtggcgtagtcgcgggctcctccgcgacgagggtggtaacggtagggcgagtgctgcaactcgtccgggtagcgctggtgaagagtaccgatggtgaggagtgcggcgttctggcaagcggcggagaaggaatctccacccgcggtgactgccaacgaagtcctctcgggtgagccagtgaggatcactgcagtaacctcccaagcagcgtggggctctgcatcgtcaccctcctgctccgagagctgcttgccctggtagtccactccatgcggataccccaggacaacgcacatgccccgcagctccaaaacgaagccagtcaggtccagaccaccacggttgatgctgccggccatctacaaacaaaaacaaaaagaaaagcaacattttaaaggtcagattttgacgataaatgaagcagcaggacagagagagactagaggattttcacaaataagacaggatttttattttgaaaatattgctaaggcttgggatctacggctcgtcctagggtcaagggggctctgataccaacttgtcacgaccggaattaacccaacgggcgttccttacgtgcgtgtattattccttgtcccaggaggcaaggtacaccaagagttgatacatttcagagtttatcaagcggaagcgtaaatagttaatttattacatgggcagcgaaggcccagcacacacaaagacaaacgagaaacaacggaagactagggcgacgaccacaggcgcttgacggcaggcacgagctagacaccaaagccttcatcttccaggggctcctcttctgggtttgggaaaaattgagcaagactgagtacaaccaccgtactcaacaagacacacccacaagggcagaataaatgcaagggagtactagggagttataatataaagggttagggtttgcagtaaacagcattaaaagacacttagttgctcaaagctattttgtaaatacggtcctagagctatacaatattattaaacaaggccgtgaacccacacgagcctgccttaacccaaggcctacgatgattcagaccgaactggcaacccgaccctgggtcccagcttgtaccaagccaacccagggcaaccattccacattttagttgttaaacaggttttaagaattaaaacactaacttgggtacatgctcggcttgcccataaccgagggcgcggctattcgaatagattatactctgatcagaggtgtacatctttacccacaagacacatcttcctcacatgtaaccacgtgccacataccaccacggtatacggacagaagacgtgacatagtctccaacccatcctagccatagacaagagtaccgacccaatcccacctacggccggaacccccgggacaggtaggcaagactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttttgcaacagaggcccgaagaccggtccttatatggccgaggtgctactatcaaaaccatgcaccccgagcccagcctaaaaccattttggggattttgaatagagggggcggtgtgaatccaattccacattaatcaaaccattccatagtgtccaggtgatgagaaaattcccaaagtctagagttgtaaaactacctaatgttgcctaattaaccagcgaagcatctacctaaaatcatactagtggtaccatgagtagagtgtccactagttggggttttgtttattctagggtgaacaaggaaataataataataacaataataaggtcataacaaaggtaaataggcatggctagataaaacagtgataacgcgggaatttaaataaagcgataatgcaataatttaaatcaaaataattttataaactgggattcaatatgttcaaggatgatgtgacttgccttgctcgctttcccaaacgtcggcttcaaccacgacgaagagcggatcttccgaagctgcagcgtctacacgaccaacggaaaagaaaagacttttactctaataaactccatataacaagcaggaacaaagcacaaaaatgggttcttgacttcttaaggaaaaattagagacttgaacggtcaaattccgagttcaaatggccaagttatggctatttgaagtttatatgctctttaaatgaatatttgcgaatttcttcatttaaatttaattaaaaaaaggtttattgcgtcagccgaggggagggggcgcgcggaccgggtccacgggagtggggcccacgcggcagccccacggtccacggtggaccgggcgcacccgggctcacaccggccggcgccgtgggtcccacgcgtcagccgcacccgagggcgcgtgtcacatcctgattttttgtttcaggatttataaattatttaataaattattaatagattttatattaaatgatctttaatttacaagtgaagttaaatgtgggaaataaaatttcctaaaaataaagcatggatggatttaatttttattaaattctccatgattaagtcaactctctgaaatattctcggatttttcggagctgaattcctaaatgatacaaagaacagttcagtaattatttgatcaataatgatctaattataattgttaagtgcttttcttgtttaaaatccttaaattataaattgttgtttaaaagggattattagaaatgattttaaaagcttcgaagagaagatctaattttaatttgttaaatctcaatataaaattgggctagataaaattttgttaaatactttgcttaattctataattcctagatttttctgggatttatttgagctaaggaagtatttttaataaatggaatttcatttcatgaataatttaaattgaaaaatgtttttaaaagtccgttttggctttgggccgaaagccggcccaaaacctctcttctctctctccctcggcccaagtcggcccagttcgcaatcagtccgagccgccgctctcctctctctctcgctgccgctgacaggtggggcccgcctgtcggagccgtcttcctccttcggccgccgccgcccgaaaccctagcgcaagccgccgccatctccttccaaattcggccgcgtctttccttctccggtgaaatctttagaggggaaatgatcttctcgatttcctcttccttttctcttatggaatcaacggctaatttcgtttggaaattcgtggattcgaggtcgattcggatcggtctctccctcccgaaccctaatctttccttctcgtcgccggccgccgtgggcctttgccgccgcctcctagcccctttaaaaggatccccggtgtctcctctacccgccgccacccttgctttcgcctctcgccgtcggaagagccctagcgccgtgagacttcgcgccgccgtcgtcgccgtcgctccagccgtgcgccgccgccgtttcagtcgtcaccgtcgctcgggaaggccgccatcgtggtcgccaagtcgtcgccgtcctcgtccgccccttcgccgccgccgaagaccgccggagaaccgtcgccgccgtcgacccgatctccgccgccgcttctttctcgtcgccggcgctgtctgttgcttttccgccgccgttttggtcaccggtgagttcgccgcgccgcgctctacgtcctggtgccctccgttctcgtcatcgcgccgtcgttcgccggcgagcttgcgctcccgagccgccgccggtgatgacgtcaccgctgacgtcatcgtcgccgttcccgtgagccggtcgtggaccgattgatctcggccgtccgttttggataggatcgatctcgcccgtccgttcccgtgaaccgctgccgtgcacccggtccaccgcaaaccctagccgctgacgcaataatccttcttttccttttcaaaaataaatcattattgcgtcataattcaattaaaatctatataagtgttttaatccgatttaatctttcaaaattcataactaattcatcttagctcagtttaatgtggttcaagttgcaaaaattgtgtaaaataaagatctacatattaaaattgtccataaattgaattaaatttatttaattctttttaaatgggctttaattagatttaatcttgtaaaattcataataaattcatatgaagtcagaatgaggccgttcaagtctcataattcatctaaaattatgatctacatgtttgtttactttttatgtattgtttatttggtttttattagtctttttctttgttttgcgtgttagcttgtcgtttccgtcgttgcgaaggttcgcgagtgcgctggaagtattcaagaagattaattgaagaccgattattgcaatgcaagtcacacagatcctaaacacaatcctttgagcatgttgatcctatatttaaattctctatttatttcaactgtgcatttattttcaaatgtcattgggtggaattaacctattctttgttatggcccttttgttcttgattactttattccttgataccttgggtgattataattggactagttgaactttatatatattggttcaactagatatcagatataattgcttagccatgcttagaaacattagcacactattgggataacttatgactcattattatttaatgatggcttaatgatagttcacgatggtcaatcgtgattggttaattaattacttgccaactaaaacttgataatggtgggttgtgagcacatggttttgagagtcgtgctcatgacaattaaggaccagttcgcgagctactattgtgaaacattaatcgtgccaaccacaagccagcgtgggcaacggctttacctttcgtatagcatggttcattgcagagcaccagactgagaagtggcggagataagcccacaggggtcgctggggagtccatgcctctggttttgagggggtgattatgatccaggaaaggtgcactgtggtgggttgtgttatgcgaggggtaatgtcacagctcctttccgaggtaccgtggtggtactgaggcacatggtggcatgttgtggggctgtgtcttgtgggtacagtggtacacctctggccagagtaaaactattcgaatagccgtgcccgcggttatgggcgggttgagcaatgtttttcgtgattagtctcacacttctcacaataattatggatgttatacctggtaataatttgcttagctcctggtttggagattagatctgtacagccgggtatggttgtttcagaatggttgggcctgagcagcatgggcgtgttgttcagtgttgattaaaatttctgattaattactccactgatttacttctcttaaatgttttgctaaatgctgcttttgcaaatgagactatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttatttttccgctgcagttttcttcatggtgaggactaagtgcctcttaagtaagtatttagcgttttaattaatttgatgaatctgtatattaaattgtcagtttgtgtacctcgcctgattcctggacgaggattttatgcacaaataagttcagaaatttattagtgaatttccgggcgtgacagcgcgggcggctgacggtcgggcccacgcggcagccactcggtgcgcccggaggcggccac

SEQ ID NO: 72831 - DNA, 764 bp, Oryza sativa
aattagcttgctatcttgttcctgcaccccagtataattctgttccacacgtactccctcactctatccattaatataagcatatgtttggtaattctcagcacacgttactgtgtcaccataccgtttgaaaaccgttggccgctgataaaatttggtcaagttctgttattaactgtaaagttcagtttgggtttttttttttaacttgaccggaaaactaggcgatttatgttctcaagcaagctcggaaagtccggttttcataaaaacaaaccgatgttcatcggttttgtaaactttgttccgaacattaaagtcgtttttaatctcaacattaatcttcactaaaacaccaacattgattatattgcggactaaaaagagtatcacagaaaattgtcacattcaatctaacctgcatagagaagtaggagtaattcttccgtcccaaaatataagcattttataaaattttttaatggtatctaacaagctagagagataaaactaaatagggacatttattcttttacctgagaaatggggatgttcgtttattggttgagaaaagtaggtactatgtactaagaactataagttttgaacgtagcgaggagtatattttgggacggagtacatgtttatttactgatatatttaagggagtaccccataaaactcccacctttaaactaacatgcataaacaagttaagaatatttccgttcaaaaaaaacacggactagggaagtttttttttt

SEQ ID NO: 72832 - DNA, 625 bp, Oryza sativa
acacctgtgacgggtgacttttttctacccgtcaaaggggaccaaacagctgtgactggttttaggtttccaccgtcaccagacgtccaaaatcacccagaaaaaaaagaaatgcctcagcccaaatgtacgaaatgaagaaaaatccaattcatctcaagatgcacatgattcaacaactttgtattttaaatcaaatacatctcaacaaacaactacacatgaagcaatctgacaatatacatcacacaagtatccatgtccattttaacaaactacacatccacacaagcaacaaacatgagcaaatcaagcacaaacaacatcaagcacaaacaaatccggcggccggcggtcggtggcggaggggaaaggccgcggacgctggatccgcgtcccccgacctcgtggaggccggatatggcggtcatcggtcggcggcggaggaggcggcgtccggcagtcggggaagaggttgtggaggtggcgaaggtgtcggtggctggatccgctgtggcgtcggcggccgggaggcgagggaaggcgccggcggcagaatccggcttcccggaggccaaacttggcggcatcggcggccgggaggcgaggaaaggcgccggtggcc

SEQ ID NO: 72833 - DNA, 667 bp, Oryza sativa
aagccaaggaagaaagaacattagcatctcaaatagagccatcaaccaccgcaacatagcttcctccaaaagaaacatgtattcttccaaattttgtaagcagcacatcctcacatgggtttctagtctaccaaacagtgcccaataccggtttgaccacgccacttcctgcaccagtccacatacatacccttcaaggttttcctttaaatctccttctctccctccatctccactcccatccctctgctcttggcagtgaacaactgtcctcctgcacattttgtcttcctctcaaaacattgccacagaatattgttcattcttgacacgtagaagagccatgaggccatcactcttgcagtatctgaagctgctcctgttacttgcccttggtggtgtcaccaccatgcatgtgcctaaacaagatgtgccatcatccctggaggaactcacccttgatggccatttcagcttccacgatgtgtctgctgctgcacaggactttggcaacctgtccagcttcccgccggttgcggtgcttcatcctggctcagtggctgacattgccacaaccatcaggcatgtgttcttgatgggtgagcactccacgctcacagtggcagcccgtggacatgggcactcgctgtatgggcagtcccaggct

SEQ ID NO: 72834 - DNA, 760 bp, Oryza sativa
atgaactgctatcttattcctgcagccctgccttggcagatcagccgttcagaaccacctgaagaaaatgcaggagaaaaaaagaatggagcaactttgcttactactatgtcatcgaaattggtgcactgcaaatttccgagaattcaaagtgttagtggttgttttagcttcagcatttgggatcttgttgatctccagtagcccttgagcttgttgaaagatgaaattatcattttttccctcttacaatttactcctatgtctgaataatttgcattctaagtttttggcaatgggtagacttcagaaaaggaaatattgagcagcaagaacacctgagttggggtcttctcataacttcctccaatctctttaatcctgttaataagtggttggagctgtttggaataagaaacatcttcaatgagcagagttgcagcagtgcaataggagagggttcgtgaacaaggatgcaacaagctcataataatattagtaaaaaatacaaccttggtcaggaactcaggagtgtatattcgtccacggggcccagttgggggattatttggagtgtattttcctgtcagaacacctgaacagaggagacatattaagctaggaatttattttcgataatcactcatttgagaaatggaatgatgatcgatgaagtaaacatttcagttctaagataagacattttcatttaaactactagattgaacaattttcttgcaaaaaaaagatcttgatatag

SEQ ID NO: 72835 - DNA, 579 bp, Oryza sativa
actatagggcgaattcgagctcggtaccccgaatcttttaagcctaattgctccatgatttgacaatgtggtgctacattaaatatttgctaatgacggattaattaagcttaataattcgtctcgcggtaccgacggattctgtaattagtttttctattagtacccaaacaccccatgcgacaccctatataatacccgatgtgacacgtcaaaactttacacccctggctctagacacccccttacttattttcctatgaaattgagccatagaaatataattctatagaaaaattcttaagagtcccattggttgccctaataagccaaagccaaagttaaaatttaaattttgagatttgctctggtccaacaataccagtacctcacggtaccaaatcatttctaatcgttggatctagctgggcaggatgggcattgttagatataacgatcggaaacgatttggtaccataagataccgatacctcgaggtacattttattggactggagaaaatctcttgaattttcaaacttaatttgaaaggcaattttaagatattttcaatatagt

SEQ ID NO: 72836 - DNA, 733 bp, Oryza sativa
atatatatacatgtatatgtacgtacttaggaggtgtattttgtacgtacacagattgtaatactgtacatttgtacgccgtacgtcgaggtattttgcctcacgtaggcgtttgagaaaaaaaaagaaaaaatttaaaagattttactgctgcgtcaactgtgcctcgctaacgttgcatgcatggcccccatgtgcgtgtgtttctcgatgacgtggacagatgtgggccgtacacgtgtccccgccgggtggcccggatcggctgcggagaggcgcggccccgagagtgacgtgcgctggaaagcgccattttcttggaggccgcagacgatcctgtccacacgtattttgctcgagattttggggggttattttagattttaaaatttatttggccactaaattcggatggggccttatctctgtactacgtattcggcatcatccatccacttgaggatatggtccatccaaatcaaaatgctggatcttctacaccaagaattttttttaattaaagttctcttatatgatttacgaaagcataggtgagaatctgatgcccgaaaattaacctaaggtttttattaatttaattaccaattcacggagagtcagaacgtaattaatatatcaggcagaaagacagtatatagtcgatggacaaagcgtgcaaacgagggttctttgatttggcaatacattgctatcatgttgttcgatctttctg

SEQ ID NO: 72837 - DNA, 2306 bp, Oryza sativa
gattgggagcgacggcgggagcttcatccctggggccttaagtgcatcaaaggcagccgaggagatgatgctcagactggcccctccatccaccagcacacatttcatcttgacattgtggatggtcggggagaccaccagggccaactcccccccccctgagcaagcaccgtcggatggtcactctggttgaatgtgagcttcacctccgaccagcgtgccttccggaccgcctcatgcgtgggaacaacggccagaaactcccgcttcatggccttgaagcttcggtgagaggcgtgagcgcaagcccccccgtcgagcgtgtcgacggtcccctgaggtatctggaaatcctgatcctcaccgtctcagccatcatcagcaggggccttgtccttggcctcccctcgccggtcaccggttgaggtcgtgggggctttgccctcccgtcgaccctgccgcttttcctcattagcctttcggaaccactcggccaaattcttgaccgagcggcagtcggcgagactgtggcggtaagtgttgtgtaccgagcaccacttgtccgccgaccggccctcgctggagggaacggtggggctcggcctatcgccggtggcctttcctttgcgcggggcccgcgtgggcccgtctgctgcaaggacatggccctcgtcatcggagcgggctggtttccttttgcctctcctatctcgccgcttagagcggggggcagattcgggggtagccgcagccgccgcaccggtgctgggagagttctaggcccatgcctcctccttccgggccaccttgtccgccaactcgaagagctcggcagtggtcttgggctccttggaggcgatcttctccagaatgcgattatgccgcacgccgttccggaatgcatatacaaccgcgtgggctggaatgcacggaatagtgttgcggacctgacagaagcgctgtatgtacgaacggagggactcatcatccttccgccgtacatcgtgtaggtccgcctcttcccccgtgcggggatatgtgccctggaagttcgtaatgaactgctggcacagatcctcccaggagtgaatggagccgaggggctgggtcatcaaccagccacgtgcctgacccttgagggccatgggaaagtaattcgccatgacccggtcgtcaccccttgccgccacgataaccgtggtgtagatctggaggaactcggagggattgatgctaccatcatacttctccgtaaggttggggcgaaacttcaggggccaccggacattccggagactcgccacaaaggccctacaacccgtccccccaggggtgagtgtggggggagggccgcctcgtgaagaggagcgtggcgctccagatgaggaggcgccttccccgacatgggcagctcggcgctcgtctcggcgtcgctcaatgttgattcgagcgtcctgcgtcccgtagaggccgtcatgacgcctccggctttccgaggcccctgacgatgttagaaccgtggaccacctcgagatcgtggccgatcgacgagcccttctccttgccgacgaggagagggtgaccgaggtacgcgacgtaccagcggcagcggatcggccactcatggctaactgccgctgggtagtagtgaccaggttggccacgtcgtccagccaacgctgaacaggagtctccggctccaggttcaccgggggatgccgcagaagggcgcctgctgcctgaagcgcgccttggggcgaaccgccatctccatagtcgagacggcgggcgtgtcccggcacgtcgcggcctccctccgccagggggcggagagagagccgaatcacccgaacgagtgagatcctccctccgcgaaggttcgcagcggggaggagttggagaaccatggcgacggtgacgaggacctcggctcgtgccggaatccccactcccgaacggggtgggagtaaacgccaccgcctcctcctctatttccgggacctcgaccatggtcggctaaggcctggagaaaattgggacagaagaaggcgacttactctcggaatgcgcaaccgcccctacctggcgcgctagctgtcgaggagagatcctcaatagcggggaatcgtgagacccccatttgtgagttcggccgggggcggaggctcatctcttggaaatcactcgctcgtccctaggatcaccgacgagcttgcacgcaaacggattatacaggttcgggccgctatggagcgtaacaccctactcctgtgtttgggattatggatgagttttacaaaagattt

SEQ ID NO: 72838 - DNA, 1484 bp, Oryza sativa
atgataaatgtaaaacttaggcctgacaacaatactgaatcttctgtcattaattatcctccatgtttggcctggggatcttctgtcttctttcaccccccaagctggatttagccacctcctcaggagagaggctgcacatgtctacccccatcttctgtatgaccgaaagtgaacaattagagggagaggagtcagagttcatatcactataagaagtttcattgaaatcagactcctacatactgctatcaataaagagttttgcaatacctgcaaattccttaatctttttaacagactttccccttggcttcccaatgcccattcttgggtccatctgcaattctttggttgcattaccctgcagaagtcttgagctttgtcttctgtagggactatagagaatggccttcccatctttcctctttgcaggtgccttggggggaagtagggcaacaggggccacactgattgggctagccacactgattgggctagatgggggcctcacattgattggtagaacatcctcaaccacccttttcggctgagggggtgaaatagactcaaaaggttgcaaaacccattcaggttcatgctggcccactgaaggagaggaatcaaagatggacttccttggcaggagcaatgtggagaaatagttggacattcttaaagcagcaggaataggcttgccctggatcaaagtctgcatgatgccctttgctttacagaggaagtcaatcttgtccaatattcccttcataggataaaagtaggggtgccttggagcttcatttctggcaattctattcagccgagctagaaattcctggacttgggggtctagaacaggatcctggactgatgtcatcctagctgaagggagaggtgtggccatctgctgaggtagaattagttgtcctgggttttcctcaatctgccccattggatggtcttggccccaggcatcttcttgttgttcatttgcagcctgctgttgctgcactgcctcatcccattctcgagccccctggttcccagggttgccaaactgccagacattaccatcatcggggtcttcgtcagctgcatcatcaggtcctggctgcggaccggcatgggggagatcctcttcaggggggaaatttataaaatccacctgtagcatgaaaaccgagactgtccaagattcatgtcacgaccggaaataacccaacgggctttcctgacgtgcgtgcattaatccttgtcccaggaggcaaggtacaccaaaagttgatacaaatcagagtttaacaagcggaagcgtaaatagttaacttattacatgggcagcgaaggcccagcacacacagagacaaacgaaaaacagcggaagactagggcgacgaccacaggcgcttgaccgcaggcacgagctagacaccaaagccttcatcttcaaggagctctcttctgggcttgggaaaaattgagca

SEQ ID NO: 72839 - DNA, 12493 bp, Oryza sativa
gcccccgtcatccccgatggtgataactttggaacaatttcattcaccatggtggatagatattaaccatccccgtcacctaataggtgaattcaccgcgggtgaaacggtgaacgggccccattgccatctctgagtgagaagcgggggtgtcagcaacgcggattgcgggcaaggttgtcagtatcctgattcgtatcctagtatcttacgataatacgatcctaccaagccgaaatgataccgatcccacttagtatcctaattttcatagtatctcgatcctactattcattactacaccatcctataaaatcgaaatcttaagtgatatcccgattctacgatccctatgatactacaaaatattatttaaaataacatggtttgaaaataatgtaaataaatatgctcaaatttatatgaaaatcagttaaatatatcaaaaccaacatagtttctcttgataaatgtctctatttgcatgacatatatcattactatatttttttatatagaatggctatatataattaatataaatattaattaaacttaaaaaaagaaaatctcatagtatcccgatactacgatacgatcctacgatacgatattactttgagcaaaacgatactacctagtatcccgatcctaataaccttgattgcaggtacatgtacaacctcagttccaaaaatatagctattttttacacggtatcttgttctaaataaaagttatttctccaccgaccttcttctgtcaaccaattacaactattatattttatcaattttatattctcaaccaatcacatattttttttaattattcttatctactttcttaatacttatatcaaccttaaaaattacttacactttggtacggaggaagcaagggctagctctctggcgtcgtgacatcgccttcagcttcgtgccctgcgtcgcgttgaccatgcagtggacgaagtgatcaagaactagccagccgggcgggcgggcggcacatcatccggcccggcgccggcggtctctggccatccatgtcgccacctgagtagcaccacaaagttctctaagttcaaatttttataggagcgaatttcggatcagttatttaagggcttagactgtgttcgtttcattagaatgggaattaattccttcctcacagaaaatagagcggtccattagcacgtgattaattaagtattagctttttttaaaaaaaatggatcaatataattttttaaacaactttcgtatagaatttttttttcagaaaacgcaccgtttaacagtttaaaaagcgtgcgcgtgaaaaatgagaggggaagttaggaaccctggaaacgaacgtagccttagttctctgtttaataggcaaaatttatagttggatgtagaggtcgggtttttttaaaaaaaattgtcgccactaggtcaattttcccattttattttcctattcgcctcttctggtcacacaaagaccccaccccaccacacgcaaagaaaaggcaaccattgttccacgttaatgagttattgttgggtctaattttttgggcctctttgcatgcgcgtcctttggatacaaaactggaaatagttcagtttacacaccccttataactatgaattgagtagagttccatccaccactactagaaaaatcacttttgcatgcggccaaaagcaatttttacgggcggagggaaggaccgcctgcagaccaacgacggtgaaaatcatccagcccgcttgtaaaaatccaataaaaaacaaaaaaatcgcctcactaccgccggcgctgccctctggccatctctgggagaccgcctctcccaggccgggcccgcttaaatctggtagctttcataggtcatagactgccctcccacctctcccaggccgggcccgcttaaatctggtagctttcataggtcatagactgccctcacataccaacaaaagtcttttctacacactttgttgtcctcactcgtgcgcaccgaggccgggctcgcttacatctggtagctttcataggtcatagactgccctcacacactttgttgtcctcactcgtgcgcaccgaggccgggctcgcttacatctggtagctttcataggtcatagactgccctcacagaccaacacaagtcttttctgcacactttgtcctcactcgtgcgcatcgaggccgggcccgcttatatctggtagctttcataggtcatagacttttctacacactttgtcctcactcgtgcgcaccctgacattctttccggtcagtcacccatcccaaattgcttcaggccaagcacgcttaaccctggagttctttagagattggtttccggaaaagaagttgtaacttgtggcttaataggattaatagaacgtgaagggcccatggctcgtccgtactgtcgccttctaaagccacgaaagacaaaatcaccaccccaactgctaagggactaaattttgatagtaagggatactctatactcggttggttttgcaatcgagggatgagtacagtggacttttatggcctacattaattaaagagtccatttttctttggaattagtctattttgtccctcttatctcttgtctttggacaatttgtatccctcagctataaaaccgggtataacatctcctccaactttaaaaactattacaaattaactctttatgtggtatggaaagcgctttctactgacgtgacaagtcgatttggtccaagtgtcgtgacgtccctacgaagaggttagaagcgttttcaagatgattctttctttgtcgagacgaaaaagtcttttcagttgaaaaatgtgagtatgttttgcccactttatcccccatccccctatatcaaaatgatgaaaaaaggaatttaaaatgatcttatccatcattgccctgcttccaaattggcagagacccctgtggagaatgaagaggagtcaaggatcttactctcaagagtactttgataggctccactctcaaagaataagttaggcctgtgctcacaagaaatctcggagccacccattaatcgtaatgaactctatgcaaagttttcctctgtgatatgagttaccacccccttggtcacttatagtaccctaaacatccaactgcattttccaactaaaatggaaaatgactaccgaaatgaaattgtacatctagaatagacctaagaaaacatgatcccaggcggatacttaacatgttccccctcgcccaggcccatcgcaagggaaccgaaaccaagatttgctttatcgggtatcaaacgggccggaactgtgagcaaatataatacctttaaaaagtattactacaaccacatagattgtaaatgtataaatgcgatgtactactttctttcctcttcctactacatgcacggctataatcgttatatattctcttcttttctttactcttcgttttgcatctcttttcttctattgtgagggtagcctagtcatcaaaggaattgaaaatataagtgtgtcccacatgtaagtgacaaattaaaaaaaattaaaaaaaggtgaggtccacatgttagtgacaattctccttctcttcttcgtccattctattttttctctcccagccaccaccgccgtgcatgggcggagggcgggggtctcgtgtcatggcgatgaaatccacggcggagccgtgctgaagagaggaccaatgtggtggagaggcagtggtggtggcggtggccggataagaggagaggaggcaaagaggtcctcaacggcgcaacagcaaatgcttgctgatcgacgacgctggggcctgggggagaagcgagaggggttaggcggagaggtcaaggtgggaccgtggggtaggtgtacaaatgaagagtacaaaattaagactacaaacgaattagaaaattatagaaaaaaagtgtaagggctgatcacaaaacccatattgaaagctatatacatgcacagtaaagagttgcatcatactacattcgtcctaaaatataaaaatctatgatattttctataactacgaatctgtataggttatctgtccagatccataaatctatgatattttctataattacgaatctagataaattatatgtctagattcgtagtataagaaaatctcccatccgatttagattattatatttcggaacagatggagtatatgcgtagctagctctatcctactccatcggtcccaaaatataagcactttcaaaatagtgtcgaatcaaacatttttttactttggctattaatagcaaataaaaaagaaaaacatcaatcatgtaaaattgatgttattagatttatcattcaacaaactatcataatatgtaatgtaactcttttcatttaaaatatcttacttttatagatactgtaagtcaaaatagcatctcgaaaactgtgcggccttgtttagttcgggaaaatttttgggtttggttatcacatcgaatatacggacacacatttgaagtattaaacgtactctaataacaaaacaaattatagacccaccaaggaactacgagttaaaatattaagcctaattaatctgtcgttaacaaatgtttattgtaataccacattgttaaaacatggcgcgattaggcttaaagattcgtctcgcaatttacacataatctgtgtaattggtttttttctacatttaatattttattcatgtatccaaatattcgatatgatagtgtgaaaaattttattttaaaagctaaactgggcctatattgaaattcaaaaatgtttatacgttcggacgaagggtgtatatgtcatagtagtaactttttcacaagatgacactgtgtgtttggcctcatcttttactccagtacccgtagttctgtacagtaataaagaactactgtagtagtatcacccagcactcaacacagtgcattcattttcttctgggtggagtttgagcctgctgacatggtatactacgtactccctccgtgaaaaaaaagttaaactctgagttttaatgtctatctttgactatccgttttatatgatttttttatataatttatatttttattattgttagatgataaaacatgattaatattttatacgtgacttgtctttttaatttttttcataatttttttaaataaaacggacggtcaaacattggacacggaaaccagggtttgtttttttgaatggagggagtataggagtagactgtagctgcgtcgtcaagacccaagagcacagttgcacatgactctgtgagattcttccagggatgagataaccccttttcctcggtttttgaacatcacaaaacgacaagattccttggtcgctgcaagagagtacgtagtggaattcgtgatagtgctgttcagtggttaaaccctaaagcaaggcccatagtgtctgttttcgataagcttttctagatgataatggaaaattccataagtaaatcgtctttgaatactgtatgattcaacttgttttttttttttgattttcagtatctgtttggatgtgacaacttacactaggattttgattttcaggctaaacttttttttcttaaggacttttgacattaattattccatctgaaattcatgggttcaagttcaatgtactaacttggaagatctaagatagtgttccaaacgatgtaggttattagcttatgatcaattaagtactggagtaactactataaactttaaatatatttacttgaaaaatgcatgaaagaatcgagaggcagtccgacggtccgaccctaggaacaccttgcaaaacccttcgtccctttctagcttcttgtgcttacaggaaggaagcgaagaaggtatcaggagaagattaggagaaatgagataattaaatttaagaatcctcctgatctgattttacgtgatggtcttttaacgtgttttagttttgagtacggctttccaaattttttttcccaaaaacgtaacatcgaatctttggacatatacatggataaaagaaaaaactaattgcacagtttgcatggaaatcaggagaagattaggagaaatgagataattaaatttaagaatcctcctgatctgattttacgtgatggtcttttaacgtgttttagttttgagcacggctttctaattttttttcccaaaaacgtaacatcgaatctttggacatatacatggataaaaggaaaaactaattgcacagtttgcatgaaaatcgcgagacgaatcttttgagcctaattaatccatgattagccataagagctacagtaacccacatgtactaatgataaattaattaagcttaataaattcgtatcgtggtttctaagtgggttatgaaattagttttttcattcgtgtccaaaaaccccttccgatatctggtcaaacatccaatgtgacatccaaaaattttcttttcgcgagctaaacagggcctacgttgcaatatcaactatggctgtgtttagtagtttaggtgtaaaaatttttgcgtatacggacacacatttgaagtattaaacgtagtctaataacaaaacaaattacagatttcgcatataaactgtgagacgaatctattaacctaattaatccgtcattagcaaatgtttactgtagcactacattgttaaatcatagcgtaattaggctcaaaagattcatcttgcaatttacatgaaaactgtgcaattattttttttccgtccacatttaatgctccatgtatgtgtctaaacatttgatgtgacggatttgttgaaagtttaaagggaactaaacacagccttaggccctgtttagtttccaaaaacatcacatcgaatttttgaacgcatacatagagtattaaatatagataaattaaaaaaataattgtacacttaggagggaaatcgcgagacgaatcttttgagtctaattagttcatgattagccataagtgttatagtaacccacatttgctaatgacagattaattaggctcaaaagattcatctcgcgatttccagacgagttataaaattagttttttcattcgtgtccgaaaaactattctgatatccggtcaaacgttcgatgtgacacccaaataatttcttttcacgaactaaacaggccattacaattgaatttcacattttgttagcctaccggcctatagatgagtgctccctccctccggcctataaatgaggagatgtaacccttcttaaaacaaacaatatggacttacaggagagtcatatccctttccctcctgggttgagtttttttatggaggaaagttataattaatatatgatcgtttgtcttatttaaaattattttataattaatatttttattactattaaatgattaaacataattagtagttatatgtgttattaattttttaaaataatttttatataagatgaacgatcaaaacattggatttatgttttctttagttagggaaaagagaaaggtctctttttgctcagcaaagtgatgatgagctgatgccaactgacctgaggccatttacaatgcggtgaggtggcgttcagcctcactgcgccagcgcatagattccttgccacgttagcttctggcacacttttctcaagtccgcgcgtccaactttggtcacgtgttcctcggccaaatccagggcgagcggcgtgaggaacgggcacttgcgcgcattgtggaggtcgtgacctcgtttcgtcgttctcccgcgctcgcgtcgtcgtcgagttcatcctgccccgcgtcgtcgtcgagttcatcctgccccgcgtcgtcgttgagttcatcccacaggagagaagggaatccggcctctgcagattcaatcaccaaatactccttcagtttcgtcatcaccaagacgaacagaagaagagagaagcgagcagaagaaggaaaaaaaaggagcaaacatatatgcgagaaacagaatatttgagaaagaagagaagaataccttcgttggaggccatggacgacactaactaaacgggaggagcaattgctgccgatgctttcttgcattgaagtcgaccaaccgttgaagcagagaagaagcaaaccaaaccaactcccggcgccgcctctctgcccgggctggatctagccgcctgccgccgccgtctcgtcagcaagcgctgcccggaaggagagagagagagagacgcgcccgtgccatggggaggccgaagggcggcgccgcggcgtcctcctcgtcgaagaagcccaaggcgaagccgaagcagcgcggcggcgccgccgccgcttcgggggaggagagggtggctgcctcggcaccgtcgccacccgcgccgccgtctccgccgcgtcgccgctggcgcgctccgctgagcccgcctcggggtcgtccgccgctagcgcccttcgccgagatcgcctcagggtcgtccgcctccggctcccgcgccgtgtcgccgccggcgggccgccagatccggagggggagaggggcgacggcggtgtgtgggaggcgccggcggcgcactagacggagcagttttgtggcctggttggggaaggcagggagagagaggagaggaggtaaaaagtgaggagagagaagggtgggacccactgtgaaggaaaaagaagaccacatgcactgtggaggttgtcgcttgtaaagttcttagtaggtggcagtgttgcccctcaaaaattggtgacgcactgtaagtgccctcacgagtagtagacgcgtgggtgttgtactagctgtaggctatagctactactactagccccatgggagtaggagtaggaataggagtagcagcagtaaatactcgcaccagtcactttttcatctcgcttttactgttgcatcacttttaccacgtcctgacccttttgcaacatagtacccctgattgggattttcacctttttcatccttttagaaaacttattatacaaatagacccttaaaaaacttagggcccctttaatttggagaaaaaacataggaattttgaaaattttcaatcctatagaaaaattcctatgagtgcatttgaatcaaaagattgaattttatccgattctttgaaactcctattgtatggacaattctacagagattttggagaaaacttagcaagagttcaaagctcttagaaattttcctttgagtatatctctctattttgtttcatattttttcctactgttcaatcaaacagtcatttctatgtttttcatgtgttttacaattctctattttacacttcaattcctattagaatcttgtgttttttctattcctttattttttcattcccgcgattcaaatgggcccttattctaataatggatccttttcgcagggccaatgttattggcgccgtggttcaacatgatatcgtcaataacgttagcgtcatctccttcgcccatcgtggaagacaagtaactaatgtgaagagggactatttatagaataactttagtcactaatgcaaaaactaacggtgtgtttagttcgtgaaaagaaaattttttggtgtcacatcggacatttgaccagatgtcggaagaggttttagggcacgaatgaaaaaactaatttcataacttgcctggaaaccgcgagatgaatttattaagactaattaatctgtcattagcacatgtgattactgtagcacttatggctaatcatggactaattaggctcaaaagattcgtctctcgatttccatgcaaactgtgcaattattttttatttatatttaatgctctatgcatgagtccaaagattcgatgtgacgtttttgggcaaaatttttttgaactagacaagacctaagtcatgttagaccacatcgtcaataacgttagcgaagcgaaaaagataacactcctaaaataagttttttagggtctatttatagaataatatttttcaaaaggatccaactgtgaaaaattccagctactcctgcagctgcagtgcagaaccaatgaatgggagttgggagagggtcacaggggggaggcaggcgctcacatacataaagatgagtagaatccttttgaaaacctcagcttctttctcctcgctgtggctcacggagcagcggaggtccggagcaagcgaggctcgtactggtaggagtaatctaccataatgtcttctagtctagtagtagttctacttaactacacacatatcactctctgatcacaatataatgtgttgatccacacgcaccgatcgacacaaactgatctaatactagtatagtgtttttgtttgttgttttgttcagagaccaacaacacaagttgtcgatcgtcgccaggagcaagcaggcggtggatcgagagaggcaggcaggcagcagcagcgaatcggatcggagaggacgttcgatcgccatggcagcacacacagtgagtttgcatacataggatgtatagtgttgtagtatttcttagctagctaactccagatgtgatgttggatttctctctccatcggaaactcacttgctagctagagtagcattttaattgttttctctgtctttcctatgtgtgatgcaatactattcattcattcattcgttcatgctctctagtacgaaatcatacagtatgtatgtatgtatgatcgatcttgggcttttctttctttcgttcgttctttctttctgtgactgggttttgtgattttcatttcattattactagcaagtagagagtcgtgcattcgcaccactatattctctcacatgttaaatgttaagttcttaatgaacaaagtttataggaagtgcagttacagtttttttctgtaataaacaatattttcgtgaaaaaataattaacatgcctagcgtgtaaaatttatcgtaaatatttatattagcatatgttctcaactctatatatattattagcatgtattatattttaattattaattagtccaagtaatttttaacatttattttaaagctttaatttctgaacatttgaagaaccttgttctgtaccgttgaaaccacgcttcaaaaagcattagtttcttttaatattttttcgatcttaactctagattttgtttatgtattcccttttctaatcggaggtacacatcgtgtttttattactccatgttttcttccaatccttccattggaagtgtcatgaatcttctcctgccctctacatttctaactgtcctttccaaatccatttagagtgattttagttttcctttcatcacagattattttccagcactttctttttacaaccattaccaacatagatatattatcataaattatttttgttttcttagttcatttttctatggtttaccagtattagctcaaacgattaataatatatcctgattagtgggtttattttgcaatatacacttgttaactttgaggaaaaaaaaagtgatggatatttctataaaatagatagtttcatgtgtgagtaatagaatagatagttccacatgtgagtaacataatagtagaaaccatatgtcctaaaataactgtatcttagaatgtcgatttctattcgtcattttgcattaaaattgcacggaaaaaactttggactacctttttaatttatgcaaatattcccaacgatcctagcacttttctgtaactaatcatttctataaatctagttttcctgtttatcgttttcatttagttatatgtattgcttacttttttttattatacacatattgtactgtatttatccaaaaaagaatcagtgattgtaatgtaatccttgctacgatttgtttttgcatttaaacatatgatattatcatcatgatgttactttgttcgattttcatctaacatttagccgattcttttcattatgaaaggttcaaactcatatttttttccatcttctctatcttgcctttttaattacttcattttctttctttttctatattaaaatgcatgacaaattctctttggaagtctctagaatctagctataatgtttaaagtttggaagcctatggaatatagatagaatgtttaaagcttgtttttcttggaattttttttatcatatgttctcctaatttatcttaaattttagccatgccaagtggcccaatcatcttgcatcttccatgccagctttagaaggatagacgtggctcaattgaaaagcgaataaacattctacgttcattatatatgtatatatatatatatatatatatatatatatatatatatatatatatatatatatatatatatatatatatatatatatatatatatatatatatatatatatatatatatatatatatatatatatatatatatatatatatatataca

SEQ ID NO: 72840 - DNA, 859 bp, Oryza sativa
attacaactgtttaaatctttcaacttctgtttataaatgctcgctttatgcaaatgaaccactctagctctcctttgataattccctgcatcatacccctattccggtatgacttgctgagtacagtgggtagtactcagtcttgctctttttttttcccaaccccagagttcgggtatgtgtcagatggagatttctctgaggagtaggcttctccgtgccatcgagggtgcctgtggagtggtgttcccgctgcagttctagtcaaggcttagctcctgttgtcttcctttttccgctgcatttatgtaagacttttatgatgtttgtaagacgtggatctgaatgtcaacattgtcgtttgtgtaccccggccggtcctggacggggattttaatgcacattctgcttggaattctattcgggaatttctgggcgtgacagcgggagcggtgtcgtcggcgtcgctccgcccgccgcccgccgtcgctccatttcgccccgctgctgctccgcttcctcccgccgtcgctccgtccaccgcccgccgccgcgccgcttcgctccgttgccgcgccgcccaccatcgctccgcttcctcccgccgccaaccgcgcaccgtcggccgccacgccgcttcgctccgtcgccccctcggtgccaccgctcgcccttctctcatggcagtgtagggggagagagaggggggatagagaaaaggaggctgacatgtgggaccacatggccccaccttttttagttattttttgtgtagctgacatatgggtcccactattttaattattttttcgagataaaattgccacgtaatcgccacgtcaatgcccgtgggacgaa

SEQ ID NO: 72841 - DNA, 523 bp, Oryza sativa
gctataataagctgatcatccggtggcatctcgcctgctgtaccacacacaacagcacactccaccacactctgcccccaccgacgaaacgccgtgccaaaatcagacctcaccgtcgccatcgccgtcgcctctccggccgtgtgcccacaaaattattgatcccctgtggccatggcgacgcgagagacgacggacggcgagagcctagctaggccgtcgacggcgagctctctctcactcgctcgcggtcatggctcccgctatagctagctgtgcattgctgacttgctgcacgcaggggtgccctttctgaaaggtgtctcctgggaatttgcgcggtactggtgtctcaagataatgcagctaagctaagctgctatctgcctctcactgccgtgaccaatcgacaataattaatcaatgacctataattatatctccatctgtactcgtaaaggaagtcgttttcgacagtgacacggtttccaaaaacaactctgatttattatttctataaaaa

SEQ ID NO: 72842 - DNA, 602 bp, Oryza sativa
atcaattaatagaatatgtatagactataatgagatacctgatcaacaataaataggtcctggtccagctttccaatgataaaaccaagattaaactgcccaacaacctgaaggtgtactagttatttagtgttcataaacttctttagcaaagtactgcaaatagaaatatagaattcatacagcactttttttaatatttcatcctatttagaacaatgaaatcacaccactcaagtaaaaaacaaatgttcacaataataaaatgctttcagataaaattaacaaaagacaacatatgtcttgcgaggaacttgcaagaatcacacgacctatcgtacttgatagggccatgaacagaagcaagctatcaaagcacccaaattatacaacaaatacagttaaataataagctggctggtcccactaaagaaacaaaatgtattggtacaacttaatttcatgattgacaaaagtcattggggttcctcccaagcactgagctactgagtatataacaataaaaaagttctttttgaaatagcacttaaacgacaaaaaggaaaacactcgcgcagggaaaataagcagggtaccgagct

SEQ ID NO: 72843 - DNA, 622 bp, Oryza sativa
cccgaagctgttgctcccatcaagccggcggagaaggtgggcacgaacaccgggtagccgaacgcggcgtccgccggcacgcaccgcgcacaccccgtcagccccctcacgtacatgtcccacgccctccccactccccagtgccctcgccggcgccctccacatccagctcagcctgctccccctgctcatagatggttgcttggtttgggttgggttgaagacgatggattttggttggagacatggagctctcaccggtgaagggtatggctgcctcttatacaaaacaatggggggagcagccaaagcaagtggatgggctggtcggctggagatcgttgaggtggccaccggcgagcggttgtcccgctggcctcgcgcgccgccgctccgaccaccgtcgccccactccacccgccgtcccagtccacctgctttgccttgcctctgctctgctccctccaaactccaaattaacagagagaggctctccgctttggaaattttggaggggatggagctccatcaccatggaagcagcaacgtctgaggttaggtacctaccttcgtctccccccttccctccatgttaatctctagtattagtcaatgcgcataa

SEQ ID NO: 72844 - DNA, 2886 bp, Oryza sativa
gatacaatgatacatgctgcctcgttaaaaactttgtcatgtaaaaactcataggggaaaatgagaaaaccatgacaaagaaaagagtacagctcaaaggtcagaactacttctaaaaaaattctactggggttggtctggatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgttacatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggcaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaataaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgctgcccgccctgtcagtgcgccgctcgggccgccggcgtgtcgtgccgcgggccgtgccgtgctggcccgctacagtagccgtgccgtgccgtgccggcccgcgggctctgccagcggcccacgcacgggacggatactcgggccgtgccggc

SEQ ID NO: 72845 - DNA, 12542 bp, Oryza sativa
acgccatgagactcacgatcctagcgaagtagagctcggctagtttgttccctccataggtggtcttcacaggaataaatcgggctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacatagggccacgaactctgcaatttcccgcttcatactaacccaccagtatttctccttcaagtctaagtacatcttcgtactgccagggtggatggaataaggactttcgtgagctacctgaagtaccagctgtttaagttctctgttatctggaacgcatacccgatttccgttccatagggttccgtgttcatcctctgtgaaaccagcggctttaccctgtttcatattcttgaggagtccatgcatgtccggatcattcttctgagcctcgcggatttgatcgagcaaggtgggcttggcttccaacgtagccaagaatccgcgaccaactatgcttaggttcagggcttccatctgttgattaagttcgggcgggatgccacggacgttaagagtgttgcaatggctttttcgacttagagcgtcggcgaccacgttggccttaccaggatgatagtgaattcccacatcataatccttgatgagttctaaccatctcctttgccgaagattcagatccgactgggtgaagatgtatttcaaactcttatggtcagtatatatttcacagcgattcccaatgagatagtgccgccagatttttagagcatgcaccaccgcggctaactccaagtcatgggtagggtagttgccttcgtgagtccgtagctgacgtgaggcgtaggccaccacatgaccgtcctgcatgagcacgcaccccaatccttggcgcgaagcgtcacaatacaccatgaaatccttgcgagtatccggcaagattaacaccggcgaggaaaccagcttttctttgagagtttggaacgccttctcgcattgcgggctccacacaaatttctcttctttcttcaacaactgtgtcatgggtcgagcgattttggagaagttctcgatgaacctccggtagtatcctgccaaacctaagaaactgcggacttgagtgactgtcttaggttgcttccaatcagtgacagcggtcactatttcggggtccacagcaactcctttagcagatatcacgtgccctaagaatttgacttcggacaaccagaactcacacttgctaagtttggcatacaattgatgttcccgcagctttcccaacaccagacggagatggtgctgatggtcttcctctgattgtgagtatatcagaatgtcatcaatgaaaaccacaacaaacttatccaagtattccatgaacactttgttcattaagttcatgaagaaggcaggtgcattggtcaaaccgaatgacatcaccgtgaattcatacagcccgtatcgcgtggtgaatgcggtcttcgcaatatcttcttcacgaatacgtaattggtgatatccggaacggagatcaatcttggagaatacagtggcacctttgagctgatcgaacagatcatcgatccggggaagagggtacttgttttttatggtgacttcattgagagctctgtagtcgacgcacatcctcttcgtcttgtctttcttctctacaaaaatcacaggagcaccccatggggaagtactcggacgtatgtaccccttttctttcaactcttccagctgtttctttacttcggccagttcatttgctgccatacggtagggtcgtttgtacagaggagtggttcctggagcaagatctatccggaactcaatctctcgcttgggcggcataccgggtagttcttccggaaacacgtctccgaactccctgacgatggggatttctgacagtcctatctgatgaagttctgaacttctgacagaggttgggggtgcaaagaaaacaaccggttgttccggccctcggtacagagtgacagtgcgtctcgcgcaatccactactccttggaattgagccaaccaattcatcccaaggatcacatccaagttcttggtgtctagaagaatcagatccgagggaaaaggaatcccctgaatttctatagggacggcagggctataatactttgctgtcataacccctccaggggtggtgatgagcagagggttcctaagcctttctacccccaactgatttctccccacgaatggcacagatataaacgagtgggaagctccagagtcgaacaaaattgtagcagggatggaatgaacgaggaacgtaccaacgatgacgtctggagttgtcagcacgtcctcggccgtcacgtgattcacacgaccccgaatgacatccttcccgccgttgttggagcggggaggagcttggccttgctgacgccttggctttgggcatttatccgcaaagtgcccgggctcgaagcagttgaagcacagacgctgctgaccttgagcgtccctgcggccttgaccaggcggcacagttggcgtaggaggacggggcgcacgagtcccttgttgattctgctgttgctgcggctgtgggacacgcaccacgaattgaggtcgaggcgctgggcgaggttgctgctgctgttgttgctgctgcgaggaggatccccctggatagggattggtgtagcggaccctctggttagcaccctgttgattgcggaaattcgccaagcggcgcttgtgcgactccagttccttgtgcttggcttccaagcggatgctcttgtccaccagtcggtggaaatccggatagtccccagagactaggcggacggacagctcaaggtccattcctgccaggaacttctcttgcttctcctcatctccccgcacatcctcggagcgtaacgggccagattgttgaattcatgcaaatactccagcacggagcggttgccttgcttcaactctcgaaattcccttttcttaagggccacgactccagcggcacatgggttctccggaaagcggcggtgaagcgggcccaagtaatcggctgtccctctggctgcgtagcctggaagtggtcccaccagagagatgcgggcccctgcagttggtgggcggcgaagatgactttctcctcatcggtacactgcaccgtgtctagctttttccccacggcatgcaaccaatccaacgcatccacggggttgttggagctagagaaggtaggtgggcggatgcgaaggaactcggcgagtttagagtgttgggaaggtggtggtgaaacattctgttgtggtggattttggaggtggtggaggaaagcattcatcatgttggcttgctgggcgaggatttgggtgagaatggcgttggtgtctggtggtggtggtggagaagaaggtggaggtggaggtgggttgccctggtggttgtggttgctgccttcaggttggttgccatcaccggtaacagtgtttctcctggtcgtcaccatctggaaaccccacacagaaccagcaaacagggaaagagctaacaattaaaactaaccacccacgactaccattattcttaaatttatcactgctattaaattggttcattaaagttcaagttgcttaggcaaacaaataaagacaggctccgacatagttatgccacacaccggcataaccatgccccacacgactccaaaaagacaaacgagaaagaacacacgcgcaagcctactaactgctcgtctactgctgcgacgggccaggacggaaggtgagcaacagcgcatcctccgtgctaccaacgccggaggcttccccctcctagggaaccacgggcgcaggctcggcacgaggggtctcgacgaagcaggtccacgccagggactgacggactagctcaggcctggaggtgctcttgcgggcggtgatcttctggctgcggcagacgcggcgacgcttggggcggcagatctctccctgggcgatcttgagctgatgcagttgcgcctccactgcgtcgaggtccttcctgagctgcaggttctcttgacgcagctccaggatcttcaggttgttctcgaccatcccacgacgcaccatctgatggaagtcgatacgagccgcgtcgtatgcctccaccatgcgtgccagatgcacgacggtagcgtcatcctccgagctagcatcccggaaggtggcgtagtcgcgggctcctccgcgacgagggtggtagcggtagggcgagtgctgcaactcgtccgggtagcgctggtgaagagtgccgatggcgaggagagcggcgttctggcaagcggcggggaaggagtcgccacccgcggtgactgtcagcgaagtccgctcagaagagccagcgaggatcactgcagtgacctcccaaccagcgtggggctccgcgtcctcaccctcctgctccgggagcggcctggcctggtagcccactccatgtggataccctaagacaacgcacatgccgcgcagctccaagacgaagccagtcatgtccaaaccacgacgggtgacgctgccggccatctaaaaacaaagaaaagaaaagcaacattttcaaaggtcagatttttggcgataaatgaagcagcaagacagagagagactagacagttttcacaaataacaaaggatttttatttttgaaaatattgctaaggcttgggatctacggctcgtcctagggtcaaaggatgctctgataccaacttgtcatgaccggaaataacccaacgggctttcctgacgtgcgtgcattaatccttgtcccaggaggcaaggtacaccaaaagttgatacaaatcagagtttaacaagcggaagcgtaaatagttaacttattacatgggcagcgaaggcccagcacacacagagacaaacgaaaaacagcggaagactagggcgacgaccacaggcgcttgacggcaggcacgagctagacaccaaagccttcatcttcaaggagctcctcttctgggcttgggaaaaattgagcaagactgagtacaaccaccgtactcaacaagacacacccacaaatgcagaataaatgcaagggagtacaagggaattataatataaagggttagggttgcagtaaacagcatttaaagacatttagttgctcaaagctattttgtcaacacgatcctagaactaaacagtattattaatcaaggccgtgaacccacacgaacctgccttaacccaaggcctacgatgattcagaccgaactggcaacccgaccctgggtcccagctcgtcccaagccaacccaggccaaccattccacattttagttgttgagcaaattttaagaattataacactgacttgggtacattgctcggcttgcccataaccgagggcgcggctattcgaataggttttactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccgcctacggccggaacccccgggacaggcaggcaggactgagcccctagcagcagggcaccaaccctctgccgtatgacatctcgactaccgggccgcagctcgtgtagccttcatttgccctggagaatgtccatcgacccccgacttcatccatctccaatccgtgtacttttgtttatgactagcctgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtgtgtccaattccaacataagccaaccattccatagtgtccaaatgatatgagaatatcccaaagtctagagttgtaaaaccgcctaatgttacctaattaaattgcgaagcatctacctaaaattaaactagtggtgccatgagtagagtgtccactagttgaggttttgtttgctctagggtgaacaagggaataataataacaatagcaataataaggtcataacaaaggtaaataggcatggctaaataaaacagtgataacgcgggaatttaaataaagcgataatgcaataatttaaatcaacataattttacaaactgggattcaatatgttcaaagatgatgtgacttgccttgctcgctttcccaaccgacggcttcgacttccacgaagagcggatcttccgaagctgcagcgtctacacgaccaacggaaaagaaaaaggcttttactctaataaactccacataacaacagaaacaaagcacaaaaatgggttcttgacttcttaaggaaaaattagagacttgaacggtccaattccgagttcaaatggccaagatatggccatttgaagtttatatgctctttaatggatatttgcggatttcttcatttaaagttttaattaaaaaatctcatttattgcgtcagccgggagagggcgcgcggaccgggtccacgggagtggggcccacgcgtcagcctctcggtccacggtggaccgggcgcacacggctgacggcggccggtgccgtgggtcccacgcatcagccgcacccgcgggcgcgggcggctgacggccgggcccacttggcagccgcgagggcacgcccgaaggcggcctcgccggcacggccgacgggagggggacgcgcccgcgccccgatggtcaccgccggcgaccaccggcgcggcggagcggcacccgagagagaggagggaagggggaagcgaatggagcggtcttcggctcaccccggtcgacggcgacgacgggaacggcggccgaagcggaagaaggcggcggcgcggttcgggacgacgaggatgacggcgctccgtcggtcggcgagcgaaacggaggcgcggacgaggtcgacgggaacgcggcgaagccgatggaggtgacgccgagtggggaggaagtccggagcgacggcggcggcgaaccggagcttgtcggcgacagcggagagagaggaagatggcgcgagcacgaatgcgacggtgagagcgagcggcgaacggcggaaacggaggagagaggcacgggagacgtttaaatagggccgagaggaggagagagcggccggaggagatggaaaccggcgcggagatctcggccgccattgattgcgccggcgaactttgcgggcacaaaatcggacgaatccgagggagagagagaggggaaagtgggggaatcgggagagggaatcgcggggaatgattcccccctcattatggcgcgcggggacggcgggatgcggcggaatccgcggcggcggcggcgctagggcacgggcgagcggcggacgcggcgggaggaaggcgatgacaggtgggtcccacccgtcagcgagggtggcgggcgggcccgcctgtcagcggcgcgcgcgctgggaggagccgttgggccgcggaggagaggagagagagggagagaagtgggccgagccggcccaagaaaggaagggggggaaagaggacttcttttagggtttttctttttataaaccttttcaactttgtttatttcttctcaattattatttgtgctctgaaaattccactaaaatttatttacgcattttaggcttttaggaaatatacaaaaatcctccaagccttatttgacttttatctttgcacattttaattgttggaggctttcacaggaattttaattattctttgcacaaatttcgaggatgtattttagagtcgatttgggacgtgacaattcacccccacccccagcactaagaggatcaaagaggacaatctttctcggcacagaatcctggtccctgtacttagccataacaaaaacccttcccaacattctgtcagcatcctcccaaaaagtttacttaccaaaagaggtaactgcctggtgcacatgatggcgatcaatgaaatcaagcgggaaatctaggaacatgaaccagccttctctatggtagttagccgccctccaattaggacattggtcatgattaacaaaaataacagagtgaaccccatcatagaactcgggcggggagaggaccagagcatccctattcatggcagacctcatctggaagaaacctactacagacgggtaccagaagctgttacaaacctcatagtgtagctcatcttgaacgaagtttgcaatgagggcccgatgatgatcccagtcctgctccaaggggattggctctacaatggccacatagaagtcttcatggcgccgagcagggcgttgcgggacagtgaggtcaacccgcgggatgcggaagtcacctccagcatgaacaacaagaccatgcattaggaagcgcagcggattagggttgagattggccattggggtggagggaagctttgggtgggaagcactgtgcgtttgggagaagaagggtttcggggggaagaagacgagatttccggagaaatagttttagccttccaaacagcagtagtccgagccgacggtttcggatttttagggtgcggggcttttgtgggcttagtggtcaaacaataacgggctaaatggcccggcaagagacaggctcgacatctaagcggcccagaacaagaagcccgagaatgacccttttccaggcaacggccgcaaggagtgttttccaaatttgaattgggcgacaaattaggatcccgcatacctttggcatgcgtaattaactccattgccggaatgaacgacggcgagacgttagccaccttggaggttgccggagaagtgactgaaaccgttttactctgcttaaaccactcttgattacaaaggttattccagctattgcctcttgttgaccgagagaagatgtagggaagaccatttggattcagcaagacaatgcacggacacatattctaccaaacgacgaagcatttgccctcacggtggcccaagtaggctattgacgagtgttaaatgtcgattctataccgccaacatctgcataaagatcagataataaaacatccaacatagtgataggtgcttaatctcacatattccacaagtgttggtctatatttgtatgcagataataaaccctgaagttgggaggaaaattagactaatgtgaggagaattatgtaatcatacaaggaggggttgtgaacttcatcgaaacattagtgaatcaacccaaaactccgagaaatggacagaggagagcctagggagtccaccgactgaaggctaggccaggaggggccagcccaagttcgaccgaaccacctggttcgaccgaacccccctgatcaccgctgatcctagggtttggcgaggacgctccagatgctctcccaatgacggttgaggggcagttcggacatttccccttcgcgaaccgtcatacctacccctatataaggacatcatctcactcacttcaacacatacttccaagcttgagctaaattataagaggctttattgtactatattgtatactaaaataggaagagcgtagagtaggagtcggaagaattccggagttgtcggtaatcttctcctatttcttttattctatttattactctgaatttaatataatattcttcttgagtaatttagatttatcttgtgagaattatctcttggttagttcctaaatagcatacggaattattgttcactgtaatcaactaaaatatagtgattgctttgctgagttataaacactaaagtagatagtaattgcttagacgtggtgtttaggtaattgttgtccagtaattgctgcgtataccacagtacgttgaggtgggtgtagaggtggtgacaaccctcgagatcactgaagtcctccctgtccgggtacgtagtagagcgacatctgggaacagcgggttgccagttcctgaagtactgcgttaggattaaaattaagctttctctagacactgtttctcactaataaatcctctctatcctagcctatcatttgcttggtgtccttggatgaaccggaggaagctctgatcacacacgttcccttggattcgatacccttggaatacaccgtaggggaagtgttacatcggtatatctgtgcacttacggattttatctgtaaccgtatcaaataccaagaagcatttctagcaccgttgctggggaacagttgctgatcatttccgaacccagttcatcctcgtatcttttttcattttttttattctaccttcacccctgttatcctagagaagtattcttgtcaactcttctcgaccatggagcaacctctgtttgagttgtctactcctcggggcgaattctatgagccacctccttcatcggagcccatttgtacaactggctatgaaattcgtcccgagctaattagtatggttagggaaaatcctttttctggttttgatctagaaaatccctaccatcatctgcgagactttgaacaagtccgctcatgccttaagattcgtggcatgagacaagaaactgtgtggtggaaattgttcctgttctctcttcaagagagcaaagcaatggtacacctctaccgttggatgtgtaaatggtagctgggaaaagctgcgagacagattctgttttgccttcttcccagttactcgtatcactgcccttcgaatagaaattctcagtttcaagcagatcgaaaacaaatcaatcggtgcagcttggtccatattcactaatttagagcagtccggaccaaccctgtccttacccgagtatgtgcttctccaagatagaggaacctctaacaatcgagccacttgctgaaccatccacttctgctagctcaattgatgagaaggttcccgagcagccgtccatcgagaatgaagaaattcagactccggattgtgccgcaattatgttcagggacggttttgacgaagactatggcaataccctgaactattttagcaagaggaaaccacccgttcctttgtcacctcccgatcctatggaactcgggttcctatgagaaattgtccgggaattgacatccataatgagcaatgaatggctaagggaggcagagctttcatccgaagtaattcggataaatactgctccccgaatcattccttgccatctggaagggaacgatgtcggtattctctatagtccaactgtcggggccaaccttgtctctgagttttttgcattcgcttatttaagtgataaggcagtgacgccgacaaacaaattcttcaagcatccaaatggaaatatcatcgaaggatttgggattgtacaagatgtgcttgtctgctttgaagacagggaggcgatcttggatttcctcatctttgaaatccaagactttgatatcctaatcggactgcccattgagcaacttctcatcaactcaccccgattaggtagcctcaaaataacactaggagagaatgaattctcaattccattttcgcgggcaaggttcaccttgaccgaccctctcccagaaattgagtcagtggaagaggttactgcattttttcctcatgagtctcccgaggcccttctggaagatgaggtccccgaattcatcaaggaagaagcagatcccggtgagactctcgacctgccaatcatggaaccgccacctcgacctccgcttgagcttaaacctctacctctaggcctacgatatgccttcctacacaatgacagagaagcccctgtcatcatcagtgataagctctctgaagacgagactcaacgtcttctcaccgtgttagagaagcatcgttctgttcttggctactcgcttcaggaccttagggggattaatcccgcgctttgcacccatcgtgttcctattgaccccgagggtactccctctatggaacctcaacgacggctcaataatgcaatgcgataggttgtaaagacagaagtcttgaaactcctgcatgccaggattatctatcccgtaccatacagtgagtgggttagcccagtccaggttgtgccaaagaagggaggaatgacggtcattgcaaatgctcaaaatgaactaatttcgcaacgaaccgtaaccggatggaggatgtgtatcgattacaggaaactcaacaaggctacgaaaaagtatcttttcccgctacccattattgatgaaatgttggaacggctggcaaatcattccttcttctgtttccttgatgggtattccggataccatcaaattcccatccatccggaggaccatactaagactacgttcacacgtccatatggcatctatgcgta

SEQ ID NO: 72846 - DNA, 17434 bp, Oryza sativa
acgtggccggagaaggcgggaacgtgtgcgcggcggcggatacggggcgcggcggcgccggctggaggaaggggacgggcctgacaggtgggccccacctgtcggcgaccctgggagagaggagggaggcggccggctcggctgggcctcggcctgtcggccggcccagcggaaagaagggggggaaaggagagaatgggccggcggcccaattggaagaaaaagagaaaagaaaaaggaaaaagaaggaaaatagattttcctgggattaaatattgcttgtgctcaattttaattggttaaaattatttctagagctctgaaaattccactaaaaatcttgttagcgtatttcgacatgtagaactcaagaaaaattccacatgccaaatccgattattatttgtattaatttattagggttttctcttgcttttacaccgatattttctctggtggattataaattcaatttaggcttgggaaagaacttcagggcgtgacagtgatgctcaagaatctagcagttgtatgttgattgggatagtctagagatagctccaattccacataaccaagttcctcagcttgctattgattgggatgcattagtgatagaacattccacaacaacttggttgatctatgcctttgatggaggaagatgaaatgtatacatttgttggacttagggctgaggacaagagagccaaacaaactaggcttgaagttgagaggcaaagggattatgttcctacaccaggtccagctcataccgaagggaacttgaacattaacaaggcagagattgttgttaattgatgtaatacttggtgaatctgaaattttctataactaggatgatcctcctatggaagttggaagcttatatagtatgattgaatttaggtcaattgtgaggcaacacgctgttaaggggtaatttcagcttgggacaaagaagattgataaagaaatgtttaggggcttttgcacagctgagagatgcccatgggctatcgtggcaaggttgatgcctgatgaaagatccgtgagggtactaacaactaactaaataaatagtatctcatatttcaaatattggtttggctatatgagttgtctcatggatgtaaccatcttatgtgtgtgtgtattgcaggataccataaaaaaattcgcccattctcgtgcatcaacagggagagtaaagataaagatggcaagttataagtgggtggcaaataacacaattccttttctaaagaaggatccaactatgggtgcaaagcagctgatggggacttagaaaccaagtacaatatcactttaagataccatactgtgaatagaagtatggcaaggctaaagataagatttttggtacatatttgtttaacttcaaggctaaggttgagctgaaaatgtctaaaaagtgttgtggagatagattacaagagattgttgatggggtttattttcatatattctattgtgcactcaaaccttcgattgatggtttcacgaatggatgtcgaccatacttgagtatacactccacagcccttaatgggagttggaatggtcaactagcttctgctacatctatagatggacataattggatgtttctagttgcatttgtattctttcaaagcgagaccacttacaattggacttggtttatgcaacagcttcattaggcaattagggaacaatcacacttagcaatctgctcagacacttgtaaggggctggataaagctgtgaaaaatgtatttagtacaacagagtatagagaatgcttttggcacttgatatagaatttcacctagaaattttatggtctagtgtttgggaacatataccctacagctacgtcttacataacagacaaatatgagcattacatgaataattcactagacaaatccagatgtgaggctatatctagaaacttaccacaactactttggatgaggagtaagttcttagaaaagataaaatgtgactttatcaccaacaatctggtagagtcatggaacaaatggatcaaggatttgaaggatcatcctattgtagatcttgtagatggcatcagagcaaaaacaattaacctattggcaaggcggaggaagataggtgagaaattggatggcgctagattagcgtcatgctgaaccttcagggagaactgcaggataagcacggaaacacgctcgccgcacactggcgcgccgtgcgtgccatgggccacggcacacaggcttgacaggtatatatgatgaatcatgaattgctcttttatataccaggattattagcttttttcgcttggggatgtgaccccattgtttgtttgttacacaagttatccttttgatgtggtgtggtatgtaccagaaaaacaaaagaaatattcagaattgaaactgatgtgctcttggtgtgtcatccaagtcttgaaacaatgcgacctctgatgaaaggatcaatatcaccgtccaggacagagttcaattctgacagctggaggcctgtgttgagatcatgaaccaatttctgaggcccaaatttgtaccttcttgtctctcggctgtacaattcctccaccgtctgcctcttgatcgtcttcaggttcgacgatcttaactctctggatataacaagtagctttgctttcagcctgcttatagctttcatcttgtttgcgaagtagcttcgctcacctgtggagatataaagagtcagagctgcatgagagttcacagtgcatgaaacatttggttaatttagtacctgaactttcagcagtaactccagttcgaatgtgttgaaccctaatggctgaatttctgtgatcccgcctcttatgatcactaggggaaggagaaatctccagatcattctcgtccaagtgaagattaactggtctgtctaagaagagaggaattatatcgaccctagctgacgttgcctgcaagctttggtcaactttaggttagccattttgatataaaacagcatacggtgaatgccatgataaagttgtgtgcacaatatgggcatccaaaaacttgtacagcagtttatccaggtctttttaaacacagaagtcaaatcatgttgacattgccactattctactccctttgcttaaaaaatttggatggccaatatttcagccagaccgattaaagaaaaggggtcacagtagttgaaaaccatgtataaattctgaactatttttagaaatttgcatattaaacatgacaagctgaaacttaaacctaagtatgtgctattactttctccgttgtatcctaatggaaggctacgtagttcgacttttgttcagtattttgctgatgcggttctatatgtttgccttggttggtacatacatatcagtcagttctagtgaagtaacaattttaaatattggagtccaggttttctttatttgatattacctgtctaaccaattgcttgaactaccttgcagaacatctcatggttctctatgcaaatgtattagggaattgcaaggaattctaatctcatcactaatgggtagaacaaaattatgataggaactaaatattaacaatagaaaaatgtaatcacctcataagtgccagcattatcgacagaaggatagatcattctgtgagttcctttttctccagtaagggtgccaaacatgtactctgattcaatttctatggctgcagtccatacacgaccacttgttgatgtgatcttctcaaccagcccatccttacaaccttgtttccgtgcccaacttgaatacatgcaaaagatcctctctgcccatagctgcaatggtaaaaaaaatcttgtttataaaaaactcaaaaggtggaaatggttaattttgctcaagaaagaattcaggtaaacatcaacttctataaaactgcaccacagtgctgataaagtaatagctaagaatttagatttggaaggaatatttatagtgaccctccatgagcaattgagcattttatatcttcattcacacgattcttaggcatatgtattccttaatttaatgagcagcatttcaataataacacagattcatggaacgaactgagcagtaacattatggaaagtacaaaggtagtgttattattactttgttagtacaatgttggcgttcttttattcttctctcattaagatccaatgaataattccattaaccaacattctataatcaacttgcctcagaagcagcaccatctgatccagcagtgacgatgatgcaagcgccttccttgtcgtacggacccttaagaagcttgtacatctgataacgatctagaaactcagtagcatctacggaggtcttgtatgcctgcttaaacaactcaacattgatgacatccatctctgagagttgactaatcagcttagcctcttcagcctgcaccgcatatcttaagcatcaaaaggagaaaaatgctaaattctaaatcacaatttctgtagtgaaaaaagaaggataaaggggtggaatttttgaggtggttagagctgagtgaagggcagacaatgcacacagttcagtcctgctatcaagcattgtccattcacacaacagtataggaagctttactttgtccaaatgtagggaaattttctgaagcacatcttgcaacaaggaattaagcaatcaccttatagcgaaggtctttgagatggtcgaccactctgatggcatcagccagagcagagagtgtctcgtgcgatttagctggattgtcccacaagttgcgccccctcaacacctcttcctgtctgattctccgcgcttcctccatctccagtgcactggatgcagtcgtttcgacccggacaacggcatcttcgatcctctttttcaaagagtacaaaccttggtacaatcaacaagtaactgtaataagtctgaaaattctgcggtttcaattttaatgacttctgctcaagttattctctagtgctgtcactatgtttggcctgaaaaattcccttctcttttaacactttagcatgatttccacaggatttatccgcatgaagcaacataatcaaagtactagtagcttgtattttcgttgcattcagattttgcatttgattgaacttgaactatgaacattcaggacagttcttactcaatacaagataacaagaacaggtatgtccacggccatattagtaacattgccactgaaataagccacgctctcagaaacaatttccacaacctaacacaatagcagagggctgacccaaagagggagccgcggggactcaccgagctccttgtaggaggcggcggtggaggcgccgtcgccgcggccgtccgccgggagggcggcgactcggccggcgctggaccaggggcgggagcgggagcagcagcggggcgacgccgcggcgcgcacggacgccggagagggcgccgtgggcgccatggatggtgagcgcgagggaagggggagggggggtttaaagagcggcggcgagcggcggagggaggcggcgcgcaggctgaggggctgggtggcgcggcgtggctcacacgcgcctcatccgccgcccaatcagcgcgcgccaactattctgggcttgggttgtgtgcccgtggccagtgggtgttgaactgttgacaaagcgaaaatggccgaatttttgtgagggctcctttgggacaaaggagaaacattggaaaaaattagaatcattggaaaaaaatttcgacctttggaaccaaggaatgggactggaagatttgtaaggattgcttttccacaccccctattttataggaattctaacatgagcacaaacctcttgttttatatgttttagttaagcctaatgcacactctctcttgctcgggtgtggatcccctagagttggggatcaactccactgggtggatttaggataatcctaaccgtcctttattttgtacggatgttattcattttcttcctcaaatgtttttttattatctagacatccaaaacctccttgacatgattatctaactccgaactggagcgtttcgacttctgagtggcggcatgatgagactgctagaggcagacgagcatggagcataccaagtgggaggtggcacatggtgctgaatctaaagccaaaacatgcccataagggttaacaatgcttcatgtaaatcagtgatagatgcacatcaattgaggcttcggagaacgaaacaattcatcatcagtgcacatcatagctcaattggctacttcttctttgggcatgggaaagggtggacctagcccacagctaaggcccgcggtgccctttagtgctctcacagtaagctagctcatatatggtggaaatttgttgtggtccatggggttttgacaccaagccctagcccatggcctagggtgccacgggccagggtccgcccctaggcatgagcgcatagctatcgtatgtgttttcatattctttgatagtagtaggctggcaacatcaacattagttctccactgaggccgcaatggttgccgccgagaaagaaggcaaaggaaagatgttgcttattccaatctattcactagaaacaatggctacgattaactgaaatctatatggtggagttgaggccagctgcaggggatctgtactaccctgcttgccatatctatactctctctctctctgtattttcaaaatcctgtgttccaaataagcaccaaaagtatcaatactctactatttttttaagtgaatcatgtttaggatcatattttcttacctgatagttctaggtattagcatatccttttactttagactaggtaagaaatttttaccctagattagttgtttcggatgagtggctcaaagcgtacctctcatctccatctctccttgcatgttgctcgtctgcatatataaccaacaaactcgactacaatatgaatgtgatgaaagtaaaattcagtggtataggcctgacactagcaaagcacagtttataccatgcaaagatagagcttgagttgcacgaaactaatatcgatctgtgaaggcctagaggaacaatctcaatgtcctcaatatcgagttggggctagcacaggaaaaggtggaggcagagtttgattgcttgagttgagcaagcatggatctttagctttggatcaatgccaaatggtgaaatggaggtggagcttaaaaaaactgaagctactggtggagggcaatattgacctcgagtggaagccgccaccagcaaatcaaagaacaaggttagttgcactagccattgggcggaggcggaactcgagctacacatggctacctttggaggagatcattgttgacgtgtcgacgtttgatgtcgcgattccgatatttgcatagtatggggattgttggtactaggatatatgcgagacttaggtaaaaaagatggggacgaggatttttatacaggttcgggcccctgaattgtcaggtaataaccctatatccagttggccgaagccggtattgctcttattcaccataatcacaccagtacaatatttggggtagcctatctaactgttgtcgacatggcggtctgaagttctgactcgtagtcgacaacagggtagtcttcctcctcgagttcgtgcccagcgagatcaaagacagcgctagatccctacggccggcctctgtaggtaccggatagggttgatccaggcatatctctgatgtcgatatctggcggcttgtcttagcgtatgttggcttgtatgttgatctttctatcttgatctattgttccgtcccccctctcctcctaggggccttgtatttatacctataggtgcccctttgtccaagtagaactagggaaaccaatatggatacaatccgagtagtcattgtcgtttccatgtagaactctattcatccttccttatgcagaactcctcctatatccgaagattgttcccgtataagacatggtatgtggtgggtcctaccgagattaaatcaactactattggatatgtggtatccataaccctgacggtggacggagcttaagtggtgtggaagcaaagtacctagacctagtgcagtaggtggggtggagctcgggttcacaactacaacgaggattctacaatcaagcgttgtcctagtacaccctgtgcttgtacttcgttcatgttaattaactcatacctagacccagagtagcagatacgaataaaggagggtgtaagagaaggaacatggagagtattctgtaatgtgcgaaaggaaaaatggtctaaagtgaactatgatgataaaaagtaatccaatatgcaatatgcaatcttctagtgaaattcatagcatcttatgcattttttatgcaggtttgacagtatatttctcttaacaatcattaaaattttatatagtttatatagtaagtccaacacaatatcacggaaagcattttcacgtgcagtcaaaatggatctatggaaagcattttcacgtgcagtcaaaatggatctacgtaagcggctcggctctccacctgtcattaaagacctgtgaaaattaggtcttcgtattcagacggccgactgtctgtgtagatcgaacatgtggccatattaaaatgtctgcttttgaaaattagaaatgtttatgaagttgtaatcttaaaatacatatgatatctgaaaaatattcttcgtatgcattacttttgttctaatcctcaagagattagcagcaactagaaaattgtggggtgcctagtgcgccggcgcgcgccgctggcgcttaatttgttggataagataattactagtagtatattagtgttagataatgattgtttaagataattatcataatatataagattttcttttttcacgagatttttttaactaacaaattgaaaataaatatatattcgaagttaaatttttaaaattttaaatccaaatttgaaaaattttaactcaaaatttgaatttttcaagtcaaattttaaaaacgttcaacttttcacctcagatttgaaaacttttaactcaaatttaaaaacttttaacttatatttgaaaactttcaactcgagatttaaaaatcagcatgaagacacggggatgacatggcgcgcgcgccagcaagcgcgaattagccaccgcgagaaaattgccccaactgtaaacttagacgggcccatagcccccagcccaagcgactgaaggcccattcggcagccttcccggggcccaatcaaatcagtctgtgagagagcttgggccctcactcccggtaggacggcagcctccatgtagaaggcccacataataaatgtaaattgctcagcccatacacgtccaggtttccagagagataaatgtggcccatcaattaccaaactaacaacctcaaacaaaataaataaataaataaaaatgagtataattaaaatgaaccgagcgcaggctgcaggtgggggaccacatgcagagtcagcagcaacagcgacccgccgtgtcctcatcgatcatcggttaggccggccccagtggcggctgattacgaccggtggcgccggcgaccgccccatccacccacgcccatacacgcacgcatgctgtcgtctcctcgtctctcttccagcttgtcctcctgtctcattttatatattctatctactgcttcatattataattttttcgagtcaaacttaattttttttaaaatattaataatatttaaagtatcaaattagttttattaaatctaatattgaatatttttcataatatatttgttttgtgtggaaaataccactatatctttctataaactttgatcaagaaatttgattaaaagaaaagttaaatgagttataatataaaccagagggagtagtcatcggccggtcaacatcaattgttcaatcgttccatgtaaagataagatttatgatagtatactacacacatgtaggtttagctagccacgtgtgttgttgctggtatgtactccggccagtcatacgtggcggtagcagccgccgccgccggcggtgtcccaccgggcagtcatacacaaggggctcgatctctggataggccgcgcgaattaatgcaagttggccaagttgtggccgctggatgcatgcatcctacgagtttgtgtgtgtgcatatgctttgccggcttgcaatttgtttactgcttgatcatcagatcatgaccatagttccgaattccgattaattagatcgatcccagctaatcatgatcagcaggtgcatgcatatgtctcggagcacctgatcaatgctgagtaagctaacaatacctactgatctgttcgtgcatgcatacgctgcatgcttgctgctgattatatctcgatccaggccaggcaggcagcttcccgtgtggcctgaatggatcgatggtcgcgtgttgtttgcgtgccgattttgtgcagctagccaaattaagtctatagctagccgagaaacctggacatatgacatgctcgatctgcagcagctgtgacgaacgaagctagagaaagtcacaggaaattaaggcagagcgagcaggcaggaggcagcatccaggtcgtctgagatgtgatgagcgcacgcacaaaatcacgccaggattgcagccggccagccaggtgagctccatgcatgaccgctcaaattttaagcaatcgcgcgcaaagcgcttgattgccagacgcaaatgacgatcgacgcacgtactttcgcctaattttagttggcttgccaaacctttaattttattcgttagattttaaattaaacgcactgaaaattagctctttccttatatgccattgatctaaatttacgcaccctctcataccactctcgtctgttgaccgttaacttttaagtaaagaaaacgtatttgcccttctgagtattggacatggctaacaactcagaagagcaaatatgtcttttttacattagagttaacagttaacacacagtcaacagacggaagtggtacgagagggtgcgcaaatttggatcaatgtatataggagaatagccaatttttaatgacatacaaaggatcagaccaattttcagtaacatataaggaattctctctttcacgaataacttgctcagcccgccctcaagttgtatagtaggtccatcttggaataaggttttcccgcctatctttaacttgattcccgctaattataatcgaaacgtttttcaaattggaattttctagttttcaatatataatgtacaattctatagtagtacttgttaacgtagaaatacaatgcaatattctgtacgtagtactagtacttgtcaaaattaaattaaacgatacatttgtcaaaaagcacaagcctacgaaggctggatatatatttatggacaataatccttaaattaactggctgatttatccaaaatcttaattaagccaacgaaagatcgatcatatcgacggacacgattacttttttacttcaccattaattaattaactaatgcgtgattaacaaatccatgggctccagacgtcatcgagggccagattaactaacctctatacgtacacctactcctcaaattcatatgctttttatactttatttcttaattaattcctcttcgtgttttttgttaagttaaatgacggaggcgcatatacatacgcatcgatcgtgtacgtcattgtttaatttaagccctgtcagcctatagctttgtcgtctctctctctctcgtgcactcaacacaaacttaaacagtacacatatagtctagtgcaaccggtactacctaatataacgacctgcatgtatatactccctccatcccaaaatgtttgacaccgttgacttttttaaaaatatttgaccattcgtcttatttaaaaaatttaagtaattattaattcttttcctatcatttgatttattgttaaatatacttttatgtatacatatagttttacacatttcacaaaaatttttgaataagataaacggtcaaacatattttaaaaagtcaacggcgtcaaacatttagagaaggagggagtatatggtatagtgtgtactagcctttctaatctcaaaatagttagcatatataaatacagatatttaaattagttatcatgcatatataataatcatcgatcgatcgcttgtgcactgctacatttgtagctgacctatatatgtctagcttttgtgatatatatatgccgtgtatataattaaatagtgtgtgttacatgcatatatacattgcgtgtcatatgatcatatcatcgtctctgcttgatcaatatatcgatatgatcgatggacaggccacgtacgtaagagctagcaagtagattagcaaggatatcagagctaggatatatattaaagctaacaagatatgtgtatgctacaaaagggagaaacttaattgtactcgatcaagctacaacttaatcattactaattaattaacaatgtggtgttgcatcatatcgttgcagcttgacacttggagctcatatatcctgaccaatggctgcttagagctaagctaattaagcacgtatagtacgattcactaagtaatagcacatgatacatatatacaagctaagccgaaagtaaggcggctaagacgcctctcgtgacagcaataatccatttaatttgtctatacacacgtaatgactgattcatgtgtgtgtgtgtatatatatatatatatatatatatatatataattcatcttctagaagatcatcatcatcatcgatcgatcacctcgtgattatcgatagatgcactattgcacttactgcctaaatgtatataattattacgtgatagtgcatctctctgatcaagatgcaggcagaatacaatcgttagtggtgaaatcaatcaagatccaacacaatcactgtacaggattaattaagtttttgcaaaaatgttgcgcatatatatacaagtaagtggctagttaagatcagattgtttataacactgaatggtatatgagatgtgccacaatatttgactttgtacacgggttgaactcgacgtcaatgggatcaacaacaatacacgcctagctactactcgtacctactactactactgctactagtcacttaatcaatggagagatcagtggccgagtcttgtaagcaattgaatcatgaggtaatattgatgtttacacgtttgaaaactataaaaccactcatcctgccagctatctatctagctactcccaataacttgatctactctcttttcatcacatcctattttttaaaattttgtggagggaagagaggtctttaagtttggcaagtgtgtgttatcatttgttagactgaaatgattaaaattagtcgtctagtgtttagctctacctgcaccatctttttcatttacacttaaatcttccctaaatgattgagattagtttacacttctactattaatagaaatattgatattcttcattatattagttgttttgtggagagaaaaaaattaatgtagtaacaaagctaacctagcaaggggactgatgtatatcaagcggcgtacatactctttttttaagaaaaaaatgtctcctaccagaacacctatagacctaaacagtgcaactgattaataattaagtaaacctatcttgaatctctctccatgaaggagaatttgtacggcaccaatgctcactgagactgactatttgctaaggaccaccgtataattggatatataaggggttaatatgcttgtttattgattcttgagtattgatgtcgtgacaatttgctagtaacttaggccaagtggattgttgttgtattaactaactacacacaccctttgataattattgatatgtggattatcttgtgatttttcaccatgtactcttatcatacatatgggtgtggacaacgacttaaaaggtggctattaccgaagttttcttattttttgaactttttaaaatttttactttaaaataaacactttcaaaacttagttctaaagtctgaaccttttttatcacgctagttgcgttatttgatcatgccagtctaactggtgtggcgagataaaactgtcacgcccgatatgtgtggtgtgtcagtgttggtttgccaaaccaaacgggctggcgtgattaaaagattcagattctagaaaagttttagaatggtttatttttaaaaataaaaaaagttcaaaaaataataaaaaaagagattaccactacactaagacatagaattgttatggatagccattgggaaaattttgcattcgtgcacacaaactgtctattgggaaaagaaaattacgctagtagacaaactagctgttgaaaaaaatgacgctcttggtcatgtacaaactatttaatttccataaaaactatatgtcaacgattctgtgtcgtagggtgatgtgcccgtgatacatatagtaataaatatgccttaaaaaaataactgataaaattaactttgagtagttacttacttacacagtcaaacctgagctatatatacgtaattaactaccacatacatatatctatatcttagtttgaatatttttggttaattaattaaacataaataggaaagtgacatgtctgattctgaagcgctctctagctagggtgtgtggtcactactccccagtcccagtctgtggcctgtttgaaaagctgagatggggttgcgtttgcgtgcgtgcgcgcgcgtgcgccggacgcgtacgtcctaatcccttgtgagcccccaatcgaccattccattccactccctaggacgcaaacatgtggcatctcctccccacaataacacaatctcattatgagttgatgacaaggccaaagctacaaaacaatatatccatatccatctgattgtttttttaattttttttaatatgccaacatatatttgaaagggaaatttatatataaatcgctttcgaagcatgcccatacacaaacacaaagtcctacaaattaggcgtccgtgtcgacctgtgtgaccgcccggctgctgcgtgcgtgcgtgcgtgcgtgcttctagctagctcttgtgtacaacgagacgctgcagctttccgacgtggcaattttgcagcttatcctttttttttatgatatatactctccctatctaatgtgttcaaattaaactcgatcttttccaaatggacaggcgcgctagctagcttctcccagtttcttaatttgttttgtttctattttaattttgtgtggctattcaaccacgtccacgtcatgcaatgaaacctctagctaaaatttctatggaaaatacgtacgtggaatatataaatgtatgtaattaatgatatacgtacaagcataatcaactatatacaaaaatgcgtgtacgtgctatgtactagctcttattgcattaagctatatatatatagttctttatgtatactgttgttaactatttgtgtacatatgtacacagacatatagagtacacatatatatacacacatgcgtaaatatacgtaccattgtactctcgatcgtacgtatagagatgtatacatgtatgggccggccggggtaaaataaacggcgtggaaatcttatcttatctggatggaaacaacgtaataggggcttcaagttgttcctgtggctgcatgtgcgtacgtggcttatccactcatgtatcatctatgatcctggctagcctagatcacaaagctcaatctactacctctgtctcatattataacactttctagcattgttcacattcatatagatgttaatgacatacatatatatttagattcattaacatatatataaatatggataatgataaaaaatcttataatatgaaacgaagaaaatactgtactactactgtatgatcgacctagctatagctgcagccgccatcaaaagcatcgagatcaacaggatgagatcgatccaaggagaagaagaagctagagaaaggaatcgaagaagaagaagagaagagagaagaatcactggaactctctctctcattcatcaccttgcccatcacactgaaggtgataggaaaggaaagattctgggcaaagtaaaccatccatccatgtgaccatgacatggataaatcaatccatccatgagctgatgaccggtcgagatgtagctagcacacgtttaattaattaattaaattcgtttttatcctcatacacatatttagttctctcatttttatccatacacatgcagcatatgaaagttaagatgcagatagatgttaagttgcttgttgatttatctagctttcatatgatatagtggaaacaaaatatccgggtaatccggcaaccgtggctgtcgatcgatcttagccattaactgctgcaattgtcaggtaacagtggtgggtggtcttggttaatcgatcatcatgcatgactcattcatgcatattgcaggcccccacatattccaaattatgctttatcctcatagatctccattaattactccattggccactaccacctttgcccatgcaactagtactagtgtactctatatatatatgccattcgttttccttcagaaatacttgggcctcttattttctgaggccaggaaaataatcaaaaggcataagcatctttaacatacatgtatgttaatttctcttagaaagataaatgtatatacatgcatggttgtgcacaaaggaattaataatgcactccctccgtactcgtaaaggaagtcgtttaggataatgtttaagttaaacattgggaatataaatcatgaataactctcaagtttattgagtttgaaaacgtaaaaaatatatgaatagatttgtcttgaaaaatactttcataaaagtatacatatatcatttttcaataaatatttttatagaaataagaagtcaaaattgtgttttggagactgtgtcgctgtccaaaacaacttccttgacgagtacggagggagtactatatacccctctctacttaaccctgatgttggtagcattatacaataagttagcatgtgcaccaacttgctgatgtgtcagctagatgagcttggaaggaacacaaatattctttctcagctactgtttggctcatgactttggtgacggatggctaatgcttgtactcctatattctctataaattaacaagagcaagaagacatggaaaaacatcggactcatgtagaatcacagtccaagaagataaccacttcctagagccggccaaggcaaattaaagtac

SEQ ID NO: 72847 - DNA, 4300 bp, Oryza sativa
cggctactcggcccgtcccggcacggcccgttactgtagcaggccgtgccgggccgtgcctgctacaggttcggccgtgccccgggcggcccgtttggcccggcccatttggccacctctacacaactctactaactactacaaatgaacacagccatagtttgccaaaaagaatcacatcatagctaaataaatgttttatgtaatatatatcgagagaaaaaggaaatagggagaactccaattgccccgagagtggtgatctcacttaataggaatagccctatgtcaatatggtataagtgaactcaggataattttaaaccaaaacaaatacttatagaacctacgtggataaaataaaactgaaacgactaaattgaacttttggtgaaacttaaggaattagatctattcaccctaaaaaatcagctaaagaaatattttacgaaataatatatcaaacaataataataataataataataataataataataataatgaagaaaaaataaatatagggaggagaagtccaatccccaagagagcggcgaagaaagaagaaagagaaacacgggtgcacgcgctttcgcacccttcctttttaaaacgccactcccggccaacccggcctctccccatcctctccgtctcctctcctcccttccaccacgacgcgaccgacgcggcggagaaacccgcgaagccgcagtccagccagcgaggggccgccagccgaagctgaagcgagagctagggtttgctccaccccttgaacccgcccgcgcccccgccgccacgaggccgatcgaggtgcgtgccaccgtaatctccgcgcgtgtttgtcgtggggttgggttgggttgggtggggtggggtttggtgtggatcagggaatgcgggatctggtggggtttcgtgcctcgctcgctcggggatttcatttggtggggtggtggtgatcccatcctcccccactggattttgatggatgcgacccccttccgctgaaatcggagggattttggttgccatgcgctgctccttctgtccgtacggttcggtgaatcgggagttgtagattggtggtgatgatgacccagtagttggttctgatgctcaatactcgctgcgatttcgctcccctttatccaagggaagggaagggagaggggcttcctttgcgttcaaatttagcaaagtaggaattgtgtgagattggtggtagcgctcacttttttcagctctagatcgttagttctgcataccatgaagattcttgtatcaggagaagattattatatttattctgtggagaacgatatcagagatgatttgtgggggtgatttttggctgatttctgctctgcagggttctgcttctgaggctgtcaagcctggcggctaattgggatggaccttgtgggatcgctgctggtgaacatgactcacttggttgacacctcggggctccagttcttcggctggctcatcaccgccggctccttcggcctcgccgcgctcatctacgccctcctcaggctgcagagggcggcgtcgctgtactggatcaaggcggctgccagggagaagaaggcggcgtggaagtcgttgcggtgccccagctccggccacacctggaccgaggactacttccgcggcggccagccttcgacgtgctgcgtgtgcctgtcgtccctgaccacagctcagggtgtgggctctcggggtgccgatgccgttgtggtccaccgctgctcggtgtgtggggtggcggcccattctggctgctctcgtggcgccgagaaggactgcaagtgtgtttcacagcatggtgcttccaccttgcttcatcactggtcggagaggtgggtggagctggatgacaacccagagatgtcctctttctgttactactgcgatgagccatgtggtgtgccatttctcggcgtctctccaatatggcgctgcctgtggtgccagcggcagatccatgttgattgtcatgcaaagctgttaaaggagacggggaatacttgtgatctaggccttctcaggaggctcattgttcctcctctgtctgtgaaagaagttgcccaaggaccagcaattactggaatgctcaactcgatcaaggaaggtcttgtcacttcatcagttaggggcaggattaagaggcgaggcaacaagaaacgcatgaacaaccatcctggtggtaagacaagtccagtccccacaaacagctctatccttgattctgtgcttgaagggtttgctagactgcagaacttgaatggaaagtatgcgctggcaaaccataagtctagtggggattctgtcaagcaaacacatggatatgacagccctaatggagggaagaaaaagtatgaaatcattgatttgccacaagattcaaggccactgcttgttttcattaacggcaagagtggaggacgaaatggaccttctcttagaagaaggcttaacatgttgctaaatcctatccaggtaattttccttaattctttacttacgaaaatggtagcagctcattcttatcaactgctgagtcaattaaactgcttgctagtttctctagctttatatgcatgatacatctgctgaaaattgtagccagcagttttccttggttcattctacgatacttgctaattaataggcattttatacctatgtaggttctagattgatctatttgtcttttgatgttgccctcagagtgaagttgtactatttttgtcatttgcacactttattccgccaaccaaaatagtcactgagatctgacatcatcaaatgtttagttaatctactgttaactttagtattagccgtggttgattgtgacatatttgatactctattcttaacctggaaaatctcattcttgtttcagatatttgagcttagtgcttctcagggacctgaagttggattgcaatttttccacaatgtaaaacacttcagaatccttgtttgtggtggggatgggactgttgcatgggttcttgatgctattgaaaagcagaactatgaatctcctcctcctgtttccattcttccattaggaacaggaaatgacctatctcgtgttatgcgctggggtgggggtctgtcttctgttgaaggacaagggggaatatgtgcacttctaaatgatgttgaccacgcagcagttaccgtgcttgatcgctggaatgttgccatcaaagagaagaatggagcagaagatcaatgtaccaagcaagttaaatttatgactaattatataggtacgatgcatctctcaacttccatcatcttactcgatattatgatatatatctcacttcaaccagaagttgctgaatatgttattttatcatgtttggcctgtaggtgttggatgtgatgccaaggttgcatatgacttccacactacgagagaggaaaaaccagataaattttgcagccaggtagggattgatttctacatatatttttctgcaaaatgatgtttctccatttggaacaagcaaaatccctgtagaaattgaaccttttatggaaacccctgaaatattgacctcccttagcatttgatcttatgctacctcctcttctatcacttttactagtcaaaataataataataattcaattttctactgagcagtttgtcaacaagctgatatatgctagagaaggcgctaaggatatcatggataggtcatgttctgatttaccatggcatgttagtcttgaagttgatggaaagaacgtcgaaattccagaggtaacatgctacgcatcttttatgtacctccacagtccacactctgatttatcatcggatgagcttcttatatatatgctatttctcatcaggacgcagaaggtgtgattgttctgaacattcctagctacatgggcggtgttgatctttggcaaaacgacaatgaacatgatgatgattttggtttgcaatccatgcatgacaaaatgcttgaggttgtctgtatatctgggacgtggcatctaggaaaactgcaggtaagcttgatgtgtatgcttgcatgttgttagactattctccatctttccattttctaggagtcttctgttcctgctgcacttggtagttttagcttttacccttttagtaatgataatgtgaaggcagcaactcagtcttctttctttgtttgataggtgggactctctagagcacacaggctagcccaagggaaagttataaggttgcatctccacagttcattccctgttcaggttgatg

SEQ ID NO: 72848 - DNA, 6104 bp, Oryza sativa
tacgaagagttttgtagcgcgtagaaacactgttactgcatgtagggttcaatgagcattgtaagctgtatctagggtgtatcggtggcctatacaaaaggtatgaatgtaagtttaatccctcgttttttgacagaagaaaattgtggattttgttcctgatgagtgactaaagattcttttggtgcctgtcgtgacagaaatcagttgtgatgatcctgctgattttatttcttcattgatgtttgtttctaaatcttgtattcgtctcaaaagatttacgttattctcaacctggctctggtgatggaaattgttgatttacctgaagccatgattctcttttacctcctttgccattttccctaccaagacaatgctccaagtttttttagcgatccccgttgccgtagtttaccatctgcttgaaggtaaattaccctttgccgtcagtttcaggacgcggcagattaaaaactctagcttagtccaacgtagacaagtgcacgagggcagtatactggcaccaaattactttcaatgctataaatataaaatcggtgttttttttattgctacagaaccaattttgccaattgcaaaactgaaacagagacgaatcaggttcatttgcttgaacctgccacgtcggagcagacgaattgaaggaagttgctcgaggctggcagaagcgaaaccactcaaactagaggattacatatctccttaaaataaaggctactttatagtatatcacagttaatcaacctccgttcccaaaaattagttattccaaaatgattatcatattagtattttcgttatttgtgtatgaaaataaatggacatatatgtacacatatgtgcgcacaacctttttacaagtcttggtctgtttggtgctaggaagtaatggggatgggaatgtgcatgcatcgaattagttaacggagtaaatatattacgggatagctattagcttttttttatcttagtacactcttataatgcgatgataaattggaaacaaagggaataataactttatagagtaggaaaacatgctttgaaaaatttcttagtagtgagtatcctactccctccgtcccaaaacatatctaattgacttttcatggagagtaattctaatgtttgatctttctactaattgtgattgcaatgtatgatattgctaatatttatatacatatatacggtttatttggtagatctgtaactacacctctcctaaagatggagctcaaccaaagtgtttaaccttcacctagaaagggcgtggagcagattaaagtgcttttacaaaatgaaatagtgaggtgaatctccacaactctacttcaaacctagcttttggagttaaatttaaaagtttgaactctattacataataacatagatatagtacgctagtaacagagcttatacacggagtagaaacatgtggcacctaatttgggtatattgatttttgctgtagctagtaggtgctccctctgtttcattttataagtcgctttgaccttttttcctaatcgaacttctttacgtttgatcaaatttgtagaaaatactaccaacacccgcaataccaaactagtttcattaaatataatattgaacatattttgatgatatgtttgtgttgtgttgaagatgttcctgcacttttccagaaacttgagcaaaagttaaaaaaaagagcaacttttaatatgaaatgaatgtagtacaacacttcaggatgtccttttgttttacacgtcagtttcacatgttgtccaaaaggtttacaaatgaagctatatccaaaccaatatattaccttcgtttttctaatatttggcgtttgatcgttcataaattaagtacaaatatgctaaaatataagcatacttaaaatttcttaaatgctaaaccatgtcacaataaaatacataataattatttagtaagataaataatcaaacatcatactaaaagttaatggagtggtctattgaaaaataggattgttatatacttcctccgtttcacaatataagtcattttagtatttcccacattcatattgatattaatgaatttagatagatatatatgtctagattcattaacatcaacataaatgtgggaaatactagaataacttacattgtgaaacggagggagtattatatatcactctataaacgtacgtacagctccaacgaactactccctccgtcccacaatatctcgattcctggagggagggctttgtcccaaaaaaatcgattcctgcacagaaaaccgcgtgacctctctatccgtatcatgtgtggggataggtgggtggtgagtggcgacttctccagaatactcctctctcctcccagaaccttatctcctcccagccgcatactactcgtacgcttctctctccccctctcgtgtttttctccctcccgttcctccccatcgcccttcacccctctggatcgaaggcatcgacgcggcggcgtctagatgaccgaccctagcaagcttccaactccctccctacctccctcccgctcctccccgcacgtccctccttgctctacgctgctccgccaggctcccacatctccctgccaagttccccgtccaactagttgcttccactcagatgcggcgggggaggtttacgagcagttagatcggatgccggagatggctgcggtggaagtgtttggctcgatagcgccgttcatggaagcggcggaaaattttagggttttgattcaagagacacgagccaaggcggaggaggcgtgtcggcttgcggttgtgatccaaaaggcggtggcggcggcggcgctgggtggaggcagttgggatgcggcggcggcggaggaggtttgcaagaaggcggcggcggcggtgggtggaggcagttgggatgcggcggcggcggcggaggtttgcaagaagggggcggcggtgggtggaggctgttgggatgtagcggcggcgtcggaggtttgcaaggcggctgatgtaatgctcaaggaggtggcggcgcccgcgaatctgataaaggaggggacagtggaggacgaggctgaccagcctcttattctaattccggcatcaacaactagggtttttggcggcggtatgcgtcgattgactcaaaggtacatctcccactcgatctccctggctccaatgcctctcagcctattccatcctaaaatatactaagcagatctcatattcctctgtgcgtaagatagttacgcagtgtcctgcatctccaagtcattagcacaaaactaaactaacaaaagaaatctactccgtagctagcaacacaagacttacccaattaatcagctaattaaaagcccaaagtgatttctaggtgattgaaatgtgatccttcaaattacagagcctacaaaatcgtgaagcacttaactaaactcatggatgaatgattaccattcggcggtgtgtgttaatagactggttgctgctttatggcacaaaagaaaaggatatacagtgtgttttttatgttttgagacagacagtgttttttttcgttaagtactcgattgggtccaatggcatattttcttcttgggcgaaagctgcatgcatattctttttgtcttcaacctgcatgcatattcttcctctcaaccacagtagccagctcattctaattgacagcaagtgacagcaatagatgaggacttatgtcacgtatcgatattgtttgtttgtgctttgcctaaataagttgaatatagatagatgcagcatatctgattgattcctaacccacttaccaagttgtcaacctgattgatttctttaaacagtaatgattaatcaaggttttcttatttgagaacaatgattattttgtttcaacaattacatcgatataaatataaatatatggcagaaatgtgatatttttgaaaagaaatttcaatttcatcttctcgcatatcttcagtaattatattgttaaaaaaagtggttattttgttgtgacttgtttacaaatgctattgttttatccttttcaggacaatgttggttgacgatagcgaccacacggcactgtttgagaagaaggcaagcgtcaagcaaatcggcatcgaggagatgaggggaaaagctaaggatgtgagcagcgaggagggaaacagcgaggaggtgaagtcaagcgactatgatgaagacatggtcattaggggatatgcgcaaaatccatatgatgatagtggcctagaagacctcctgcaagaccaagatgcattggaaaaatcggtaaagaaatttctggagtgttttaagaatgcaaaatttagatgaatgcttcaattatgtgatgtttgtgtgctggtttggtggttatgaatagtggcctaacaaagcaactcaataagtacccttttggtattgtatgaaattatgtgtaaatatggtattagataagattaggtggttatgaatagaagccttgacagtctgtcaaagtaggcacacttttggtattgtatgaaagcatgtgtaattacggtagtagatgatattaggtggttatgatggtaatgtatcgaaatatttcaaattatgatggtttatggtggtgactgaaattaaggagacgtttgcaccatgatttactctaatgctgatattacaatgtcttatgtacaatctgaaattaagccaaaagctgaaaccatcataaaacttcctatattacatagtccaaaagttcaaaccatcataaaactttatattacatattccaaaagctgaaaccaccataaaacttcctatattacatgatttgttgcatttacttgcgtaatactgatcttactttaccatatatacaacctgacatttaaccaaaagctgaaaccatgatagagcttctcatgttgcatgatttactgcacttggttggataatgctgttctgaccttgtcatatagctgacgaccacaactaagggtattagggagaatgtctagacgctctagcctctctttacccatatgaggaatcctgtatccatttccaccatcaacttccataacctctaacaagcaagattgtagagttaggaaaaccctattcagcttgttgtcatcataagcctgaaattcctgctcagcattatctattagctcatccatattcctagatatccttctatatgttaatgattgcagagatgcaaagaacccaagatctagtgcattcatatatggggaattaggaggctgatacataaggcgaatgtcaaaccctgtttgagatactgcataggcaaattgaggatcatccaccggcacatgagaaggagcattatcttgctgaatccatataggttgtgtcgctcttctcgaggccaacttgatatatagctggtaggactttagcaattagaaatgatctgacaatatctcgatcaaccttgattgtcttggtgacaagagtccctcttggcctgttttggcttgccctttgtgctggttcctaaatagtaaattatgtaagttagattaacaattaagttttgcatcacaagcctatcttgccgtcagtaattaaaaatgcatatatgaagatgttatgatacctttttggtgaaaggccacaagcctatcttgccgtcaaaagtgcaaataccttcttcattgtatctaggcctagccactgctgccaagaacatcactttatcaatagaattcttgttttgcacaggcctgtatatcctcccaatggaccatgtaaaaatttcttgttttcttagtggtattgaaccatttttcatcgatgtgcacaatattgcgcatatcaacaaacttgggttcatttggcaaagtatgccaatctaacatggaaagacaccatcgcagccttgatcgtttgttctcttcttcaacaatggctttaatgtgttcgagtgacgtcttagtatccgttctttcaacatcctatgcagcgtgctctttggtacacctgcggctgatgtaaatgaccgtaaagtgccccttagttgcaagggaacattagcaatatctgat

SEQ ID NO: 72849 - DNA, 5553 bp, Oryza sativa
catgagaaggcgcaaaaattctagttagagttatgtgagcacacttaagttcatgttggcaacaacagaccagtactgcagaggtatacactacaatagagagactatgcaaagccaaaaagtgaagtggtaaatccatgtttctaaaaaaatgtaactgaagtttagatgattggtatgttaaatggtgacatgatgctattactttacatattctagacacattttttctattaaaaaaatgtgtctaaaaattgtaaggtcatcatgtaggcagttaacataccaattatctaaacacctatcaaacacagggcatcttgatggcttcaatgtttcagacttctcaacctatctgaccgcactaagtcagtctcatcaaagccaagctgtctggcgcctaacgtctatattacgcaagtatgcatcgtacttatattgaacatatggataaaaatattgcatggtcatgtcggtcaactcagactatttgacatttcacacatatttatgatgctactcggttgagaaaagaggccattaccacataaaagtaccttgtttgcaaatatacggcaagcaattggacgtgggcaatcctgtccatccaaagcttaataagctcaccagcccttgctctgcaacaaatgtttaggggtagatttcaaattaaataaatattcaaatcaaatactcactttaaaacccttcaaaaacaactatatgaccaaaaggcaattagttcttatcacgcgtcaaatgatggaaaaaggagaatagatgtagatcttttttatttaaatgtgcttatgtgcattgagctatacggatctaggcagataaaaatatgttttatatatatactcactttacactgtcagtagtcggcataagtttaccaatagattttgcaatttgtcggtcatatctgctgaactcctgcacaataaaaacaataatagtcaaatacaagcttaccacaattctcatccatatggcaaaagaactgaaaccagcagggtgaccatcattcatcatcaatgttaaaacaacaaatttgcagcaaattgtacaaatgcagttggaagaccttgctggaatgaatgttcgctggcacttgatcaagtaatgcacgcctccgcaattctgcttccagtgcagaatgatcagcaaagactttgatccctgttatgaatgagcaatcaacattaatatcacagtccttataaaatcaagctacgatagtcagccagtgaccagtgtagttaggaaattaacaccaaggctagaaattattcttgatacaaaaatggaatgtctgatgcagcgcatgaatgtgaaagcagaaccacagttttccctcgtgttatttatgtctgtatgcttttaagcgttgaaactgtgtatcccttcaagttttgcatggttcctggatcccactacaatggattttaattatatttcaaatattgctgttaggagtaggttgtctcagtaccacaacctttgtgctaattaaggaaacatggtaaagttctaggggctgaacatgggttttgcatagttgaagatcagttaggggtgattatccttctgacatgttataatacttttacatgatatatatggcccttcatgagcctaagcccacagtctaaataagtaaatatacaagaaaaatgagaaggttaatccttaaatttacgttttagattaatatccaccatttgatgttcataagcattaagctgtgataatggctgcctgacttagtatgaaaactagtttttaagaaatatgtatatagacacaacctgattctactaagcatatcaatcagcagatcttcagaatagctccataaaacattgcgatataaacttataatggttctgtaaaagcaagaaatacctggtaattcagatttaatttcactcttgtttgccctcattgttcctgcaacgttgttctgagaattttggctggatttggaaacctcagctgctgctttctgagcttctgctgcttcctttgcagcagcctcagctgctgctttctgtgcttccactgctaactttgcagctgccttctgtctggcctgcatcatagttcatgaaatttctggtaaactggttatgcatttaagcgactaccagtgaagtaaagaaaattaggtttctgaactacgtaggttgtaaagaagttcagtgaagaagtaacatgaataacaaggtattagatataactgaactagatggaactcaatggactaagtattatgataaataccagagccaaaagaaataacaatgaattaagtctcacatattgacatatatcaaaagaaatatatcagtttatgttaacaaaaacacaccaagtgaccagcacatctaggcaaacaaacctctgcttcttgtttggctctttcctgccttattttttcgtccttcatggcttgctcctttcttttagcttcttcaagagcagcatcatctcttattctacgttccacaatttgcgatttctgttcatgatccctttggaccatagacaaatgtttatcaagtacttctgcactgcaaaaaggcaacaattataacaaggtacagaatccaacaaaagatcatcagaaaatccaagtataacttataacgaaagatcatcagagtatatgtcctttatcctgtgagaactactacaaaggaaaacaaatacaaacgctaacatgcaaagtttctgaaaaaatatttacagtgctaatgattgaactggaacataaagttactacacaaagaagtacaaaaactatataattgtgtcacagatagttaattccttatataacacaaatagagcatttaaaaaatagtcaacccttagtctcagtcgctaatcatttgaccaaacaccacaggtataagtatggaatatttgtacgttaaacccacacgatttaatcagttgtgaatagaatatataaattgctgcaaaatgtaaagagctgaaaccttgggcttggaatttctcattgatcatttaagtagcaaatttaaccaaataacgatgaggataatagcaaatggtggaggaaacattaaggatcttagtattagtccacaatcacccaataaacctttatattggaatttgggcatataggagatgattgttttctcttcaaaactatgtgcactagaaataatccatgataaactgtgtagctactagcaaggtccgtcagccttcatgaatatataccttttccactcaggagtaataaactatattggaatgaaaaacttagcactttgtaagccctctttacaataaaataaattgagttatgacaaataaaaatggcataactttacaaagcaaccaccaataaaaattcagtcttgacaaactagtacaagaatatcttgatatgtgccacagaaaatcctccagtaacaaaagagaacaaactagtacagaagttaaccctagtcccagaaaattgcatcaccaaagaccttgtaaaacatacagtttcctcaaaatttgaaaaatcaacagtaatcatgaaatgtagatttaaaaagacacaggagaaacaattcaacaacaaaaacatacatttttctctggaagtggacatctagccttctgtctatctcttttcttgattctgcgtatttctgtagtcgagcaaatgcagaaactgttcgctggatttcactttggtggcatacctccaatgcagatagtttacttctgacttcctcctgaagaaaaaaaatcatatgaagaaaatgaacaaaaaggattcagcagatttaataaatccatcatggtaaaaaataaaggcatgcaacatcagccaaaaagataattagtactatgatacccaatacttagaaatttagtcatatgacatccctgttggctttctatgttaaacttcttggatcacaatatccaatttgaagtaaatgcagtattgtatttgaaaaatcttcttcaagtagcaactaacagaagtgatgtattgtttttcttgaaatttcatcatgtcattatccaaccatatcagtgtggcactacactaaccttaaagggaacaaacaaaagcttcattcaggaattcatatacagtataaccttagaaagatgaaagataatggaagcatccacatgcctggatagcttaaaatacctacataaaggtgaggaaaaagatataaagttgatccgtaaagtgtaacctaatgccatggtaaccctaaactagaatgaggattaatggtaatgaaaataattcaatggtctattgccaacacatcaaagaaaaatcagcccataagtactgcattcagtaagaaagatataacagtatagattgatgaatacacacttgaactttcagatgatgctcacgttccagctcaagcagaatgctcttctctaggctccgtttctccatcaggtgatatggtgcaatcctgccatccatttcatcctctgattcttcagcatcactaggaagaaaacaaaagaaggggatatctcacacaatacgccattcatttaaacttaattgcagataatgtaccgtacttcaaagcaaataaattgcaattgcagtggccaaatttcagcatcaaatcttcacctggattcaagatcattgcatgagaaccttgctccagtggccttggccacaagagcccgggactccccatcactgtcgtaatcgtcctcatccgtgtcatcttcctcttcaacccgcatcacaaaggccttctccctcacgctgccactgctagccctaaatgaaccaaaaaaaaatcatatagaagcaatgtagagggaaacgattgcagcttatcggcgaaaccataagcaaggagcgcaagggattggagaatagagataccactccggcggctgcttgaggggcgtgggctgcccggtgcggcaagtggcctcgagcgcgtcgagctcggtgaggacgtcgccgagggtccagctcgggcgggggtcgagggccctagggcaccgcagctccacgcgcgcgaagcccctgcgaggaggaggaggaagacgtagagatcagcctgcctgccattaacgaacaccaagcggtgacgagcggaaacggcgatggggggctcacatggcggccgtcgaccggcgaggtccgccccggagcggattggagccgcgccggcgcagcaaaaccccctaagttgcgggaggcggcggcggcggtggcggagaggcggtggacgctagttgggtctcccggctccagtcccacctccagccgctaatggagccgtgcagacaagacgcggtctcccttgctgccgcgcccggttggcttcctcgccgtcgccgctgcgccctgccctcccgtgccgcggtgccgctccgcctcagactggccgccgccgccggagcgcgaggccgggatgcgccgccgccggacgtagaggagagatgggccttgggccgaacactggttccggaggtttcgcttgcttattttggaagtacggttttctg

SEQ ID NO: 72850 - DNA, 2464 bp, Oryza sativa
cctgcagcccaataataataatctaaattaaaatgtgatacaatcttaatattatagatctgaacagaatgtctagatttatactattacgatgtcacactccgttttaagtttgtttattttggaacggaggggagaaattcgaatgaaatgtatacgttgtttcgtctgaatatatcagagaaatgagttcttagcaagcattttttttaagcacagtcccagtgcaaattctgaacatgaactctgaatctctgataatgccgctgttgtcttgagccagaataattaagctaagaagataagacaaatacggtatttaaggcttaatgtcactgaaatctactcccttcgtccatcggtccatattgtacatgaatctgtctcgctgtcatgagttcttaataaatgctaaaaaaacgcatgttgtttgtctgaaactctgaatatatcagaggaatgagttcttaacaatcatgctattttcagtgcattcgttgtgaaaaatctaaacatctctgatgttttcttgagctagaaagatacagttttggttctggctcttgacctgtactgcgagcttgaaaagtcggaggccatatccagatatatatgccatttgtcgcacagatttgaagagtattttgttccgttgcttctacctcagccgttaatcttatgtagaaagataaagccagagagaaacacaagctacaaagataagttgtgtgcgtacagcttaccaaagcaacaatacaaggagcaacaagaggaaagcacaagagaaatctgtggactctgaactttctgaacttttctgaagagatagtggactctgaacttccttgaaactgcttgatggcctgtaggcttatagttagcctgtggatcggtggatgttcagaaatacagaataatcagagaggtaactagcactagtataattcaactagggcatctcttaggcagtgcttatgtccaggaaattatatatcatggaacattaagagattattgctgcagagttttttttgtgccaaattggaaaaggagtagaatatgtaaacatatgcctgccagcgccaaagatgacttggaagcaagtcaatgaggcttactcatgcatagcttcaacaagttcaacaagagagatactccaaattcttgcattttggcacaatggccgttggctgctgggtatcagaaagcaatcccagtgtcatgtccaaactccaaattctccatcataaacctccaaatttccaaatctagtcaaaattctccggttgtactgccaaaccgacaacagtacaagcctgcattttctgtcatgctgatgtcgtaagactagtcatactgtacctgaagtctgcttctctgtcatcattctgcatcgtacgatccagtgacatgtatacgttgtttgtctgaatagtcatagagaaatcttgagataacggttatgcaactgtttattaattttggatgaagattcacaaacagaattcaataattgtatactccttatctttggttggtagtttttagtttgctttttcttcacggttggtgtcctcttttttatgtgtgaacctttttatttttgagtgttacgctgtaataattggctgtagctcgttgagcaaagccagaatattctattccattatctaaaaaaaagtcatcagagaaatgagttattatagcaagcttttcttttcttttagtatagtccctgtggaaattctgaacaagaactctgaatctctgacaatggtgatcttgaaccagaataattaaggtcagaagataagacaaatatggtattcaaggctttatctgtacattttggacatggctcttgactggctctacgagcttgaaaagtcggagccatatccagatatgccatttgtcgcagagctggagagtactttgttccgttgcttcgaattcacccgttaatcttctgtagatagatgaagccagagagagacagaagctacacaagttctgtaaagctaattaaaagccattgtgaggtatgagtgctgagtacccaatactcatacactgggaggaacaaccggacaagagctctttagtggtgatccagaaaaagtatatcaggatccaataatactaataataatataattatcatgtataagtttgtaattaatatattataggatagatagaaattgatatcttacccagtgtccggtacaataggataagttccggtacaataggataagtacatgaaggtatgcccctctctcagcacggttttattatcttgatgtaattaactgagtttaattaaagtttatatcatcttttaaaaacctagactatggctaaagaggaatctttggactctgaaatttctttgaactgcatgatggcctgtaggctgtaggatgtagtgagcctgtgaatattcagaaattcagaacaa

SEQ ID NO: 72851 - DNA, 4215 bp, Oryza sativa
ttttatcgtcatggatgaacatgcttgcaaaattatggctgatacaacatgcatatactttttatacatgaccatgcattatataatttgatgtgtactgaacaatcgtagtaggcaaaactggaaatgtgatctccatattaagtgctcatgttgataataaagttcttgcacaacttgttaggctcaccatgtggtttactttataatatgatttaaccatacatatcatttagaaggcagagaaacattggcacaatttactgtatgtgctttctttgagattgctatggctgtgagccaattaacatggaaaatctatgtaaatacaacatattagcatatttataatccttaatctcatcattcgttgtgatttactatgtgctgaaatatccaatttataatccttaactattgatgcaactaatgcagccaatggcattgctgaattattctaggtagttggcatgatgtaataatagtacctgcttgcatttgtaggtgttcctcgaaggcatcggagttgatatcaaaaggaaaggcattatggatgtgacctccataaagttgcagaacttgatccattgcatcgccattgtctacaataacaattaccacggtcagtagttagtaccatgtcaaatagcaatattttttgcaagcacaatcctttttacccatgattcaatactgaagtggtatgtgttcaatttgcaaagtatcatctattccagatagacctatgaaatgtccacttagtgatcatctctgtttctctatatataactgaatgatttagttcatccattctatgcgtgcaaatagatatagtaagtaatacaaaggctgccatgttgtagaaaacatgattatgtagactgtaacagagtgccctgttcgctgctggtgatacttgatgtttgacatgccatggcatatttgccttactagatgtgtgtgactaaaagaataatgtttatactttttttccaatatatccaaaatacttttattactaactaatctattaagttacataactaatggaaccaatgattaacatatgttcctttatgctgtacaacatcaacacaggagattatgagatcaaataaccacaatcaaggtaccaactgtatacccatatgaaatttagtttttttgtgtagcaattttattattctaccctcaaccatgtttttcagtagagggagtctagtgcacagattttaaacaccggtcttgctttctgatttgtcctgtttagtatgtagcatatcaggattgattctagacattagataagcattataacaggagataagtattgcattagttcagctagctaaatgtataacctgtgatattatggaaggggaattaacttcattagggccaactcattgatagaatcaagtcctaacaatttcctcatacttatcaaagattgattttgttccaaaaacatagcgattgcatcaaggcacatgttactgatcatcttttcagagaactagcaaagattctgagttatttatgctagtcagtgctacaaatgttactcatttcatattaatgcttgcaaagttacctggattcatttctccttgatggccaggtgcatcaatattgagatcaaaaggaagcacttgagggccaggtgcatcaatattgagatcaaaaggaagcacatggttgtcacctccctggacatcacctccaagttgatcctcctcctgaccaagatagatttcaacttcagcaatttcatcattgaggtcaggcaaagcctattcatctgcctcatctattggcttgtttagatcaagagccatggaggtgattttgaagactcatgcagtgattcagtgggagggaaacctgctattgaggttcatttcaaacttatatagggttgttgtagtggtgtgtgctgaaatttgtaatgcttgccgccaatgaagcaatgctgagtttcaaaatatttggcgcactggttgctgtgtattatttgtatattgagcacttaatggcagcatcagaaatatgcttatccaacttggtggctgagtagtactactattttatttgtctccaatgattgcatgtactttcactgagggtattttagtcttttgccacctgtcctaaaattcccttgggattctagggtttgagatattatgggacggagggagtatatcaaactatagcactagcacatgtccatcgacgccggcacagcgtcctccggcgatctcgacctcgacaccaccatagacgacgcctccttcccaacaccaaatcgctcgaccacgagcccggagacgacgaccacgtccaccaccaaacagagcagcagccacgccgacgacccggccttccagctggtgaccacgccgcccggcgaggctcccggcggcgcggccgcggcgcacagcgcgtagaacacgagggagccggtgaagagcaccaggaggacggcggcggcgacgctccggagcagcgtcgcggcagcagtactagtactaatactaccacggtggtggcgccgcctgcaggtggtccgctcctcggtggccggagtcgtgccgccgccgctcgccatgccgatcgatctgtagctaggatcgacgacgacgagagggtgatggccttcaactgctcgagcttttgcttacaccgcaacggaaaggatgcgagggaaggcgattgttttgaagttgattgatgtaagtccgattcggaatttggatccgaaacccaaaatttccaacttccaaaggcccacgaaaatctcacccggcccagcccaatcgcaggaggtttcgaaggtttctcgcttgcttatgatgaagtgctctctttgcttggtttgcaaggtgaaattattcaattggttaatcagtgaaaaaaagagcataaggtagattgatgagaaagctgagcatcattaaagagagtgacaagggcgatcaccagttcgacgaaaaagcaatgggcaaatgctgagagatcatactactacatccctccagtttggttaggatagaagattaagcgtgcacaaagaacgagaaaaccattagcgtacggttaacagagttttaattatttaatttttttaaaaaatagatttatttggtattttcaagcaatttatatataagaaccttttaatggtttgaaaacatctaacgaaaatctaggtaaaatctacatctattaaaaaacatatcaattatggttgtggctatcttttttttccttaaaaaatatggtaggacaatcaatgcacctttggatgcataattaatagtcatctgcattaaatgttttctactgaatttatcatttaatcatgtaaaatagtttatttactaaaatatatcttcagaatttagtgtcattcatctataggcttatgtttttaaacattagtttttttttttgaaagaaagttttataacattagttaattcctctacaccctataattctataccttctacataatcatcttctacagtatggttattgttatgaagatgtgtataagtgaagccacgtcatttgtatgaatatattgtgacacaagttgccagctgatccatccatcctttaatgaaattgatggcaaagagtgaaatttctctgctgccaagcgccgcgttgtcgcatgccacacacctttgctgacacgcatgtagtgcagatatgcctctccttcttcggcctatattttttccccttaaacacagataaactctaatatatgaatgctctcatgtgcctttaggatgcgtgaattgaaagatacgtgcaatgccatacatctcgagtcgactggagggggcccctaataagcgactggtcacgcgggggcgtagccacgcgaccagcccgctcctcctagactcctactactactactagtctactggtactactactagtctactactacaactgctggtgcaactactacactacaacaacagtactactacgcgtatatatacgtttgtatatactttgtatacatacgtaaaaacctttgtataatacatatgtattatcagtataaagtttctacgtatgtatacaaagtatacacatatgtatatataatttttatgtgtaccaaaaaattgacgtataaaaaatatacatgtatacaaactttgcatacgcatatacaaagttagcatg

SEQ ID NO: 72852 - DNA, 1201 bp, Oryza sativa
aagagcaagtctaatagtacagtcctctactagctccaattcatctatagtcaatctaatagccaattatacaatagttcttattacattattaatatatggtcacgcctatcatacacacagtgtgtcttagaatccgtgctgcagctggctacagatctgtagcccctgcttttctctctcatcgtttatctcattaaaatatgtttatagctggctaatagtctgctattataccttctctaatggagacaatctgaattctacccacatgggcatgtaccccgggccacatggagtattatgtgggtattggcaagtgcccaagcacactgcattttgattcggcaagtgacgacttgagtgtttattcctcccaacatcttaaaaaaaatctaaaattaaatgtgatataacgaatatggatagaaacctgtctaaattcgttacgaatccgaacagactcctgtccagatttattatattaggatataccacttttaattataggtttatttttgggacggaagaagtatgatttagatgcaaaaaggtattgagccgttgctggggtcaccgtgatttcgtcgtcattgaatgatgggtacttagacgtagccatgtggataatttaagagcgcattttgcaataggattcaacttatctgtctatttccgtacgtggatgtgacctaagatatggtttacttagtttgatgtcgtaacaatgaaattcggtggtatcaaagccgggacaagtttttgcgattatgaaattcgttttagtcttggtacagttagaaaatgattgttgttttttttttcttaccagccctagcgcactccgataggaattactacatccgtttcacaatgtaaatcattctattattttccacattcatattaatgttaataaatctagatatatatatctatctagatttattaacatcaatatgaatgtgggaaatgctaaaataatttacagtgtgaaacgaaggaagtaccaaaataaaaataaaaaatcatactagtacattcgaaggaaacccggaagaactattaaaaaacaagcttgcgttgctgttcttgacttggaccaggcaagtcgtagccttttgacgtttggtaacgccgctgtctaagacgacttataaaaaaatttaacatctgtcgatgcatcgccattgggacgtgc

SEQ ID NO: 72853 - DNA, 1364 bp, Oryza sativa
tagggcgaattcgagctcggtaccccatggtgtgtggatagattgcaaaaagttaatgattaatttcttgggagacagagaaagatgaagagattataattggtagaaatgggctagctaaatagagatagctagctaacaaataatacacacagtggtcaagagtcacatagatatacatcaattttcatcaacaacgtcatgcggaaaagagagataacaactctcgttagcgagtcatctcgttaaacgcctccccctgcagtttcggtgcctgtcgctctcactgcgagtttaattattctcttctgctgcttaattgctgctgctgctgctgctgctgaaagaaggttaattaagctcgtctcgtgccgtctcattctgcccatcactcacacgcatcgtcgtcttcgtctatgggaccagtaaaaacctcgcatcaatcactttcgttaaaagatcaggaaacctcaattttgactgatcttctctgatgactcacctctctgaatttttgcttatcgagagtcgttctctcaaagatatatctatcctttttgagtggtggcacctcaccaaaacaaaagtgcatatatatatatgtctgaagaatatagtataattgactgcagtttaattaacaagaaaaattactgcgagtagtaattaatttctgcaagcaagcatatatagtatcttgggagcatgccgaaagggatgtttctagctagctagcagctagcttttagaggcacatttcgtacacaaattaactaacaatcttgcagatgaagtctttgcatgtttggtgcatgcatgcatgtcatctcacagttgcttgcatcttttggaactttagaatgtttcaacacataacctagctttatatctttctttctttctatctctcatcagtagtcatgttaggctaagaattcagctactggagatagcctttttgtttttgacattcatgaaagttaattcaatttatcaagtgctatctctctcacaaatataagcttttctatctctctcttgatccctaccgcttcgtttgttcccttattgattcggttgcaacaactgcttaaccaccccctaacccaacaccacaccatatctcattatctgtcgtctttagttttctctctctagatatatatatatctatcgcttgacatttttcaaatgatgcatgatattgtacctgcccagtccaatggtcctccaggttgacacaaactcccatatcttgtaccaacactgttccattctttagtaagatatatgcatgttgtactagctagtaactaactcactcactcactaacaatatctaatgatggatatatactactaaa

SEQ ID NO: 72854 - DNA, 1977 bp, Oryza sativa
ctactctgtactgcgccgtcgctcgtagactactccatcccgctcgccggcgtgcaccggcgatcgggagagcaggtctccggaacctctgccttcgacgtcctgcaccgggagaaggcggcaataaggtttttgggaagcgcttcgcgcgactgctccctgtttgttcgcgacggctcgccttcctcttcgctcgcgtgtttcgtgccttcgtagacacctgcgaaaagtttcgaccaagcagccggtctttccgtcacctcggtacgtgttcaatatgttgcgcatatttgatttgttcatgttatactgtgtagtttacatgtatagatctaatgatgcgttcatgctagttttcttctgtaatgtcatgatttatttatggaatagattaaatcattatatgtctataatctcaacaccctctcctcatcgtcctccttctccggcaccggcggcccgccgcgcatcgacgatatcgtcgccgccgccacgatgacgacgccacgcgatcataagcttaaggtggtgaccaagcctggcggcggcgcgcagcgcgttgcggccatggagacgctgccgcgggagacgttctcgccgcgcttccgttgcggcggcggcgccgccgccgccgtggcgtcggccattgttggtagaagctaccttggtggtaaatgagctgttggccattgcatgaatgctagctagactaattgttaattcatggcgaattggcgatagatgtttgtgcagtactaagcaggtaatcttggctttgtgatatgcatggtttgtgtctgaaccttcagggtaattgcatttttcctttgtaacatgagacaatctgagttctgaaggattccaattagaagatttatgacctgttcgatgctttcgttgctgatttgctttgcatacctccaaaacctgattatttaatcaatgtcgctttacgccatatgtttgaaacacatgcatgattattttcttcaaaatgatgggatagttcatactttaattgctccaaatggacccttaaatagttatattagtaaaattactttaacaccagcggaccagaattattttaacagagtttatgctgctatgcttagagcaagtactataaaagctcatgtgctgtccctaaaagaaccatataggattagatgataaggtggaagagataagtgagcaacgagaatatgagcacctcttatgcaagaggtaaccactgcacaatcttaaaaaaaaggtgaaaagagaaagtgaaatagtgagagagtgagtcaattaaagaagattttagagtttgtgtgctagaggtaacatattgtacatgttgcctttatagatgacatatacaatatgttacctctaaagagcatcgggtcactacgccgtagaacacaagatcatcgaaagaagttcagatcaagccacaggagagagagagaggaagaagctagatctagactagtacatattgtgattttttttatctttcaaccctttttttttgtttctttgtattagatcaaaatgctttagtagagattcatgtggtgtctcgtacttttgacttcgattcctagggatatgttgatgtttcaacagttgaaactcaatgtatggatgagtgtgatgtttcagtcattattcaaccatgtttcaccaccttaatcgtttgtaatatttttggtctagtggtgaaacctagtagcgataacacagtggggaaaaatcgggcatcaaatttgtagtcttgcgtgaatatgtgctagattggccggctacatcgtgagagtttctagtgtgaactactaatatactcattttccttcgaacttctcatatccgtaattcggcattccgattcgaattccgaattgcactagactgctactgcctcagtagacaaagcagctgcaaaattaattagttgcaaaatttctaatttatatggctactagcacg

SEQ ID NO: 72855 - DNA, 22900 bp, Oryza sativa
gggggggggaactgggccgagccggcccaagagggggagggggggaaaaaggactttttagggtttttctttttataaaaccattttaactttgtttatttcttcttaattattatttgtgctctaaaaattacactaaaatttatttacgcattttaggcttttaggaaatatacaaaaatcctccaagccttatttgacttttaaatttgcaccttttaattgttggaggctttcacatggattttaattattctatgcacaatttcgaggatgtattttagagtcgttttgggacgcgacaggactcatggaaataaagtttgctctcaaaacatcaagcaaagaaaatatagccaagccccctccacaatcatgccaagagaaccaatttggagagaaagtgtaggaaaaaggaggatcatttctttattccataattccacaaaatatttgacttttccattttccaccgtaaataaagacccttgatctaggagtatgactaatgatcttcttgagtccatatttttggctttgcaatatatatgatgtaggcatgtcaccagtttatccctaccaagcttcacatatcagccttagaataggggtaaattcttgcacactttgcgttggtgaggatccaaatgaaaatatacatctttgagagataagagagaaagtcaaatatgaggaaaagagatagtttgcgaaaattcataaaaatcccatgagtttgacagagaagcaagaaggactgaaatcaagatcgttccatcccaaaaatccttcttttatttattaggagagggcatgattacattttttttaacattatgctcatgcttgatggagcataaattctttttttttcataaccatgcctttccctcctttctttttttttctttcaaaaggatttttctttttttaggagaagaaagcacatgaaagcatggagaatttattttggtggtaatatgcatatggaatggaatattgcttagctcccagtgtaggagtttagcatgtgcatatatgtgggtgtatgatcttgatcatagagcatgagaagtatctacacaagtcataagagtttgacaaagttcaatggaaagtcaagcaaccaaaatgtatatagtttaatcatgatagcatatttttggctctggtaggaatttatatcaaatgaggaactttcaattttatcattttgaaaacaaatcatcggaatttaagtcaaactagtatcaggatcatagctactcttatttactatctcatatctcacaatagcttggacttaaatcagcaagtgcagcccatttaccttaggttcccggataattattggctacttatattcaatctttgagagagcacttaccaagaacccatatataagagatataaaacagagcaacaattcatcatttcaacaaagagaactagctagtcttacctagcatgactcaaacctatcctatctttttggtattttctattttgcaaatttttatgttttttttgagttttataagatgcaattggaaagcaagtatgcaattggaaagggaaatatgcaatgggatacaagttaccttagtggggggagagatgtctccctccaagcttgccttttgctcagggtccttgataaggattgaacccctgaaatcgaaagtacgcgtgaaggtcatcatgatgttactgcatcatgttgttgatgttggcgaactgagcattagcagattgttgccattcttgtgtttgagctatgtgttccgtgaggttgtactggatctcccctgtctgcacatcaagggtgtccattgtcctagtgatttcacccaagtcccaacgagaggaacttgagcaccattcacttggagatggaggcacaccacttgatctagagggttggttgtccccccagtggatgtcatgaggcgcatgccaccggtcctcactggcgcttgaccaggttgagactccgatgctatggcgtggagcttggatccatccaggtgcatccctagttggtgcccaacctgcctcatacatctgcacgggtgtcgaggatgatgaactttctcgttcgttccttgtcatgttgcgcgtctccctgtatgttccacctgcacgagattcttctatggtctgcaggggaatggttagttcatggcagttgtacaaatgataccccgcatttggcaacaggatttcatttgttaaaccggggaaaaagtatatcaaaaatccatctgctccatgtttcaaaatatgcccttgcactagataggcctcatcaatacgcggacgagcggctgagataaaagcaatttggtcgctaacgacccctagcacgagcctaagtgtaggattatggatatcatttgttgtcaaagccacaactgcatacgtcgaaagacgtggttactcaacagtagttggaaaagaagtaaaatgtattaaattgagaatttttcttgggatccccctattacatggccctatggggctagttatagccccattacaggttcttactactagggttttggttatatagggaatttacatggttgcccgtatgaaagggacatttacacgggtacacagtgtaattgaggttcatgggcccctaacgggccgttaggcgatcgtcgacccaattagcccctaggcttgatgggccaggatggcttcttcggtcctcccggggccgaacttgctacggcaaagtcgtctcccttcggcatatactcttcgccctacatccttcgcccaggaggcctctggcttggtgaggtacccgtgcgattccctgcctctcgccgtcgttgtttcatagtcttcgccatgggggacttcgccctgactaaccttgacgtctcgggcttgaatccccactggtcgcatggtttcagcaggtttggtcaaagggcctcatgccatatcgccaacaagcccctcacgggcaagggtgagataggagcttcggccgagaccgtgcaaaccatgtggtatggtatgtggcgccccctttcgactggtgctcctgccccccattctctttttcaccgccacacttgtcattttcaccgcgcgcgctttcttcctctgttcttcctctcacggcgccccttggcccttcagacctttcactcgctctctctgttcgcaactgcacactcccttcgccatggctccccgcaagcctaacccctcttcggcgaaagggaccgaccccggccggattgacgacgacaccaccgcctatttggggatttctctgatagacaacggcgagttggcaaagttggtcagctctagggcgttggttgagggacaggctttcgccctggggaaagccgttgtaccgaagcccgtcgacaaccggacggtggtgttcgccgtgttttttgaggcggggctccggtttccatgcaactcgttgttgccggagatcctttgccttttctaggtggagctcccacagttgagcccgtcggcgctggtccggatcactatcttcgactgggcgtgccgaacttccgggtttgagcctaacgccgaactcttcgatgccatatttttcgccaccgtgaattcgaagacggtgattaccccggccgggatgaagaagacagtgttcgggagcgtgaactttaatgttcgccccgagcactccaatctctggccggtgaatgccgccatgtcgaagtgggaccgccattggatggcgaggtggtttttccacatcatccccttcgaggctggttccgagtcagcgaaggccctccggtgccggcgcaaggcgattgcacctaactggaaacccaagatcgccgtggacggtgctatggaggcgtggttcgctctgctgcgtaaggtttgttcccgccttagctgtcatgacttggtggagactgcatgcttcgcatctttcccctctcccagtcatggcaagtcgcggttgaccaaggcgaagaggttgatggtctgtcgaagttggttctccctaaggggacgaatggtaagactgcactttcactacgcattcctgttcttggttattttgcttcgttcgacacttaatgtggctgcaccctctattttttttgcagtgttgaccctcaatcaggccgacgccgaagcccggaagatgatcggcgacgtgtcggtcgtcgagtatagccagctcctgacacgataggcggtcggccgggcgaaccgggtttataacggcgaattgcctcccgggcgaacccccacaaggccgacgacgatgcagggccttcgcgaaagtggacgcgcggacaagtgaagcttgcccctaggaagcgaagggttcctgcttcctccgattccgacgccgatgatgaggacgacgtcgaagagcgtgacggcaagtaggaaggggaggaaaaagaggaggcggaggccgtggccgaaaaggccgcggacgaggcggtcgaaaaccgcgtcgacacccctggctacactcctactccaagtccaggtcacaacgagactggggtggaatcgaatagctcccttcttcatcgaaaggatttggagggggcgaaggcgctagtagcgttttcggcaggcaaggcggcgaagggaggcccagttaaaaagatctccaaaaagaaaggactcgtcgatgtcgctcgcgttttcagcgacgacgagtcttctgacgagactccgacttcgcccgctggccacagcttgtacctttcgaccgctcccattcttccgctcgacgctagtggggcaggtggtagcgccgccgctggggcttcaacctccgctgaccggatcgtgatggctgcggcgagggttttcggaagccctctgcgtcagccggttgtttcaccgctagtaaaggcgaaggggaagggggctgccgtcgaaacatctgcctcggagtactccctcgtggtgccccacttcgcccctggtgatttcgagacccgggcggatcttattcccttcgtcgagggagtaagcaatcttgtcttacctgcctgcacccagagcctattcaccgagttgaacgagttcgatgaagggtgttccgctattaaaagcttggcggttcgggtacgccttttcgctctctttttgattttcctctccttttttacatgtcccataattaacatttattctcctcgcccgctcctgtcttggatctagattcttgcggcccactgttcgacagagcgaactgtgcgggcccatcttgatggatttaagaaccgtcttcgggccaaggatgacgaaataggccgcaagagcttgaagatggaggccattgccaaaaccctcaaagaggcgaaggccgaaaacaagtggctccaaaccgaattggagaaaggaaaagaggctagggccgaggtcgatcgcctcaaggccgaactggagaaggggagagaggccagagctgaggttgatcgccttcaggctgaactgaagaaagaaaaagcccattccactatgctgaccgactattataacctcactaagccgaagatggaggctcttcgtctggaggtcagcaaggctgaggcgagcactgtggaggagtcacagcggttttcacgggagatggcgaaagccaccgaatccgcaagaacggcgtgccaaacgctccgccttgcccttactgacatgggtgcaagggtgcgaggagtccctgccgaagacgcctcagccttcaacttcttcgagtggactcagcaggctggtggtgcggtttcgaactgcgccactacatacagcgattgttgtgtgcacgtatcagcggccttcactatgggccttatgtagcagttcggctgtgagcacgtcaccgagttccctaactatacgaagggggactgggaggtaagtgcgcagaacgtttcgccgacgctccgtgtgtggcgaaagcagttctggcagaacgacggccgatccaccgccaaggcgcgcctgctggagcaattggcgaaggcagaggcggcagaccggtgtgaagaagaggacgcggcggccgaagggggtggaggcgatgcccaggatcacctagaggtgtgaggccctccgccctttccttagatttttgtagtttttcttcttccttttgtgtttgccgagagaggcgaatgatgtaaattcggcgggctggccctaaccctccttattgtagccgaaaaaggccccttggatatttggaatgtttgactcaatcttagccactttttatggtcgatgcctttggcgtatatgattacgccactttcgcattatgtaatatttgctcttttttcgcccattcttactatccaattcgtcttttgccctttctgcattgtctaccagggtgtttgctgaaaattgtgcattcggcccccttctgggagttggcgaagcaaaaacgagaaatttgtggcgttgaaggatctgctaaatgtacgatgcccgtttcggcatgtttatcgcgagatggtgataaacggccacagctataaggtttttaaggttgctggctggctacgggcgcaccccgggcgaaccttagaagattatgatcttgttcattcaaaacgtttggaggatatggctagcttttggcaaaaccatcagaagactgatcggcaggaggcgatctcccagcgtcgttacagtctagtctgtgtttcgcccccttctcctcttagggtcgtgtatgatattagtagtgatgacgaacccagttcgtctgaccattccttagagagagagagagtgattgtgggggcgaagatgtaatttatctgtaagctgggctgtaaaaccattgctttttcttttacttgtaccatatttttctttcgaagttaacaaagatgtgttttatttccttttcgctatgcattgtcactttgcgtgctttcgttgggtcagaacgtgttggccctttgcgtatattagcgaaataggttttggcttttcagctttcggcttccgttttcgatccattttgttctacattgtaggaagcactcgtgcattccttttgatcgagtgtaacggtgttcggttagttgttccccgaaacaagctgttgcggtttcaacgttcggcgagcgatgcttcgaccgatttgtttcgcccccatggcctttttcgctgatcaggcgtttgccttggggtttttccacaaattatcaatcacacaaataaataagacgaaggtggaggacacagagattttattatggttcaggcctccatggtagataatagccctacatccagtttttcgtctttttacattttcctcttttttttctttttttccttttttcttctttgccgaaaggtttacatagtgtcgaagggcttacataacgatacatacatttttacaatttggcgatttgggtgccacccgttctagacatagaaaagcttgagagaggcagcgttccaggaatggtcgaactcttcgccttccagtgtcaccagtcgaaaggatcccatactggacttgtccttgatgaggtacggtccttcccacttcaattcaagcttgccaacagctatcgggttcgcctttggcaaaggagatgcagcgaagcaagggttggagcaccccggagcaatatagctggctcttcgcttctgcttcatcctccgggagccaaccgttcttgaggtattttacgaacggggttcaccagtcctttaggtcttcacacagctctgcctggtcgattgccatgatgtccaggatctctatgggcacacttggtgcgtacaggacctcaaaaaagatgtctggcgaatgcgggcctccacaagcagtagatttcgccagggcgtctgcttcttcattctggcctctaggtaagtgttcgaccgttatgccggcgaaacacttttccatagatcgaacagcctcaagatacctcttcatcccttcttcttctgcctcaaaggatttgtcaacatgacttgccaccaatttggagtcagttcagatgagcaagcaccgaacccccaaagctttcgccttttttaggcccaacagtatagcttcgtactctgccgtgttgttggttgtgtcgaactttagccttgcggtgtactgaatcgacacgccccctggcgaagtgagcactgccgcaacgcctgcccccttgtgtgaccatgagccgtcggagtacatcacccaaggttgttcgacaggctagggttcaagggcgaatgtcggtgtccattcggccacgaagtcagctaggacttgggacttgatggcagtgcgggcgacaaaatgcaagtcgaagggagataactccgctgcccacttgctgagccggccagtaatttccttgccccggagcacttcgcccaaaagatactgcgatggcaccgtgactttgtggccctgaaagtagtgttggagcttgcgcgaagccatcactagggcgtaagcaagcttttccatttcgatgtatcgtatcttcgccccttgcaaagtttcgaagacgaaatacactggtttctggcctgactctgtttcttgaacgagggctgcagtgaccgccactggcgaagctgctaggtaaagtagcaattcacttcccagtgctgggctgaccaaagcagatgtgctctgtagatattgcttcagctcgtcgaacgctgcttggcattcgggtgcccaggtaaattttcccgcgcccagagggtcttgaagaagggcaaacctctttcggctgcttttgagaggaatcgattgagtgccgcaattcggcctgcgagcttttgtacttcacgtacgctcgacggggggttcatttgctgaatggcatcgattttttttggggttcgcctcgataccccttttagaaacgagaaaacccaacaacttgccctcgcgaacgctaaccactcagggtggtcgatctcctggatcaccctagccttgcacagcatttgcacctcggctttcgctgcttcttggcgattagcggacatcttgcgcagcttttgtttccttggcttggcatccggcttgcccgccagatgatgcatgatgaggtctgtcgaaacacctcccacctcgtcggggccccaggcgaagatatcaatgtttttcttgagcacctctaggatgatctcagcttctcttacgcccatgtcaccccccagtgatacaagtcttgtgggataggcgtcgtcgacctgcaccttgatcaccctgccgtgaggggcgggcttcggcacgtgcttcacccggtcatgcggttcggcctcaacattgtgcactgctctgttgattacggccaaatcgccctttgatgtagccgaatgttgaagccccttgaccacgatcactccttcagggccaggcatcttgagcttgagataattgtggtcggagatggcttcgaacttgttcaaggttgcgcggccgaagattgcattatagttgtacgggatgtccacgacgtcgaacagtatttgctcttcgcccctgttttcacctgtgccgaaggctaccaccaagtgtgcttggcctagaacttgaactgcttctccgctaaaaccacgaagccgccggtgcttgggtgagggctaagataggcaaccccatcgtcgaccgaacttcctccgtcgactaggattcgctgaacttcgaagccagtacctcggccaagatagctctatcttgatgtgggaacagcactccttcggcatcttctggcccgaaagagatctgctggttcaaatatcgcggggcccctttgcctgccgaagtgatgttgtgcaccattcacagctgcatcttcttttgccgtcttgacagttgattcggcgggtcggcccttgtaatcacttggattactctgcactgcacatcttgccactgttcggctgggggtgcttgttcttgaataccttcgtgaggcgcttcgactgctgctccttgctgcggccttggatcttgcacgttgccacgctgcagaatgtttcggcattgctcggtggtgtgcgaagagcatccgtggaaggcgcagtaaaggtcttttctgaccttcttgcgaacgggctgttgatggctgcttgcttgctgggcgttgaactccttgcggagtgcttgaatttcttcaacagccatcacggccttgcctacacggtcgtttctgaatttcctccaagtcatgggagcttgacctggccttggcgattatccttggttcgctggctgtggctagcgaacagcgagaggagccgattcggcgacctgtgcttgtgcttgggcttgagcagcagcgacagaggccttatcatactcagcttggattgcttgccgtcgcttggtatcctcttcgccccttgcgtatccgtcaatgatgcgaagcaggtgctcgagtgtctgcggctccttattggcgatttttcttatgagttcgccctcaagcaacacagccgaagcggcgttgatgacgaacgcctcagttatgtcctaaacatggcatcgggcttgcgagaagcaacgtatgtactcccttatcgactctcccggcctctggcaaatgccgagtagatgttgctgcggctttggcttctcataggtgcctcaaaagttaaggacaaagacgtcgcacaattgctcccatgagtaaatgctgttagctagtaaattgaagtaccaagagcgtgcgatgccatctagagcgagatgtattacctttgccttggtattttcgtcaccatgagcggcttcgatcgtggactcgtagatggacaggaactcttttgggtccgtttcgcccgagtatcgcggaatgggtgggaacttgaattggggtggaattggacgaatcttgattcccccacttagcggcagccccgtttcgccccccgtctttctcacggcaccttgctgcggaggaccgtttggatatggcgtggcgaagtgcgatgtgatggcttgcacgtgcagttgggccatagtgttcggctgcccggccctaaatggtgacgcttggtgtgccgccatggatgggtcgaacgaaggctgggtccatgccatggcgatcttgttcggcgcctgattcgctccgaagcttggtgtcggtgcctgtggtcggatggttggtgcttgagtagcattgctgaagtcgaactacggtccttgactccatggcgaaggccctggaccaggaaggttcgatggtagccaactgggtgcaccttgacttgtgtttccctccagctggaccgaaggggttgcttctgaaatgttttagggttggttgagctactgaagaaaagcttggagctgcgcctgcaaggccgaagccccttctgccattgcttgcgacatctgaccaagtggcggggggcgtacttgggctcgaccagccgaacttgtggctgtacaagaagggtcgggtgtactgttgcgaccgaacgctgtccggcgcagtacgctggtgcttgcacagcttgtgacggaagggcttgaatcggcgcttgcaggtagaccttgggtgggatgtccgccgaatattggagaatggggaccgaggcgaccttggcttgccgggccgcttcgtacgcctgctgttgctcttgcatttgacgaagcatgtcctagagtcgcgccatgttctgacgcatggcccccatgtcggcttcagcttgcgcttcgaggttggtgttgacttgtgcggcggtaagcgcggtcgaagttgtagcctgctgcggcgaagcagcttggggcaccaccacttcacttgtcgaaaggatctccgccctggtctggagcgcccttgtcgttgcagccgcctttgccgtatcaacagtgttcggcgcctgccccgtcgaagcggcaggagccgaaggtggtggttgcggcgtaggggccgaagtcgatggagccacaccagcttcggcaccaagcaccgaaggctccgctccctcttcgactgccatctccactcctgcttcactctccttacaccttgcaaccttctcctctgcgaccttcttcggtggcattcgctctcagtggtttccctcagaggtccccacggtcgacgcctgccgcttgtcgaaatgacaaccgcatacgtcgaaagacgtggttactcaatagtggttggaaagcagtaaagtgtattaaattgagaatttttcttgggatccccctattagggtttaggttttacggggaatttatatggtttcccttatgaaagggacatttacatgggtatatagtgtaattgaggtacatgggcctctagtgggccgactggcaaacgctggcccagtggcccctgggcttgatcggctgagatggcctcttgggcctccttgaagttgaacttgttatggcaaagccatccgccttcgccatacattcttcgccatatagtcttcacccaagatgcctccaaccttgtgggataccagcacgatccttcgcccttcgccgtctttgcttgataatctccgccatggggacttcgccctgacagactcgacgtcttgggcttgagcccccactggttgcatggtttcggcaggtccagtcgaagggtttcatgacataccgccaacaaatatagtgattgctttggtgagttataaacactaaaatagatattaattgcttagacgtggtgtttaggtaattgttatccagtaattactgcgtatgccatagtatgtttgaggtgggtgtagaggtggtgacagccctcgagatcacttcagtcctccctgtccgggtacgaagtagagcgacatctaggaacagcgggttgccagtgcctgaagtattgcgttaggattaaaattaagctttccctagacactgtttctcactagtaaatcctctctatcctggcctatcaattgcttggtgtccttggatgaactggaggaagatctgaccacacacgttcccttggatttgatacccttggaatactccgtaggggaagtgctacatcagtatatccgtgcgcttgcggattttatctgtgatcgtaagaaataccaacaagcatttctggcgccgttgccggggaacggttgctgatcatttccgaacctggttcatccttgtatcctttttactttttattctaactctacccttgctatcctagagaagtattcctgtcaaactcttctcaaccatagagcaaactctttttgagttgtctgctcctcgggtcgaattctatgagccacctccttcatcggagcacatttatacaactggctatgaaattcgtcccgaactaattagtatggttagggaaaatcctttttctggctttgatctagaaaatccctaccatcatctgcgagactttgaacaagtctgctcgtgccttaagattcgtggcatgagataagaaactgtgtggtggaaattgttcccgttctctcttcaagagagagcaaagcaatggtacacctctaccgttggatgtgtaaacggtagttgggaaaagttgcgagatagattctgtcttgccttcttcccaattacttgtattaccgccctaccagtagaaattctcagttttaagcagatcaaaaacgaatcaattggtgcagcctggtccagattcactaatttagtacagtccgaaccaaccctgtccttacccgagtatgtgttactgcaacatttccatacgggtttggataaggagtccgcattctatctggacataaccgctggaggatcgttcatgcacaaaacgccgtcggaaggaagaataattttggatcgcattctagaaaatacttccgtcatgacgaaatccaatgaacccagccggaggcatccgtgtccaagatagaggaacctctaatgatcgagccactcgctgaaccatccacttctgctagctcgattgatgagaaggttccagagcagccgaccgtcgagaatgaagaaattcagactccggatcgtgccgcaattatgttcagggacggctttgacgaagactacggcaataccttgaactattttagcaagaggaaaccactcgttccttttcgacctcccaatcctatggaactcgagttcctacgacaaactgtctgggacttaacatccataatgagcgatgaatggctaagggaggcagagctttcatccgaactaattcagataaataccgctccccgaatcattctttgccatttggaagggaacgacatcggtattctctacagtccaactgtcggggccaatctagtttctgagtcttttccattcgcgtatttaagcgataaggcagtgaccccaactgacaaattcttcaaacatccaaacggaaatatcattgaaggatttgggattgtacaagatatgcctgtctactttgaagactgggaggtgatcttggatttccacatctttgaaattcaagatttcgacatcctaatcgggctgcccattgtgcaacttctcattaacacacctcgattagaaatcctcaaaataacattgggagggaatgaattttcagttccattctcatgagcaaggatcgccttgaccgattccctcccagaaattgagtctgtggaggaggttattgcagttctccctcatgagtctctcgaggcccttctggaagatgaggtcctcgatttcatcaaagagtaagcggatcccggtgagactctcgacctgccaatcatggaaccggtacctcgacctccgcttaagcttaaacctctacctccaggcctacaatatgctttcctacacaatgacagaaaagctcctgtcataatcagtgacaagctctatgaagacgagactcaatgtcttctcaccatgttgggaaagcacggttctgttcttggctactcgcttcaagacctcagggggattaatcccgcgcttagcacccatcgtattcttattgaccccgagagtactccttctagggaacctcaatgacggctcaataatgcaatgcgagaggttgtaaagaaagagttcttgaaactcctgcatgctgggattatctatcccgtaccatacagcgagtgggttagcccagtccaggttgtgcgaaagaagggaggaatgatggtcattgcaaatgctcaaaatgaactaatcctgcaacaaatcgtaaccggatggaggatgtgcatcgattacaggaaacttaacaaggctacaaaaaaggatcatttcccgctacccttcattgatgaaatgttggaacggctggcaaatcattcctttttctgtttccttgatgggtattctaggtatcatcaaattcctatccatccggaggaccaaagtaagactacgttcacatgtccgtatggcacctatgcataccgtaggatgtccttcggactgtgcaacactcctgcatctttccaaagatgtatgatgtctattttctcggacatgatcaaggacattatggaagtcttcatggatgattttttggtctatggaaagaccttcggtcattgtctacaaaatttagacaaagtcttacaacaatgccaagaaaatgacctggtacttaattgggaaaagtgccatttcatggtccatgaagggatagttcttggccatcgagtgtccgaacgagaaatcgaagttgatcatgctaaaatcgatgttatagatcagcttcctcctcctgtgaacatcaaaggaatccgcagcttcttgggacatgccggcttttatagaaggttcatcaaggacttttctacaatcgccggacctctgaccaatttgctagccaaggatgcgccctttgagttcgatgacgcatgcctagaatcttttgaaattctcaaaaaggcacttgtctccactccaatcattcaacctcctgattggactctgcccttcgagatcatgtgtgatgcaagcaattttgctgttggtgcggtcttgggccaaaccaaggataaaaagcatcatgcaatctgctatgctaacaaaactctgactggagctcagttaaattatgcaactaccaaaaaagagctgctcgcggttgtttttgctatcgataagtttagatcttacttactgggagccaaggagataatctatactgatcatgttgctttgaagtacctactcactaagaaagatgctaaaccacgtctcttcagatggattttgttgctccaacaattttacttagaaattaaagataaaaagggagtagaaaattctgtagcagatcatttgtccaggctgcggatcactgacacgcaggaacaaccgataaacgacttcttgagagacgacatgctgatgacggttcgtgactccaacccgtggtatgccaacatagtaaactacatggtatccaagtacataccaccaggggaaaatcaacaaaaactaaagtatgaaagtcgccgtcatatatgggatgagccatacctatatcgggtctgctccgatggcttactacgaagatgtgtgccaactgatgaaggacttaagatcatagagtgatgccatgcctcaccctatggtagccattacggtgcattccgcacccaggccaagatttggcaaagtggtttcttctggccaacaatgtacgaagactcaaaagaattccccagaagatgcacaagctgctagaggcaaggaggaatcactgctcgcaatgcaatgcccctcacatacaatttgcaagtcgagatatccgatgtttggggtatagactttatgggacctttccctaagtctcgcaactgcgagtacattctggtggcagttgactatgtctccaagtgggttgaggctatgccgtgcagcgccgcggatgcgaggcatgccaagaacatgttcatagaaatcatcttcccaagatttggtaccccagaatggtcataagtgacggaggttctcacttcattgacaaaaccttccgagacctcctacgagagatgggagccaaacacaatgtccttaccatccgcagaccagtggtcaagcagaaacatcgaacaaacatattaagaatattctacagaagacggtcaacaaaatgggaacaagatggaaggatagattgctggatgcactgtgggcataccggacaacatacaagacacccattggaatgtccccatatcagatagtctacgggaagtcatgtcgactacctgtggaacttgagcacagagcatactgtgccatcagaaactggaatatggactttgaaggagcaggagaatggagaaaaatgcaaattgctgaacttgaagaatggagagagaaggcctaccataacgcaaagatatacaaagaaaggacgaagcgctggcatgacaaaaggataaaaatcaagaaattcaagccaggagacaaagtgctaatgttcaactacagggttaagcttttcggtcacggaaaattgtgtagtaaatgggaacgaccgttcaacgtcatcgatacctctttgcacggggcaatcacactccgcgacaattcaggtaatatattcaaggtaaacagtcaacgcttaaagattttccttgagccaaatgaaactttagatgaagaagtggatgtcattgaattaattgattatgaactatgatgatttcatctaatgcatgcttaaaaccctgtatagttgtcatttttgtgcttagattaggttttaatgagcctagggaaaaattggcagctagctggacccactagggttcgtccgaacctgctggttcggctgaaccagggcggcgcccgatcagccccaattttgaacctcagtctcccccgctcatctatagtctgttgtgatgcgcattcgggggtagatcagtcgtatcagacccagaaccctgtccttcctcctctctcccacttttgcaaacctcctcttcttctcatctcaattccattgcttcatcacccctcaattcaccagtggctggcaaatctttgatcccattcatcggctcttcctccaacttcacatacaaccttgacggagagccgacaccggtgaatcaattgatcctggtggagcattacacgatggaaggggtgaatgcactgtgggcacaaccccttgcaacagtgccaggctcccctgcgattctggagctgatcggcaagctccctggttcggccgaacccttctcggccccgttcggccccccgttcggtagtgcgatccctctcccctcgccatgtcacaaggacaaaaattcggggggattcgcttgcgcgacggccgacaacgggagaactcgtcttgttgaaggcgcgacgccttttccaaaatgatgagaaggccgctccacctcccgccgagcgctatgtaggcaccctgttcaccaaggcaggggatgaggtgttccataagtatgttacacccaccgctactccatccactccgaaggaggagcgtttccacattcaaggagtgcgaactcctggtggcgggtatggcaagggtttactccggccgttaacagcatcagagaaggagggggcagcggaatcccatagccctccacctatgaaggtgaagcataatttgacaccccctccaattgtgagggctcctggccaatatcaagaagatgaggtgaagtcgccggaaccctcgatccataagctcgccgcacaagtgaagaaactccgcaaggagaacatagagcttagggatcgcaacacggagctaggggtagagcttgctgaatttagaattaatttcaatagccttagtcgcggtttgtgcgctgagatcaagcgcgcattcgtagaaatgggaaaggaaaataagtattacgctaattagatgcttcctttccatgaataacatagtagtaggtgcttggttttatttttccaatcatttaagcacttgctacgaataatgtggctcattggtgttaaccccaatgtttgccaaaatttgttttgtttcatgtttaataaaatttaggttttgaataagtgtgggggagatatctcagcttcttacgtgcacataatctgaaaattacttaatgtctgaacacctggaaggcactgaactctgcagaaaattgcagaggtattgggcaccagagtggttcggccgaaccaccaggttcggccggaccagtgttggccgtagtacctcccagttttcacaagtaagcaggtgagcacgtcttttatctgtatatctccaccatgatatagtactagagctaaaaatttagaaaacaattggttcaagcatatgtgaaagataaaatttccaactaatgaaattcttcatgtgattaaacttgtatattcatcattctcagctgaacttgtgcttgtgaaccaccatccatgtttagcgaaccttatgcatctaagtaattgctttatgtgagatgattcaagatgaagggaatccttgcaactcttgttatgactcttgggaatttgttttcaaaaataaaatggtttaaaagctcaatcctccaattgacttcatcttatacctaccaaggtgtcacaccctgaaaattcaaaatatataaattgttgcttaattggaatttttagaaatgattttaaaaaaaccctagaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggttttttaaaatcctcttttggctttgggccgaaagtcggcccaaaacccttttctcccttcccggcccaagtcgggccagaccgcagccgccgcgcgcgcgcgttcggtcgctacaggtggggcccacctgtcggacccattgtctcctccggccgccgccggccgaaaccctagccgagccgcgccgccgtgccctctaaaatccggctgctccttttcttctccggtgaaatcttttgaggggaaacaatcttcgggatctcctccaccttttctcttttggaatcatcggcttaatcgttttgaaagttcgtcgattcgaggtcgaatcggatcggtctctttcctccgaaccccgaggtttccttcgcgtcgccggttgccgtgggccttcgccgccgcctcctagcccctttaaaaggatccccaagctctcctctacccgtcgccactctcgccttcgcctctcgtcgtccgtagcgccctagcgtcgtgtaagctagcgccgccgtcgtcgccgccgctccagccgtgcgccgccgtcactcctgttgtcgccgtcgctcggggaggtcgccttcgtggtcgccgtcgcatcgccgtcctcgtccgccccttcgccgtcgctgaagaccgccggagcaccgtcgccgtcgtcgagccgaaggtctccgccgtttcaacctcgtcgccgtcgccgtccgctgctcctccgccgttgctttggtcaccggtgagttcgccgcgtcgcccgcttcgtgctggtgtcctccgttcgcgccgcagcgccgtcgttcgccggcgagcatgcgcgcccgagccgcccgagccgccaccggtgatgacgtcaccgctgacgtcatcgggactgtcccccgtgagccggccgtggaccggttgatctcagccgtccgttttggatggatcaatctcggccgttcgtttccgtgagccgccaccgtgcgcccggtccaccgcaaaccctagccgctgacgcaataaatcccttttttcttttcaaaaataattcattattgcgtcataattcaattaaaatcaatataagtgttttaatccgattaaatcttcaaaaattcataactaattcatcttagctcggatttagttggttcaagtctctaaatttttctaaaattgagatctacatgttaaaaatatccacatgtactgttcatgcttgtttatgtgctgttttggtgattttgctctttcctgcttagattccgacgttcccggagagtccgttttcgtaggagaagattttgaagagttccaaggccagcaaggcaagtcacacagatcccaaacaaccctttgagcatattgatcccgtttaaagctattgtttcttttcaactattgcatttattttcgaatgtcattgggtggaattaacctattgtttgttatagcccttttgttctggattactttattccttgatatcttgggttattataacttgactagttgagctctatatgttggttcaactagaagtattagatataattgcttagccctgcttagaaactttagcacactattgggataactttatgactcactattatttaatgatggcttattgatagttcacgatggtcaatcgtgattggttaattaattaatgtgccaactaaaacttgataatggtgggttgtgagcacatggttttgagagtcgtgctcatgacaattaaggaccggttcacgagtttcggttgtgaaacattaaccatgccaaccacaagccaacatgggcaacggctttatcttttgtatagcatggttcattgcggggcaccagactgagaagtggcagagataagcccacgggggtcactggggagtccatgccttgtttataagggggtgattatgatccaggaaaggtgcactgtagtggattgtgttgtgcaaggggtattgtcacaactcctttccgaggtaccgtggtggtattgaggcacatggtgacatgatgtggagttgtgtcttgtgggtacagtggtacacctctgatcagagtaaaactattcgaatagccgtgcccgcggttatgggcgggtctaacaatgtctttcgtgattagtctcacacttctcaccataataaatgatgctttaattgataataatttgattagctcctggtttggaatggtatattcctggtttggagatagatctgtacagccgggtatggttgttcagaatggttgggcctatacaacagggtatgttgtatagcgttggattaatattgtttaattattacttaacagtttcattaaattctgaaatgtttattaaatgctgtttatgcaaataaaaccctactatgccatcctttgttatcctgtgcacttgcatgtttgctgcgtggcttgctgagtatgtcatatactcaccttgcaatcattcatcagaggaagagttctacaatgatgctgatggtgtggaggattaggtgtagccctggtcaagctgcctgtggagtggagtcgtctgcgccgtttatcttattttccgctgcttagatctttattgattgagaggaactatatacctctgtaatgatattttattcgcttattaattagaataataattgtactctattatcaatttgttattgtgtgcctcggctgattcctggacgagggattcacacacatgtaagcgtttggaattttggatagaaattccgggcgtgacaagttggtgtcagagcccccttgaccctaggttatgccaaatggttacccatagaagccctctaaaaattattggaaaagtagaactgttctcctccccttctcttttaattaaaccaaactaatggcacatgcacttcataatctcttttaatggttctcattcaaaatctattccagtgttattagtactgtacatctattactgtactaatggctcattttaccagcaaaagttttacaatattgttttatttaatcttgatgcaaggaaataaatttagcatgttatttaatcttttggaacctgttgttcaaaagtacaaaatttgtaaccctgtttccaactgtttcaacttatcttg

SEQ ID NO: 72856 - DNA, 1506 bp, Oryza sativa
ggtaatatagaaggaatcagaaggaatcataaaagaaatcatgtcacggagagatcctcaatagcggggaatcgtgagaccccccatttgtgagttcggccggggacggaggctcatctcttggaaatcactcgctcgtccctaggatcaccggcgagcttgcacgcaaacggattatacaggttcgggccgctatggagcgtaacaccctactcctgtgtttgggattatggatgagttttacaaaagatttcttgactctagcaagcgcactcgcttcctccctcctggagtttaggtttttttctctacccccccttctcagtgggcagggtcctccttttatagctcaaggagataccacatgcaccgcctctacctaccctctatcggagagggatcccactctacttttcctgggctttaaaccgtgccttctcccggaagctaagcaacaaccggttctcgagtggaaccaggcgccgccccccgcctgactcgggggacagccctgtcattccctcataaatgaacgatgacctgtgatagcccttcctcgagtgacgctcggacgtgacgggtcatacccacccccactccgccgggtacaagggcgacgtgaggacatggttgccctatccgtcggatgtgacggtgccaggccggtcacaaaccggtcacatccgttagacagaggttagctaggcgcgccgcacgtctgcccttaccgcattaaatgcggtgagggacagtgtgcgtccacattatggctgtttacctgtgcttcctctttccttcgcgcgtggaaaccgggtgagggccgcggggcgaagccgcgggatagcccgagggggtgacgccatgccccgagcccccccccccccccggtggcttccacgactcgcgtgacgcgcaaatggggctaacttgcagagtcacgtggccggagggaaagtaattcccctctacttcacatacccccgggtccatatctccgacaaatccgtttaaaaaaattcacatgctaacttgagacgatcggactcctaattgcagctcatgattttctaaaaatatatatatccaagcgaactcccaatttcattttaactaaaccatataacaataataagattaaaataaacttcacccgttgcaacacatgggcatttttttctagtaatcctaatttttattgacttttggtcctgcaatttgagttttattgatcaatcgtagcaaattaattaactagtaggttttccgcactatttgacgtgaaactagatataaattagaattatatttgattaaactattttccttatataaacaccaaggcaatagctaggaattaaaggaactggtgcgaaatacataatgggatctaaaatttgacagccaaatttttacaatcttgttatcgtgatggcctatcatgatgactcatagagcatgatcacacctagctctattcggtttagctttacctattcgatcggctta

SEQ ID NO: 72857 - DNA, 1856 bp, Oryza sativa
tgttatgtgggctgaaggaaagtatttctactcctgctcattgacttgcacccttgttaggtaacttggggtaagcccacttttagctgcagcccactatatggcccatcgtgtatccgaccatttgggtacatgacaacaccgagccagattcctttgttgtctctgttcatagccagcggcggacccctttccaggaggcctgggccctgccgccgccacaccaccactgccgttcgtcgccatcctcagctcctcgtccatctagccggctactggcgctggctcgttcatcggtggtggctgtgtagcagtctcggctatgcagcagctcagtacaactgcttcggtgaattgatgaattcatgttttagtacatcgattcaagtgaatttttgcttcagtgaactatcagcaagcttcttcttcaagcgcatgataaaattttggatactcgtgtcacgcttttcaaaatgctaaacggtgtgtttcgtgtgaaaactttcttatatgaaagttgctctaaattatcagattaatccatttttcaagtttgtaataattgaaacttaataaatcacacgttattaccacctcattttgcgtgaaacactcaatttttatcttcatattcatatccaggagattcaaacaccacattaattaatacaccgtgtggatttatttatcttgttctgcaatctgtgacatgagacttactatgtgcatgatttatttatcttttgcgaggactcaataaaaatcgtcagacgttttctgtactgatctccaagcctgagtacatggcaagagcagagtacaagttctctgtactgcacgaagctacatatggcaattttcttggtgggagttttcgttggtgcgaggctgcgagctaatgatgtggtaccctctgtaggacttgcagtggtagcacttcattttatagagaatctgttatatgccactaaaaattggttttattacttatatgccactgaaaattagttcttcccctatatatattattggtctaaatttacgtaccctctcataccactcccatctattgaccatgtgttgaccgttaactatcaagtaaaaaaagacggttttggcgttttgtccttatgagtataggacatatctaacaactcagaatgataaatacatctttttacttaaagttaacggtcaatacatggtcaacaaacgggagtggtatgagagggtgtgcaaaattagaccaatgacatattggggaagagaccattttcaatgtcataaaagcgatcagactaagactaatttttagtgacatataagggattctctcttgatttttatggcagctctctcactctcttgaccctcgggcgatggggatcgatcggctagggcgctagggccaggccaatctgctgccagcgatggcgatgggggcgtgcagcggaatggtgagagaatggttctcttgttgttctggttctgcttcatcagatgagagagatcgattgatcgattgatccacataagggcagcaatgccaattcatgtacccaatccaatcaacgcagtcaaagataacgggaaaccaagagggatcgacgaaattgctttcaacaataacgaaatgatattttgggtgctgttaagttgaccgcgaactttggatgatatgaaattaaaaagaaaaactttcgatgctatagaatcaatttcgcctccatttttttatagggtaaatagccaattcagtccttgatgttttgctaggggtcgaattagtcctttacattttgcattgtccaaacaaatccttaaaaagattatcgtgtggcttaatatagtccttg

SEQ ID NO: 72858 - DNA, 556 bp, Oryza sativa
tgacggttatggtcgttttcaccggtagaaaccgttatcagctggacacttgccaagaggagaagggagatgctttttggatgcttaagcatctccacattcccaaggcacctctaggcctataaatacccctcctctctctcatttacaacacacatggagctgaattacatgagcctctattatatcttttgtacattataaaataggtagagagtgaggggaagctctggaggagtacccgaaagtttggcactctctccaacttctaccttttctaggaggaattctggaggagtaccagagctgtcggtacactctgctccgggttcggagaaacttcttctattaagtaagcattcaggatctttttttatgttatttaatttcttagtctaagtgagataaattttcatctttacgggttcattgtttagtatccccgtactaagtgctctagtactaggactttggataaaaaaaggaagtcctgcgaagtatagagtataataataacttatacgtggtgtctacgttagagattacctttatttgt

SEQ ID NO: 72859 - DNA, 20189 bp, Oryza sativa
aatggtcaaacacatgctaaaaagtcaacagtgtcaaatattttgaaacggagggagtattacctattttcctgaactatggttgtgccacattatccaattgatccacaatcattggatgaaatctgaatggtttgccacttcacctaccataccaacaccaaagtaatcgaaccgatcggtacaacgatgagcgatcctggtggaatagcaagcccacatgtaagagaacccctaatgtgcgatcgatcgatggcatctccccgcgcgcgatcagatacgataaaacatactccctccgttttacaatgtaagactttctatattgtccacatatatatatatatatatgctaatgaatctaaacacatacctatgtctagatttattaacatataaatgaagagagaatccacttagtgccactgagttttgtccgcttctacaatatacccctgactttgtcaagttgaacaacatgccatcaggttttctttaactttcactgcgtgccatcgccatccacgagccgttagttggcctccgttgaccgtattgaattgtctctaaataactaaaataccctttgactaaaatatcattgtacttgttgaccgaaaaccgtaacacaccatccacccccaaatcgatctgttgatgtttctcctccagtgagcggcgccgactccccatcgatggaacgccagctgcctgactcctcgacgcgccgccggccggccggctccccgatgacgcgcggttggccgccttgctccccgacgacgcgaggccggccgcctggctcccccacgacgcgcggcccggagctcggctccccctcgacgcgcggcggctcgccggcctccccatcgacgcgtggctggtcgccggggtcccatcgacgcgccgccagccgcccggcaagcagcgtctccatctcaatggactaccaccgaatccacccggtgggcgtcggcgcaggagccgcgggcggcggtgctgtcggtgcgtgtgctggacgctgctcgccgtgctcgtcctcgccgtcgccgtcgccggcgagacgcagctggacagcgccgtggtggcgcagctgctgcagcagcaataggccgggttcgtgccgctcacggtgtgggcgcgcgtgccgatccgcatcaagttcggcgccatcaagctgtggaagatgaccgggaaggcgacctgcaacctcgtcgtcgacaacctcgtcgccggcaggcggatccgaatccgctccaacaactacagcttcaagctcaaggtctgatcgagctttgtagaggcgttgatccatctccatctctgtgaatccatccgttgagttgagattagcaggtggtagaggcgtgtatttacatttttaccgatactagtttctgcgaatccattcgtttttggaagcactgctactcagattagttttaatatatgagcaccgatgtatatatgaaaatgcatacgcgatgaatttctttgaaaattggaataaagatggctaacatatataataagttagaggcaaataggtctttttacatcgctaacagatgctaactgttctgtgatggcacgtagtgaaggttaaagaaaacataatggcatattgttcaacttgacaaagtcatgggtatattgtagaagtaggcaaaactcaatggcactgagtggattctcttataaataaatatgaacaatgttagaaagtgttatattgtgaaatggaggaagtttgtggtaaggcttctacgtgcgggagtccacgatgaattcaaaaatccatccaaaactagttccttgaaaaggctcattaactacatgccctccctctcctttcgacctatgtgtgaatagataaaaagcccatatttttttgctttgagctggcaaaaaaataatataaaaaaatatagtaggtagcaattttatacatagaaactttatacctagaaagtttatatatagaaactttcaacatatgacaaattggtatataagctttgtacataaaataattggtatagaaactttatacatataaatatttagcatatgaactttgtatgtaatgtaaaatatccggtataaaaacttttacacaaaaagtttcgaattaaaataaaacagaaaaacataatcacaaacacttgattgggcaaatgtgttcagcccaacatgtgcaagaaaaatgaaataggccaagtaaaaaaaatccatgcgtttagcccataaaacgaaaagaaaaatgacggcccaacacaagtatcatctgggccaaaaaaagcaaacggacgtacattaacttttggaaaaagtataatttgactccctcaactatcgtccgagtattcatatcctccaaccacaaaaccgggtatatcgactcctccaactatcaaaaccggtgtaaacaatatccctggttttggctgatatggcgcctacgtgacggttttgaccgagtcttttcctacgtagcacttacgtggcattagaataaaaacaaaaattaaaaaatatgtgggacccatatgtcatacaaaaaatatatatattgtaggacccacgtatcatcctccctctccttcccttcttcctccccctctctctcctttatctctctctctccccccggcttttctcttcaccggaggagcggcggcctccaccggcgggatgcgtataggtacggcggcttctaccaccgtggggagggattccatggcaacgagaagcagctggtggccgagatgcccgtcgagccggcaacggcgactaccgtggtgcttcccgtcgcggagccagatccggactcgagccacgatgccgccgtcgcggccgccgaggagccggtccatggcgaggccgatgaggaagacgaggatgagatggcgagtagccggacttcaccggagggatgtttgcgcagaccgttcacatgccgtccgatgtccgtctcctgcaaaagcacaaagcaggaacttcaacttcatctcctctccttttgttgcaaggggaacagaacagcagtgacggtgaaagaagaatgggggtaaaaagcttttgttttcacctggagcgccttgtacgggatgtccatgtctgccaggctctgcagcaagctcagcagctcgtcctccggctgtgaggaaacaaaacgaaaaaacgtgcagctcgtgtcaaatttcaatggtttctttgatcgaattcgtcggcgaggtggtgaaagaaaattaaaaaaaaaaacctcagttgttgtagccgccgccgggcgtagagccgctccacgataccgtcgcgccgcgcgcgcagctcgtcggggcggtcgtgcgcggcacaggccagcgcggcatccacgagctcccacacgccgccgcctcctcctccaaattccgccagcgcgcggcgcagccactcgtcgtcccgatccatctcccccctcgcggcggcgccggcgagacccgacccgtccgcgccggagtatatgtcggatctttccaactcagcgccacacctcacaaaccccatcaaccaaccaagaatccgacaccaatcaagaacccaacctccccatcaccactgccgccgctcccgaccgccgccgccgccgctctggtgaagagagaggtcggggagagagagaggtaagggagagagtgggggaggaagaagggaaggagagggaggatgacatgtgggtcccacaaaccatttttgtgtgtgaatgatatatgggtcccacatatttttttaattttatttttattctaatgccacgtaagcgttaagtaggacgaagactcggtcaaaaccgctacgtaggcgccacgtcaactaaaaccatctccaaaaccatctaggaacattgtttgcatcggtttagatagttggaggagtcaaaggtatatttttttttccttaactttttcgcacagcaaaggctcctatagtagaatagccaatcttgtccacctcctgatcttttttgtcctcaaggcacccgtccattcctcctctctcgcggaagcgcatcgccccacgagggagaaggcacgctccctgcgtccatattcagagagcttctgcaggccaggcatcttctcagtcaatatctctttgccataaccaccatctccgatctcctactctcttttcaatcgtttgatgttgcatctgttcgagagctccagctgcttcgtcctggattgctgctgtacaattgcaagtgcaacatgtactagctccatgaatcggctccacaactccacaagattctctcgcctctcacaacatgtttctactgtatttattgtttcacattcacaatcactgatcttttgatacaatgatattaggcagctcgctaggattaattaacatttcttctttccctttttttttcccagcagatgggccatattgcttagattttattttccctgacctcaatgctccagccagcttctactcgacgcctctctttgatgtagtttattagtatctcccctgttttttctatcttcaaatttaatttgtctctcccctatcagaactcaggtgtcctttccctaataagaggtggtttctggaattatgggggttgcagtcctttttttaaattttcctcaccattgtcatcaggtgattccaatgtactaaccaaataatttaattgcatgaactgatttgatcaagcacaaaccaacagtgcgcctgatgtccatctgtagtagtgttaaggtatttgatcctcctctagatattagatttccactagcaaaatgctttgctatgggtaaaatatacatactttgctttgaccattcttatttgaatatatgttatttacatgattgaaacaaatattaaagtattgcacaatatcatagactaatttgtaatatgtacaaaagtagtggtggggtcccccaccaccactattatcttttatagcggtatagattatctcaggctgataagtttgtcaatatttgttctcataatctcattggcttctatttgtgtcattgatgggttttcacctttcttgcttgacccatccatcaaatatcactttttctttcgtttacaaaaagtataaaaatgtttaagctctactgggaaaaaaattcagctatcattttagccaataaattgtgcagtatactgctgcacacgacgtaaaattgaccctttcaaatgtcatctcatatatttttactttttttttgttcagaactgaattatatgtactttttatattatatttcaatacagtatatatgttgactaaactgttactttcacacattggttgtcactgttctattcttttcctacatttttgggcaattctgatgtggtaagcttgctgcaacatgcatactgttgctcaatcaatagtgtttgttacttagaatgacagttgtcaacttttcattggatataaggcgctatgacttaatcaggtggtccattcaaacatgattttagtatataaaagagaatgtgactcccatgagcccttactaaaaatgtgaatctctcgattatttctcaacttgggtaattgtcttcttggcctaactttcctaaagtagtacttttttccctaacgagactactataatcgctcttccggcctcatcttttcgtttatacttatacttattagccaaaatttaaatttttaatataaaatttggagttgattttgtgattttttttcatcgaagtttatttttcagcctttgttttcagatcgctaagaacacgtatataaaaattttattcataaattatttttaatttgcaaatatgttgtttcgtttattccccaaataagcgaaccgatgggtccgttcattaataagcttgtacaggtacaactatttacttagcaaacatttattctatatttctaaaatttgaatttcaagacccctctaaacattgccatcactaaacaatccaaatcacattttggatttactattttctttcagaaaactacaccgaaacatcatatattcagaagcaatcagacaccacagtcttgacaaactctcgaggccggcagacagccgccaatggcgtcgccattggcatcgtcaacccgccgccttcggccatgtcgacggcgccgccttcgccgatctcccaatcgaagcactgcacgagcgccgccaccgtcaggccgacgaggcgcacggcgagcccctcgccggggcaccgccgccggccgagcccgaacggcagcatgggcgcggtgaccgcggtcaccgcgccggcgccggcgccgtcgtccatgaaccgctccggcctgaactcctccggcgagccccagacatcgccgtcgcggtggatcgcccacgcgttcacgaggatcatcgtgccacgccggacatggtagccacccaccttgcaatcctccatggcctcgtgcgccgggatcaccgggccgacggggcggagccggagggtctccttgacgacgcactggaggtaggggaggctcgccatgtcggcctcctccaccagccgcgccgcgccgacgttggcgtctatctcggccctgaccttcgtcatcgcctccgggtgcgccaccagctgcgccatcgcccactccgttgtcagcgccgacgtgtcggtgccggcggtgagcagcaccaggacgatgcccttgacgacattgtcggtgtagtggtcggggtcggtttcttgcagcgtgaggagggcgtcgatgatgccgttcttcttctgatccttgtcggcggcggcggcggcggcgcggcgtgttcggcggtggtcgtcgacgaggccggcgacgaacgcgtcgcgccttttctgaaggctttgtagggtggccacgacgccgcggagacggtcgacccaccggagcgccgggaagaagtcgccgacggtcggcgagccgctcgccgcgaacgtctcctcgacgatctcctggaacctgcgcgtctcgtcgccggcgtggcggcgcgcggtcaccgcgcgcagcatcacgttgagcaccagctcgaacagcctgggccggagcgtcaccgtgccgccgccgccgccgccggcggcggcgtcgcggaggacggcgtcgacgagggacgcgacctcggcccggcggtcggcggcgagcgcggcgaggcgcgcgttcgagaagagctcgacgccgaggaggcggcggagcgcgcgccagtggtcgccgtgggaggcccacacgacggtggtgtggccgtacccgaggacgtccccggcgagcagccgcggcctccccgccaccgcggcgtcgcacgccgtgaagcactcctccgccgcggcgtgcgtcgacacgagcagcgcccgccgcgcgcccagccgcagcgacaccaccggcgccgcccccacccgcgcggcgacctccgccagcgagcggtgcagcggcttcttgatcaggtgcaggtggccgagcaccggcatcgccggcgggctcggcgccgcacctccatcacccaacctcgtcatcacaacaacggcgaccatcaagaacagaacgccgacgacgacaaccaggctagcgtcgccgccggtcaccgctgtcgtggcaacctcgagaccagccatcatcgtcgacggatccgggaacggcaagaacactctcaggaagcgattcctcgaggaagaagaagacaagaagaggaagagcccatcactccaattgatgaatggcccatgccggctgctggccgccatggctgaggtcactgtcagctcagctaagcgtcgccatcgaagctgctattccgtcaatcgaatggaggagattgacatttggcgcattctagacaacttcccttttttagaataatggatttaaataaaacctagccacttctagacaacttctaattttgtaccgaaactgtggctggcacgtcgctgctcactgacatatgggtccgaggggctgtagggtccacacgtcagtgagtaatgctgcagatgacatgcatcctcgctatctatggtgtcctattttattcagcttaaccgtgtaactacttactaagcagacatgtttttttcatactgtttaaacggtgtatttttaaaatattatatataaaaataatacttagttaaatcaaataagtcaatttctcaaatttataatgattaatacttaattatattgtacgctattgacacgtcttgtttggcttgcaatgaaaaaactcaagccaacaccatatttaaacgcaacatagaagacatcctcggaacgtagagttgaatgaaatttggaaaaaattcaaggaaaatgtactagttagccaattactgcaaaaattacttttttattcaaaggaccattggtgattatgttaatctcaaaatatattggcccagttttctagaggtgtttatagggatagtgtgtgcgtgtgtgctcatagaagcgggtgtgtacgtgttgttaatgtctacgtttgtattgtgtttctaaaaaactgacaaaatatccaccttaaaacgacggatcatactttagaggagctcttggtgaggttaaattaatcaacgtgtgcgtcaatggaaaaaaaatcaagattagagctatggatggacatatgatcaagctacggatgaactcaaactcaagttgaacatttacaattaatgtatataaatggacatatgactaattatacctactgtagaatgggggacttttggtggaatttccgaggagttgaactaatttcgtttgaaaatgctgtacaagttcatgtgtttcaaaggtgctttaaagccttatccgtagttcctaaaaggttacgaaattacacaattaagatggatgtatgaccggttttaatggcgatagataattttggacggcactgcaaacttatggatatcccttgcttcaaagttttcaactacttcctcgcacagtgacttatactaaaatgaagctattttttcaccttcatcttctcttagccaagcataaccattctcttcaccttgtttctcatctccactaatcataatcttttttcaattatctctacctattttttaatacccgtgcttgtaaaaaaataattacattatgggatggaggaagtacatattaggcgtaagcaagtattttgggccttttgggccagatgagaaaaaaaatgtattttgggcctaaaaaaaagtggagtagagaccatatgcatgcctataggcctgaaaagagaggcctgattgcagttttggggccaaaatgaggaaatcttgaccccaaaatgaactgagatttcaagtgaggctttgttttcctcctaggtgaactttggctttttaattatgttttatttaccataaatcgagcatcaatttccctaaagtagtacttcctccgtttctggttataagactttctagcattacccatattcatatagatgttaatgaatctagacatatccgtttcaggttataagacttccgtcattaacatctatataaatatggacaatgctagaaagtcttataacctgaaacggacgaagtattaccataggttcaaaggtttctggattgctttgtttataattatcccagtgattttgatctcctgtcctttaatttgaagtgcatgtattgtaattaaaatggtataaattaacctatgaacacgagagctaatgaccgaatatttgactatttggttgaaatcaattacacaaaacaattatttggcgtgacagatcctataacgtatcaaagaaaaaaaaatttctagagacttttgagcacagactccatctccacacgtggtaggcacatggccatgagaggcacggccataggcatggtgagcccagaaccttcactcatatcaaccttcttctttccgacgcgctcccactgaaagcattgtatcataacccctagcgccatccctaccgtcctaagagcaaggccttcaccggggcacttccgcctccccataccgaagggcatcatccacccacttccatcgactttgaaacccttgaacctctcgggtatgaacttgtccgggtcctcccaaacacggggatcccgctgcatggagtacacgtcgaccaacaccatcgtcccgcgtgcgatgacgtgtccagcgaccatgcagtcacgtgacgcctcgtgcgggacaaggtgcggggctagagggtacagccggagcgtctccgtgatgatgcaccggaggtaggggaggttagcgaggtcgggttcctggaggaggcgggacatgccaacaacagagttaatctcatccgttgctttcctgagcacatctggattgttaaggaggagagccatcgcccactcgatcgtgcttgctgatgtgtcagttccggcttgtagtaaactctgtatagttacacacatgttgaaaaagattaaatttgaatatagaagcaacaaatttcaatggcaacatggcttaagcctttggtagaagtgacatatatgtcaaagatcattaccaaaaccattaacttaatcaatgctgaatcattgtgactagtaaataaactaaacactcagtgtgtactacacatcagactgttgacattaacaaaatggctagtgtgatgcatcatcactgacgactaatgccatacatgatagctttctttatatttttttcttgttaaattatcattcattcaagtactataaacagtgaaaccaactcaattcattttcaaacttataaagatactactagtatcaaccgtacttaaaaaaaatcactgaattattgccacaaattaattaattagctatagttcgcagtgcagtacacatcggcctcatttcgcggtgatgagatggacgaattttttgaccgtccgattgaaaatcgacggctaggagtactctaccacgtggcgcgtgacgtcactctgacacgatgcatgcgaggtggattatactattggagtacgtaccaagcagacggtacggatgacctcgtcggcgtacgactccggcgagctctcctgctgccggagcaggtcgccgatgaccgtacgccgcggcggcgaggaggagaagtcatcggcggcgacggcgaggcgacggcggtggcggcgcctgtactcgtcgacgatgcgctggccgaagtcgtgccgctccttggcgatgccggcgagccgccggcgggctctcccgaagtccagcagccggaggaacgggaggaagtcttgccggttcgccgcccccgccgccgcgagcccggcctcggtgatggccttgaaccggagcacgtcctcctccgccatgcgctcgccggcgaccatggacatgatcacgctcgccacgaacccgtacgccgccggcttcacgccgacgacgacggccgacgccgccgacgacgacgaggaggacgagtagagcctcgccgccatggcgcgggcctcggcgtcgcgcgcggggaggtggcggcgaggcggcgggcgcagagggcgtggacggtggcgaggcggcggaggtggcgccaccgcgcgctgtgccccgccgtggcgatggtggggcagccgtcggtgagcagccgccgcgacgcgagccccgggcggcccgcgagcgcggcgtcgtgcgccgtgaagcactcgtcggcggcggcctgggaggagacgagcaccaccggcctcgcgccgaaccggagcaggaggagccccgcgccgccgccgtagcgcgccgccagcgcggcgagggagcggtgcagcggcttcttgaggaggtggaggtggccgacgacggggagggccggcgggctcgggatgcgccggccaccgtcgccattgggtggtggagcttggtaggataggagatggaagagaagccatgtgaggaggaggaggaggagaagagaggcgaagacgaaggcttgtgagatctccatggacaaggtgaatgaaactctgcatgccatggagctcagaaatcacaatggttctggtgtttatgtagcactccctccgtctcactcccaaagacacggtcgaatttgtcatagtcttcaggacaaatatttgactttaaatttatcatatattataatatttgtagcaacaaaatcataaccatatgaaagtaaatttaaatgataatccaatgatattattttcatcaaataaaatttaatttataataagctatttattagtcgaatatttaaaagagttgaattttaaaatacatgtgtgtcttagtgagtgggacggagagagtagggtattgctggtctttaatttaatgtggtgccaagagtatgtaaaagattgaaacaatttatgatttgagctatatatttattatttgaacttatgttaatttagagtgggtcatcagggtttgctttcttcactatgattggctaactctgatcatggctttatttatactccattcatcttaaaatataaatataagacgtgttttatttcgataggataagacttcggccaacgattactctattagggtataatttttatgacaaaaataaattaaatttgttagatttatatctaaaaagtcttacttacgatcatagataaccaggccagaagtacttccattatcttaaaaaggccatgaggagcttagaatagacaactcacatgcctatccatcctaaaaggatattaaaaaaaccccaaaattatgccaatagtgatacgaatacttgtatatcacaaatacatacagtttttcagaacaacaacttacttattctccatgagcatgtttcccaacctgctgaaccgtgtgtttcatgaaaaattttctatatagaattttcagtttataaaaaactttgaagttttttaaatcaaataaatccaatatttagtgtataataattaacttgattaatcatgcactgatgacttatctccctctcaataaaaaatctcagtttacacgctgaaacgagctcatgcttagctttaatttgagaagggaattttcctttaagaaaataatctgacaaaacaaattatcctaagcaagaaatggatacatatgatctctgcaatatccaggaatgtttccaatcgtgcacgtgggaaatgctggcattaggatagcataaatcacacgttttttcatcagtgaaaatcacacgtttttggagagatatcgagagccatgcatatccatcaatccatcatggaccatatacgcgttagggttcaggggcccgttgtgatgcgttcttgcaccagctgggtatgattcggatctatctgaattctgatgatgatctgtcggcgagatgacgtgtacctatgccgaagttgaacattgacatgcgtactgttgttgagtgccgactccacttaattaccactgcctttcacattgtatatttggtgttgagtgacgcttgtcttattatagtattcagaatattccaatatcctaaaatataatataatataagtatttctaattataaatttagataactgttcgtttaaattcatacttaaaaaaattatattttgggcggatgtagtacaaaatatgaaaaataactatgcatcctcgttacttttactcctcaaattttgcaaattgtctaggtagtaaagttttacgtggttactatgtgtaatcactttctacgcccacatcaacgattgagaataggtatactgacaatatatcatatagaagcaggctcaacttggtaataaaccctgagatgcgcgcttatgtggttttattgtgagcttggtccatcatggtaaaaatttgtccaaccccatgggctttcaattatagcctatagattgtagacatattgttgtcctagctggcaaaaccacttgtcaaagctttcacatacgtgacatcactggatataaccactttagcagttatatagacatgattgcaaagtttgatgtaattatttttcatttcaaataatatatatttcattgattagcaacatggaaaatgaattattgttacgaacagatcttccaagagctagacgaatattcccatatccacaaatataagagagacttaaggtttcattccgactatatttaggaggaaaaaaatataccccttaataagtaaggggaagttagagagtgtgagagttggtgagagcaacgttacgaaaaaaaattgagaaataggtgattggattggtgagacaaatagtactcttaaaatactttttatttttggacagaggaataaaggaaaaaaaaccctttgtatgtagacaggggagtggtaactattttggccactatgacgggaatcttgaaacagctataccatgttggtacagtgcccactgccaagaggactttttgtctcaaacttgactcgatccgaccgtccgattggataataatagagaaaagcgtgcctgaaagctggctgccacagactgtaatcaatctctgctcctcaaagatgaacattgcccggtgtgtttttcacgccaaaattgaaagtttggttgaaattgaaacgatgtgacggaaaagttgaaagtttatgtgtgtagaaaagttttaatgtgatggaaaagttgaaagtttgaagaaaaagtttggaactaaacaaacgcccaattgaaggagcagaacatgcatgtcaggctgtcagcacaatattgcatatatacaccttaattatagtgcagtatttagcacagtgtacatttgcatttgtttcattaattttggccttttcttgtttatctctgcttctcctgaagagaagcactttgtaaatatattgtttttttttgtcttgatgttcaatggaatactagaagctctcttgctatcagtttcgataaaagaaatattttcgttttatggaacaactagtatttttccaaaaaaaacatgtatatcggtttctttctcaattttatttcaaaagatatatgaggcatgcaatcaaattcataagtttcctcttattattcatccactattgcattatggtgccaagcttatactatctattctcacatattttactttttactgagaggactttcaagttacttaagtattcctatgcaattacaggggctgacctggactaagtaatctaagccaaaaaggcacgtggtacattttggtgttgtttggataatgagaaatggattaatttcccacctatctgtaactttttaatcctaatcattcattctttccacctcatttcatccaaacctttattcatttcctaagcccattccacatctcatatcctgttattcgaacgggcccttctgagttttcaccatactagtggcccaagctataataaacatggcccaccatggcccacggactagtttttgatcttcattggatgaacagtgatgtcatttcgaaaagttcacttcagatccctctcttgattggatctcatccctcaaccgtaaaatcgggtacatcgcatctctcattttttttttcaaaatcattgcaaatatagtctcaaggaggttttggatggtggtttgccggtttcaagtgacgtggtacctacgtggcgtgttggcttggtatttatctaacatgacacctaaaaataaataaaacataatgccacccatgtgtcaatcacaagaaaaccatctatattcaatgaaatcggcagctcgccgattcgttcaaaaaaaatcataagaaaaaaagagaaaccacaagctcacatatcagttggcattttctagccatacttcagctagtttcgcagcctcggcttctcttcctcctcctccgacatggctagctagctccaacctcgtcctcccagatggcatgcaagagtggcatttggggttgttcattttcgaaggatggcatatagtaaattctcctcgaaaccccttctcttcttaatttctcgtttcattgacatataatccccactcaaccatgtagtacaaaacaaccgtcgaacccacttgagaaaacaaaatggaccagtattgataattgaggaacattgtatacccggtttcacggttaagagacaccgattgaaactgatcctcaaatcgagggatgcaatatagaattttttccatatcatttttgcatttccttggatcctgggttctacttctacgggtcaaaaacaattgtcctgaaaacgcagcaagtttcttgtactccgtgcaacaaaaaaccacacgcatatgtctcacgttgctgatccacctaaagtctcttgccacttttaaacatcacacacttggagttgagcagttgactctctgacaggtgcgccccccgacgcaatccaagtccaaaaataatactacctccgttttttaatagatgacgccattgactttttctcacatatttgtccattcgtcttattaaaaaaattacgtaattataatttattttgttatgagttgttttatcacttatagtactttaagtgtgatttatatcttatatatttacataaaatttttgaataaggcgaatagtcaaatatgtgagaaaaagtcaacggcgttatctattaaaaaacggagggagtactaacaataacccaatggtggaatattgaatacgtactttccttttccacccacggaaatattctacgcacgaaagccgcacacgtgtttcccgcgaccgcgccacgtcaccgcaaaaacaaaaccggggggagccacgtgtgcccacttccggatagattcacgccgacccccctacgtcacccccgcgggccccaccacagccactgacacgtgggccccacgagtaaccacctgttccgctactagaagtatagtaggcttcgcggcggtggtgggtaaaagcatagtgagctctcccgtgccaccgacaggtgggccccacccgcgcggcggaaggttctaggctctccggcgaaggttctggaaggttcgggaggaggggggagatgattctgtcggcgctcgcgacttcggtggggatcaacctggggctgacggtgctcctcgcggcggcgtacacgctgctccggcggcgcccgccgtacgtcgccgtgtactcgccgcggcggccgtacgcgccgccggagccgtggctgcccgcggcgtggcgccgcaccgaggccgacgtccacgccgccgccgggctcgacggcgtcgtcttcctccgcatcttcgtcttcaggtcccgcttccccgctctcctctcctccaatctcggcatacacgctgctcgctttactatgggggatggagattgacgaggtgatgggggattttggtgttgtgcagcattagggtgttcgcggcggcggcggtggtgggggtgggagtgctgatgccggtgaacttcatgggggaccagctgcggcagattgacttctccgatctgcccaacaagtccgtcgatctcttcagcgtctccaacgtgcaggatggctccaacaagtgagctatttcgagcttcctgatgcctaatttttgttcgcggatttagggggttttagtgggttttgtgtgattgttagtgcttcaaggtggatacaattgtttaataataataaattacgtgccagttatagattaaattctcgttttcgtattaggaggatgaatctcttggattgttttaatgaggttgagtattttgtttatgctagtggctattgagatgttcagagtatgcttcactgcacagttttagcttaggattgctcagtttggtgagcactttgatggttttcttttcctggccactagtctatttataaagcatgatttgtttttctcattggttccttatttttctgaaattctaatttgtattttctttgttttgaaggggcaaagtgctaactgcatgaaaaaaaacacagagattcactaattcacctatttgatgctgtctcgagaaaatgcgttgaatctctctcataaaagaaaaatatttcttttagtagtatttagaatttgatgtcggtcatttaaaatccaacggtttcaaacatgggcctgcatgcttaggccttctccatggctccaggctgatgcgaccattttgctagagtgttaagttgatttctgtctggaatttatcttcattattgggctagcaatgcatagcatactcattaccggtggtaatgtggtgaacagattgtggctccacttttcggctgtgtacatcataactggaattacatgctacctcctttattatgtaagtaattgagtattttgcttctttttggctacctactcactgttttcaaactaattcaacattttacttccctctcttatatttgtgctagacctaataatttgatctattttcttgattggatacttcttcagtcaaactcatttgatatttcagttaccataccatgcatgcttgtcagatctggcattcatttatcaaattcttctcgttgaagttctgctttgctgctttcctgttttcacatctttatgtacacaatggtttatgttagctctttgcaggaatacaaatatatttctggcaagaggctcgaatattttatgacatcaaaaccactacctcagcatttcacagttctagttcgagctatacctgtaaccaatggtgtgtctgtgagtgatgctgttgataagttcttcaaagagtaccattcatctacctacttgtcacacactgttgttcatcaaactggcaaactccgccgccttcttgtaagattcgattgttttgctactttctattgcttcagtatggttaacatcctatattttatccatggttccaacaacacttactatatggggtgtctatagattgacttattgcattgggtacatgttgttgtattgaaagtagatagtgataggtttgcaaggcttgcattttgtttcagttataatcaatatgttttgacaacttattagtcctttacttaatttcttgtgactaaaacaactcaccatactggaagttgctattttactttcaacatgtcacttctaactctatgttattagtctgatatatacatctagtgattatgtcgaaaagtagattttagattaaacgtggagtcacagaattgctcctttccattgtttcataaataaaatacagaaagtatctaatatgtttctgcctagacatgtcaaaaaattcaaggggagaatatatacatcagttgtgatcctcatttgaaagttgtccgtatcttatttcacctttcaacacgcagatttattccctttttttttgtcatgcgaacaattttgtttatcctaaatgtatcttaagaaatggtacaccagtagattttcttcatcagctggaaaactaaacagttccatctctacatttagatcaactttataatgtctttgttctatattgcttaatgtaatctccagttccattttgatagttaactccatctctgtccagaatgacgctgagaatatttgcacaaagcttgccaacttgaagtctgtacggcgtacttctggagatcctccaggaaaatttcttggaatatttggcagaaatgatcttgttgggaaatatcagaaaaggctggaggacctagaagaaaatgttagaatggaacaatcagacactactaggagcagacaggtgcatatttctaccaattttggtcttgctcaaaccatgatgtttcaatatctccctatctgtttgttatactgcattggaattagtatttggctctggtgctcatctttcagaaaatttatttataaacatttcaatattttgtcatctgttctgattttctttacatctctttaggaagttcccgctgcttttgtgtcattcagatctcgatatggtgctgcaaatgctatttacataagacaatcagacaagcctactgagtggcagactgagcatgctcctgatccccatgacgtttattggcctttcttttcaacatcattcatggacagatggatatccaagtttgtagtctctgtagcttctattctcctgatactcgtctttctcctagtttcggcatttgttcaaggactcacctatatggaacagctagagacatggttgcctttcctgagaaatatactggaaatgttagtgtttatccatcta

SEQ ID NO: 72860 - DNA, 13661 bp, Oryza sativa
caccgcggtggcggccgctctagaactagtggatcccccaaatagtttgggattgatcggtaataattaatgcaacaacacactttcatatatatgtatacaaaattaaaatgtgtattaaaaagtacgcaatactacctgtataccaaggcacggtaaccttttgttgtaacattgtgatgaaactttatgttgctgttgatgtccatcgagtaaggcatatctccattgtggcaccttaaccactcatcgacacttccctaattatttgttagcataaagagataaaataagtaggtagaattaacattaatgcaaaatgtatcctggcgaatagtaagttgtatatgaaattttaccatctttatcccaagagcttctcgtgtgatgttgttgttagcccaaaaatatattaaataattgccatatgtctgttgctggaagaaattaggaattaatggatattcatatacaacttttggtggcagtggcacataactatactaaatggaaatgaagtgatatacaagtgtttatgtatgttcggagaacaagggcgcatgcaatgttagagcagtcccaataccagactgcatcacctagtcactggtattaatattaggcttagctcacccaatgcacaatgtttaaaatggtccaaataatgtaatttcatcctctcatttttttttcttcttcaaatagctctttcttttcaattgatgcttagactctattctctgctctattagttcatacgaggcaaagcttttgccctcttttcaaaaatgcttaattatactctatatccacgacccaacgagcttggctctcgtgaaagacctacatcatgcccctctctctctctctctctctctctcattgacatacccttttctttatccttatatccccatgcatggccttttagcctcagattatgattcataaattacaagggatgtttgataagttaacaataatgcactctatataacaattatctagccacttgtagtgatatgaatgaagccaatacataaggctgacttacaatacattctcttggaggaaatggtggaatctttcgtttttcctggatcgatccatctatatcactatcgtaaatacaatagttgtacaagatatgtccgccagaactttcgccaagcagctgcagatcgagtaagtaacatcaatttactaagggctatatatatttcaaaatatttttggcatatgcattatatatagaaagaaatattggaacatacttcgttaaacctatccaaagcttgacggcaaatagcattcttggggttgctataatcctctccttggcagtgctccattatcgtcttaattaagatcaatcacatgtaggcacattgagacagcagtcagcataggttcagttaatttctagtgaggtcatctttgattaattagtgtgaggcttattagcgagattaattggaatagcgtgttaaagaattatttgattacctcgtacaactgatctgaaatgatcccaactccatgagcatacggcactctcgaatcgaagtcaatgctttcacctgtaaccggattacctactagatagccctgcttgttatcacaaaatacaaattgatgaccatatatacaaaaataaaatttatcacgaaggatcacactatataactacatactacctttatgatgaaatcatgtttgatatgtgtgatgaataataggcaaaatgggttattgtttagactaatgtggatcaagatagtgatcagaacttgtttccgaaagatgtttctttttatttgatgtgcatgtgaagctaggaagcgaattataagcaatcataatgagttacaagggaacgggagactaggatgcggtttccgagatcagagtcggtcaagagatgtcattagatggccatgctctagcttgttgtatgaagatagaagacatggaacgggtgtgtgttctacgcaattggctccgtgctattctgacatggtggagttggatcggttagtgggtcggtagtttagtttgtgatgagtatgagcttatgagttcatatgggttaattgggccaagttcttttggttatcggattgtcttataaaacttataaggagacaaagagatatgacgggaaacagaagagaataaattcgttttttttaaatgtatatggccttgttgaactttagaaatggtatttgacctattcatcttattaaaagatacgtattatttattttgttgtgacttacgttgacattaagagtacttaaaacataatgtgtatttttttactaaattttatattaagaccatggtgaaatgatacatctaaaagtccatataacaaataacatcttatgctttaaatgaagggagtagtaattaaaaaaatgacatgacttaggatgcgtcgcaagccagcatacagtacagaacagtgcacacggaaaacggaacggtccattagcacgtaattaattaagtattagctttttttaagaaaaatagatcaatatgattttttaagcaacttttatatagaaacttttagcaaaaaatcgcaccgtttagcaatttgaaaagcgtgcgcgcggaaaacgagagggggaagttgggagcaggctctcccgaacacagccttagttatattgccattagcatatatagaaaaaaaaacctacatatgatatgcgggatttctatatattgatgtttattaggaggtggtgatgcttgaatcttaggtggtgtttggatctagggacttaactttagtctctgtatttagacactaatttagagtattaaatatagactacttacaaaactaattacataaatgaaagctaatttgcgagacaaattttttaagcctaattaatctataattagagaatgtttactgtagcatcacataggctaatcatgtattaattaggctcaatagattcgtctcgcgaattagtccaagattatggatgggttttattaatagtctacgtttaatatttataattagtatccaaatatccaatgtgatagctcatctaaacagggtcttaggctaactagtcctctaacttaggatataatagtataagtaagactctgggtctttctcatattgccactagcaaattaactatcgacaacaacggcacatatatactccctccatcctaaaatatttgacgccgttgatttttttaaaaatatttgaccgttcgtcttattaaaaaaatttaagtaataattaattattttcctatcatttgatttattgttaaatatacttttatgtatatatatagttttacacatttcacaaaagtttctgaataagataaacgatcaaacatgtttaaaaaaatcaacggcgtcaaacatttaggaaaggaggagggagtatattagaacataagaagtggataataatgtacctaaataaatagtattgtggtgaccatatagtattggtgtacgtaccttgagatcaacaattggcctcaccccagcttcgatatctgaatacgtacacaccacatgatcgtgtcagaaaaaatgtaagcgcgcagattaattaagcttaatttgcacactaaactaacaaaaatctcctagttgcacgtaattaatggtgcaattaagtaaataattaaccttcagagatcttctgcgcgagaaatgggacgatcttccctgcgtaggagtcacctccaatgtagaaaggatttgcgagatactccggatgatcactaatccactatatattaatcacaccaattaagcaggttaatcatctcaactcgattgactaaatcaaaattaattactattcccaccatttcatcgtagtccaagtcaatttaactttttttttcaaacttatttagatttgactaaattatagaaaaaaattaataacatatagaacaccaaattagtttcattaaatataacactggataaatatttttataatatatttgtttttattaaaaatactactattctctttataagtttagttaaatttaaataagtttttcctaacaaaattaaataagtttgaattgaaaaaaatcaaagagacgtctaccagaagactactactacctccgatctaataaaaattacattatatttatagagaattgaggacaaattcgtagaattaataaatgaccacaataaccttatttaattaaaaggaattttgagacaacaagttagagaagtgattggaaggaatggagattagaaggaaatatattttgatgtaatcaatttgctgggttccacattagtagaaatataatttttgaataaagatttaaatgtagaaatacaatttttatgtgacagatgtagtagtactaatatatatgatatatatgatatcacatgttgtgtatagtatacgtatagattaattaattaccttcgcgaggaagtgcttgagctgcagcgaggcggagacgtcgccgacgaggtagccgtcggggtggcgggagaagctccagccggcgccgaccggcgagtcgacgaagaggacgctcgccgccttggtccagccgtgggggtggtacctcagccgcgggagctcgccggcgtcgtaggggcggtggtgctccaaggccagcctcaccgggccgacctcgaagaagacgccgctgagcacgctgcagcgggcgccgccggtgagccagaggaggagcgggtcgcggcgcgggtcgccggactcggactcgacgaagtagtagaagagctccgcgccgtgctcctcctcgtcgacggcgacgtagcccgtctcgaggcggaacgggagctcgccgtcgtagcccgggagcgtggtgacgacgtggtgatggctcgccgtggcggcggcggcggcggcggcggaggtgggggtggagtgatcgagagggcaggttgggagagcggagaggatggagaggaggaggtggtggagacggaggcgcggggacatggcggtggatgccggcatgtcgccggtactgtgctccggtggacggtggtcactgtgtgattagtctgattatccatggaaatggaagtaaaatatgtagtggtcgtcggcttaggttttaggtaatgtaaaaaataggactgctactgccgtcaacattaaaatcatgtcaattctgaaccattccatcgtgttgagatttacgcacaataaactcccccgtcctccatattttttttctgaggggactacggatcggtagtccgatccaaatgtgtaaaaatcgggcgcgtcacacatgcgtgcaaaatgactttaaactaattttctcttaaattacttatccaaatcttgatttgattgcaccattaaatttgttgcaattaaatcttcaaaacaagaccacacattgatatattccggcgaaattttttttagcttattattgaattttttaaatgttgcacgatgttccaccaaatatatcgaaaatgtttcaatcatttaaatcaagcgttgtttcaccttatataaaaacaatgtttcagcaaatagcgaaagaatatttcaattccctacagcattagatctatacatagtgaaacattgtgagtacactaggtgaaacatttttggtggaataaaaaatgaaacgaattctctaatagagggtttccaaaatatgtgggtgatttgttgcaaaagaatgtttcgttcattgcaacattagatctatacatagtgaaacattgtgagtacactaggtaaaacatttttttgcaacaaaaaataaaacgaattcccttaatagagggtttctaaaatatgtggatgatttgttgcaacatcgtgcgtggtggggacacgtggcagtgtggcagggaaaacgtggtggggcccctaggggcgtgcgcacgcgcgtcagggcggcggccaatttttgctgcgccctcccgagtgctcgataacgagcattctcgttttttttttcttccctcgtttatgccaccaggccaccaccattgccccagtggtgtcacggcaagccccaccagacctcccccgcccctcctccttctcaagctagcggcgccgagatgtccaggcacaccgtctttgatccatatttccgacggctccccatcgccacccccacctcctcgctccgcctcctcccacaaccatccctctaatttaaagaactacctcccctcacctcatcccacccacctcccttcccttgcccgtccctaccctgaaccctaaaacctaacttgccgaaccattgtcaatagccaaagtttgactggggtcattggatgtagagtaggagacctagcatgaagcaaaccctacaatgtcataattgcaaaaaaaaaaaaggttaattggatccatgccattattattttcacggttttgaaaaataccactactatttaactatttgaaatcatgccattacaatttaataggtatttgagatgcgccactatataccctttcattgcacttagaaaatatttttgacaaaattgtccatatcttcctcctgcaccccgaagagcatctccaacagaatctcaatttggctcttcaagttaaaatttggccaacgtagagaaaaaacaagctccaatagactctctatctggatggtcaaattgctccaccgctggccgaatgtagccagcctcctccactggccaaaggtgggtcccaccaccactcctaaccccatccttcctctctctgccgtccacccactagcgcatcggccgggggcgaactggagggcacgccgaccataagcgcgctgccgacgtctgggccaccacccgtcgcggtgtcgtcatctaggccaccgtccgccacgactgtcatcttcgtcgctgccgcaccacggtcatggacgagccgttgccgccgcgcggacgtcgagcgagagcgcgtcctcgacgtcctcatcgacctctgacgaggaaggatagggagcaccttcgggcggtggcggcggcgacagcgagggctgaggaggcggagggggtggcgaggaaggacagagagcacctccgggcggcggtgcttggaggaggtggtggtggtggtggcggcggcgagggccgaggcggaggcggagacggacgagggcataggggaggggccggggacaggaagaggtggcgagcggagtggcccgatgagcggagcatcgcagcggcggtgggggcacaagccttggcaccatgggcggcggccacgctgcccctcctccgccgccacgggggactacctcaccgccgtgctctcacccatgctcgtgtagattctcgggaaaaggggagaaaatgaggaagaaagagatgaggctgacatacgggtcccactgccatacactcaaaatagagaggatgaatggagagactattggagtaaataacaaatttgacatgttaattaaatcgagaattaaccaaatagatatttggagagtcagatttagagagactgttggagatgctctcctctcccattcatcttttcccatcgatggagctagacccggatgacgcaggaacatttcttcgtcccgatctcctccgtcgggcatcaacttggcgtaggagacgttagccccaagcggcaatcaaggcgaggaggacgctcaccgtgggctcggccgacagagatggtttcccgggtattggtagtgaggccggaccaaaaccatcagcggaggtggtagccacgccaccaaatgaggaagccttcctcccacaactgacgaggctggaaaccatctcccaccacaccaccttcgcacctcctcttggcccgtttggttggggagagtttttaggagggattggaagtttagagggatgaggctattaaatattttgtttggttaggagacatggaaattttggtgggatggggatggggaattaaggaatgaactccctccttttcaatacctgggtagggggtcctttacttcgcctaaacaaatctcagccatccgttttcattaataacctaatctctaactaaactccctatcaatttccaccacctctactaaacaaggtactgggatgaaaaatcaaattctcatcttaatctcaccatcaattccctcgtgtaaacacccaatcccattccctcaagttgccaaacaagccgtctattctttcaatcaatctcttcacagttccgctgcacgccaactgtttgtgaaaatgctcaccaaagcaaggatccctcaattcccaggtgttgttgcacaatgcccgtcaactcctccagcgctgctgctgcatgctccccgtggccgagcttgacgatgcaggcaccagctctgcttttgtgcctgggcctttgtgagcctctgtctccgcgtaccttttcgtgccaccgggcctctcaaccggagaagcatcaggaacaagatcaggcctgtttaggggagcttaatattctgaaaagcattagtagccagcttctaagaatttaaaaaaattgggtttggcttctagtttattttctgaattctatagcttatcaggatctgaaaaaaaaaactggactgtttgagggagtttctgattctgagagaagctgcagcagctaaaagctcccccaaacaggcccttagagagagatggtaggagtggaaagagaaggggaagaaggaacacggcatgggcagtttggtccaaaagaaatttttagtgcggtgataggaaatttagtggcacatattaaataacccattaaattgtagtggcatgatttcaaatagttaaatattagtggtattttttaaaatcaccaaaataataatggcacgatccaattaacccaaaaaatttaacgccaaatttctatggaatatgattaatttagcggtttcttttttttttagttaaatttagcagtttcgataaaacagtagatctaatcctggttagcctcgcaccattactgagacgggaggttgccgtcgccaacgtaagccgttgttagcgaagggaacgacgctgatgagtatgttccattgtacggacaatgcgggttcttttagcaaattaccagtcgccactcccatcaatgatagcgaccacaatgacgaactgaaattcctatttggcgcacacgcgtcagtacaccatgtcgagcacacatttcgggccaccagaccacgtgtcgtgttaccctttttgagtgatttttggctcacctggcccactagtccacgtgtcgtgtttcctttttttcgacccaacgtggccatgtgttttcattcctttttttttcattttccaacattttaatgctcttggttttaaaacctaaactttcaactcaaatttaaaaactttcaaaccaaattttaatacttcaactcaaattttaaaaacttttgactccaatttcaaaactttaactcaaaattcaaaacttttgaatcaaatacaaaaactttcaactcaaatttataaattttcaaatcagatttactttcaactcaatttttaaaactttatctcaaaaatttttaaaaagtctacccaatattaaaaaattaaagttaaattatgaaagttttcaagtcaaatttgaaattttcaatttaaattttgaaacttttaatttcaaatttaaaactttcaacttaaattttaaaactttttgattccactatttatttattatttgtttgtaactaatcacgctaaactagtcgcacttaggcgctaaccgccctgcttagcgaggggggcgcggcccggggacgcgtttgtacatttccaggtcgcggcccaccagatatccgcgagagttcaagacgatgggtactttggtccagatggaagcgtgggccggcccatctgtaattattgggcccatttgcattagttgcaaggtacgtcaggcccactgttattgttgggctctgatgcttgtaaaacagacgcctgtctgttcatctccgaccgaccgacagcaaattaaaatcaatacaaaatcagcttgatttgggattatcgcatttcagacaagtatatgcatcacaaattcacgatgtgaagatagaaatgttctccacgtccaaagaaaagcaaccaaaaaaaacagaagaaaagagagcaagtttgccaacgacattgatcatcatttcattaatctctctttgtatttcctttgcttcaggacgacacagtcagggtgttacaacaaatgaaatgaagattacatcagttgcacttcttctcaaacagctaacccttttggaagtcactgtacagtgagtatctcctccaatccccaagtccatatttctctatacgtttgagatgttatgatggtgtttaaaacggccaaattttggttatctttgtcatgaaaaactcttgcgtatagttgtgatgatctgatttggcagctcggtaccccgcaggatgagatacaatacaaaagaagcataagcaagtactgccacgcagagaattgagccagataataggcctcttatttctgaagagaagaaatccagcaagagatagccattgatcgtgatcaatagtgtcgccactgtccaggtcacagcctgcataaatttgacacaactgagtgagaacagaacatcatcggctttacacctcaacaatggcaaatcaaagcaagaatgtcactagagcagtaatacgccatcatttaactaataagtcaaatagttcgtaggcatgctggtttgaagatataaaatgttcaatgcagatcctaaaagaacccagacagatacaggtgggaatctgggatatgtcctacagcattgctgatttagtatctatcatgttcaatgcaaatcctaaatgcagggatggctttttctcaaggctttgcagtggcagtggcatcttgcagcgaagtgtgcaatcatgagcagacagaaacacaagtaggatctataatttccgtaatagaacaccaaattaattgactaccacaattatttatggctggattatgctgtcaatggaagatatagccatctcatgaaatgaaggatgcagaatgcttgaagaacaggacaggcattatatcacagatcaatgacgacttacttgagtatttcgacctattttaaatacccccataactttctccttggaaaccaaagttatcagcggaatcagggcaaaagggatctgaattgattgaagcacatttagccactcgtttagaacatccagcgaatccgatttatcgaagaagagtgcgacaattatcgttggcacaatcgcaaagcttcgggtgatgagtgacctgatccattttttcaacttcaagttcaaaaatccacccattataaactgtccagcatatgttcccgttatggtactactctgccccgcagctaatagtccaattccccaaatgtagaggatagggaaaaaccctccaccaaacttctcctgtagatactgtccagcattttcaaggccaatattaccagcttcttttgtgccataaaatcctttcgcaaaaacagttgttacaaagagatttatcatgaaggacacagccaaggcgatggttgactctattgaatagtatctcaacgcttcacggacttggtgttccttgtttgggtctatttttctcgactgaacaagcgctgaatggagaaacacattgtgtggcatgataacacatccaacaaccccaactgcttgtcttattgtcctggagctcaattttgggaccaaaatacctgcagacaaaattatgcgtaatcaatgggtcaagagtgtgggacaattttgtagtgtcaaaagctgccgatcggtaggatctttacctatgaacaggttcttcatgtttggcttggtatcagtaaacatccatgcaaaggagacagccatagtcgcaattagaatcgcaaatacagcttctaatttcctcaccccgtagttttcaagagacaaaaaaatgaaactgaaaaaaaaaaaagaaacatctcgtaagtgacggtccaaacaaagatagttccacaattttcatgactttgaatactaattttgaaacagacctaacttagcaccgtgcaaagcacaaggcagaaatcctcacagaaactagcaagtgattaatattctaatccaattagtagtttttagtgctagtgaacatgtgagcacttgtacagacttctgaatcatatcattaatcaaagcaagggtctagaacgagatatataaaataactcttgatggacaacaacagaacatgtcctacttttatcagaaccaaaagtcccgtcaaagaattgcataagcacaagcagtgagtacggagttaaattaaaatacagtctatagctgtcagcagcatcaatccatcatgaaaaggtcagcacagtaacttggtactttatattccttcaggacaaacccaaaactatcataagcctctcctgacaaaattaagttaaattgaccaaaaacatcacatcattgagtaatcagcagcttggaattgtgaaaatgaaaaattcggaggtacaggttccgtgattatccatatttggaacttgggcattaatttttcatttctcatgaattcgcagccaaaacagatctgagactgtgttcatgtaaaatgaattggggcgaaagctaaaattcctcaagcattcaaccatcctacgttatagggtaccatgaatatgaagtctatcaatatacagtacagttatctccaacacagtgatcgtacgccgccaattttaagagaagtgaacaatcctcgaaattatgaaattaataaaggaagtactgtggtttacagcgaaatgagaagaactgaaccaacgcccaaaaaagtgaagctacaaattaaacgaaaacaacgaatcagcagcctataacagtcacagcaaaacctcccccaaatccagctcatgatctaacatcacacccaaactctttagtagcaagtagcaacaacacatttctttttttttctcaaatatactaagtatcaagaacttaaagcagcagcatttttttttcttttggaagcatctcaagttaagttggtgatagggaaaaagaaaagcaaacttctaatcttttggaactatggtgtgtgatctagacctcgtcaatcacaatcaccaaagccatgcgaaagatccaaaccaatcaggaatcgaaaccgacccaacaaaaaagaaaaaaaattcacaagactgaccaatccaaggcggtgatgacgacgccggcccagagagggaggaagccgcggctgaggatcttgatggcgatggcgctgccgatcacctcctggatgtcggccccgaccatggcgacctcggccatgagccacagcgcgcggcgcgcccaggaggggtactcgtcgcggcagagctcggcgaggtgcctccccgtggcgacgcccaccctggcggcgagcagctggacgaggagcccatggaggtcgcccacaggagcagccacagcagcgtgtccccggccaccgccccggcctgcaggtccccctcgaggttccccgggtcgacgaacgctatgctcatgaggatccccggccccgttaacagccgcagctt

SEQ ID NO: 72861 - DNA, 668 bp, Oryza sativa
aggtgatggtatgtccttctggccgtgatgcttcgtagctatcccaccactctgaagccggtccaaccagctgaggagttgcgaagccaacccgctcctggtcggtgcactgaatcaaccctagcttcttctcgattgtgcgcaaccaatcactggcttccataggatcgacggcaatggcaaggttggaggctcagttttgagaaattctgataacttgcactgttgctggactgtaggtacttgaacgttggttgtccctgctgggttgttccaattctgtaatagttgaaaggctgttgccaacatgttggtttggttaaccacaatttggattagctctggtgaggttttgttgatgcttttctcattcccactggcttgggttcttgagtcatcggatccatcattcccatagcctttgttaccagtgttatccatctgtcacaaggtagaggttgagaggggaagcagacaaggaaagaatggaccagaactagggacaagaccttaaaggaactaactcttcttgttgatatgttgtttgtttcacttattctgcaagttgattaagcaaacaacctagcatggttacatcacaacccaccgatgcaaaccacgcgctacacacacaagcaaggaacacacgactaacaacactaccctat

SEQ ID NO: 72862 - DNA, 1675 bp, Oryza sativa
aaggtcagccaaaggggcctcgttggcgctattgacgtcttcatactaatcgatggggtcgggcaatgacgcattggtgcagaggaggcatggttgagctgatgtcatgtgatgccatggagggaagagaaaaagaacaggagggttatggtttggagggatttacacgaatcttaaagcaacccgatgatctaaaatctacaagattgtaggggctcccaaaatttaactccaattaatcttggattagggccgaaacaattgatgatacttgttcatgctgatgttgctgaaacaatgtttctttgtagaaatgaatttacatcttatgttgcttgcttcatagagtagtgcgaaagagatgcgcacgatctcgcttcaatctgatcgcattgttgtccttggaaacaagacaacgctactagaacagggaaccaactcatttacctggcgaagtatgcaaggcgacaattaatggaggggatacactgaccaggattgggcatgcagaaatatgtgttcagagcacttcgggagatgctagcctttatggccatccagttcccaggctcccagctttgcgattggatcaggggagtgcaaatgcagtcatgtcgggccctggggtagagaggagcctgaagaacttgcatcactggctcactggctcactgcatcacaacacaatacaacgaccgcgaacatagttacacaatccacaagtactcagcaaatatgcaaaagccggatatggtgtaacactattgccttacgccagtaatctacgaagacttcattgttcccacaagagagattactagtttggcaacaagcgaacaacagattatataagacagcacatgtccagagtaacatttacttcgaataaattacaggctcgccctcaatacaggcgtacaacaaattgcatcgcatctaatctatagtattcgtacatggcatttatacattaatattggtggcttaaaaagggagaccttgggggcgcaatccaagacatttcttcagggcgattctggccttctctgccatcatataaccgtgcaggttgctccatttggacagtatgaaatgtcttgctgcacacatagagcattatctggcaacagccattgctaaccgcggtgacaaacttggccagtgtgcagtgccacatcgccatgctgatctggtgtctgatcctcacgtgaacaactctttagatagaagctgttgcgcaaggtactggccttctggttcctcaaggtaaaccttgtcagtcagataattctgtagattacttgcagcctcagcctgaattcgtgagccttgttccttcaaagcgggtaagaagcaccgcaatattacatctagaagtttcatgaactgtgatccgtatttcttgtgaagtgcaaaaccagcaacctgaacagaaacagaatccaagttggctacaacaaacctgctacaagcacacacgcataggagggatgggggtcttgaagcatatttttaccttgaggaaagcatgaagggcacaagcagttgctgtggtggccgggagagtattaaggaacatggcaagccatttccacccctcagctaagccatgtggatgccgcacgcccctaatttcggtctgtagaaaaaaattgcgggtgtatttcaattctaa

SEQ ID NO: 72863 - DNA, 10999 bp, Oryza sativa
ctacccgagcctcggctccggtggcggtggcggtggcttccgcgactcgcctacctcgaccgactccgaccgatggtcccgtgccgctcctctgcctccgcacaatggcgagcgtgagcggccacgcctagtgcttgatccgcccaagcgggatgcctcggctacccctacgccgcctcctgccgaggcggcacgcagccggccaagcccatttggcgccgcgaggccccgcgaggacattcttgctgaaaaagggctggactggaggaagatggagacagagattgatcataagactagccgcccaaccagctcacagtctagtaggccaggaagtgcgcattcgtctcttcctgggagccctggatcacagacatcagctgtgggtagtgaaggtgtgccgagggctcggccgaaggttaatccttttggggatgcgaagccaagagaggtagttcttcaggagaaaggcaaggattggagaaagattgatcttgagttggagcatcgtcgaattgataggtatgccataaatggatttgcctctttataacaaagtttaccttttatagtatgcacaactgtgcaattagcatttgtctttgaatgcaatactgatcaaaacaattgaatctttgggcctgtgaccttaacaattatagagtgtgtttagccatgacctttggctgctttatgcttgtgagttgtggtggtgcttaagtgaaatagctttttgcagaagcatttcggcagcaccttgcaatagttcaagtcagccagacattagttctaattcagctatgcactcttaagtagtttctatgcttctttaagcaaattaattttgcacagtgtttacgaaataagcgtggcattttttttttgtgcttgctggttatttcaatggttatataacaatgagcagttgtatgaattgaacggatataccttttttctttttttgctttgctttgagagattatgagaactgcatttacagcaataactagttatggtcttatggatagtaactataatgggaaacttgtattttttttcattaccttttccatttaaatgtcttcttattagtccatatactcccattgtaagaacctgggaggaaaaacttttattcctaatgaaaactggttgggacctgtgcatgcatttcctatttatatattaaccttttaaaggacatggtcaaattacaaaaaccataaagattccaagtatatgtaaatattaatattcaactgttagttatgccatctttttatattgcatatacaataccacactgtgctatttcgtcacatttggttgattaattggaatgcacgtaacaaactttaactcaatagtttatggaaatttcacttttagtagtttttttttggtgcgtgaatgtatagggtttgttcaacagtattctgttcaattattatggtaatctatactctattactaccatcgtgcattttactttaaaaatatagattcaatgatttatagttattgatgaagatgacaattgcttctggctttctgcaacgttttcctttcttactactttcacactatagcaaattgctcttgcttgcgtaactctgcgttttgaaatgtgtagtggtgttagtttattgaattacctcattggtcacccacttgctcatgcttgacactttgaatggttatggttgttacttgtcagaagcctgacagtttttaacctgtttgtgtcatgcatcaacaatcttgagtgaaatctctgtacaatggaaaagctatcgaccgtcaatagatatgttaaataaaataaatttcatctatgttcttgtgtatgttaattcctccagcattatctctaccttgttgtgtttttcacgaattttcaaatttactttcgaaatgttccagatctgtgtgaccaataattgttacctgccaggtgctgagattactgtggaactgaaattgtaatttctgaaccacccaagccctgatttgtaacaatacttgaactgtctttggtcctaatatgctatcatgtaggataatttatcacctctaccagatatatgtaactactaggaaagactagcaagatcatcggtaaactttttgaaccagcttttctttttgtggaaatttgtagcatgataatagaatattctggtggttcctggttatcaaatactttgactgttcatgcatgtttgcctttctttttaaccaatgccaatattctggtcgttgaagcatgcatgttcctatagtttgtcgtttcaactttcatatggtttgggcctttggggaatgattttcttcctgtctttatgctcagttcctggttcctacagtcaattgctttagcccttgccttgtggtttggacctatttacgtccctcgttccaataaccaatcaataattgctggtcatgcccaattgcaaaattaatcaattttacatttcaatagttatattgtgtagttttgatgttttaaaaatcgctggtcctactgaaatttactcgtgtaattttattgttttaaacatttgttcatggacttgaatgttgcagaccggagacaaacgaagagaaggatttgaaagaacagattaacctgcttagggtggatttgaaagaaactgaagcaaacataagtgacgaggataaaaaaggtttatcagaaaagttatcccagatggaaagggaactggagcgtcttacagttgagttggacaacaaggttcgatttgggcaaagacctggttctggatctggcaaggttactgcacatttaagtaattcaccagacgaatcacagattacagagtcaatggaacaaccacgttcccgtagcagcatagaccaaaatcctaaaccagcagaagaaaggtgggggtttcagggcaacagggacagaggctcatttggtggtaacagaaatacagacaggtttgtttgttcctactgtccatgatgcttattagcataaatccaactgaacgcgattaacattgatcacagtaactttgtcctgtattactagacatatctgtcaagtttagatcatttattaattttcagcagatggtagatgtgaactctttgtctacctgcttttcaggtcgttaacagggcagagatggtgaactcttctgccatccatggttttggccttttgagcacttctatcctcggacagatctttttttttcttcttttcctattttaaacaatgaacaaataagttgtcgcgttcttgttgctgcttgactcccattttgtttgccttggaagagtggaggggataatggaatacctcgcaggctcgctcaagggcccaagctattgtcacctccatggtgatgcttctgtttccttttatttttcctcttaattcccctttgcccctctcttccatgtcaaaacagtttgttaccaaactttaatacactaactattgttcttgctatttgcacaattatgtttcaacctccacatttaggcattgctgctatccattgttacatggaattctttattaggccagtgttcacatctgcctgtgcttgtgatttgttctgctgtttgtgtgtgccgtatgaacatataaaaaatatcgggttaaaatttccgttgcggttgtcattgttattttgccttctcatactacgtgtgaagctgaataatttagtgggaggttagctcattgctgtccctattaagtacccagaaaaactataatgtttagtcctcttggcctttcactacgctggaaggagtacaaattacaaacattaggaagcgtacacctgtttacaaagttgactatgagatggcaaatatatgttaggcaattagttagcttcctatcatgtttgctgcaaagttgtaaactgaacactccaacgagataattcccctggtaattggaagctctctggcaagaatgcatttgatttgatgctatgtttgggagtgggaccaattcatcaatttttgtttttcattttggatttgaatgcaaagataactttagaagctttcttgttccttttggcatccgctgctcacctgaccaagtgcacacaatgtacatgctgcccaatatactgtacatcaccataccagaaaaaagacaaactttgagttacagcaaccaatttattttcatattcgttgcacgtgaccaaacaaaaataagaaacaaaaggtacatataatttttataaaaaaggtaaaaacaaacacaaaattatatccgaggagaacatcactgtatacatttataacagcaagctaaagtacgcatttccttttttttttccgataacggaattcagtccactgaagctgcgaacttgcgtttgcagcaagacgatctacttgtccttcttgcgcttctcgacgacgaagaagaaggcgagcgcggcgatggagaaggtggagaagacgccggcggcgaccttgagggaggcgtggatgccggtgatcccggcgacgtcgaaggcggcgtccggcgagctctgcccgtaggccacctccgtgccggacgcgtccaccgcgtaggcgcgcacgaagtaggacgccgtcgggatgtcgcgcgccaccacgtagtcgaacctgccggcgccggcggcgtacggctgcacggtgaccttgaactggcacgccttgtccttgtgcaggtcgtcggaggccttgcgccacccgcggtccgtccggctcgccggcgcgtagcacagcttcaccttcacgctcttgaacgccgcgtcggcgcccgccggctccgacgtgttcagcgaccacgtcaccgtcaccgtgttctcgccggcgtgcacgactgctcaccaccggaataattttcccttgattagtgattagtaatagtagtactcttttcgtttcaggatataaaacgttttaactttgatcaaagttaaaagtttgacttagtttatagaaaaaattagtaaaatttttaacccaagacaaatttattataaaaatatattcaattattgatttgatgaaactaatttagtattaaaaatattactatatttatctataaacttagttaaacatatatttgtctataaatttagttaaacttgaaacagtttaactatgacggaagtcaaaacgtcttataacatgaaacggagagagtagtagccaaagtacatgtgacacttttaatctgattattttaacagccaaattcaacgaagcctaacgtgcacttatcatgattttttttaaaaaagaaaaagataaacgaaagtgagctaacaaaaaaaaaagattttgtagtacggccatgagaaaatgaagtgaacttgaaatgagaaaaaaaaatcttattattattattctttaaaataaaagaatagcataggccggcctggctatcactaggataggagtttcttagggacatattcttctcccttgctgttcatcccttttcggatgcatcgatcacaggcgacaaatcagacaaatcatcattcggagtttcagttgcgcaaatgggtatcggaacatattcttaaggctgattttacatcaaactttaggcgaaaaatactttttttttataatcgctagctaggtagccatgaagagcattttcggttcataatgctgcatgctaatcaagagcaatcttgggtggttcaaacacggtttcaaaatgcaacagtaaactgcctggttgtcggtcttgtcgagctggttcgaatttagaaaccgctggataaaccggccaagttcaaaaaaaaaatcaaaccaaataacttttggcaaaatgttaactgctcgatcagtaactgaatggtcaaacggtttttgtaagaaagaagcaagaaggtcatcatcatcagctactagttgttatataccttcaccgtgcttgggcgagacgccgacgacgagcgctttgggcagcttggagaggaacacctgcgtcttcgccgcggcggcggccgccggccggggcacgccggcgccgagcaagacgagcaccaacgagagagcagcaacgccggctagcctcgccattgctgacaaaccaaaccgactgattctggatatcaacccaaggacggagacggagacgaagaccaagaaatgaatctgctgctgctgctgatgctgagatcgatcgatcgatcgatcggtgaatttataggcgggagagcgaggctacgagctcggagagttgaccagctacttcgttggattcaagaggcaacttaattgttgtaatgatcaagttgattaagtttagtggggtcggggatatccaaagtcagaggctttgacgacgtgtgagaagagaagagaagagagagatcatgcggttttgggggtaattaagcttttggaggggtcccaagggttcaggcaaccggtgagaagcggcaaccgcgaatgatcttgagtgcctcggttgttgttaattaaattgtgagcatgacgttcatggtaggttcatttggcattaagataataacattggagttattaacgttgagaaggcgttcttaatggaggaaaatttgatgatataccagtgttttggcaaaaaaaaataaatttagatgttttcatatggaaaaaaactcaaaaagagtccatttcactcatccaaactattttaggttcattgagcattaagatatcacattggaattattaatattgagaaggcgttcttaatggatgaaaatttgatgatatactagtgttttggcaaaaaataaatttagatgtttttcatatgaaaaaaaaatcatttcgctcctccaaactattttgccacagcatttaacctcctaacaattcctcagcttagtttacaccctgaactattgaaaacagttcaacttactctctaataatattcctcaagtactgctgtactcctacttccgaagagatgacatgcatgagcgcaagagcaggacagccatccgtcgatcgaactcgaacacgaccaagtctgcactgtgttgatcatatcagctcagctcagctagctggtggccagctccgtctcttgattgcctagtgctgcaattatatcgacccagttctagctagctttgctcaagttgtccaagcagatcgatgctttgaaacaacagcctgccgaaaataggcaatcgattcttacttaccacgatgagagtaattatcctatgaaatggcatatgatcattgaaacttggtagcagtttcgccacgacacaccgcaaaaatcctttttttaaaagtactacctttaatttaaaatatctgacgatgttgattttgaacataacagctgaaagtttattttattttaaatttatcattaaatatactttaagtataataaattttaaagtttcactaaattttgacaaatgatcaaacgcatataactatataagttaacggtacgtacatttaaaatgagtacagtacaatggacatcggctcacacaacacaaccacacccatatcatcacaaacagctctatttttttccttctaacttttacatgatactcactctgtttcacaatataagtcattctagcatttcccatattcatatcgatgctaacgaatctaaacatatatatcaatctagattcaaacatcaatatgaatgtgaaaaatattagaatgacttacattgtgaaacggaggaagtactttcggcagaggactaggagtgaggtaggagtgaggtgggagaggtggggaatcgtgtgagatgccctagtgccctaggacacatttcctctcatatctgatatgttggtctagttgattaaagccaatgtttaaccccagctagttggtaacgataatgtattgagatccaatgcagttgtcactatgactgcacaatagcaactgcacacaatttgagcccacacaatttgagcccttcttgatccaatggtccaaatctattgatacagtaaaaatcaaaattttactatttgtcagagcaaatcgctgcagtatttagatgcgtctggaattctgaatcatgtgttttaaatctggtggtgctcgtgtgactgcttaacttgtggccacactagccactgcacctcaagcggatcaacggctattcatcttaaaataagtttatttttcacctattccacacatagtaattcaaaactaaaaagactataatactcatactttatcaaatctcaatacaactatttccactttatctactctcaatacaattatttcgtacttccacaaatttcaatgcaatgattattctacaaatgaacttattttgatacaaataaaatgagctaaaaatgaacttactaggagacgtaggaagtatgctattagttcttataaaacaattaatttatgatataccagttagacatgagccctagctatatttctatttaaataatagaggggaaaatgttattaataggaaaacgagtaaatttcggaaaagcacaactattttcgttaaaactactagtttgcgacaacttcacctggttttcttacaaagtggaatggaacaatagttgatgattttctgcaactttttttttgtcttattggttttggcctatatgtcagacatacatataaatatataatacttatactgttgcaagttgggtccacatgtcagacactcataccagttaaagttgtggggttttggtaaaattgttcacaatcgttgtagttttgttagatgtcctgctatagttacagctaactgataagctaactgataatttgcagttttacgaaatccactctaggaaatactactccctccgtttcaaaatgtttgacaccgttgacttttcagtacgtgtttgatcattcgtcttattcaaaaaatttaagtaattatttattctttttatatcatttgattcattgttaaatatactttcatgtacacatatagttttacatattttacaattttttttaataagacgaacggttaaacatgtgttaaaaagtcaacggtgagtattagggtatgcagagtccaggagcaaacggtcaaatttctcatttttagaacgcccagcagatggggtcaaatttatcatcaaggagtactactcaattgttgcaaaacccagtgtcatatatatgatcatcctcggtgtatctggtaatgttgcttgatggcatgatagcaacagcatgccggcattgacatggtaaaaacaaaaataactaataattaaaagaggacacacacttcatgtggggtcatgtggctcttaacaccggttaagagttacaagaaacatcattttgtttgacttgcctctatcgattagtgtgaaaatacagagaagacgtttggcttatcaactggcgtttagatgtcatgagactatgagagtgataggaggagagtggcaggtcaggaagaatgatcgacaccgggacagatcatacttaattatataatgtcgacatgattgttgagggaatgatacgtttttaggccttgtttggggcaaattcttgtgctggctgtcattgactaggagttgtgttcttcgccctggaatttaatctttcttgggtattgcttccttatcatttgatcacctatcttattaaaaattacaattatcatttactccctccgtctcaaaatataagcatttttagtatagtgacaagtcaaacatttttaacttttaccattaatagcaaaaaaataaaaaagattaatcatgtaaaattgatgttactagatttatcattaaacaaactatcataatatcataatatgtaactctttttatttaaaacatcttacttttatagatattgttagtcaaagtagcatattagagaccgtgttagggtctaaaaatgctatattttaggaactaccatttgtaaagaactaccattaatttccttgaaacttgatagcaatgatccaggcctgtttgggaacaataaatttgaccaaattgtatacgaaagaaagagattcctacggaaattctacctcccaaacgagatgaaacctagtaacctacaggctacagccataaattcaaaacatggaaagcttgatttttcccccatacatgtacaatgggcttacattacggagccgcaacaactcacagccggaggtgctcgaaaagcttggacgtcacaagagcagtttgctcatagaccgatattcgttagcgagattgcagttcttgaagcagagggccaatcctttgagcgccaagaaataatgcgtcgacaagcacgagtgctccaacctgttgttccaggaaggaacatataaaagcatttccattggagaaaagaattgatgtgtgcctctcttgaattcagagaattaccaaacggcctgtgaagatcagacggtagcccagcccttctttcacagcctgcgctcgttgctgatccgtccagctgaaatgaagtcgttgtcagtacacaaagcttaaagatttgtaatcagatggagtgctctggagtatggaggagcgatagtgcatgcttctgtggaagtctgaaacatatttctaataagaaaatcccattataatgctcatctgcctgtgtagacacaatctgaagttttaagttgttggcgagttctagcttgcctatctcattatcacattattctgttcttgtactcaaacaactgctttgattttaatacatgacttgtgtatgtagattggacagataataatagggataataaaccactaggaggggagaatagctggggtcttgaaacctacccgaaaaattccgaaaccccaccaataccagcaagcttgaaaggctggggaccttctcgctcaaagtcctgaaggggtaaaattataaaccataattcagtaaaaagaagtactccctccatcccctaatataagggattttgacattttgcttgcactgtttgacc

SEQ ID NO: 72864 - DNA, 1870 bp, Oryza sativa
caggcaagtgcggaaggcgaggtccctctccctctccttcccttatcacactccctccacttctcctctatgaccggacagtgagtgtagacgggtgtgtgaggtgacctcgcaatggcgggatcggatgagacaaggtcatggtggagcttgtgacttcgcacgagtgaagaaggtcgttgggggagagggaggtccgacacgcttagggtgacgcgtgatgacggcgtggtcaactgtgttggggaaggtgatgtgcacggtgctatgtgatgatttttgtcttatgcgctgtgtagtaaccaaaataaaaattttcacgttgtcacattgaatatttggatatatgcatggcgtattaaacgtaggaaaaaaccaattacatatattgcatataaattgctagacggatcttttaagcataatagtgccatgatttgataacatggtgctacagtaaacttttactaatgatgaattaattaggcttaataaattcgtctcgcagtttcctagcggaatctgtaatttattttgttattagagtacgttcaatactttaaatgtgtgtccgtatatccaatgtgacaactaaatccaaaaatttttcccaactaaaccaggccttagctcccagatctacacggtagctgtccttcttatcctcttgcgttccaggaggctggcgagctcgaagaggacttcgtcacttcactgccaggagcacgtaggggaggagcacagtaagaatggatgggtgcgttgtgaattttcaataccttagtccaatcatcatgatgtttcattacttcgataaaaatcttgcactgggttttaatggtgttttattttttttctttgatttcactcagatctaatgatgtttcaatagcttaaaaattgcttgtttcatacgtggaagcaaattatttcatctagtgctaattgtgtttcactcttttcaagagttgaaatattttgttgagtgctaaaacattattttaagagttgaaataccgatcgttttagaaaaatcggacacctgatttatagctgtgttaaatagatactactacataatcgatttttgcatgcggtcagaattggttttcgcaagtagctaggcgcccctcctctacgcaggtgtctgcggaaatcaaccttttcgcaagagggtaacgcaaccgctcgcgaaaactgtattttcgcacgcgggcgcactaagttgtccgtttgaaaaacaagtttgaagaaaaaaaaatcctaaaaccaaaaatctagaaacatgccgtcgcaagatccgacaccaccgcttggatctgtggtcgttgttgctcaaagccaccgtcgtcacgcacggatctgttgtagtcgtcatcatgcggaagcttccacctccgtcgcatcgggatccaccaccgttgtcgtcactcaaaggagctgcgccgtccttgctcgaagccgccgcattgtcgttgtcgttgtgcggaagccaccaccattgttgcgtctagatccatcttcgtcagtgtcgttcgagggaggcggagaggcagcggaatctgcgcgggaaggagagatgccaccagatccgcccgtcccatcgccgcagtgggtggatctaagtgtgtgggggcgaaaggtagcaggatccgcacgatccgaggccgctgtcgcctcctgagcaatgcaagtcattgccgctctcgccgttgcggccgctaacccgagttagaggaggccagacgagagtgggaaagagaggatgggaggagggaagaagtgggagagatatggagagtgtggaggaaaaggagtgcagcaaaattagtggggagagaggaagcgggaaaaaaaagagcgaagagaa

SEQ ID NO: 72865 - DNA, 3311 bp, Oryza sativa
tgtgagactagtacgaaactaatgagtatttctataaggtcgtaataattatatctggttaacaaatacaatagaggaaaactgatacatgaaaattattaatggtgatggttattgtccgccgaagcctcattcagccaactgttcatatgtgttgctatcatgtcttgatttgaaaggtactacctctgtttcaggttagaaagtacctctgtttcaggttataaaactttctagcattgcctacattcatataaatattaatgaatctagacacgcgcgcgcgcgcgcacatatatatatatatatatatatatatatatatatattcattaacatatatataaatgtgagcaatgctaaaaagtcttataatatgaaacggaggaagtagaagcgtagaacgtaggatgggttgatgggaatggaatatgacacgagccgtgtcagtccgtctgtagtatatgaccgtcggtgttggatcgcgctcctctgacgtaaagtcagagggacgtgggtcactgatgtcagagaagacttatccgcgttggtgtttaacttgctctcgtgttctgatgcatttggacggtttgtcatttttatttattttttgcataattcgttttaattttttttagtttttagcaccaaaagttttcattttccctaatagcattaaaaattattattattatttttcatattttaaatatttcactaatttttgtggaaacccttagtgttggtcggcggatgaaaaaaaagatcaattgggcgctctcctcgccgcttattctcaactcctcgcatctctcttcctctacatccttatccattcgccttctccctcttgcgctctctctccctctctcctcatcctttctcatctcttgtcttctcgcctagtctgtgagcattggaggcgtggggcacggagaccctggaggcgaggttggcgctgcggaaggtcgtcatcaccaagctgcccgtagccttgtcgtcggcggggcggcaacatcgcacgggcggaggccggcagcaggatgcgctccttgctcgatccctcccttgctgcctgctgctggatgggggagctcgcagcacatcggaggagagagaaatttagttggattgtcttgtgcttttatgtggccctattgaagaggaggaagaaatcaaatttcgactggtacaattttgagtttttgatgtttcagccaatgtatatggatttttttgggtttggattgaaatgttgtacttgatacttcgatggtgtttcatatttttatttactagtgagtgtgcacgtgcaaggcacgttaacatatattgaatggagtaaattagaaaaaacacccaatgcatgtgaaccttaataaaatgatgataatagttgcactgttagatagatagatacttctgttcaaatcccaaaattaaaggaagaggtggatatcaatcccaacataaagtaataggtggatatcaatgtatcaagtagtatatcaatattcatgaaggccagaaacaatcaaacatgtggagtacgcattaaccataaaggccagttagcagtcttgtacataacaaatagaagcaattaacctgtatgtgcatgtgcaaatatttacatatggagcctagtccttgtagaagttaccaacatctatcggccttcttgacagcgaggagtagtcatcactaacatctctcttctgtccatcaggagttgagagcaacgtcaacaataagtatgtggtcctatcctatagacaaacaattgtataaagttaaacatgtattggtcactttgaaaatcagtccagcattcttgaaagaatgaataagatgtgcaataacattcttacggcactgctgtatacataatggatacatgaatatgtacctgaattttaccattaataatgttgatttttgcttcatttgctgaatcaagcaactcataggaacaacatcatccatatcttagcaagctcgatcgttgcagtttgcaatcctctttggtgaggcgcctagctatcacaataggttgtcgaggctgaattctttggtaaggcacctagctatcacaatagtttgtcgatgatgcattcctgctttaaataatcagaacaacaatgatgagcatgttaattagttgcaggaaaaaaattattgcacagctatatatagattgcaatcaagattgattactttgggctcgtgaagttgctttgctctggttgctttaccaagcagctaaaagtaagtcaaccatatctggaagcctcgctgttgttctctgtaaatgggagacgtccgagtgtcataacaggttgtcgattctcgtttccaaaataaaatgtttattgcaagaatattgacttgatgacttatactaatgttcattatatatactattaacattaaatgaagtgaacacgatatccacaacagttgtataagcagacttgcctatggtgcttgatgcctccttgtgctacaattaatggttcttttttattcttacttccttctgctcggcaatgggggaggcgtacctctctatagcatgctttcttctcaactcgagtgcactaaattgttaatatggccaagcagacatttctagttagtctgtattggtaaattattaaaccttaattgcacatgttgtcatatagagaagcgattgaaatattcaaatatgtgatagatcatgaatatggaaaacataaaaaaaacattgacatgtaaaaaacagtctagaagcagagcatgaccaatatgcaggatcaatatatgaatttcccagctgctctaattcagttaatttccattagcgcaatatgtgtcaatgcgatttactcaaaggcaaaacatattagcaaataaaccgaaacaatatgtgtttttacctggccatgcagccgattacgatgtagagcttcatgtgatgtccattgaagtagggcgagagaggagatgagtgcattgaatcacattaaggcgcacaattgacatagttcattgagatgtaactcgagtacttagccaagataatcagtggcaataaaatagagatgggcattgggtagtctgcgagcttgagattccaaaaaaaaaaaagaataatcaatatgacactctatttaagaaataaattaggaaattataatattcataaaacgaaatgagttcaactataaacaaaaataaaagtaagattgaggcatcaaggtgtgactacaagttgcatgtttttagtgccttaattgatcgagcatcacactattcagaaaaattca

SEQ ID NO: 72866 - DNA, 1201 bp, Oryza sativa
aaagttttaaaaattttattctaaatgtcagatatttatgatcgaatgcagcacattttcgtagctaaaaacaagtattttcagttataacagcattctgttatgcaaacttcattaacttgaaaagtacctaaaaatgttgtcttttctccatccattgagcaggtatgatatccatcactaggacatgaaggtttcctcttttcttttcttcttttttcttttttacaggaaccaggacaagaaggttaactccaacgactacaagttcgtctctctgcagttgtctgagcagccttttcccgttttctctaatccattctgagtttctgacggctagcatctcttgtgtttctgtgtatgatgtgagcttgctttgcaggggatctcattcccttcctcttgcaactctgaaagggccaacgaaattctaaactaagcctctgacctgcttgggcatattccagataattagaatcgaacagtgtacatttctctcttgtaaaactcatattgttcgagaaaaattggctgcacatttactggaggattatcccaagcatcggtagtatttatttgattccgtggacggcaaagtcaggtcctccattaaaaaagatcaaaaaggcagaaatttccgtggactttctgctgaaggatgaaaaaaaaggcacctttgtaggaaaaaaaagaggagagatctcttgtgaaaaaaatgaagcaagaaaaggagaaagggacagaggagagcctctgaacgaagaagtgaactcgttggtgagccgaggagtgagatggtcgcccacagaatttccacgtgtctcacggtcagccgttgctgccgctgtcaccggaaagctacggattttctggcccccggcgccggcggccgtgctgatgcgatgcgtgcatgtctgtcaggcaaataggcaatcggccatgggcactgggaaaaatgttgagggcccatttgatttgtaaagaaaacatagaaattctagattattttaattctatagaaaaaaaatcctatgaacaccttagaaacaaatgattgaatcccatcacattctttaaaattcatgaacaattctatatagatgttagaaaaaaaaacttaacagtagcagtagcactgctcatgaagaatctacaggctattttcgttttcgttcagcatcatcccacgcgcaccaccccg

SEQ ID NO: 72867 - DNA, 13229 bp, Oryza sativa
tttttaccgtgaattggagaattgggtgatgttgtagctttgttgctgctggtcgtcgggcttcttgtgggacgggttgaaggcgacctgctcggcgcaatcgcggttgtcaccagagtggtcgcggacgacacccatgaggtcgaggttgtactggtagttggagataaaaatgttcatgtcgtcgatgtagcccttgccgtagatctggtttgcactaccaattcaaaattgcacttccttttccatgccaacaaaacacaggctaaaaactgataagatagttctaataacactaagaggggaaatccttgcattatataacctaattttcatcacattgctgatggaaaccaagtttctatgtgagtgtttaacaaagttgcaaaacacaacatgtactttccagtaagtctaaggtattgaattaattttctaagttgagagaacattacatccccatagtagcattataaccctaaccattataaatatgcgttaggtatttgagtatctgaaaagtcttatttgttacagcatggaatgggccaaaccatgattagaaaggaaaatcacaatatttatgtaaaaaccatttaaaaaatgaaactaaattagtataccaatttcaactaacctgttctgacagcagatgagtgtaacagggagtggcaatttgatagtgttgtgcatatatacaagtcaaaactccaatggaagtttgcacttacgatactctttaagatttgataaaaaaaaaggtgggctaaattggagggaatatttcttttaccttcatcattgttgttgtaagtacacctacccagctgccctcatcaaagtagaaatccttaatttaatttgtaagaaaacatgcttgctcacccatctgcaccgaaaacagaaattaccattcgtgagaccattagaaaaacacaaacggcttgtttgtcaacttaaggaaaggggattgggagtttacacgagggaattgacggtgagattaagatgggaatttgatttttcatcccagtctcttgtttggtagaggtggtggaaattgatagggaatttagttggagattagatcattaatgaaaacggatggctgagatttgtttatgtgaagtaaaggaggaattccctcccaattacctgcccctacccaggtattgaaaatgagggagttcattcctcaattccccatccctatcccacaaaaattcctatgtcccccaaccaaataaaacagttaatagcctcatccctctaaactcccaatccctcctaaaaactccctccaaccaaacagacagaaagatcagatcacatgttatagaggagtgcagattggaaggttttgaacaaagatgtattcagaaatacacatattctaacttgtatgatctagatctcctccacctagatcttcttctgtaaacatgttaataaagatttacaatctccaattatctttaggggaaataaagaaagaaaggtttggaacatgagaatcaccttggatttatgcacattcatgtatggtacggtcatgctcgttgttgcttgccagcttcttgcatccttgtagaattcgtcatgattcaacgccagtccaaatagatgcctggacgctcgattgcctcggcagtggaggggcacaggacgccaaccacatcaatatatggagccgacatggctgaggaagccgcagagctccaccatctgcatctgcttgcctcccatggtgcaaaagctgaagaactcgaagaggggcggcgacggtgacaaaggctcaacggtttggagtgcgggggaggcgcgagcggggtgactgctcggaggcggtgtgcggcgtaagtgatcgcggaggagggggtgggcggcggggtagggcgagcggtggaaaaggcggctgccgacggtgaccacggctctccggcgagcacgcgcgaggaggcgacgacggggacaccggctgtccggcgggcacgcgcgagcaggtggcggtgtagggtggccatcctgcagttgtccccgtagcattgtccggcggatgctggcggattgatttctggcgcagagaggcgcggacgcgagggggccgccggctggcggtgggtggcctggcggtttggagtgtgggcgaggtggccagcggggggaggcgaagggcgcccaacggcggtgagcgacctggtggggaggaggcgcagcaggatggcggccggagttggccccggcagttgcgattgggatgagactgtgaagaagtggatgaggggaaccggcgggctttgagcgaggaggcggcagggtagggcccgcgacggagccgcgcccggagccggcggcgacggccggctgcccggcgggtgcgcgcaggcgcgggaggcggcgaggcgcactaccgggaaagaggtttgaccaatcgctattttttttttgttgtttggcgttcttttttttatcggcctttttctcgtgcgcgacgtggtccgccgatagaggtggccaaacgggccgggccaaaacgggcggcccgaggcacggcggaacctgtagccggctcggcccggcacggcctgctacagtaacgggccgtgccggcacggcacgagtagccgtgccgtgcttgggccgccggccgagcccgcgggccggcacagcacggcacggctactgtagtaagtccgcatctcatccttccgcaagtccgtatctcatccctcccaactgacggccagcccgctagccgcctccgcaagtccgttgagcacccctcctagctgatggcccagcccgccagccacctccgcaagtccgcatcgcatccctccgcgccatttcggttcctgggccaaccgtgccccgtccacggcccatttttcattcacggcccgtactgacacggcgggccacacgcatgccgtgccggcacgggcacggcccggccatccacgggccgtgcttgggccggcggctcggcacgtgggtcgggacggcacggcccgtttcatgagccgtgcctaacgggccgtgccgaaacgggccgtgccggacccgtgcccgtgccgtgccgggccgggccgcccgtttggccacctctatccaccgatggcgcggtttgtttgagccggatgacaggtgggtcctatgtgatattggatctgaaggattgcaggattggggatgaacctgtactttttatattagtatagattactcttgtaatttgttgatgtttcaactgttaaagtttgatgtttcatctatgagaataatacatttcaatcatgattaaactgtgtttcaccatttaatagtctgaaatattttttatttagtagtgaaactttttcgagtagcggtaaaacatcacatgattgggagttggatttgtagtcaccgttagatatctattttcttgtttttccaagaaacaaaacgggaaatgccaaaacaccactgcagtgcagtcatccattccgaaaatgccggcaccatcaaattaggttactttttaatattagaaacatgtggataaaaaaattaataaaagagatgacaaaggaaaaaatatagaaaattaagataaaagaatagaaaactaagttaattgaaaaatcgttaaaatagttagaaataagtacaacacattaaaaatatgtttagtactttagaaaatcttctaaaaataattctgaacttctctttgttctcgccgccatatatctttgtagcttttgtgtagaaattactcataactccgaataagtgcatttaaaacttgttaaaatcgttagaaataagaagaattcataaaatgtgtaatgtcagttttgagtttaaatatgatgttttaaattatgatatgattatttaattagtttcacttttttggacttacttaacatttgtttattttatgtataggtggatcagcaatggatgtacaccacgggccaatggtcgaaagagtttcttgaaggcgtgcattattttttgagtgtgggcaatgttaacatgcataagggttttatatattgtccatacaaaaagtgcaaaaccagaagaagtattatacatcaagaactattcatgcccacttgtttgagtcggggttaggggcggcaatttcccccgtggggcatgggacccacccctacgggggcggggatgggtgctgatttcgacccgcgggaattcggggtcggggccctggccatgggcggggacgggggccggggaggatagccacccgcgggtgacccgcggagccccgagggtgtatattagactattaatactaccatattgcaagccaaaaagcccatctagcctatcatatataaaccaaaccctaaattccccaccctctacccatcctcctttcctcaccaacccagcagtcactctccacaaccaccagaccttcctcagttcctccggcggcggcatcggcagccaggcacgggcgacggcgtaccaatcataaatttggtaagcctggagtaatcatcggcttagagtcagcatcggcttcgaagtcctgagattagccgatgagagttatcaagtcgtcggttgttggattctttctatattcggttaaggaaattgatctactaaaggaaatttatccagaatagaccgagttcaaagagaatgcggcatggcaagttatctattaattaggaatagtttgttagtttcctttttaactttaggaaagtgtgtttagtgtcctataaggactttatgttttccttttatctttaggaaagtttctttcttgtcctacaaggactagtatctacccatgggtataaatatgtacacctggggtcattgtaaacgatctctcgatcaatacaattcgtctcatcgccacctgttaccttttctattttattttatcgtccggcgggacttggcacctgacgcggggctgcatcggtgttcgatctctggctaaggggtaagtccaatgtttcgccggcctaggcaattgtatcgtttacgttggcgtcgttcaaggctgcatcagtacattcgacctcttggattgctctggtttggatgatatatttgcctacctatttatcatatgtctctgttaatctagtcttagcatatcaatttagctctatcggctgcttctcgttttagggtttctgccggtatcggctaaatcgcattgctagattagattagcttagacatctaccaccctgaaaactcagtcaacggcttgattgtttagatattatgtttcttttcaatacttagtgttgcatcagttaagtttgatctactatgtcatgcttagagccataatctctagcctgcttcttgattgccaataagagtttcatcggggtttcagctggtgagttatctggacgttgcatcggctcataaggattgcatatacatataagttggatttagccgatgacaacaaaggtttcactgtttaatctaatcttgtggatttcatgacatcggacctccagccgatgtatactttaaccttcggatcagtgcttattctatcatatcaatgctcgccgattggtttatactggactatattattgttatattttattatcagtagccaattgcctatatatcattatttgctaaagtgtaagaatctacattggacgtatagccgattgctcaaaaccctatcgctatcggctggtatcggcatcggttattatcggctatctgctggaactactccatcggcttgtcaaccgatcggctgttttgtctactatttgcatatcttgtcagttgtaggatcaaactgactggcacgcccgcatctcaccaatctttggacctacacaggagctaagcagatctctcaggccggtgtgttcgattttttcatcaacacacgggcggtggcagcggctaggcgcgtgtgctggcggcgttggccaggcgggggtggcggcgtcagcggctaggtcacgggcagcggcggccaagtcatgggtagcggtggcggcggcggccaggcgccggcgacggcgtctgtggccagggcgcgggtggtggcgtcgacggcggcaacagccatccgcgggcggcagcggctcgcctcgtcgtcttccagctcgctgtcctcgtcgtcgtccagctcgctcagctgggtattgcggggccccgctcacccgctgggtcccctgcggggatgggggtgggtggcgttttccacccgaccacctctgcagggccggggtcggggggagaagtcggggagcggtggcgggggtgttctagcccaacccacccccgatccgccccgttgccaaccctagtcggggttcatgcgtagctataattgctggacctcacacggagagtttggggttgcaatggaagaagacgaagaagaagacgagaacattccggactaagctcaatgcggtggattttaagaaaatataacaggtgaggcagacggggctgttgaagataacgacgatgcggataatcttggtcagatgttgcacgacatacacaaggactgcaaaagtgaaaaggaggtccagaaattagagcgtatgtttgcggaccacaaagcgtcgttgtacccaggttgtgaacaggggcaaaaaagttgggtaccacgctgaaattcttgcaatggaaggccaaaaatggtgggagcgacaaggcatttggtgagttattgaaatttgtaaggaacattctttcggagggagatgaattgcccgaaacaacgtacgaagcaagaaggtagtctgccctctagaactggaagtacagaagatgcacgcatgtccgaacaattgtatcctctatcgtggtgaggagtacgagaacatgtgtcacgtccagaaattcccgaatagaattccaagcagaatgtgcattaaaatccccgtccaggaccagccgaggtacacaaacgacaatgttgaccttcagatccacgtcttacaaacatcataaaagtcttacagaaatgcagcggaaaacaaaagataactggagctaatccttgacttgaactgcagcgggaacaccactccacaggcatcctcgacggcacggacgaagcctactcctcggagaacccgccatcggacacatactcgagctctgagatcgggggaaaatagagcaagactgagtactacccactgtactcagcaagtcataccggaatgggggtatggtgcatggattcaacaagggatagctaagcaggttcatttgcataaatactggcatttataaacaggaattgaatacgaaaacagttgtaataattaagcagtattcagcatccactgtccaacgctacaccacgttgcaacaggcccaaccaaccacctataccatccaacttcattagactaactaatgtgagtctaatcacggtgaatctggttgaccgcccataaccgcgggcgcggctattcgaataggtttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgtcccgctccatcacgcccacccttgcctggatgcgtcgactagaggatagctacactacaagcccagccgttgcccacgctggcttgtagtaagtacgataaattcttccagggcatcccgcgaaccggtccttaactgccatgggtgcgaccagcaaaactatgcacccacagcccaccatgtgattcattttaattaaccaacaccaaagcggtgtcactaatccaacatgaccattagaactaacagtctaaacattaatatgattttccccattgtgaactagttgaactaagcatggctaagcaaaccctagtcctaactctaatcatgttataacccaagctaacaaaggagcatggtatcaaaatagcatggctgtaataataggtaaccatcccatagtaacattgcaaaacaaatgcggtatttgaaagaaaacattaggacatttgcaatataggatcaatatgatcaagtgacaagcatgacttgccttgctctgctgctggaggaacctcggcgactatctcaaagtacaccggagcgtcggatgaaacggaatctagcgacaaacaaagcaaacattgcaaacaggctataagactactgaaacagggaacaaaaccatttttaatggattctacacatttttcttgatttactgagacttgaatgggattaaacggagctcggatgaattagttatgaattttagaagattcactgtgtttattactataacaaaaatccttaaataatttattgcgcaatattaaccaggctgacgtcagcacgggggaagcggcgccgacatgcggggcccaccggtcagcgactcgggagagggaggaagggcgccggcacgcgggcccactggtcagcggctcgggagagggcggtctacggcggatcgggtccacggaccggggaggagcggcgcaccacgtggcggccgaaccgatggccccgatctacccacggagcggcagcgggagctcgcggccggggcgcgcgggcacggcgcaaaccggcccggcggccatggcgcgcgacggcgcggcgcgcttacgtgcagcggcgcaagacggcggccggcggtgaaggcgacggcgcaaaaggcgacgcgaaggcggctgcgctaagcggcggctaggaacgggagggaacgggcggcgataaaggcggccgccggcgcggctcggcatcaaagccgaccggccggctaggtctaacggcgacggcacgcggccgacgacggcggcgaccggcggcacgggaggcggcggcggcagtcgaaggcgacggcacacgacttgaagcggcggcgcggcactaagaggagaggaaggggaaaaaaaaaggggaaatgcctcaccgagggtggccggcgcggaggaagacgatggcgaacgacgacaacaagccacgggaggacgacgtcggctagcggacgagcttcggggtgccctaaggaaggagaagagagggattagagagagggagatgaaccacggcgatcggaaaccatggccgaaggcggcggtggaggtggtgctcacccgtgcgcgaggggatgagggctccggcgacgaacctcgacggaggaggggtggacggggtggatctcggccacgcgaacccgacggcggcgacggtgcagcctggcggcgaccctaccggcggctagcggcggccggagcagcgaaaaaaagcggcggcaaggggttgcacggcgcgggagcgatgggaggctcgagagagtgcggcgaaatggggaaaaagtgagaggggacggcggcgatgcttaaatagggggagagggaaccggacgtggccgagagaggcgggaatcgccggccgacgtgggggagtggggaggagagagagcgggattcgattttcgaatcccggccatctcgggcgcgggcgcgagcgggagagagaggggagtgggcgcgggaaacgcggcgcacgcgcgggcgtggtcgacgtggcccgggggaggcggagacgtgggcgcggcggcggtttcggcgcggcggcgcgccgggatcggcgggaggagggagacgggcccgacaggtgggccccacctgtcggcgaccccgagagaggaggcgggcggcctgggtgggcttcggcctgcggccggcccagcaaggaggagggaaggaaggaggggaatgggccggcggcccattcgaaaaaaaaggaggaaaaagggagggaaaagaaaaagaaaaaggaaaaaggattttccctggaattaaaaatattgcttgctcaattttaattggttaaaattatttctagagctctaaaaattccactaaaaatcctgttaatgaatttcgacatgtagaactcaagaaaaattccacatgtcaaatccgattattatttgcattactttcttagggttttctcctgatttcaccagcattttcttagggtcatttataaaaattacaattttggcttgggaggaaaacttcggggtgtgacaacatgcccgatttgtaaggcactacgacaaaaaattagacaagatgacccaggtgatgttgacggacaaccttcaaaaaagagagttccaactaagttgatgtgttatttccctataataccatggctgaggcgtttgttcaggaagaaagcgcatgctagaataatgcgttggcacgcagaaaaacatcaacaagacaggatgctgagacaccccaccaatgggttgcagtggcaaaacatcgacagaacatttgaagactttggagaggatacacgaaacatagggttcggtttaagtacggatggcatgaatccattgggagagataagcagcggtcatagcacttggcctataaccatatatatctacagcttccccccttgattatgcatgaagcggaagtacatcatgatgccaattattattcaaggtccaaagcaacctggaaacgatattgatgtgtagctaagaccattggttgaaaatctgaaactgttgtgaagaaagaaggtgcccccgtgtggaacgaggacaaataagattggcctacgagcgttgctgaccattaacgattggcctgcacttagcaacctatccggacagtcaaataatcggtacaaggcttgcacgcactgtatggatgaaactaaaagtacgtatttataacattgtaggaaggttgtttatatgggccgtcatcgattccttattgcaagccaccttgtccggaagaaagcaagcatttcgaatagaaggcagaccaacgtactaagcctaagcatcggaacggaaaaaccgtgtttgctctggtgaaagatctgagagtactatttagaaagggacctggcagccaaccaatagtgagtgaagacggtcacgcggcgatgtagaagaagaagtctattttttagaagataccctgttgggaagtcttgcacctcactaagagcctttacgtcaacctggtaggcttcctaggtttatatgggaagtcgtaagatgcactaaaagcacgtaatgatctcaagcatatgaaacaatgcgacgaccttcattcggaaccgaaggagaaaagaagccattacttgcgtccagccaactacaccctgagcaaggtagagaaggaaagtatgtttgaatgcttgaagagtattaaggtaccgtttggatactccagaacgcaattttgcagaagatcattgatccagacagtttaatagcgtggtgcaatgtcttgtcagctttgagataatctttccaccatcattcttcaatataatgacgcatcttctatgtcaccttgtgaaagagattggtattctcggtcctacatacctacccaacatgtttcctttcaagaggtacatgggcgttcgaaagaagtacattcataatcgttctcgtccggaagcaagcatcgccaaggggtatggaacaggggagggcattgagttttgcgtagaatttattgaagacctttgtccaatcagggtctctgaatcaagtcatgaggggagactgcggggaaatatgactcttggaaggaaaacaataatgaatgtagacaacgatttatttcgtaaagcgcatttcacggttttgcaacaatcttcattggtggctccttaaatcgaggagcacttggcgattgttcgctccaaaaacatcggaaagtccgatgcatgtattacacgccatcacattgatactttccccgcttggcagcgacaacatctcatatgtaacgagacgattgaccaacacctagccttcttggcgagaggactatcttactcaattttgacattgcagggatatgaaatcaatgggtatacgattgaatacattttgcatacggccccttaagagcatctccagcaaagcacctaaactaagcccccaatgagtctaaactaagcccccaatgagttttgagtgaaggaagaaaaataaaggtatagcagggcccctattaaaggcccccaaaataggaaggcacccaaatttctccttcactaaagtatatcaggcactaatcatgtacaagtgtcctaaatttcttcagaatgactaactgtttgtattgagtcgttaatactgcagaaccaatacatatatgctaaataaatacacgttataaacagtataatcttggttgcccacaccatatttacatgtttgaaaactttgatttttaatttgaattgtgcacttcgaaattgtgaatttaagtatggttaaattatatgcgttagaaatattcatgtttaaattattgtggtgttaaacgtagtgtaaatatggattgtattttaaaatacaagagaaacatgaatagaggcttaaaaaataagggctactgctggagttggaggcatttttttgggtctttgaaaaatgggggcagccctcatttaagtggggcttcaaaataaggcctattgttagatatgctctaagagcaaaaatagatttttacatacgggtcacttaaaggagccgcatacgaaaatggagaacgattttagcaagcgattagttacggtctgtctgaaatctattgggcccctcgtatagaaaaatcaaaatcgtttttacagtagtgataagatcagaagactctcaccttgatttaatctgctacgttaatcatcattactcgtgaaggcaagttcgcaagggccaagggcgctagggcaaggtgtggatgcagcgcgcgtgggcgtcagtgtcaccggtttgctgggtcgcgccatcgtcgtccactggtggagaaaccatctttggtcggtcgcccgaaatccacaattgtcccggttccattaacacggacaagcaatatcgtgtttagtcccgttggaggatccggaaggaagatttgatctttagtcccggttggtgttaccaaccgggactaaagatccgtgggatctttagtcccggttggtaacaccaaccgggactaaagatggatctttactcccggttgataatatcaac

SEQ ID NO: 72868 - DNA, 3162 bp, Oryza sativa
cactccctctcccccaccatagcgatagtacacacatttgtcagcttcgttcacaataaagccagtagatgtaagtgttgtgtcaaacttctcatgccattgcttaggtgctttcttaaggccatataaggatttcaacagtttacacaccattccctcctgaccttttagtacatatccgtctggttgattcatatatatctcctcttctagctctccatttaggaaagttgtcttaacatccatctgatggacgagaagaccatgagaggctgccaaagcaagtagtactcgaatcgtggtcaagcgggcaactggtgagtaggtgtcgaaaaaatcatcgccttctttttgggtataatccttggccacaagccttgccttatacttttcaattgtaccatcaggcctaagctttttcttgaaaacccatttgcatcctacaggcttgcacccatatggacgctcaacgacttcccaagtaccattagacataattgagtccatctcactacgtaccgcttccttccaatagtcagcgtcaggagatgaatatgcctcttctatggttcttggagtgtcatccacgaggtatacaatgtagtcatctccaaaagactttgcagtcctttgtctcttactctttcgagttgctacaatgttatcctcctcaggattttcctcaggcgtttgatcattgtgttttatcggtgcaaagtgctcatggggtaaaacaggttcttgactagacgtgctaggtgtatttttcatgggaaattcattctcaaaaaatgtggcatctctgtactcagtaattgtaccaacacgcatgtcgggtactccagagtttactattaaggacctatagcccacactgtggatagcataaccaaggaacacacagtctacggtctttggtccaagtttacgctttttggctataggtacatttaccttggccaagcagccccatgtgcgtaggtatgagagatttaatttcttcctttcccattcttcgaatggtgttacttccttatgcttcactggaattttattcaggacatgacaagcagtaaaaattgcctcaccccaccattccttggaaagtcccgcagtgtctaacatggcattcaccatctcagttagagtgcggttctttctttcggctaccccatttgattggggtgaatagggaggtgttctctcatgaataattccaaactcttcgcaaaaggacgtaaactcattggaaaaatactctccacccctatcagacctcaaccgtttgattttcctttcaagttggttttctacctcagctttatagatcttaaagtaatgcaatgcctcatcctttgttttcaatagttacacatagcaatatctagtgcaatcatctatcagtgtcatgaaatatttctttcccccattagtcaacacgccgttcatttcgcacagatcggaatgaactagttctagtggtgccaaatttctcgcctcagatgccttgtgaggcttgcgaggttgtttcgattgaacacaagtatggcacttggaacctttgaccaaagtgaattttggaattaaactcatgttagccaaccgcgtcatacaaccgaaattcacatgacaaagtcgcgaatgccacacattggactcatcgttctcgctaatatggttcacaacattattattattattacacatgtcatccaaagaaaaacggaacagacctccgctatcataaccttttccaataaaagttccatatttagatacgacacatttattggattcaaacacaagtctaaaaccatctctacacagtagagagccgctaactagattcttctttattgaagggacatgctgcacgttcttcagctgcacggtctttcccgaagtaaacttcagatcgaccgtaccaacaccatgaacaaccgcaagcgactcgtttcccatcaacaaggaggaacctctcccgacctgataagaagaaaacagggaaatatcagcacacacatgaatattagtaccagtatcaacccaccaatcaggtgaatgaaaaacagagagaactgtaggtaaaaaattaccgtaccccgatgttcctccgctctcgctaataaccatgttggcagacttcttgtccttgcgatcaggacaattcttcgcccaatgcccaggcttaccgcacacaaagcagtcgcccttggcctttcccttgcctttcttcttaaaattggttgtagcctttggtttgacatcaggcttgactttcttgttgttgttgttgttgtgggatgcgtgagggttcttctgttgcaccaaattggtgctagaacctccctcgatatttttgccccggttgtcctttgctctcgccttctcctcaacacccaaagagccaatgagatcagtaacactgaactcttgcctcttgtgttttagagaagtagcaaagtccaaccaagaaggtggcaatttggcaataatgccacccgccacaaacttgtccggcaactcacagttgttgttctcaagtttctttgccagcatctaaatctcatgagcctgttccactacagaacggtcatcgaccatcttgtagtcatataacatctccatgacatacagctcgctgccggcgtcggaaactccgaacttggcctcaagtgcatcccacatgtccttccctgaaggcatgtgcatgtacacgtccactatattgtcagcgagtacactgatcaatgctccacggaacaggcaatccgaagcctcgaacttagcctcctcctcaagagagagaggcggttcacttcgtttgccccgtgaaacatagaagcattgcatcgctgtcaaccacagtagtgcacgtgctttccatctcttataattagaaccatcaaaagcatgtggtttcagtgttgcagcaaagccaactaccgaaaatgacctatcaggtttttggattgttggaactttggtcataattcggcatattttaatccaaaataacaagataataaacatgatatttacaatgagatttgatctagtgatagtggtgaatgtaatcaacatgagcatgcttaatatagaataagtatcaacaatcacataataacacaatgttgacattgcgatgaacattaacagtaa

SEQ ID NO: 72869 - DNA, 14223 bp, Oryza sativa
agcatcactgtgcacgatctctaaatttcgatcggctaattaattgtttttttaatgcagtaaggttgacccctcgaaattattaagttggatgctgtctgagaaataattaaagtattgggcagtgtttttctcgtgtgttttatttacttctagaactgaagacaataagagcaagtttaatagtatagccagctactagctccaattcatatatagccaatctaatagcttattcatacaatagttatgtactacactattaatacctggtcccacctgtcatacacacattgtgtcttggagtccgtgctacagctggctacaaatctgtagcccgctgctcttctctctccttatttatcttcttaaaatatattctccttatttatcttcttaaaatatatttgtagttggcttatagcctactattgtacctgctctaagtgagtacgttatataagaaattagccgagtcgtgccatatgcagcaggatatacctatatataataccttagagagaagagttaattatatcatgtttattgctgaaaatgatgctgggttaattaattaattgatgagatatggggttactgtaacaagaatatatacgagagcaaactaacaataatactccatctaagcatacgttttatccaaatatcatactagtagtattatttatcgttctatcatataattactttccatatcaattccaaataattgatatagactagctattcgagggggtcaaacagcacgtactacccactctgcagacacactttagagatggccttccatcttaacatggactgcagatacacaaaaaaaatgatacatactcttaactggatagcacaagaacatataaaaccgagcaattgggatccattcataactgcaattgggatccattcataactgatggacgacgctggcaaactgcaccataggacacctaggaaaggaattcgcaccctactactcctaacgtcttgggagatcgatatggaattaaggagaggtaccaaagggtgttctagcataaagagctcttgactttagttctcgctgcaaaaatcaaggaggctaaaacctggaccctagcatgagcggaacgcctagcgcagatcttaccttcgtttcctttttttccttgtaaagttccgtttttagcagttttttctcatgtcatattcaatgaaattggtgcactttaggtactcaagaaaaatatttaaatactctgatgtcaattaatgtttactctgctgcattaatttatgtcttcctcaattcccttttggcttcttaagccactagttaaatactcgtgtttcgctatagattaaaataaattatacatgtgtgttaatattaattgcttgaaataaatcgtatgtaggaggactattttgtagtattaataaagcagttggtaatacaatgctctatacattagagttaattgctagggtgacaaccattatcttcttttgaaatgatatatagatattgatttaatatcctatttatatagttcacttcgtaagttaagatgccaattttgtgaaaagaaactgactggacaccattcgcccatatgacaataaattaagggttaaatcgcgatgaaaaccacccatccattgaaactacaaaatcatataacgccatctgatgggtatgttttagtaatgtccacccatacaattgtgtgggcactccaacaattgcgtgaattcacaagaaaattggcatcaagtgtcaattaataaccatccatttggcatagttgtatgtagcacctatgatatatcataatcatcctagcttgcttaattgattagctttctttcatccccagctgtactctctctctctctctctctctctctctctctctctctctatatatatatatatatatatatatatatatatatatatatatatatatatatatatatatatatatatatagacacacgcacacacacacacactcctacatatagattttgatcactgtcacaccattgattaccaacaatgacactgagcatatatttagcagcagcagtgatgctcaagtgtagtgttgggagggaggccactttcagctagctaagctaatcttccagttggagagccggccggctagctagctggcacaaacaatggttaatctcttaattaattaccatgacagctagctccattaacctcagtgcacacgcgaattaattaatgtgtgtgtgacctccaaaaatatttggtatattaataacaacaaaaagttgtataccaaacttaatagtatatatatatggcttcatgaatgctgattggaccatgcatggctggccctgcattttattgttaacatatataaactcctaactattgtgggcacatgcgtgcaagcaagctaaaccaccacacatttataattaagctaaccgttaggaattataatttcgcaaaaataacatggaatagtgctggcttttccagatttccatggccatggaattataatttcccttaatttccagttataaatgtcccttcatatacgaggaatattaatttggtcttggacgaagcccggtctaattaaataaacatttaatttgggatatatatatatatatatatatatatatatatatatatatatatatatatatatatatatatatatatatatatagtaaatttgtttggtgctccatggtgcccgggcaccattgttgaaattgagtatatatccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgcccgggcaccatggtgccccatatgagtgtcctatatatatatatatgtatgttgcgcagcaaactgcatcactgcaacaaatttaatctgatcaggttgttgaaaagcaggtatatatacatatccatcactaattaatccacatgtataaattatactacctaaattaaaatttcaagttacatgtgtacggggtgcaatttttattagcaaattattaatgaaactttgcaggtggggtcacgtacaagctagaatgacggcatatgacgatgcatgtcactgttcaagaaaaggaacagcttaattaattaattgaacttgtaccctaattgctacaaaatccaaccaccattatcggccttggtacggggttacggacgcttaggttttaaggtgcctgctggctgtactgttaactaactctgtacagcatgcacaactcagggttaatttacaaactttacaacttattttctccgttccataaaaaatcaatctagtaatgtatgtaacacatcataattcaataaattagaacatgtttttgtccagatttattatactagattctttttttataggatgaggattacaaattaaggggccacacacccagctacagtagtcctcatgagatctgcctcacctaatgcagagatggccaatgtcctcctagcctagtagcttagttttctgctgaattttatgagggcaattaaggttttaactagacatggatgatctcttcgggttatactgtacttctttgatttcaccatcaatgttcgttactgcaatgtatccctctccccaaatactgtactttaaatgttacgcttataaacatttataagttgtctagcaggaattaaaaactacttttcaaatatgtttcataatataaggcgtgcgtgcatgcatgcatacaattaattactccttccatccctaaatataagggattgtgggcgtatgcgacatatctcttcctgtccagattcgttgtactagaatgtgccgcatctgaccaaaatcccttatatttagggacagagggagtagtatctttatctcccctaaattattgttttctaaatcatacattctcaagatctctaattctattggatgcatgtattgtattagtttaggttattcaaatcatgatgtgataataattgtttcttagtctttaggttatggtcttataggtggttatgcctaatattttaggaatggagggagtattgaataaaaagactattgtgtctctcattaaataaggacctccattcctaaatacttataaatattactttctaccctatttagtggatccaaaataaaattaaagggatgactcatcttcttcctcctttagcccctcctattctccctccctttctcccttcattctatcattttatcaatatcgatctaacacccacgccagatcccctgcgagtagaataaaagatattgcgcacctctcattaaataaggctagatggtttgggaaacagagagagtggttggtgatagaaatacactagctagtagtagtactcatctaaaaatgcttttcatatttacgtacaaaatttaaatcctacaaatgtatatttggaaactgatgcaacaaaaaattgtgacttgtgagtatatatgaactatagggccgtaaaattgtagctttatattacacaatcctttaattgggacagtattatactactccagaaaaaataacttaaatgattaactaaacgtgacacgtttaaaattaccagaaaaaataattatcagatctgacacatgcagttagcaccacaacagtaggagtattaatttggttagattaactcaattagttaatgcgtgcgtgatccttacttaaatgcggttgctcccctggttggtcaaagagtctgcagcagcagcacatacagctagcaatggtcggtgcagaaaagtaaaatctggtttatagtcaatcaatttgcacggttaattaatcatctactactagcatctctgaacattttagtcagaaacagcgaggcaaatgtacatgtactacgtgcaagctagctagggtggcagaaggactgaaaaaataattttaacagcaacacattctcttttctttgggggtccaaccataatataacgtgtgtgtgtgttttcagttaaatattgctttccaatccaatggtccagatctgtcgttctatgatgtctattggaggctttactcattacacacatgtatatatttaagttcactgaattttgctattgatcaagtcaaaatattacatatcctgcatccaaaaaagctagcccaagtgcggatttagggctcggtgagacaccgaatggttacccgggctcgcagggcccaaacattgaatatatatatatatatatatatatatatatatatatatatatatatatatatatatatatatatatatatatatgggggcaccatggtgcccgggcaacatggtatcaaatacacaaaatcattcaaatttttcaaaattttcaaattctgagtatatacctagttataataactcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttgaactagttagtaaagtagctaatgttaatatctaagtaattgaaaaaatttcatactcatttgaattaggtatatactcaatttcaacaatggtgcccgggcaccatggagcaccaaacaaatttactatatatatatatatatatatatatatatatattcaatgtttggaaataatcatgagagatgaaattagataaagttctcatgagatttactagaactcaggcccgggctatggtctaaattgctcaggacctggatctgttcgtgttaaaagttacttctttcactttttttttcatatatgacgctgctgagtttttgacaaacttttgactatttgtcttattcaatttttttataaataatcatgttaaagaacatttgataataaatcaagtcacgataaaataactaataattacataattttttttgataaggtgagtgatcacacgtatcttaaaaaaatttatggtgttatacattggaaacgaatgaagtaattctttttgaaaggagacacacaccaacatgctccctcatgcatatataggggcctcagccctcatgcatggtcggctgcatgcactctgcaaaagtacttttatgtatatatataaccaagattatattgttcatacacgggaggtttgttaattcgttagcatatggacactacatgcaggaggaccatggaaaatcgtctctctatctgtctcactctaccaaccgtccggctaggggcggattcaacgtgggtgcaggaggactcaagtcaagtcccccgcactcaccggatctatggatacccccttcaattttttcgtcatggttgataagatagaagatgctaaaaatctcttaatagcattttaatatagtttaatactgagatgatgtgtttataccggtgtactctggtatgttgagggacgtactctagtatgttgagtccctcaaactttttatttctggatccgcgcccctgcgtcggctgaatatatagttaaaaaatgtgttgggcttcttgaataagattgctacacgtactaccctcgagattaataggaccatatcacatgcattgcaaagcagatcaatgtaatgtaatgtacgtcgttgcaaatatgtatagccgacgaaattaattattagatcgatcatgatctgtatgcatgtacatgtgtacatgtctgcacatatatgttcatgcaggacagggacaaatcaagctagctagctagctatcgacacgatcgaaccactcaattggtagcacgtagtagtattaatttacgtgtgtcatgtgatgtatgcatgcatgcatgcatgaatgattgtgattttatacctatgaacgatttgtcgtatgtatgtatgtacttacgaatatgtaagttttgtttttaatcttaaaattctaagcacttagtatcttaaaatgcaaggtatttacttgtcggtcagcggacgaaataattatcctcggcggttttcatgctatatttggtggtttttaaccaccaaggacattctgttttcttttcttgtagagggaagttatcccacgtataaagaacaatctctacataaactttaatagaaaaaatataagagtattagagttattgggattcgtgtattaaagataatctattatatacatcacctcttaataatttatggatagatgatataaataaaattcaagtatacaacactactccataacagatttttccttacaactaaaatcaatttttcgcagacggctggatggcccgcgtgcacccaggtgtttacgaaaatcacatttcccatgcggccggcgcaaccgcatgcgaaaatctcatttttcacatgcggtcacctatacctaggtcgctcccgccgccatcgttctcagcgtccttcacgccagatccgttgtcgccgactccctgccattctagcccagtgtcggtcactcctgcccatcgtcggttgtcgaccctcccgccgctccagctacgttaccatccgcgtgcacgagagggatagggaaaggacgagtgagagagagagagagaggagggaggagaggataagagaggataggtggaggaattaatggagaggaattggtttttatacttagttcacaatgatttttgcaaactgaatctctataaggagggcaggaagcatatatgaaaatctgattttcgcaattctcatatgtggccgtttgaagaccctgggatagcgatttttataggcaaaaaaaacagttatggtttgcttacaatctaaagggcatctcgttcagaaaaatcaataaaaacttgctctcagtttacccatagctgctactccacaggcattaccaagctaactaaaatcgtgtcggtctgaaaatcaattaatcaatgagcttggacacaatgaattaattaaccagcggccactggagaccggtccactctacgtacctatcgatggctttcttggtccatccgtagactcgattgatcctagggtacaaattaatgtcaatcgtttgcttctctctccccaataaattaccaccggaaaattggtataattaccaatcgattcaatgggggttaatccggccaattaatccatactcgggggatacgtgagcgaggtagatatatagcatgcatttcttgatgaacgacaagaccggtggcttaattaatctgtactatagctgtgggtaaagtactgtggttgaaaattaatgacgcgatgtattgctaatggagtactccctccattccaaaatataagacacaaccattcttaacctaaaaatcaagaaacaattattattatctcttggtttggatcaccctaataaatataatgcatgcatctaataaaattagaaatattgagggtggaggatttaaaaaagtaataatttaatggagaagatgtcctaattaattgtatgcatgcatacatgccttatattatggaatataaaaaaagtagttgtgtcttatattatggaacggagggagtactatctatccccgaaagttactaatgccatatttgaaaagtttgaaattataagaaacaacttatgcgtatatagctggatggtaaaagtctctaaaaatgttgggtttctcgatcggtctcttgtttattttatagatattaaaattacgaattcttaaacctaagtgagaatccaatttctgtgaagctagaaactctagaataaactgcaaccgttatatatagtagatgattccccacgctttactgtgagaattaccaagcaattctcaatattatttttacaatcaagttagcagtaaaaagaaaaaaaataaaacatcagtgtttatcagtcaaatgatactcgtgctttagtgtgaaacatattgataagtatatgttaaatattttaaaagtgatagatatatttgttaaaatattgtgcaaaaatgatacgaggggtgatgattagatatgcttgtattttcatttgtagaattaaataaattgtagatcatgttttatatatgcttgcacgaggttaactatataattatagctagtgggtgatgatgtggtatggttgtatgcatgtttagctttaaattttatagaaaggataagctatatgaaacagagcctaattaaattactgttacgtactctgttgaacggttgtcaaaatattgttgatgactgggggagtactggtgtactagtgtactactacttcatgtgccctatgtctaccaccccatcccatagcctaattaatccctttgacaattaaatatactaaattaggaaccaataaatcacccatacaattaggtattgatataattatactatgtttgctgttaattagagtagatatatagcatccaagaatatatgtagtcaaacattaaaaatcttaaatcattaacagatcctataactccatttcaatttacatgggtattctagcatttaatttttttttcacaatacttgtcatgctcattttctaaagtatttttagaggtgactttcactgtctacctttagagcaaaggataataatgtgctataaatctactataaccttatttcgaggagagatgtaataaaaaataaagggtgttagctctcatacaagagttagcttaacacatgctctaagactacaaatacatcaaagtgagtgaaagaggtaggagaagaaaaattgaaaccaaccttatatatagctaatctattatactatatatgttagctttaagatgaacgaatagttgacaatgagctctactattagaaacttgctcttatcagtgaggcataatatagtactaatactttagagaagaactttttatgcttgctttataaaaatcgattgcgatgtaattaatgagggtaagggtaatttgccacacttacttatttggtgtgattttgctagaagcctagaatgacaaatagtaaaccatgaaaagaaggaaatataaaaatacttttactatgtgaaaatgtcactattagatttgctattaaagatactttcatattacttactccatccgtcccaaaatataagtatttttagcatagtgacaagtcaaacatttttaactttgactattaatagcaaataaataaaaaagatcaatcaggtaaaattgacattagtagatttatcgttagataaactatcacaatatgcaactctttttatttaaaacatcttacttttatagatattaatgatcaaattagcatctcagagaacgtgttagactttaaaaatgcttatattttgatacggaggaagtatattctcaataatatttataaatatacagtttgaaaaaaatatcgataaaacatgtgtattggagactattatgcatgcactgataagagcaagtctaaaactattagtttatcttaaaaccaacgtcaaaattaaaacacaagtaaggtagcagcttaaaacgccaatagtatgcatctgaacagtgacctcagtgacatttttcagatgtgcccctgccccctatatttgagacaagaaaccgtgtacctcgacagattagaaccccaccctcatgggctcaggactcctataggccagcttagtttcgatgatctattggcttcaccactgcatccactcacaaaccattacatttgccgtgcaaaattagcaagaaaattaagcatgcatgtgcagtagtaccctggactctgttcttgtggttgtacattcatacatatattatcagtactggctttagctatagggtgtacctccaacaaataatagtacatgaaatcaatcaatcaattaattcatgcatgcatatttagatcgatcaacagtgttcatgtactagctagctagagtacttcctatacaactgatcatatgctgctatgtcaagctttagatcgatcgatctctattgttactaattaattacttcctcattacaaaaaagttacacctattatttttgtcgctaagatcaaagagaaattaactcaggttgcatgtaacgaaaattaaggaatgtatatgcacacatgcaactaatactccctccgtccagaaaggaggacgttctaggttagttaggaaaaattagtgttatgtgaaaatgaccattttgccctcaatttataggattggggctaatcatttgaatgcttagtaagtattaagatgactcatcggattctgatcaaacatttaatttacctctatttaaatcttatatgtatagagactacaaatagaaacaacttatttagaaaaacttaaatatgaaataagtctaactaatcatgtggatggatggaatataattattaaagaatatcaatcgatcgatctctcttgttattagctagttaattatatataataattgtaggagctagctgatcgatcatcagagggagctaatagcattgaaaaatatctaagctactgtgtgcagtacatgtatccagtatcgtacctaagatatctatttcggtacgtactgttggtaattttaatatcatgcatgattcgcagaagtgtaagtacatacgtacagcttagcttagctgttccagttattattattattattattattattattattattattattattattattattattattattattattattattattattatacggaatacgcgcacacatacaacacggttacaacacggtcacaccacggttgttgtgtctcctcttaaagagacggagactagcgacacatctctagtctcactaaattcctaaattcctagaaagctcactcatatgtgcacaaaattttggcacatgttctaacttttctatttatttggctccctttttttataatggaatttatcccgatctttgctcaaaatattatggccaaataatatagagctagattgcaggatgaatgtttgcgacttacataactacggcttgattggaaaaataaaactaaatagtatgctccctcaatgacagatatttccatctaaggttggcaggagtatgcttccaagttatagttatatgtagtgcttgtctttctcaaatcagaaaagcagaatatctccaaaatcataggttgatctttgtcaatcgaatgtcgctccgtttggtattacaatatgttgtatggcaaatcttgtttggtgcaatgcaaacggtaatactataattaatatatagagagaatgatacgtcttgataacatattttgcctaactacaatttctgcaaaacagattgcaacaatcatgcatgactttattttacatcaacttaaaaaaaaaggcacaacacactataattaacaaggtatggtaaccacatattgccagagataattaattagcttttggtaaaattcatataaaacttttttaaaaacaacaataactacatcccgttatgcttttctttatatataaaaaaaacatgttatgcatcctcaaattgttggctagctagcttttcctccatcatggatgatgaaacgacactttggatgcatgttacatggtacacatgcttggagtggaagcaagccaagttaaagaaagaaaaaaaaagggagatctcatctctatatgatcatcaatctagtactacgacctgtatgcaaataaaaatagtactagcagcacatctctccaacaagatcatgtccctgaaaaatgcagaaaaggatgatatcgagcatatgatatgcatcgcatggtgacatgacatatagctttggacaactttggtcgatcgatatcgacatagatgagctttttacatgatcacttttttcatcgatcatgcatcaggttgcatcatctcatcttaaaaaaaaaaaaggagatttggagggagattgacatccctccaaatactattttaagaagagatatgagcgtgttggggattgaaaacgagatgtcgggattaaagccactacacttgacgtgcatctcgcatcatctcatctcgatgtgatcagtcgtactaagtacttgcatagttgcatgcaagctctcactgtaagcaaacaaatctagtgattgtgtactgatgtacttttgcaaggttaacttgcaaacttgccgggttaatttatggcagggagtagtgtggtcggttctgtttgctaggagtatatgtgtagtgccgtgcgtgcatatatgatgaatgcaggggtaatttatttgcagacgcgtgtactatgcacgacaacatcatcgataataatacagaggcgtcactaggacgtgtaaggatgtgtttgagaggggggatgagaagatatacaaaattaggtgaaacacgtactaacgtatgataattgatattaaatattttatatttgaaaaatagtttaatatgttttttaagcaaactttttgttaaattttctttaaaaaatacttcgtttatcagttcggaaagcgtgctcgtcaaaagagatagagttttcctcttgttgtgctgctgccgaatacagtctaagttatttttttatcatgtagttagtagagataaatcataaggacgagtgttgcaacatagtgggttatttgggaggtttcttaaaataaatagctcaattttatcatcctctctcattttctctgtcaattattcggccactctttctccctcttgaagcatgtgcatatatatatatagagaagctgttctagcttgtctgagaactcgtctccctctgtccctatcctcgacttctcgcaacagcggatcggattgtctggtgaccctaggtggcttgattgggatcgtcggatggatgcacgataaaatgtgatatttttatgaa

SEQ ID NO: 72870 - DNA, 7112 bp, Oryza sativa
  unsure (1)..(7112): unsure at all n locations
aaaaacacgtattagatatgttggttcatgacccatccaacagaaacgaaccaccacccattcagttttccccatttttcggatctggagagaggtgatgggctgatggctgcggtgctcaggggagcagttgattggccacgatggcggcttggtggagccgctcagcgacggcagcaacggcagccccggcttggagcggcggcggccctggctagaaacgtcaaggcggtggccctggttcgaaggagcagctcagcggcggaggcggccgccaacttcgtggcttgagccggaggcgaggttccgcgcgattcgattcgatttgattttcttttgtgtgtgttcattgacggtaacaatgacggtagcgttttcttgcagcggcgtcaatggaagccagctccacgatgacgggtgaccgctgttctccgcccacggtctccaccgggatcccttcagacgccaccaccctcctcgccaacccttgccgacctactccacccaagccaccgtgacgccgctccaccggcttcactggcgttcagctctccaccgccggccccgtcactctgcgaccccctcgccatcttcgacacggtggccgcctcccgctccttaggatccccgagtcaccaccgcccttgatgtccgccttggccatggaccattgaggaggaccgaattctgcattggtcatttgtctttgttttaatctttcacatgctcattgtttttcagggatgaatacaatggatcattgtggtaggcctgctcctagactgttgtcttcatgatgcattcaacacctcgttccttgctccgatcttaattttaactttagtactgaattcgtctatgcaacgttcaggaaattggaacaagaccaggtgagcttctgtgtaccattattagattgaggccctaatgattgcgagtggtggtggtcatatacaatttcttttttggattgctacttatagtcctgcggcctggatgttgtttttgcgatgcattaatcacctaattttcatactcatatgaatttttatgtggccagacatgaatttgtgtgtgcagtattgttagaaatctgctcacatctaaattttcatttgttcagttatcaggagttggcgcccttgctgtagaacaacacctgcaacatgcacatactctgttgtttctccgcatcggctgtttttgccaatgaggcggggatggcaaccttcacatctgccgctgcctgactacctaactgctatatctgcatgttttttttggaatacttagataattaactagtgaatgctctgaattttacttgatgcgagaacttgcgttggaggcatagcttgatggcacagcagttcacaatgctctgctttaaatgttcatgttctgaactttttgggttgagcagattagttaagagtggattgctccaaataggttagctgaattttgttctactgcaggaatgctctgaataaattttgtagacttgatatttggattaaacccgttattttcaagtttgtatatttctatgcctcattgatatgcttaaatatgacacccctcacttataactgttggctaacaataggcataataaagtgaggttcttatgaagcattttatttcttctttagataattgtatctcacttagagtcatttatgagtgtaaatcacttagatgatttaatctttttttgcaaatatccaggtggccatgggatgcctccctagatgatggccgtgggtgatggatatctgttgatggggaggcctagagaatctgcagcactttgtcagcttgattcgatatgtggcgccggagtcgtcctactcgcgggattcgggcaagggtcgacccacatcgttaggcctgatctacattgttggtgttgttgtaatcttttatttgtttttgtgtattctaccaatatatcgcattgtgtatgttgattagatagttgttgtaatactaaatcttgttcaaacatttctcggatgttcatacatcttttactcaagcagtctgggactaagaacaatcaatttactcatttactcaaggaaggtggatcaagaaaaacataaaataatttatttactaagataagactagggtaatttttgttgctaaatcaaaagtttatacttctaacttgagaataatttctttactgatagaaggttggagcaatcaaatcttaagtaactatgttactaattaaagtttactggtagttttatctttcagtaaaacaattactaaaaagtcaaactttatggtacaataaaaccgcaagtaactttgttactaattgaatatacagataatgatagtaactgagttactcaatcactcctatcatttctccacgtggtgttcgtgcgacccagagtggttttgtgtgggggcttttacatgaatattaaattgttaacttgtcattaataacggtaaggaactcttcgtaaaattgttactcacaagcatattggaatggttgccccacaagcacttaagtaaataaattactaagatgactaccattcagtaaataacatactaatatgtttacctgtcaaaaaaaggtgcggtatggattcattatccaattttcacgaataataaatatgttactgatagtgtattgtactattgataaggcggtagtaatcgttttactatatatgattttgaaacagggattggggtgtggggtggggcgcctgggggtgggtgggggtgcatactgtgaggagagtgttttagttatagcgcaccccatacgcggtttagtgcatccctatatatatatatatatatatatatatatatatatatatatgatgattatttacacatttttacaggatcctcactttaaaacaatacctggttgctgcacgggcatcttttatgcaagtggttgctcttcctgataagcagcattctcttgagatgaccactgtggggtgcctcttcctttcaacatggatccgttgtttcacggacgcattctcaaggggcatgagctggaagggagatttcacgctggatgatttcaagatcgtggatggccacgttcggaggatcaagaagcccaagcggtcttgctgcagggaggagatgcaggacgatgtgagcaagtttgtggaagagatagagcgtatcttcagaaacgatgacagtcgactcatctcaaagcacccaccctacttcagagacttcatctatcgtctcaggaacatggaaatcatctctgatgccctatcgcctcggcataagctactcatcgagtcacacatgtgctttatgacttctagctccagggtatcattcataattaaactctactgcaagtacgaaggtgccaatgaatctgatgaacccaagtgggcgactgcaatacaagatgctcgtagttcaagtgaatggcgctcaaccgtgtctcgagtgatcatctttaaggaccttattgttagagctgacaaagctgaatcaccatatggatcgacaaggtttgaagccttcaggcttgttagaaatgcagccatgcatgctgcagaatatcgattcgatgtaagtactggttatatatattactgtgcaattgatcgattagtgtttttattattattctcttgctaactttctggttaatttgctgtgcatgatacaattaaacagagtacagtactccctccagttcctaatttgttgacgttttagacaggattacacataccaatgagtgattaattagtgtacctacttcatgttttacccctaataaatacggttttaaggcataccaaatcataacctgctcttggtttgagtggccatctcatgcgaaagtgaagctaccagtcctgagttcgattcttggtggccacatttttttgcatggcactgtggatgcatgactgttggcatgcatgnnnnnnnnnnnnnnnnnnnnnngtgctcccggaaaattttcactcgcgcgctgctaacaaaaattttgccaggtgcgtttgccgccaataactcagattttggcgctggtttgcaacagaatcccctttgccatctccatctatttatgctgtgcaatactagctagtttgacgctccaactccctacatattccatctgtttaacatgaacttgaacatggagccatgacctgctccatggcgaaaatggcgaaagtagtacaaggaggcgagtagaaggcaaagagccaacaagcagacatagaaaaaggaaattactcagcgcgtgggagagcaatggttgaacaggaaacgagaaggcaaagcatacatgacgttggaaataatgggagtagtaatggccggctgcatgcatgcagggacaagcaggtccaagatgcaccaaaaaagctaaaacgtcaagaaatatcacacaatgcttcaaactaatttcaaactggagggagtagtagttaagatttctttctttgtttgacgttgtttgtttgcttctcttttttttttcttttcttgcagggtagaaggaatgcaatagttgagaggtttccaaatgatagtggaattgaacttatgataccttgtcacttcgaagaatttattccccacattgttgcaaacataatcaaggagggagttgacatcactcaggagtatgatataattaataaacttagtagtagaaatagtatttttagtcaatcttataaattcaagtcctgacatagtgacatgtcataacttgtagcttgtcggcttttgctgtgtgcactggttgccccacatgtgcgttacttgctcaagaacaatcatagggtacgtatcatctacgagtattactacgtactgcatttttcatcatatatttgtgtttttagtggattcagcaaatatttgttgaataactacatgtgtgcccatgattaacatcagatatttataatgttccaaaatagttatttttagataatcattttttggcaatgtttactgaatggatgcatgacactctgttttgttcaacgacccatgcataaacacaatttagggagttttaccttttcattcaacgacccatgcatgacactctgtttcgttctccctgtcttttaatttcatctatgcatcagtgtccacaagctattagtactatgtgttgaagatattatacttgccgtctgcatttatattcttaactggagtagtacttataaaacagctagccctgcacgcacatatgtatacgtactgaggcaaatatctctgccttctatcaagttgcactaaaacatagtagtataagcaaactgactggtctagcttagcttcttgctccctaaattaaacatataatcggtcggtcgatctgatttaatttctgtcgaggagatgtatgtgaaatcaacgtcatgattaatatttgtgatgaacaattggctgtgcaaatgattttatcaatgaattggtttgaaaagatgtgtggatgttggtgtgagctgcgtgtgattaatgtgggtcagattgtgatatctgtgcctagaaacggttgttttgtctgattttgtgcaggtgacttgaggtcagccttagtcaatggtgaggaccggggctatgctcagggaggagtagaggtctagtgcggtcgggataccatgtgagaaggttactagagtctggattcttggaggacaacttcggtcaacggtggggatcgggactaaactcagggaggagttgaggtccagacgatcaaggataccgggtgacgaagttggatacaacatggcatacggtggatggacatcgtgtaggagagatcttcgtaacgggcttcacgaggtgtgcgtgcaagcgtcggtgttcgcgaaggtattggagaagagtatatggtgctatagtacggcatggtactgtagcatgcatatatgtgtgattgatcgtgtctgtgattggctggcatatggtgctacagtacgggcggtactgtagcatgcatgtgtgtgtgcgttctgtgcaaacaggtagcaatgcagtggctcggttggatacagaccgtgtcggcctggagggcaaggtagagaggccgagttggtgtcgtcccgtgcgatggagaccgagaccgagccggtacaggagatgcgtgcggctgtagtttgagagaattgtagtttggtttggtaattgaggatagagttctactgtgactaggagttgttctactactttaagtaggaggttttcggtataaatagagagggagaggtagcctcccggtatcgcttttttatcgttttgagagcaattgagttgatagtttagttagggtttcgagtttagtcgagatttttgtaaggagtgctgttgttgcactttgtaaacacagagagaagcaataaagttgtcatctactttgagcgtttttcgatttgtgtttcttcggattcaggcggcagcgtgtgagcaatccgaccggcggcgacaggactatgttgagatttccatcgatttgagggtaacttttatttccgctaaaagtttttgggtttttggttttccctactattcaccccccggtaggtttggttgcttgtgttcgatcctacaatgtatatatgcctcctagtatatacttccttcgtcctataatataagggatagtgggtgatgtaagtgtgtatgctgggattaatggtataggaacttgtaattagactggaaacattttttttccttgaacggtcactggtaacatgtttggagtggctatctttcttctcgtttgcctgcatgctccttggttaatgcgatgataatggagatcacccttggctagctataacttcacttggagttcttttaatttatgagatgtaggcccaatgggatcatacaagcgaagcaattagcaatgtagtatagatcatctttacaattaattaataatataagatcgggagcgtagcgtatagatcaacatgaatataagtaaacattcttttctttggttaatactgttggaattaatgaatgggccttagcccactcgaagattaattctttggaaaattacaaaagcccacctcatgggatgg

SEQ ID NO: 72871 - DNA, 34558 bp, Oryza sativa
  unsure (1)..(34558): unsure at all n locations
cccaggattgggttttttttgggatggagggagtatgtgatttcaggcagaccttaattattgtgttcagcattcaacataataaaatgaatcatgagaactctcagcgcctcccaggcggcatagcacatgcaccttaccgctcagtgcctcagccaccgtcatatttccaatgtcatatttcccgtttggtttggtctgttattcgaatggttttaaatttaaaacctcctcgaaatgtaactcatatgtttgagtattggcttttatgtgtttctaaagacatgagaatctgcttttgatgagcgcagcagctctttgttggtccatttggctaagcaggaatggagtattgtttggtaacaaaatgttgtcttctcctttgcaggttattactttagttacccggtggctatgcacctggactatccttcacaaaccgggacttcggaatactattgcgctggtatcacgacgtttggaccaggtggcgcagagttttttaaccaggagcatggatggcagtctagtctacggattgatagctactaattttatgtttccttcacactcctgtgcttgggatgaggttgtttcttttatggttcctttttggctgtgtgtatttcgtgcggaggccggaggtgagcttagttggattgtatcatctggtgtaattgactgagtcttaataaagcttccattatctaaaaaagtgcctcaacaactgcttaagccagatattggcttaaactaatgcaagactgtcagggctttgcccaacaatgtattttcattttaaaaataaaatatttacaagaagttaaaatacatagtggatccaaaattttacaaagtttgtaaccaatcaacaactaactntgcttcagggatctttattctgcatatatgcaaaaaaaaaaccttatttcataaattgagccgtctaagactggaaagtgggcagaaacattatgaaaaataagcccattcctctgttttcaaatatgccaagatgccatgaagaagatttctagaaaacctttttgcccaaacctcaacttgctaaggcaaccatctgcaagaaatcacgattggaattccaaataattcgcaggtgttgccaacatttggtgttgaaaagtaatgcaaattgttgatgcaacatcttacaactgaagaaaccatacgatctccgatgcctcctaggccaatcttcacagaatcgttcatcttgatctatcttctgtaccattcgtcttttgtggtcgtttctttgctcattcatcaagttatatattatagactatcagtacaacgtactgcactatttagtacaggatctgccactactacaaaactggtcttttgtggcggccaaaacacattttcgctgacggccacaggcaccgccagaaagcaaaggccagtaaagataaaacatcttcgctgacagcgaccaatcgctagagaagagatgttttcgctgtcggccagcttaagacagatgctagcgaaaattatcttcactggcggcagccatacgaggaccgctattgacaattgaattttgctggcggctgtgttaagccggccgccagcgataatcgattttgaggcaaaaaattgaaataaccacgtgcagttaccctttaactgccagcaaaaaaaaataatccacattcaaaaacattgatgcattttcaatttttaaatccacatcaagagatctaattcaattcaaatccagatttacatcaacatgtaaacatcaatttcacacaccatccaacagtccaaacatctacatcgatttctcacaacattttcaacattcaaacatcaacacatagacatcggtcatcgtcgtcgccagcgaccttggaggttgctgttgccgccatgtaacaccctgaaaattcctgataataaaaatcactaaaatttcaaactttttaaaacttttgcatcatgttggttgttatgattcctattgcttgccaaaccataaatgatcacaagaaaagaactacatttaagcaatagatatgatttacgagaatatatttaatcctacaaataattatgcacaagatattaaaatcaaataaaagaaaagttattattaacctattttatcaaatattaaaatatttgaataatgtaggtgggtgccataatatgagtacacatgaaatgatgattattcaaataaattgagctctctgtatatataatagaattatgggagtattaattcgatatgtagatcgatattacaccaagttcctaattgcatttagggattgaaatttaatatattaaacccctccatataaactaacatataaataaattgaactaatgtgctattgtgttaataacggtctcattagaaaattatagaatctttaataaaccttaaatattggacaatattaaattttgggcaaattcacatttgaacacttaatacggtcacccaaatgcttaggagtaaatacaaatttaatttacaacttttctcaatttataaatcaaccaaaaccctaaaagaagaaaaataggaaaactttgaaaaatatataataataataagaatatgttcaatattaaatttgaatataaatttcgatggaataacttagacttggtgtattttacgttgtgacaaaattagtggcaatagtatattttttctaattgcaaaataccttctaaaaacaaaaatggccggctagcactgttcattagcccccctaggtgttcgatttggttcctagccatcctagccctcttcctccgcactgccgctgccgcgtcatgtcgcgtcgccgtcgccgcgccgtctccaacccgccgcgtactgtcgccgtcgccgtcggctgcgccgcgctaagccccgtgcgccgtcgcgtcgtcatcaccgtcgcccgtgctgccgcatgttgccgtcgcccgtcgcgtcgccctcgagccccgcgcccccacaccgagtcgtgcgcgtcgcgtcgccatcacccgtcgtgtcgctctcgagccccgcacgccatcatgtcgccctcaagccccgcgcgccatcatgtcgtcctcgagccccacgcgccatcatgtcacccttgagccccgcgcgccatcatgtcgtcctcgagccccgcgcgccatcatatcgtcctcgagccccgtgcgccatccgtcgcgtcgaccattaagccacccttcccacaccctataaatatcccctcccatctcccttcttccccacaccctcttggctgccatcacaaggccccaagagcccccgagctcgtcctcccctctcagccactcctcctcccttctacacatttcatcgaacaccttgtgggcgtgctgcatcttcttctctactccacggccgcgacatcgaacttcgtcgttcctccacccctcggtaagtcctcactcctctggcctctcctagttccgtagaaactagagccccctttaatttcgccaattagcaaccgaagccgtgccggttcggccgccgttccaccgccggcgagctcgccgtggacaagccatcctggagctcctcctctccatctaactagcaaaatggaatccccatacgccgtagatgctcaagccctcaccaatttggtcggaaaccctccccatcgccctagcacctagccacacgtgcccagccatggtggccatgctgtgccactcgcccccgcgccgtcctgcgccgtggcagccggcgggagatcgccggagccttgccgcacccttccctggccgccgtcgggtcgccctcggccggccttgccgtgcgcgtcgtgtttcccctgctgctcccgctcggtcgggaggaagaaggagacggaggaaggagaagaccatccgagccactgacaggccgggccctctccttgcttttccctaagaaaattaattcagtagaaaaagaaaaggaattctgggtcccacctgttggtcactagggttatggattagattacggattaaaaaaaatcatttatgaacggtagccttttacaatttttcggatttattccaatttgaatctttaaactagcgtaacttattcgttttaactccgattcgagtgaaacttgaacctaaattcatctaaattcataagctttccaatggtatacaattaactgtttaataaaatatatttataattataaattaattaatatcaaatgattagataatagttaacctaaatagtgtgccaataaataaaaatggatattgtacagtagaataattatctttaatatgttttgtcactgtagcaaccacataaattaattataatcaatgtttgaaattaatggatatataggaaaatattagtgccatttattaatctatgtccaaatataattaaaacccatgacttattagttatttaaatagagttagccttataattattaggtaagtaaaatatagatacacatagatcggtcctaagcttgtttatggcaaataataacagagctagtgtgattaaatcacctatatgaaattaatcaacgacatatcccatataatagcatatagtaggagaggtgagcaacccttagttaaccaagcagtaaatagaaactattaaaataaatgattcaatatattaagatattatgcacacatatattgtacatcccattatagatatatggtatcgtattaatttgcttgttgcatatattaatttagagggagtatatgacaaacatgaatattagataaatactagttatacatcttgtcctcgtataattacagatcaactgtaaatttggattattcattgtaaaattatgtgatgggataatccgtaaccataatatgattaacctaaacaattctaacatacaaagcatgggtaattgttaaccttttataatttattttgacaagtgaaatatgtacataattaaaataaagcctccattaataaaataataatacaaatgattcacagtaattatttgaccgatccaaaatccatccagtaacagaacctctagtgtataaccgttctatttagatagatgcatgtgtaaccataatccttccttagccattagctagactgaaccaccatgtagatagatgcatgtgtaaccataatccttccttagccattagctagactgaaccaccatgacaacagaaagactaagaaaccttagctcttagcttgattagagtccattagcaagcgcgaataatatgagcaaccttaggttcgaccttagcaaatatattttgtttgtgcatatttgattgttgcttgaatattggtttttctcgcgtatttatagactttgtgtatcggttagtcgtgaggcaacgtctgcaacttccaggaggtgaaggttaatcaagattatatcgagaatagggattatcctgagcaggcaagtcatcaccattccttgaacatgttgatcccaattgcgaaattgttttgtttacaaataaaattgtatgcaatgatgaacatcctacttgtgattatgccatgccttgattattgtttacccttaaaatccttgtaaccatgattacgtatgagtccctagtcaattatgacaattgcttagaaatgccattctagaatcatgcatactcatatttatcaaatgctatatgcttgggcaattacctttgggaaggcaattgagatgcggcatgtggagacatgagcgccacattgccatgatgttgatgacatgatttttgaaaggagaaataaaattaaacaattgttttcgactggggcggacggaggatttgggtggtatctgggaaaggctagtaccgtccccggtcaattaaggaccgagccatgaagttaagcatgaaacgacccccgtacaaccgtacttctcgaatgggtatagacctagcggattagatagccgagcggaggcagtatccctacatagatggttcacccctgagtgatgcaggtgcgctacgatgggacagccgttgaggtaaggccgagaggcgtgccctacatcggtgtcgccattggtaggactgccatgagtgtgtgagagagagaacttaacttgaaccataatttaatatgtgtgagacttctctttcccgggagtgccagaactcctcacactgctagaaacatggactcctagagtgcatgaggatttaagttcatggagcaggtactgccaatgcgaggttatcgaaaagctttgccgtgacgcgtctcatgtgttgggacgaggctcatgtgttgggcagtcgcggagcgcgggtaaagtgtacatccactgcagtgtgagtaaaccaaatctattcgaatagccgtgctcgcagttattgagcaccgggacatgtattacacttggctagactctaaattcttaacctgtgtgggataggatattgcatgatgatttttatgctgatggagccacttcctgagaggagggaaggtggacgtcctcagaaaaccatgacgactcaatggcgggaagctatccttgggatcacaatggatggtggacagaaccgtcgttgtttaatgtgaacactggtattaaaacttgatcaatctatgctaggtctcatgcttgtgaaaagatttgcaaaagcttgctttacgcaaaagaacctggagcccttccttgaaataccctctatcatatgcattgttgttgtggtggcttgctgagtacggttggtactcacccttgctatttatatatcttttaggagagtgttgaagagaagcccttgtcgatacgcttgcgtatccaacaagatgatcggagtgcggtcttgttctaggtctcgttccccagtcgactgcctgtggcatgttaaccgggcccttatattattttgtcttccgctgttgttctctgatagttgttggcctacctggccctaacgtaagtatttaactcttttagcctgaattcattcatgatatgttgtgatccaactatgtatgtgtgtaccaactactgatccagggattggtacagataaacacagaagatttccgatttccaaaatcgggggtctacacgccaacgaagccatcccctcggctactgctgccgccgtgtccctatggccagatcggggagagggaggggaggggagggagggcgtcaccggtctccaaccatcgcgccactggatccgtcccccgtcaccatcaccgccgccgccttgaggctggaggaagccactgtcgcctagaggggaggagaaggcaatcgcacctagatctgagagagggaggggagggagggcagggtcaccgcggccctccgacggctagatccaccgctcgcgcccctcccgctgccggatccgccgcctgcggccctgcgacggtcagatccaccgtgcctgcacccgcacccgtgcccctcccggccgaggatcacggcacccctcctggcccctcctggtagccgtcgtcactatcgctagtccgccgtgttttccaacactgaggaaaggctggagaagaagaggaggagatggaatgggagaggaggggataaggaatgggaagggataaaattagtggagattttaatatagagaatattttttcgtagtcggtgctcgttagctaccaccagcaaaaaaataatttttcgctggcggttgtttaagtgggccgctagcaaaaatagctatattttctctggaggtctacgtaacccacccgccagtgaaaattgattttcgctggcggtttttagccccttacccctcgttacaatttcacaggcgggatacacaaaaaaccgccagcgaagaaaatatggtaccgccatgaaaaatctattttgcagtagtctgctgatcttgaagactgtcacgcctctggagaagaagaaactggttgctagaatcataccaagaacaaaaatattttcactgaaacatttgaggtaaataaaaaattaatggcctttgattttttactgctctttctttagcagggtgcgtgaggtgtgttttggttgtgtgcactttgttgtgcggagcccatgagtgttctcagaattttgagattagtaaagcttccattactaaaaataagataaaataaataaataattagtgtctctctgcggcctttaactctcctatcccttgcacccctggtgaatatacctgggtgagttttgcaatgtcagataatacatgaacgatccagattgatgtatatccctacccctgaatgcatgctggtgtccagtgcaaaagctgctcatctttactcccctgaagcagcatggggaaaatatcctttacacctaggtaccatggtagtatgcatgcggtttaaatagttatataaaatttcatacaattttgacgacattatgagaatataaaacagtatgcaaatatgcaagtccaggtagcgtgaaaccaaatggcccagtacagcacctgcggcaagccatgttccttgctgcacaggcttcctccagggctcccccatcgactcggcagatcgaattcaacagggactttctgaagcttgtcgaattcaaattgcagccactgaaggatgcaactgttagtgactaccacacatccaccacgcagtgccgtttttgccagattttggctcaatgactagctgaggcacaacaacttccatttaaagcattcatacatttcctgattcctcctaggccaagctgctgtctgcactgaagtggcttctagctccttgagagttgagacgacattgttcatctagatctctctaccgttagcattatatttctttgtgctgcataggttgctcatggatagatgcgtatgtagactaggaggatatatttatatatgatttgatgtttggcataaggaagatgcgttagccatctattcaaccaagccatctcagtgaaggatctataatatttatggtgtgatctgtttaactgttttgcaaagtcacaaaaaagatgacccgaagaaaatggagggagcatcctggtgttgtattggagaggatgcagatgtgagttctcaaaaaagaaaagatcagatgtgctaacatttaatttcactcggttattagttcagtacatacatacagtcattattttgttcaatcaagcaactagcaggctacaactgaaaaattaatgttgaccaagtaggatcagccagatacttgctggatgttcatctgttgaaacgggcaagcaaattttcacaagatactagctgaataatgtcgttttgtcacaagataactcgtggacgcgtagctgaagctgatgtagatgtagcaaattttcgagatgagcaaccagagtagaagctttgctactaaaacttgcatgagcaggatcatcatgtcaatttttgctaccaaagaactaatttcctatgaactgaacctatgtataccatatgaactagcactcaacatggccccatctgtactccaaaggtgtagagttcgcgtgtgtgctttgagctcctatatatcatgctaccaaatgagtgtattattgtcttctttgcatggaaaataaaaggggaaacggaaagagagaaaatttcacaaaactatatgttttggggttcaagttgtagaaaaccacacacattttttatatgtgtccatcaaaagtaaatgaagagagtatttagggtgtggacatggcatcgtgattgttccacctaggataaagctcccaagtctacatcctaggtggaacagccatatcatctcgccggtggccatgtttgttgacagtgtagttttatgaaattttttaatccaaaatatatgtagttaagtgtgcccaagtgttaaagtgtgtgtggtacaaataaagcagtgttagggcctacttgctccctgcatttgtattcgttgagttgatctcggtcgaatgctccgatcaaggtctttataatcactcgtcctgaagctgctaatcagctggtcaccattttcgtaatcattagcttcataatcaccacatgtccactattgggtggaaccaataaggcataccaagcttagttcaaaatgccaaaacaataagaggatccaagtaggagacattgcagttagctgatcaccattttaggttaaatttgaaggataaattttctcctcacaatataatgtatacataacaggtggtctgcaggttgcagctcaacagattgatgatgaagtaccaatcaggatcagtaaacttttctctgatttcgcctgattaattatgcgggtgatcagaaagtaaatgacatacaactcctatcttccagtggttcagaacatctctactgcaatgaacatgctgtcaatatgcagttgaaggtgcaaaagaacaccacgaaatgaaaagagatagccatttgcatatccccgtggtccattcttctaatatatttttgcgaacgcacaaaagagttgcacaccaatatattcttgtaatatattgacgtgcaatccttttgcgcgttcgcgaaaatatccccgtagtccatgggctcatgacatgaaaactcccgaatcctgatgcctcccaggacaaccatagaaacccattgctgtgacctttgcctccatgaaaggattatctcagtctctctgaacaaaatatgttcatttctcagtttgggagtctttactcactgttaaaaaaaaggaatccttgctctttatctgcctgtaatagaatgttttttccaactgatggatgtgaggcttattcatatcttaaattatgtccatcaccctttaagacagataaataatttactacctgtatcaccatcactgcgggatctgcccttggatgtgtgacttcttcatatcttaaaaattttgttcggctttggaacattagtaggttcaatatgtgtttaattacattcctattactgctagtcagttgaaatgatcagtatgaccaaagctatgcaaaattttgaatcctgtgatgggttaacatcgctttgtaagcaatgcgagatcgcagtggtggtcttcaagaaagcacttggtgaagaacaatttgctcgaatctgacaagcttgctttcatttttgttcgatgtcatctgtacaattgaatttggtgtggtttggtgtgaaatctgaatgaggcaactatggtgcgatctgtttgtcaaattcagaaataaattagcccgaatggaattgaagtgaacacccttctgatgcatgtcttggagatgcatatgcttaaacaaaatgtctccttaaacctagtacaaccatccacccaagtcactgaaagttttagtctgtgatcaaatgtaatactaatatctactccctccgttttacaatgtaagtcattttagcatttcccacattcgtatagatgttaatgaatctagacatatatatgtctaaattcattaacatcaatatgtatgtgggaaatgctagaatgacttacattatgaaacggaggaagtaaatccaagcaatttattacttcagtatgtgaagtcattcttgtgttcacttgggaactagtagcaggcaaggcaaggccaggcgtgcaacagaatgagagtagttattattattattattattattattattattattattattattattattattattattattattattattattattattattattattattattgaaaagaggagagtttatattgttgttgcactacatcaagcacattgattttcaaacaaaaatcttatacacaacacatttagcactagattggaccgaggtctcgtatcatcccattgtgccaaactgaaagagagctcgaactacatacatggatggagcagcgcaaaacctatagcctagcagagcacctgtggaaagccatgcccatgaggccacctgtggtggcaatgctatccaagtcgcacacagccgccatttccgagcttggaactcgacagcttcttcgagggctccattccgctaccgtcgactcgatcgctggatccaactcaacatggagatttgcagccactgcaggatgcagctggtagtgaccatcacacttcaactatgatcatatcaagtggtttaaaccattgtttggctcaaagcaggagaatattctggggtgccacatcttctctttgaagtgttcatacatttcccgatgcctcctacgccaagctgctggctgtagtgatggcatctggttcgctgaagcattaatttgtttaacttgatctctctactggtagcattttgtaacaagataactccttactcctagccgtggctgtagtaaagtttcgagatagagtgacttgagaagatactaacagatactacacattttatagcgtaaaattttgtacctctcggtactacaataaggtttccactaaaaattttgatatctctcagaaactgtaaaatttgtcttagagataagcaacgagagcataggctttgctagctacctaaacttgcattagcacgaccatcatgtcaattagaattcatcagcaaacactaatttcctaggaagtgatctccatcgactcttctttcgtttctcagcttatgttcatttatctcatttgtatggagcaaaaaagtgttccaccaatttaatgaatacactgtggcactgcttggtggtagcaacaggaggggttactattttggaacacaaacaccataaaacttctctgattctaaaatgtacgagaaatttctgaaccaaataataacccctagttgatgggcaatttatgaacaaattaataaggcaaaaagagaagcatgctactaaatcactggattgcaaaggattttattacaagtacacttgtaagcatagtaccagataataattgatatactctcaagcttaggtcacaaccaaaacgcatacatcttcaagctgcttagaccatgcaaaaaaaggttacaacctccacatggagatcatttcttcttcggcatggagttcagggtagcaaccaaacatgcccctggcccgccgtagacattgtttgtcattgtcccaggtagaaaatgtcctaatgcttcccatacttacctaacataccatatgaactagtactcaacatggccagccccctctatataccttgctaccaaatgaagtatgcgttgtcttcctttcatggaaaataaaaacgggaaagaagaaacaacaaatggagcaatataatctgactacatgcatttagcatgctcaacgttgaacttcgctttatgatcagaaagagcaaatgatcaagcatgcatgctgaatgaacacaaaaaagttagttaatttgtatatatgtaatactttttttcctgaaaagaatatatgatatatggttattcttcttctacatacgtactgatctttttttttgcgaggacatatgtactgatctagtatccatatttttcatcagcttatgtattaatatagagaaaattcgatccatagcacacaaaaaaagccggtaccaaaaaatagcacaaaattttcctctttccatcagaagcacatgccactattttttcttcgatatcacattttccatccaagtccatcggttagccatgattaggagcgtgaaaagacaaatttgccctttattccaaaccttagtttggacggtgagggcgactggatgtaggcgaggcggtggggtggtcgacagcgatggccctcccatcccatggcctcagcccccatccccaagctcattcggcgttgttgccactgctctccaagctccgcctccaccatccccatcactgagctcgttcgtcgcctcctcccccaacgcataaggacatgtactgcttgattcaaatattgttaactatgccagggtcttcaaacattcgtgttcgttgtgtttgtgcacacaccattagggcctaagacccttaatatctaaaaataagtaagtatgaagccttaaggcctctttataattaacttcagttattaatgacccagtggttggaggaattttgcaaaagatatcttataccgatggatataatcacttatgagtgatctagactcaaataatcaggtatactactctggtaacagcccatctacctcaaccctagacataggattcctttgcggccatctgatagctttacatcgatgattgctgagtttccgtgacaccagtttttgagatgagtagcaaaagaactcccaattcctcaaaggcctatatatgacagcaaattagcaatccactggcctagtccacttaacaatctctttcatttctctgtcagcttgagggcttgaggccaacaatagctacccattgccatggcctttgcctccatgaaaggcttctctctctgtctctctgaagaaaatatgctcatttctaagatagggagtctctggctctctgctccccttcatctgcttgtttaggtttctctcctctatctgcatgcatgtatattgatatggtgcaattatcgaacactgtcattccacttcaaagcagagcctacaactggaaaagaagcggcttcagttcagtctcaaggttctggcaaggataagttgatggctatgcctctttgtaccttaattcagagccatccctatcaatcaatgatgaaatcaacggctcaggtctagcaaacaaaaaaaaaagcatcacatataagtcaaactatgtgggagtgatatgtacagtgaaagtaaacaaaatggattgttattcttgttcctcttgtggtgtcaagtatttagcatctgatgaatgaaacttccggcttcacatactcaatcaaaagaaaaacaagtgcactgaacaacatgtatctgtattccatttttttattgacgatggctaagtgaagtttgaatttggtgattgtcggtgttatagataaggtatacccaatagtcttgggtagggttcggcagggcccacaatataccatgttttatatagaatcatgcctcatatacgaaagatgttttggataaggaaggaaaagcagagttctattcaggcactaagaactactcggatcatatccatacttgtctccctaattccacttatccgagggtataaatacatgaccccttagaaggaggggggacacccctcttacccctccgccgcccccgccaccactggtgttcgccttccccgccaaaggaagaagatggtggcagcgccgtcatcggcatggcaggatctccccaccgacctgctggtcctcgtgctgctccgcttcccgtccctcaccgaccgggcccgcctccgcacggtgtgccgttcctggcgtgccggcggccacccgctgcttcctatcttaagccgccatcatattgcagggagacgccatttctgtctcctattgcaatcaacagaaaggaatcgtcgtcatcagctcatttacagacaggaaaaagaactcaaccatggatgtatctgatatcgccttcttccgagggaagctatacactctcagtagagagcagaagggcttgcttgatgttcttgatctctcgatgacgaaaaaaatgtcatcatcaagatgttatcagtattcagtgcatcatccatgatgatcctaaacagccggtaatgtatcgttttttaggactgatcatcagtatgtgttgagtccaatggcacctaaggtcttcgaggcatggagctgtggcgcagtttctgacttggttcttcccggctgatgtgtaattgcagcttaaaatgttgtttggttttgggacattactacgttcaatatgtgtatttaccttcatatcactgctaatcagttatgcaaaactgggaatcctgaacattgttgtgtaattaagctatacaaaataggtcgtcttcaggtcagtagttgatgaagaacaactggctgaatttatgttatgtggtttgctcttcatttataaaaaaaaaatcgaatgagcaacttgctgatgtcttggacaagatggagatgcagatgctaaaacaatgtctccataagcctactgaagtcatccatccaagtcactcaagttttaagtttgtgatcagatacattttaagtttgttatcagatatacattaatttcacgcaattatcaattaattgcatccagtctattgtgctctaatcgggcaatgcaacacgaaaatggtgagctgggtagagcagctgcggcaagacacaaggccgcccagttattcctggcaatgtcatccctgctgcaagcagccactatcattgatcatggtgctcgatggcttccttcctggctccacagccatcgactcaggggatccaactcaacagggattcccactcgcttgttttccacgatttgcagccactgcaggatgcaaatgtcagtgaacatcaaacacccaccatgtctgaccaatttaagccagattttagctcatattaaggcgaaacagtgaggtaaaatcggcttaccattgaagaaatcagagggtttccgatgcctcctagcccaaacattggtaactgataagtgttcatgccttcgttgcacagtagagggcacatgatacaagcaaagctttgctgctggtagcatctgcagtggttggacatgacagaaactggcctgttgcttctaatctaataatgataagaacgaacgaacatggagcagacatcagtcaaatgtgcagttataagctagttcaatacatgaaatcattatcgtgttcaattggacatttgcgcaacaagcgggctacaactgaatgttagctatatataggttcaagtcatgaacttattgagtaaaagggcatgtagcctagtggttgcagtaacctgagtagcaccccaagatcctgagttcaattctccaaaggagcgaatttcaattgggttatttgagagctaagttccctgttcgataggctaagttcctaatttaaaaaggctgcatgtatccggttggatgtagaggctgggtaaaaatacccttctctaaaaaaatgaacttgttcatcagttcaaactgaatgggagttgcattaattgtcgttatattacatcgagaatcaaaatttccaacaggttagtatacgtacagcattgacctccaaactcattaaaaaaaggcaaatgtcatccatgagtttgtaaatcataattatttacaggtctattactccatttttatacattcatcatccacgaagagaaaaataatggtgagtcgatcaggatttaagaagagcatccttcccctcgaccatgggcctcctcccccttgatgatagtgggggtgttggcattggctcgttgtcctagaccgcgccgatgcagatctagtccacggacacggccgagctgcagcggcagatccagatccagtccaccatcttcaaagaggttagtcgtcaagttcaggtgaacaaatttttggtgtcatctctagattggaaaaaagtttgttgctgttagatgtgtgtctgcaatattgacaaggggttgtgttcaaattgttgtgtataaatgtctgtgtacaaaaattgatgtgtaatttgggtttgattctggattgatgtggatcgagtggcttcctttttttttactgatgagatcctaagagtgatggttttttatccagcactgatgagccatagaatgccggcacaaaaggctggttccgactgacaccaatggcttgttctgtactagtgagaccccctttgttcattggcagttgcgtgaggctgccattgacatgctccgacctcgacggctttctccatatggctccatctctattgactcgacggattcaagtcgacagggattatctcgcacttgttttctgcgatttgcggccactgcaggatgcaagggttaatgaacatcacacatccacatccaccttgtttaatcaatttaatccagattttgactgaaactaaggcgaaatgatgaggcaacatcatcttatctttgtcaaatgtttatgatgcgggtaattttaccatccttgagaagatatctagaggtaccatattttctcctccagataccaaaatttggtacctctagatactaagtatcttaaggcactaaaaattctcgtgtaaaattttggtacctcaagctaccttttaaaggattgtaaaattcctcttatgatgctgcctaggccgcctaggccaaccattgcaagctgctgggtgcagcggcctcctccagctccctaatcatttgatactgaagggcagtgaactgcctcttctctttttgtgtcagttcacttcagtgcgccacaaattacatacaggttcgcatttgcgaaaatattgtgtcatccctcagctatacatgtggcatcttgcatgatatagagataaagaaaatctatccagccggtattactgaattccagagcagtcaccacatgctgggctccagcgactgtgccgccgaatgctttcgctcgccgcggtttgccgcttggtggcactggcttggcagtcagcacctacacgactacatcctctgacatgagaagtcctgatgcctcctaggccaaacgccactttcaaaatcttgaagacgatatgtcatgtagaatacttgtgaaattcccggcgaagaactgcaaggagttgcctttctcatcatgctattttcctttgtggcttcgtctcgtattgtgtatgtggagcagaagggataggttcatatatatagatgcattgtctgatggcagcaatttaagatgtgggatggacaattcagaatatatgtgaaatatccgtgtcaaattttaaccccatagcttgatttttgttggtaggtcagatcagtttgtctcttcaattgttcaactcaatgcagcgagttatcgaccatgccagctataccacttgacttgacgagttaatttcgaacatatagcttggcaaagaataattaacaccggtaccgaggtttgcaatttcgatcataattattaggagtagctcatatcaagttcataactacttacatgtttttttatggggagtgaaatactcctataacacctatacgtgttcttagtaactgaatcgaaaagaacaacaaatatttataccatgttgaaacacgaattagtagtagaaagcaaaatcaagaaacaaattttgtcgaccagccaccatggttgtactataccagttgcccaagggagggtcgtggtggcatgtctggtcactgttgagaggttcttggtgatgcctgcctgacaatttcaacaggtgacatgcaagctcctgatgcctcctagcccaacacccatagccaccatctacatggctggagtggcttctgttccatgaaacattggttgcaccattgttatgtcaattgaatatgtatccttcagtcctttctcagcttgtgcaactgcatctcatatttatagagcaaaagggtgtaccactacgtacattactaatggatgcacatcgcagtctagtggtacagaacggagtgtggttgtttctgaaaatgtatgacaaatttctgttacttcaattcttcaattcaaagtagaaagtcagtggccacgcgaaccactcatgattttaaattgcagaattttgttacatcatttcagaaacaaacaattactggaatccataagttcattattagttggttgattcgatcacaaaaaggcggcgtggattgatcaaaatctgtggctgctagccaactcggagctcaagaagactgcgcatctccttcatgcatagggtatatgacaatatccagctagcatttgcttctgtgcacatgccgatcatctccatgattctggactgtacaacatgtgagatggggtaatcaaaccattgctgcctgagtctgtgatgaaagagctgcggcacaagcgccactttctgacttggttcttcccggctgatgtataaattcttcgtagcttaaaactgctgtttgctttcggaacatcagtatgttcagttatgcatttaccttcttactccttctaatctgttgaaacgatcagcacaaccaaactgtgctaaatttagaatcctttaatggcagagcaatttctttgcaagctatgcaaaattggctgtcttaaggacaacagttaatgaacaaaaatttgcaactgtgctttcgtttttatttgatattaactggcaaaatttatgtggtttggcctgaaatctgaatatggtgtgatctgtttggcaaattcagaaacaagatggcctgaataaaattgaagtgaacatgctgctgatgtcttggagaagattcagatgctaagacaatgttgccttaggcctagtacagccatccaaccaagtcaatgagagttttagtttgtgatcagatgtaccactaatttctaattccaagcaattatagttcagtacatgcagtcattcttgtgttcaatggagaactagcaagctacaacttaatgtgggtcaaataggtacccaggtccctaatttcttcagcaattctaatcagcaacaacgcaatggcaaggcttacaactgaacgaaagttgcattgttgtttcactgcattgttgtcgtacaacatgtattgctgctggtggcattgcagaaattgaacatggcctgaacatccgcagatagcagccaagggggtcagagattaaaacgctggcgccaattgccattcaatttagaacaatcagttggacatggtctgaacaattagtttcattttagctagctgctatcagtagcagtggcctccactaccaacaatcggctaggatctggcaagttagagtcctttcatgttgttggtatttactgggtaaatctatgagttaattttgtctgaaatctgaatttggcatcgggggtcaactttcaaagacttgtttcagtccaaatgataatagcagggtgtgattttttagactggcagcaatggcatggtttatttcagaaaattcagaaaataaggtggccttagaagaacaattgagtgaacatcttgctgtgtaccagggaagacgcagatgatcccataagcatactttatacaatgcgataccgggcagttatttgttcactacatgcaaactttattagttcagtgactgaattgtctagcaggttggcgtacaacattcaggattcaggaagagaagatattcggaagaggatttgagctgaagaagcaggacgtagatatccaactgagtagagcagttgcaccaagccatggcgtccgagtggatcattggcagtgcttccatccttgttgcacgaggctgccattgacaagctccgagctcgatggcttcctctctgcctccgctaccattgactccacggttttatggactgtctcacgcttactttctgctattccaacgcactgcaggatgcaaactgttagtgagtgcacatccaccatgtttaacaaacttaagtcagattttggctgaaactaaggcgaaagtgatcgaggcaacataagtttaccttcaaagatttcaaaggatttctgatgcctcctaggccaaccattgcaagctgctggggtgcagttgcctttgtctccctgaaggactgaaccaatgttcatcttcatcactatcctatagcctatagcatttattgtgctccttcattcactcatgggtttacatatggatagcctagaatggatatatatgatgtgaatgagtcatgacataaagcaatcaagtgaagtgcattgaattgttttgttctctttgggtgtcaggctttcaacaatgcaagccatcaagttctcactccgtctaaaataagtacagtgtattgtgttcttcaatagaggatctgctgatctggaagactgttacatctctttttttttagaaaatggattaaaatccggcctctacatccacaatggatgtatacagcctaaagtcatacaagagtacttagacccgaattccttacaataaaagagtaccaaagtgacaacacttaaaagagaaaagagaaacacaagactacaacaatcttcttttaaggttccacccatattttgcatacaactccatgacccttgcctccaaaatcttgcaacattctttcaatttgtggtcatcctctttcttaagcaacaaagtctattgaagcacccaataagtcctcttgaagatcagatgtaaaaaagaattagttttggagccggacactggttgctagcatcagaaccaaaatagcaatcgtgtccactgtgatttgagagaagaacgggagataagaattcccggtgcctcctaggcctaccacacccatggtaagcggttaagtgcagcagacactgaatttgttttactctatatatgattatagtcctacaccttttgatagttcatatgatttctgatgccgcagccagaagcattttttgtgctccgttattcgctcatggatttacatctatatacatagactataagggatacatattatgtgatacctgacataaggcagtcatttaacactgccagtacaagtgaagggcagtgaactgttttttccccctctttgttgatcaggttgttagtcaaaatgcaacctagcaagttcaccttccatctagagaagtgcagcataatgtattgtttagaaactgattacatcataccatcaaaaccaaaatagtagtcatccgctgagtactgaaacattggaagaaattgaagcatcatagataccggcacctcccaggcctaccaggcaaacccattgtgaatagccattgaatttacctttcatccactatgccaaacgaaaaaaaattgttctagcaactcatttctctcatggttacttcctctgatctttcatcgagcaaaagaacaataggcctgtactgtagttattccactgagagatctcaagatgcagtatagccatccgacggagatagtcaaactatcaaacaaagcgcagatcaaaataggtgatagttttgaaaacacggtaagatcgaacttagagaggcaagaacttgaattcctggactggacaaacaagtgaaatctcggtacctcccaagcctaccatagccacgcagcaaataagctgaatttcgagtttggcatccatcaaaaacctgaattccctgtggttcattctcctgtgtctctcagctttagctactactcaccctcttgttatctcttttatatatgggctggattgggagagcttgtatatcatatatgtcgacaaccaaatgtactatctgattccatgcaataattattgattcagcacttgcagctagtcatgttcagtacatcaggccaccaccaaaatagtgctgccgtgatgcaaggggagccgcataagtctgatcactgatcagtttgggcacttcaattgttcatcagttcaagcagcaagtgaaactgtatccttgctaccactcaatgggaatcatgcattccgatgataaattgcaagtcttagaacagaatagcttggaaaacaacaaacagttaacacaaagggaggatcaaatgccaccaattgctgtgcggtgctgcatgtatccacattgctatgtcagcaaatctcaccagagttgtcgctttaaggatcgtattggcattagcattgtcgagatggaacagatgtggaatgttactgcgactacatggtgccattgcatgcttcggttcgccatggagaaagctcttcgtgatgccgttgccagttcgacacagtcgtttcgtgacatgaaaactcctgatgcctcctagtccgacagccatagcaacccagcagcatggctggttggagtggccactgctccatgttcctcgaagagctactcgtgtcagctactccatgttaacttgcaagaacttgatgatgcgcaccatgaactcttgttcatgatgatctctattaattcttgctagctaacatgagaagcgagaaatacaagcaaggttttgtgcaatctatttctcgcgcacgcatcacttttgccacctcatctggccttcttatggagcagaaaatatatagcacggcatcatgaatgaatttacaatctgaatatctctgaagcagtctgattttttatcaaatgcaggaaaaagaagaaggggtgcacatgaatcaatgcagcacatgaaccaatccacaccacagacttggagatatgtccaatcagtttgtagactgcgactatggcgtcgtacgttgtatgatgcggtcaccattgccgccggtgatccctgatcacacggcgccctggaacgaaactctcagggaaatcacgaactcacacagatgcacaatgaaaagacgaggtgaaaactggcccatctagtaaaacatactcgaatgaaaaactctgaaaaatgagaaccagacgcgctccaggaaactgaaactctgaagggcagcacaggtttacaacatagaaactaatagccatgcatgccgcgatgatcctagtgatgccacacattcacttcatgacatgacaactcttgatgcctcccagtccaacagccagagcaacccagcaccatggctggttaattggagtggccactgccccatgttcatcgaaaagcaactcgtctcagaaacattattgccgctacaacttgcaagaacttcacggtgttcatgatctctctcaaaacaagaagcgggatacataaggttttctctctaatctcacttttggcaactgatctccttctgtatggagcagcgtgttgaatagtcctacattggttgtggaagggcaagggacctagctaatatataagtgggagggcacgggacctagctaatatttttggtaattggctaaggggagcctagatccattaaaaaaattgattttgtttgtaactagcaccttgtgttggtccatttggcattgccgcaatgatatagtttttgataaccaaaaattgtctaaccccatgcaggttgtcttcatgtcttccagttgactccattcttggtccttgatgctttcataggaggagtagaatattttgcgcagtgaagctacactcttgaaatcgatagccatgggacttttgttcacatgcatgtaaaaggaaggtgtaggtggagtcactgtgcaatcttctttgctccataaaaggatcatcagaagtaccaaaagtgactatggaagctttgatgttacaatatcacctctaggaaattccttaattaatgaccattcctcaagaatttcagtggatatatatgatatatggttgtgcaagtttcggtagcaaagtttcttgatggacagtgtttcatggagaagaggccaatccatccattgaactagttgctatggctattggcctaggaggcatcaggaactcctgtatctcatgataaattcatcagccagaatcaccaagatcctccacacatggccactgaaattctcttcatctggccaaagagcaacacaatgcacatggagacccaggaggctgtccaccaagccacagccccaaacctttactacgacaggagcttgacatgccgatgcatcctcgtcgtggtcgtgctgctctccggaggttgtgtggcagtggtagtctatcgtgattgcaaagttcttttcttttgaatgaatcgggaagccgccaatttcatagaatagagaatgagtaaacagtacataaccaggagaaatgaatgaatgtacaagcttagggcctttggaccaagctaactatatatagagtgagccagttgccgaggtttttcgcaattgcaaagttcaactcatcgaaaatgacaagtactgttaagttctagagtaattttaccatccaatatttggtaacttgaggtaccacattttgcacacaaagttctgataccttgagatactaagcaccttgaggtaccacattttgcactagaggtgccaaattttacactataaagtacctcgagataacgaatatttgtggtacctcaaggaaccaaatgttggatggtcaaattaatcttttagagcaattttacactatatatagagattttctccggtccaataaaaagtatctcgtgttaccggtagcaaatcgtttcccatcgttggatctaacaatgcccattctgcgcagttagattcaatgatcagaaacgaattggtaccgtgaggtaccggtaccttgaggtaatttttgctggtcggaagcaaatctctatgtataaatcttacacttcgatcactcccactatatatgtttgtggatattgatatattagaatgttaggcagctcactctctggaaagtgtgaacatgacttatatatctcaagtttttttacaggtaactgcagcattgacctgaatttacttttatgaaatgatatctcaccaaaccagatcatatatactaagtagtaagaaatggcacatgctgaggggggagatgaacaacgtatcacacaaccagagaaaagtttttggtttaagccacatacccaaatctttttaagaacagaaaagcatacaacaaaaaggtgaaagcaggtcctgccagtgtgttggcttaggagacacttctctgtctggctgcactgaatttgatccttagctagtgcagccattgaactagtccaaagtcagaagatcaagcctgaaacagtgagatcataaggaggccccgctcgatgacattgatggccatagattccagtgatcatcaatgtcaacctcgtgcaggaagcatgccagtacgttatggcacaacgaacacagcactgcttgtagttgttgtagcaacggcagtggcattcttgtggcgtatgttttttaggtggtttatatatggtggtagaattttattatcaatagtatcatgagtagaagtgattaagaaatttgatttatcagttctcctatcaacagaaaaaacatattctactatgaaaggtctagattagttgtactatcaagaaagaccatttaaaaattgtaactgaaaattcttatgagaaaattgccgcccgtttgtttcacaacggctgacttgtccgcttaatcttggtccaacagtatgaaattaaatgactgtcatccaattggctcaggggatatggaggctaatggacactataattccactccaaagaggattcctctgcaaaatgctactttgttcatactttgaacaattcacggtcagtcatttaggatcataaccgacgtagcgcgatgcacatgaaaagtgtaggatcgtaaagggcctttcccacccaaaagctagccaataaggtgaggggctcctccacttatatattaggtatcttgttctttcacaaccactgtaggactattcaacaatctcctctttcacatattggtgtccctcagccattcaccgctccttcaccgtatccccactgtcgctcaggtatacaggccccgcactacacaggcacagatggtccttcaggcttacacacattgttcctcgagtcagagatgttgaactagccaagctctgataccaattgtaggatcgtaaagaacttttcccaccccaaaagctagccaatgaagtgagggattattcaacacgctactcttccacaaccaatgtagtactattaaacacgctgctcaataccaatgtaggacaattcaaggatggttttttttaacatccttgttgtttggaatcctttattagagcattttggtttaaacttgttacttatgttacatgtatactagctgatttgcccgtgtgttgccatggagtcttaaaaaaaatctttggcattcattttaaagcctaaaaatatttagctctccaatcattttttgtcataaatattttcgattcttacctagttagccagagtcatgagacatagagctatgtttctttgacatacacattgtgagcccacacatcagtaagaggatggtgatggtagatttactgcagccaccactattaatatttaaagtagtatagattaagcttcactgttttttttttgttttgctcttttttttgttccttctgtttttcaaagcccttcttcaaagtggttgctaatccttaggcctgaggtgtcgagttcatgtcagggcaatctgattttctgtttgtatgggatgtcacattatgtgatggatcgtgacgcgtgcatatctatcagcctcaatggtcaagctctgtttttcattcatattaatgcaggaaagaaagctagagagcagccttgtcgacaaagtttgcatcaccaaaaattccattggttatcatcttcaatcaagttagatcatttgatcctgccaacatatataagatcgtcaaatcaccatggctcacctcatgtccagaagtttagacataggtttaccattacagatttgatttttctggatgacacctcctttttttagatgaaaggcattgcgcccagcttttactaaaaagcataagagtggatgacacctcctttatgttgcaggtgggtcattgttgctctcgcctgattggttcatgggccacatacgaaaatcaattttcacagacagacctcttaacccatagcttgttttttattggtaggtgatcagtctgtcatttcgattcttcagttcaaaaagcagcgagttaacgcccaggtaatcctgactagaggttatcctgatattaagtttcaggttttcgaacacatagcttggcaaagaataattaacaccagtaccgaggtcttcaaattttgagcataacatattcacagtaaactcacacatcataagttcgtaactagttacaggtttttgtctggggagtgaaatgcttccataagacctatatgtgtttcctggtaagaaatttacactaggttgataggagaatcagtagaataaaaagcaatcaagaaactaatgtgttgacgcacactcatacgaccagctgcgatctctttgctgtgcagaggttgcctattggcccatttgaactggtgacatgcatgttcctgatgcctcctaggccaacatccatagccaccatctacatggctggagtggcctccatgaaacattgctgaacatttcgattcttcagttcaaagcagcaaatcaatggccacgcgaactactcaaaattttaaattgccagaatttcgggcatattagttcagaaaaaacaataattggcacccataagttcaatattagttgggtggtgcagattgatcaaatgggtatatgactagagcgccgttctatatatagagagaacatcttgtaagcagaaatatcagtttcacccacctgagaaatgtatcgctgttattgattgcaatcctactggtagctgcactgctgggctccattcactttataggatttcaagtctgggtattcactcgataattaattaatttacatattaaatccatcacaagaatacaagatgatatttagtaagagttcactcaccccctaaactatgatttccccagtccccagctggtcgtgttgtggcaggcgacactgatgcatgtaatatatctccatatatcaaattattttagaaattttgggtattcacaagaaggcaggcctcattgtgattgatgtgcctacggtaatgagtatcgcgggacgaatgactgtgttatatacaccatgcatcatctcactgggatcaccttgacttgcaatggctgaaccggctagagatctcctgaaactcttctgtttcaccaaatttgagcaaaattgcaatggatccaaaataaccagaagattattgtggctttgatctcagcgacagcagcttgaatcgttggacaaagtgacatgagagctcctgatgcctcctagaccaaaaattactcatagcaacacataggctgtttgtggagacctggagtttactctacctccatgaaatacgtgttaatatatctccctgtgtgtgcgtgcgcacgcatgtatgttggtgttctattgggtctatataatatttgatttgatgcaatcatttaatacaagtaaattccaattcaatgcaacactaacatctgaaagcctggagatatatgtcatgttcatcctaataaaattcagaaaaaacagacacagtgggctacctaatattcttagtaattgaatcctgatgaaggagatttatgccagactgattgaatagcagaaacaaaaatcagtgactgtgcacatgtcagtgaaatacagcctcctacggagttcttttcatatgcatcacctacgttggttatgatcctacatgaccgtgaattgatcaaagtatgaacatagtagcatttttcagaggaatcggcctctttggagtggaattatagtgtccattagcctccacaccccatgagcagattggatgacagtcatttcatactgttggaccaagattaagcgggacaagtcagctgttgtgaaacaaacaggcgccaattttttcataagagaccttatagtagaattaatctaaaccttttgtcttctttcatccattaaattattactagctaccgatagtagaacgatttttttgttggtaacagaactaaatcaatttcctaatcatttctacttctactaatgatactacaggtaataaaatactaccaacataaaccaccgaaaaaaatatatgccactgccgttgttacaagcggtggtgtgttcgttctgccacactgccatgcttcctacacgaggctgacattgatgatcatactggaatctatggcaaaccctccaccgccatcatcgcaaggtcagggcctccttatgatctcactgtttcaggattgatcttctgactctggactagtccaatggctgaactagctatgaatcaaatacagtgcagccagacatagacgcacggtgacatgaaagctcctgatgcctcttaggccaacagccctgcatactaacacattggctggacttgctttgatctctgttctgttgtatggttttcttttcttaataaaatttgggtatgcggcttaaaccgaaaagttttctctggttgtatgaatcgttgttcatctctccctcatcagcatgtggcatttcttattgtatgctatttggtcaatatatttgctggtttggtgcgatgtaatttagtacaggcaattcaagttcaatgctgcggttacctgtaagaaaaaaactggagataagtcgtgttcataccttccagagagtgaattgcctaacattctgacacatcaattgatcaaagggtatgatttaagcagcaatgaattctgtcttgaattgttcttattctatccacttttgctgtcaggaatggaacttcaccagtgaaactataaccacctagaaaccagagcacagtataacatctcatacttcaagttttggtggtctaagcaaaaagtgacaaatacatcaattaactaattacttggacaaatagaactcgtgtagtttactcttaactgaattatgtttcttccaaagtttatccaggagcaatagtagtttgatcgatggacatgattgtgacgttgaacctaataaacctgagagatgcagtaacccatttgtgtattgatctttctaaaaacatttatatcctcttgcaagtgattaaaatgggcaaggcctgatcgatgcaaggtggccgcagtgcaaagatgcatcaatgcatttgaaaagtatatctggtttctccaggagactatcattgaattatttccaaaattcaatatattttttgaaacttcaggattactggtgggtcctagcaagatattctatttgccaaaaattccaatttctgttgattttgcaaaaaaaagaaagaaaaaaaatcaaatttagcacaatatgtccaaattttgattttttttccttctgaaaattccaaatttggaattttgatgaccctggtatgattttgcgttcgaaatagtgaactctggctgtagtgacctacatatcaatgagagagaacccatggccatggagtaaattcccttgatttgataaaaaaacaatggattttattttctaacataattctaagagatttgctccggtccagtaaaaagtacctcaaggtaccgatactctacagtaccgaatcgtttccgatcgttggatctagctgggtaggatgggtattattagatccaacgattagaaacgatttggtaccgtgcagtaccggtccctcaaggtacttttcgttggaccggagcaactctctaattctaatggatccaacacaatggaaaccaccggtgtaatagaaagtttcaatggcattgaaggcatcatcatgatgcatgcaagtaaaaatacaatggttactcacttgatttgatgtgattatccattgctctaaattcatccagatagacatgtgtatcaaactatgccatcatccagacagacatgtgtatcaaactatgccaattgtatgatagggataacatgaaaattgatccatcagtcttctttgtagccgtggcgagagttctttgtgatgcctgtgatgtcgtctcatctggttacatgggagctcctgatgcctccaaggccaacaatcattggtgtagtagtgctttttgttccatgaaaaaattttgcttgtattgacacattggtagtgaaacttcctccactctctggtgtataaacttgctagttatttacttatttctcagcttgtgcaactccatgtcatttttatggagcaaaaagtgttccacactatctcatgttactgaacagagtggtcaattctgaagaaaatgtacgagatattttggtcaattcaagtcttcagttcagagcatgaactcaatggtcagttgaccacacgcggcagccactgcactggattggaggtaaaaggcactcataaattcgttctcagacggcagattcgatcacataaaagagctgcagattgatcaaacaagtctaggagtatatcgatgttttgtacctttcaatttgtagactaatactttcatcgtaatcagcaaatttaagttgcctagcctttttgctctattgtatggcgaatgtactgaacactgtttctttttctacctgaaatctatgaaatggcagaactcctgcctttgctttatacaaagaaaaagttattttatatatagcacatattgtaaacaaaaatatcagtttgcccaaccgaggtgaggattgtatacctacccctgaatgcatgctggtgtccagtgcaaaagctgctcatctttactcccctgaagcagcatggggaaaatatcctttacacctaggtaccatggtagtatgcatgcggtttaaatagttatataaaatttcatacaattttgacgacattatgagaatataagacagtatgcaaatatgcaagtccaggtagcgtgaaaccaaatggcccagtacagcacctgcggcaagccatgttccttgctgcacatagcggcagtgctgcactggttcaccccattaagcttgctacgcaaggccgacattgttgctcatcaggttggaagcaagttctagctccgtggctacggttgtagcgacacaagctcaatttactatgcgtagagagtagatcgaggcacactatggtgttaccggagctcctgatgcctcctaagccaacaatttactatgcgtacagagagtagatcgaggcacactggctgtagacctggagtttcctcttttacctccacgaaaacattgttcaccgttagctctacctgcatgtaaagcatttcttaatcatattggtgtaatattgggcctatatatatatatatatagagagagagagagagagagtatattctactccatattttttcaggtaatgatatagtactccgtattttatttgatgcaatcatttaatgtacaagtaaattctaattccatgcagcaccaatctctggaaaagaactggacatatgtcatcatgttcaatgtctgcacgttattcctagtaattgcatacaaaagagattggatttatgccaaactgacgcacagctcatagcagaagtaaaaccaactcaatgatttgttgactgcattttgtattgtcaactgagacaattccattattagagcatcaccaagagattacgtacaatcttccccaaaaatttgtttttgggtttcttaaactgaaatagaaagcaaaataactaatctctccaagagaaagcctaccaacagaatttccgtttcctccgtcggcgcgtgcaacctcctgacactccctctgaaaccgcgcgccgatctcccacgcgtgggaaggagaggaggaaggtgtgagcggcgagattgggagtgggtgagggcaccgttttctcccacatatcaacagagcgaatatttcggg

SEQ ID NO: 72872 - DNA, 6463 bp, Oryza sativa
ctgcagcccagttctctcctcgactcggaatcagaccagtcgggagagaaccggctttcggccccgtttggattcccgaacgcggctgaaagctacttcaagcccctttcaaccgagtcggcttcaaaccactcggccgagatcgcatcttctacaacgacaccagatcaagatgatggggcttacccaccggtcctgatgaagctccccgacgatttagcggccgtcttcaccatgacagcgtcttcatcccgtaggcctaggcggaagtcggcttcaacaccgctttcgcctagcttcagggaagtcggcgtcatcctccaaccactcggcacggtttcgacggatcagctggatgactacaacagctctcccaccgtcgactcacgtcctactgacatcgtggagtacgacgaattcagttctcgctacgacgacttcgacgacttcgacggaagcctagatgacaattacacccctctctactttggcgttttcatggccaataatgagacggaggagcaacgccaagcccgggagactgaagaacgtcgccgactggaggaggagcatcaagtacaagaacaagaacggctacggcgtgagcagcaggaccgtgagcggatcgccaaggaggctgaagatcgacgtcagcgagctttggaagcagggcgccgagcgcgtgatctcatcggccaacaagatgtcgaagggacaccggttttccgcacccctcaacagaatgcggttgccgcgatcacccttctcgacaccctcctcaaccaaaacgagctcaatcgttccgaccacgtcgtcaacatcttgaaccagacgaagaccatgatcgcagcatcggtcccagttaactccgaaagcgtccacacgccgactggcagccgggtcccccacttccgatctcatgactaccgtcatccaagccccagcatcactggagcaggatccaatcgcaggagcaggggccacgacgagcggtctgttcactcgccctcccgaacttcatagggagcgccgagtggacgggcctcgctcaccactcggtcgccgccccatcgatcttcgcgacacaatcatacagcgccgagcagctcgaggctaccatcactcgccggatcggcacaagttatctcctctatgggaagggccatttattatctctgaagttacccgaccaggttcatatcgactcaagcgcgaagacggcactctcgtcgacaactcttggaacattgaacatcttcgtcgtttctacgcttaactttatcattgtatctccctattttgactgtcaacatcaagttttcttcttgccgttgtcagtcgggggctattatcacaataatggagtgtgattttttatcaattcagtttgcttacttggtttatcattgccttgtttggtttttctacttagtttgagaggactgaaagtttttaatagcttctttgggttttaggctcaacaaagcttagcaaaaacttttaagaaatcaaaaactttgcaagaatcatcaagcacagcataaatacaccagtattgtacaaattgagcctccatgtattacatccaaactcagtcagagtcagtcctttcatcatcagagtcatcattactcggctggaggtcgttgttgcgaaattgctccacaacatcactcgctattttgtcagccgcagtttgcgcactactgataagatcaagggcagcttcttcacttgtcccgtctgcaaatccatcaatggtgtcgacttcaattctcgggtacaaggattttgtcatcgccaaggccatgccagctcccatacttccagctttcttgatattcttgaaatacacttccggagcaacactcagcttgtcaaatatttcggttgcgtcgagtgcactcggaccaccattattgaggaacatggcttagatgattggagcagcagcattggcgacatcatctcttgctccttctagcctcttgatcttaccaaccaggacgtcgaattgagcttgagacttgatcttgcggtctacaaaacatatttatggtgagaatctgctgcattaaaaagagacaagttcaggccaatagctggcagtaccttcaacttccttcaaggccgagtccctctgcgcagccagttctacattgtctctctccagggcttcaacttgctttttcatttgttccattctggcggcttgcgctgtttgagatccagatggttgaggatacagttatgttggcctaaatcaatggaacagatctggatgattaccttttgatgaaccacttagttcgaagtttgcatcctggagctgagcgattcgatcccttaactccttctccgtcttcttggcgtgctccttggcctcatgtagctggtccctaaccgcttcaagagttcccaaatgaggaaccagcttttccaaagttgtggtcttggcttcattgcgaagatggattctctgcatgatggatcatagttcagttctgctaaaaagaaaaacaaagttaccgaaggctgtcgctcggaagacttacatttacaatacgagtggcctctccaagcgctttcttcagctggcacacttcttcatcttctttttgacggtttatgactataccggcggcttgtgagttctcgtcccaccatttgatcaagataggaggacgagagtcgtcggtcgcctttatgcgagggatttcttctccgtcatcacctgatggtcctgatgtgtttccaggacattagacggatacactgaggttatttaaatcaccgttgtatgagaagacaactaacctgaagatgtacctagctgagcgtgaggtgatctttgttctttgcctggagatccagttatcgagtcattaccagcttctggcccttgggaagctgtcgtctgcgcttctacttcagggatttcttgatcagggcttgcgtccaactggtttccagtcgggggctcttgagttgttgctgcttcagttgttgccgactggtttccagtcggcggctggtcactcggattggcctggtcacccgaagcatgggcgccggtcggctggcttttggcagtcggctggctttcggcagttggctcggggtctttggatatattttgctctgccatggctggatcggggtcttttccagatggatctatatcagatggtttcctgcaaagtattctttcagaatttagcatcattttcatgagagagcttaccaaagtgaaatcataccgagaggtcttatacctggaagatgttctaatttttagcattgcgcggccggccagttttttcctgggcatggtgcgctttgggggtttattaggcgagcccttatccccagatttatcatcgtcgccttcatcgtcatcaagcaccagtttcctcttgcgaggacccgtctgaccagttgatttggaggtctgaggttgcggatctggtctgatcgttggccctccacctccctgagcagtgtgttggcgaggagaccggcgctgagtgactggtggatctgatttcatcagtgcatattcctgaacaagatgcttccatagttagtcaattcagcatgaagacaaaattatgttctgatcatggtttgaagatttccgatacatacctgcggaggcggattgaatgcattatatggcacgactggcagctggtgtgagtagctgacgacgattgcatttgagaagattttatacatcctctccttcatgattctgaaatccagagagtctgattcttcacggttaggatcatacttgccgtcgaactcgaatgccgtgcgagatctttccttgattggcgctagtcggcatttgatgaaatgccgagtgatctgttctccctgtaagccttgttctttaagatttaacatacgatccaacaactccaaggcttgtactgcttcatctccgattggaagagagttccaagtatcttgatacactggaggaagacaagagtacccgggaagagcaggttcaggattctgaacatagaaccagtttgcatgccatcctttgttcgaagtcttgaagggcattgagaaatatttttggctcagagttccccttagttggaatcctgcccccccgactacacacggtttgttcttgtttggttggggcttgaggaagaagattcggcggaatagggcaaagtgaggtttgatccccaaaaaggcttcacaagcatggacgaaattggcgatatgcactatggaattcgggtttaggtgatgcaagctgattccatagaaattcaagatcccgcggaaaaattttgaggtcggaagagcaaagccgccgtagaagaaatgcgagaagaccacaatctcatgagtatccggagacgggaaagcctcaccgtgcgctggtcgccacccgatgatctccttggcagggagaacgccgtgcgccaccatctccttaagattctcctccgttacatcggatgacgcccattggccttcgaagctttctctctcttccgccatcggtttcactcaaatgtgctgatttgattcgagggatggcttgggagaggtgagggattgaggcggtggatcacgggaaggattttaatgcacttttcggaggtggatttggccggagtcgtgaaccctagttcgccggcgcagctttgcactgtagcagggaatggggaaaatggcggggaagacgaagcgtcgcttggatataggatttttcagttaagggtatcggaggtgctaatgggcctaggcctgaacagtacttcagcccaatacttttaacagcgtggcccattgtgttccttagggacttaggcatattttgctttggcaatattatgcgcacaacagtgttgcccaatgctgatgaaatcctttttatgcggtcatataattctttggaattattgcaatgcaaattaaaaaggtgcccgacagaaaggcgttatgctgtttttgcaagcttttttaggctacaaaagctgtttgggttaactagggatgacttgtttttattatagtcatttccttggcgtgttatatgcctgttttcatggtaaatagtcatggcctaggctatttgacttatttattaccataatctttatgatacttgatgggtaatctttagagtttgtatattcggatgcctgtcaagtgtgttcattcgtgaactttttagaatgtaaaccactcggatttcttttattgtggctaaaaagcagtcggctagcatgcctatttaggcgccgcgtatgcttttgtcatataatgcacaattgtgttattattttgtctttcaactatatgtttagtttgttaactaatcacatagttgggggctacacctaattaggtgcatctattcgatgcaccatattcttcatcttttcgccctttacagtccactcggcaggttttggcttgaagagtttgaagtactcgggttatcaactttgagaaggctacgatggtcgactgcaaaggactcgggggctactgtggagattatgggtatcccatatctacacggcgacggtattcgaactgggtaccggatacttaatgtagatagaatatcttatctgtatctcgggtttgtttcttaacttgtgtatcaaggaaacaccctgagacttagtcggttacgactgtattttacctctatcttcatattccgttaggaatatagattatcttttgtaatccggactccttcccatatataaggggggtccgggcgcctctaggggcatatgctgatttttcccgaatcatacaattaataatacactcggcggattcatccccggacaggagtagggtattacttcttttataagaaggcctgaacctgtataaatcctttgtctccaaacccatacactttccgagcttgatagccacccccttttattattgccgaaatctagtttcgacagttaggtacttaattaggtgggttgtattactatgaatgttgatcgaattaagaatccatgtataccatgctcgatctcttttaattacagttgttctgaaatttaataattttgaaattcagaatcaacaaatgtgagatgtactcttagtttattaatactcatgaattcaattctaaaaatctacaataaataattagcacgatgtaattgacatggacgtactcttctattaatctaagctcttatatttcagaaaaataataatcgatgtgttcatcatgattaacattttaatatttgtaacatcaataacaatagtttgtgtaagacatgattggtgactagcacatacatataatatcctagtagaacatttgaagtctaagtttgaccaacacatcaaagaaaatccaaactgcaaacagtatgtgcactgtgttaattaccaccgtatttaattaatttttcttctcactttatatacatgt

SEQ ID NO: 72873 - DNA, 863 bp, Oryza sativa
aaaacgactttctttagtagtacggagggagttttaattagttcttgatccgttcaatggttcagctcaaaaaagttaaagttgtacacaccagaggtcaccagctatattattactcgtatggtttaagagaacacacaccatattaagttttttttgcatgggttcgtgctggtcccacatgttcactgcaggaacgaccattgggagggtgttaattcgattagcgcgttaattaatttgggaacagtagccactagccacgcacgaacatgagatcgttgcacggtaggcattgccgcacacacgatcgacgacctaacaagcggctagacaagtcgaagaaagagctcgagatcacttttccggaaagtgttttcacatttaagggacactattcattttcttaaaaatacgcacaattgagtcatgaaatcctttttaaaaaagattaataatgttggtataatgactggctgtttgctgcatgcggctgcgctgcacagacgaacagaagaaatgctagttgggttcctgtagcagatggctgtggcgcaccgaacaagccctatagtaataaaacattccgactgagtttttacgttaataaaaaagatataggcataggttagtgtggagattatgggtatcccatatctacacggcgacggtattcgaactgggtaccggatacttaatgtagatagaatatcttatctgtatctcgggtttgtttcttaacttgtgtatcaaggaaacaccctgagacttagtcggttacgactgtattttacctctatcttcatattccgttaggaatatagattatcttttgtaatccggactccttcccatatataagg

SEQ ID NO: 72874 - DNA, 9619 bp, Oryza sativa
gggatggataggggagagcggagaggggtttgcgcttgcttatctagaagagagggataaggggagggccacggattaggggaggtgcggcgaaatcgtgaggcgctgggcggcccgggggttgggtctcgcggaggcgtgtgcctgtgtcgtcgttgtggggaggtgaaaaatgacgggaaatctcggtggttttgcggcgtttgggccagaaaaaatggggttgaggcccaggtttggcctcgtcacccggaacgccaacctctcttttcgcgttgtctgttttgtttggtggcgctctcttctgccggtgcacgtaaaaccgcgcggccctggtcgttccattcccgcggatgttaaggggggtgatgtcgactgtgaagcgggaagagtgacggtgatggtgccgtgttcccgtgcaacgagcgttgttatttcaagatagtaaaaagaggtgatgttagtgcattgggcttaaccgttcccctaacaaatattgggcaccacgttagcttctaccgcatccacttgaagtccgcaataccaaacttggtaacgtgttcctcaatctgattcagggagagtggagtgtggagcgacaaagaacagtgcgttgtgggggtcgtgacctcgctgtgtaatcctccacccacgagctcggtccccacttcccaaatcgccctcagccatcctctcgcgcacgcgtcggctgccatttttcccatcatgtgcctgtcctcaccatcccttccctcattgccatcccaccatggctaggagtagccaataaaggaagcaacaaaattaaagttttccaacataaatacaggaccaaaacacgaaatcatcacctaatttctacatctacaagattctcaactcaccagcaaaccctaggtactattcaaatctacagctttcggtggtgcagcaactgacgttggggctggagcggtggcggtggcgctagagttaccggtggtggagccgtcggtcccgggaccatgatcacatcccgcatctccgttggggaaagcggcgacgccctaggtctcgacggtggcggcaccacaaccaactcctttcatactcgtagccactgcggagcttcatcttcagtactcttgacggcgaggactggcaacacacggagcatcacgaggcgaggatagaaattgcgagaggagggatggaaaagatgagtcgtgagaggaggcgataagtcacaatagaaaacataagggtagcaatgtcatttaacccacttgtagctattagtctacaaggccattaggccacgacgtggcctcgttcacacccactgtagggcaagtagtctccatgtgtgtcttcggattttatggatctgtataactctctttctgcgcacgtaaattagagcaactcattatcgcatgattaattaagtgttaacttaaaaacttaaaatagagtacatgccaaatactatatctataattcatgattaatcctccatttacagtttggtacaataaagtttgtttttctttacgaaattgactctaattgcaaatttatttttttttctaaatatggtacttaaaaataaacgagaaaacccattccctctctcttcctccccaatacccccgcttttggagtctctcctcgaagaccgatcgcatccgcctccaaaccctagacgcggcggccatggcgcggcgatccgcccctctcctccagcgcctcctctcccccactccctccccctccccctccccgccccatcctctcgccgccgccgccgtctcccgccgcaccgtcacctacatgccgcggccgggggacggcgccccgcgcgccgtcacgctcatcccgggcgacggcatcgggcccctcgtcaccggcgccgtgcggcaggtgatggaggccatgcacgcgccggctacttcgagtgctacgaagtccgcggcgacatgccgacggttccccccgaggtcatcgactccatccgccgcaacaaggtctgcctcaagggcgggctcgccaccccagtcggcgggggtgtctcctccctcaacgtgcagctccgcaaggagctcgacctctacgcctccctcgtcaactgcttcaacctcccggggctgcccaccaggcacgacaacgtcgacattgtcgtcatcagggagaacaccgagggcgagtactccgggcttgagcacgaggtcgtccctggcgtcgtggagagccttaaggtatggcgaattccgcttgctgctaactcacctagttgatgtagtgtttgccagggtgcttgggttaatgcgtgtgccgagagaaccccaaatgcaacttaggtttgccacttatcgagcaatttcgtctatatacttaggactgtttgttttacctactgcttgttactttactggattggtaggtttattgtccacatctagtaaccttagtattcagttgaattgatgaaacttaccatgtgtattgacgcttttctgagatgttagtggtttgcataatgagtattcgagatccatgtattgctgggttgtgcataaaacactttaggcatatgtaactggtaagttgtttgttgcaatgaagcatgcttgctgtagttgagatagtggttatgatcgaattatgtggactattcaatacagatttcgatggatgggcttcaaaatatcctcaaattaagtcagttttacaaaatttatgtaatcacctgtgtagaaattgataaatctctgagatgatccagaaggacttatgctaataagcaccaaatgaagcataaaaataatctgataacttgcggtatccaattatccatcctttgagaaagctataaaattattaggttaactatcattggtgtagttctgatttgaagaggaaacaagttccttttgggtcctgtgacaattttcttaggtgaatggatctcacagttgaagttttggttgctagctgcacattaggagcagtgctttgatttcaaacggctcttgatgttggttagatcctatattgttggaacagatgctatggtatgcgttagcattaacaattgacctgaatgtgtaaacagtttaatacttgatacatgttatattgacgcatgatgtatatctacatagtttatatctgatattgctaatctggtcactagtccatggtgatctgagtcaattagttatatttttaacacttttgcctccataaatggcctgttgatggcactctagctgattaggtcttggcaggcagtcctttactgcacatattcttttatactcctattttgcaaatttgcgtgagtaccgatttctgaaatagaacgtatgtaaatgtttttgtcacttttcatttcatcatctaaaggaatttttttctatatggtactgttactaaatggatttactaggtgatcacaaagttctgctctgaaaggattgccaagtatgcttttgagtacgcgtacctcaacaacagaaagaaagtgactgccgtgcataaagcaaacatcatgaagcttgctgatggtttattcttggagtcttgccgtgaggttgcaacaaagtatcctggaattcaatataatgaaatcatcgtggacaactgttgtatgcagcttgttgctaagcctgaacaatttgatgttatggtaagtatgttagttctatcattactatgcatcttaacaaatgcattctgtttgtaacgtcaccatattctatactcacctactgatctatgcttttatcatgtcataaaaacaaaaacaaagtaaagtttttagtttctgcttgatgtttacatatattgatcaaatgcacattatcagagtacttagtagattatctgcaatgaatgtgatagaatattaattccctttgcacttctgtctgaaggatgttttcttgattgtcacagagttttcagatcaagtttgtttgattaactaggaacttgtgatatagcatgctcttgttttgtgtgttcggaggtcacgccaaatctttatggcaatctggtggctaacacggctgcaggtattgctggaggcactggtgttatgcctggaggtaaactctgaactatcgtctgtaattctgtactttgacctgcacaaatagtcaatacggccatcaggagctggaaccagacaggcttgctttcgcagttgtctgttagttacaggctatgtgttgtgtgatattttgtgttgcattttatacactttcttggacccactcaattttgtatgctgccagaacctcttacaaatgtgttaactctcaacttgtgcatatttcatatttgtgcatatgcaaaaaacaaatacatacaatcctcatgaaatgcacaaattttaggtaatgtgggtcaggaccatgctgtcttcgagcaaggagcttctgcaggaaatgttggaaacgtcaaagttgtggagcagaagaaagctaaccccgttgctctgctcctctcatctgccatgatgttgcggcatttgcaattcccatcattcgctgaccggctggagacggcggtgaagcgtgtcatcgcagaaggcaagtacagaaccaaagacttgggcggcagcagcaccacgcaggaagtcacggatgcagtgatcgcgcatcttgattaattgctggccggctgcgttcttttgaaacaaaattttccctttggactaggtgtctagtcccgactgattttcgtttcttatagcgttagatcatcatttcgttcgtcacagccttgtacaatcttcaggtgtcttgtgtctggtggattttgcttcggaatgatggagcaaatcaccaggaatccaggatcgatttttaacgcaatgtttttgcggtcttaactggaaataagagagaacgattctcttaactgtaacactattgcgttgattacttctacttattattacatattctgatctttactataatgataatgtctgcctgatttccttgtagaaagagttgtgttgcagttaactggcaaaatactaattcttgttatatattctaagaactcgttctggtctcaaaataataagtttaaaatgcatgtagtgaacatgagtttactttaacaataaaaattattcaaaatatggattttggatgtataaatatgtaacttttaaaatttatgttaaaaggtagtaaaaaattgtataatgttgacaaaaaagtctaaaatgacttgtttttgcggtatggagtctaaattttgcaatgtaaaagaggatttattctcacattattggcggaaatagtacataaaaggaaaaaaaaagaaacaaggccgcgctaagctggcctggcccaaatatttgcaagctggcccatatggcccgccgcctcttgtgatgcaaaccctaataaaacttctccccttcgctcgcctccaacctctcttcctccccgacccgaggcggcggcgaccctagcttcccgattctcccatcccccccatggcgtcccacctcgacttccgctacctcgacgagggcctcggcggcgagcgcgggaagcgcaagcgccgcgaggcggaggaggcggccgccgccgactccatggacctcgacgccgacgccgacgcgccgaggccgtccaagctccgcgcggtgccctccctgtccgacccctccaagcccgcctccttcgggcagcccacctacgacggcgtcatcgccgggcgcgtctccgggcggcgctggaaggaggcccgcacccgccgcgcctccgcgctggcggcgtcccggaagccgaccccgctggagcagcgcgcccgcgacaagtccctgaagcgcgcgtaccaggcccgcgtggcggagctcaaggaggagatccggcagagcaaggcggcgaagcggaagcagcgggaggagcgggagaagcgcaagaaggagaacgtgctccgctcgggcaccaagctgcagcgggtcaccaaccccaagaccatccagaagatcgccaagtccaagaagcggaagcagctcaaggtcgtccccgacgagttcctcggcggcaagaagtcggacgccaaccgccgcatgcaggtgcccggcctagacaactgaagatcgccttaccaaacaaatccttttgttatctgtgatacccatgttacagtgcagcttactagtttttacattgcgcaacgagattttgtactaatgctttagcatgagattttaagtatggtcaatccagcaattatgttggtatgaatgatgttgggtgcaggttcgttgctgattttctgtgttccatgcattgctgattgcctgcttgaaattatcttaggattaattttaggtgttctctttgtgaatttcattgattgttattatctgttttgatgattgctgagaagagagggggaaaaaatccacccatcagaattcaaaatctctttggactgaaacaagcagggagcagtgattgtaaaacgacgagctgaatttcgggttggtcccaatgatcgattgtttctctgaagtgttttggtctgatgttcgattgtttctatgaagtgatcataccagggtttaccaaaccgtgtggaaataatggtatatctcgcagtaattgcaccagtcaaatcgtgaggtggcggtaaccctacccagaacagcttggtgaaccctggatcaactgtatttcctattgtttgctcccgagctgctttcatagctttcttgaagatcgtaagatgccgcgctgcttggtttggtttatgttctggaattttgagaccttggtcaccgagtcaccatctgtgctgggtgcttaactgcttattgctcttgatccatgtgacaattaattattaataccttgttgcagctgtgtggtggcgaggtgcaaagatttgtgaacgctcgattcttgcaaactgtaaactaaacatccatttttcactgacactgtttagggatggcacatcgatgcatgtaagtttttgccggcctttgatatatgcaaaccggtgatctccaattctccatacgccgcataacgtcgatttatgtctctcatgtctccccgcagaaacattcaggcccggtttagttaccataaatttttgttttggggtatcagtttatcacatcgaatatacggacatacatacggacgcacatttaaagtatattaaacattatctaataacaaaaacaagttacagattccgctaggaaaccgcgagacgactttattaagcctaattaatctgtcattagcaaatgtttactgtagcaccacattgtcaaatcatggcacaattaggcttaaaagattcgtctcacaatttacacgcaaactgtgtaataggtttttttttccacatttaatactccatgcatgtgtgcaaacaatcgatatgatgggtgaaaagtttttgttttaggaaataaacaagcctcagcctaaagatgttgctgacgatctgcccgttaatggtctcttcttgctactcgttcagtcccaaaaaatttcagtcctgaagattaatttgaatacgctactcgttctgtcccaaaaataaagattaatttgaatatggtgtatgtttagatttatttttagaattggaattttctccacgtgtcagtgagaaaaataataggttgaattggtccgccaatttctaagggactaggctaacttgatcttggtcttaggggaatattctgtgtcatggatcatcccatcttatttgtcctcaaaccaaacaaactgaaaaataggtttaatacccttaaataaggtaattaatctatacaattataaattcttcagttttaaaatgtacaattaatatttacttatttgtagtcatgccattataactgttggcgtatcaaaaaaaaatgccactgcataccccatcgatacatcgaacaaaatgtgtagactatattgttctcgtcttcttcctcagtctcctcccatcagccactttaagcctgcaactccctattgagcactggtctccccgtcgaggacgacggccatcgctgccgatggaggcagggtctagttcggcctccaccccctctttgttttccctagtcctctggtgaccaccgttgccagtagcagaagggtgcgactcagcctccgtcccccgccaccgccattgtcgtgacctccacctcccttggctgcctcctcgagagtgaccttgtcgccgccatggctgagctccagcgctatggccttttggttcctcaaggaaggaataagtcaagatgcacgatccagatgttgtttcatatattatgtctattttctctcacttttctcatttcctcccaatttttcaaaaaacggaaataagtaagaaggagcagtagtagtagttcggcctcacttgtcggagactgaactaccgctcgctttcttcaggagatcaagtagcagcaattggcttcacctgtaaccgacctagaagttattttctatttcccactacttttcgtcattttttctaatattttcacaaatttcaccttttcatcttcttttcacattttttatttattttcggcttcatattcaaattctgtgaggcaaacgtgctaatgggcctacaccagcctacgtgctatatttgggcccgtgcagcacggcccggcccgctacaggagccgtgccaccggcatgcccgtgccgtgctcggccggccgcccgttcggccagcactacgctctacggcctgacggacggcagtagagctgggacttgggccgtgccgggctagcacggcacggcccagcgtgcttcgtgccaaatcgggccgtgcttttatcaggcggaaaggagcgtggcgtcatggcaggcgcgtgtgttttccgccgttggatcgagccccgcggcgggtatcgagggctaggatgtgtccgtccccaacccgggatcgagcgcggaattgaactagagagtgaagacactggccgcgcaacctgtaccatcactccatcagattagctgattttttttttcagcgcagccgacacgcacgcacgcacgcgccccgccgagccgcggccacgattccgaattcgaatctgcatctctcccaaatctaaaccccccgaaaaaaccaaaaaaaaaaaaacccgaaacccaaatcgaaatcccttcctccctcacccacacgcgcgctcccccgccgccgccgtctacacgcgcacggatggccgccgccgacggcgacgaggactgggagatctgcaactgcgacggcttcgtctacaagcgccgccgggtcctccacccgcccgacctcgaggacgccgccgccaccgccgcgacctcctccgccccggggccgccacccgaggccgtactccgccgccgccgccgccaggcgctcctccggctccgcgccaggtacctcgacgagctctcccgctgggagtcgctctcctcggacgtcctcgcgccgctccccgccgcgccggccgcggaccttcctccccgaccgccttccgaccccgtcgccgcctcgccgcctcccggctcctcctcctcctcctccgacctcccgtcatcgacggcctcctcgccaggtactcaccgta

SEQ ID NO: 72875 - DNA, 3593 bp, Oryza sativa
ctgcacccctgatctgtgaatgaatctatgaatcgatattgtgaatgaatctgtgatgttgtgaatgagtatgtggctcgatgttgtcaatgaacctttgaatcaatattgtgaatatatttgtgatgttgtgaatgaatatgtgaatggatattgtgaatgaatttgtggtgaatctgtgaatcgtgctgtggagttgtgatgtggatttggggtttgatttgatgatatgcataccactcgattcgggagaaaataaaaaagaaaaaaggactagctgatggactgccgctaccctctctttagtcccggttgatgacaccaaccggacatcaaccgggactaaagatcgatctttagtcccggttttttcacccgggactaaagatagcgatctttagtcccggtttgaaaaccgggactatagggggttacgaaccgggactaaaaagcacttctccaccagtggtcgttcctggtggttcgttggtgagtcctcgtgaagacgtgagataaaacagtctaacagagagcgaggttagaagcgagaagacgaaacgtacgttgcgttacactgcaccctcgacgcctcgatcaactgagtctcgactcgagatcgatgatagccgcggacctccctgacccctgtttctgacatactccctccgtttcaggttacaagacactttagctttagtcaaaatcaaattgttttaaatttggttaagtttgaagaaaaaacaataacattttcaacccaagacaaatttattatgaaaatatattcaattattgatttaatgcaattaacttgatattataaatattactatacttgtctataagtttagtcaaatttaaaatgctttaaatttgaccaaagttaaaaacgtcttaaaaacctaaaacggaaggagtagtaggctagcttgtaaattctgacatagtatgacacaacacgttaatatatattgtaagtacttccaccgatcttgaaatatatatggtaacttttgtgtatgtatatattttggccttttcggtcgattaggacggtgggcagggttgaggtttatagcagctcggcggggggctactagtgcagcacgacgggtgcacggataaggaacgccgatttggagttgtcgcgccgtcttgttggcgaggcatggagaggcaggagagactggagtcgggcaccgccgcctcgttccgggccacgccgtaggcgatcatcaggaggagcaccgccgccagaaccatcgcttccggcgcccgctgctgcgcagccactcctcgtcttttcaacatcgaacgcaggctcaccggcgagaacttgtgaacgaactccggcgtggcgccggccggtcgtccagtctgatttcttggctagaggtgcttattactggctagcactactctctctggtcattagtttgctacttatatatagaccctccggtatacatatataatgccggaccagctgctgcccggtttactggtctcgatccacaccaccatagcgtgacttttcttggttctagaaagattatgaccctgtttagatgggactaaaacttttaagtccctatcacatcagatgtttagacactaattataaatattaaacatgaactattaataaaacacatccataatcttggactaattcgcgagacgaatctattaagtctaattaatttatgattagcctatgtgatgctacagtaaatattctctaattatggattaattaggcttaaaaaatttgtctcgcaaattagctttcatttatgtaattagttctgtaagtagtctatatttaatactcgaaattagtgtcgaaatacagagactaaagttaagtccctagatcgaaacaccaccgtatactccctccatcccataatataaaggattttgagtttttgtttgtactgtttgaccactcgttttattcaaaaaattttggaattattttttttgacttactttattattcaatgtactttaagcacaacttttcgtttttatatttgcataaattttctgaataagacgagtggtcaaaaatgtaagaaaaactcaaaatcccttatattataggaagaagggagtactaataaaatttacctaattataaggtgacgaagaaacatccgcttgattcctttgatgtgataaacatgtacagccaaaacccaaccggtagaattttctacggctagttgtctctttttgtgtgactagcaggctgggtcgaagattgatggaatgtgaggttcatggaaagcccaaggtatacacgccagaacaaatgaacgattgaatggtgtgcatgcacgctatcctctatccattgtgcacctaatataatgcgtagtcatatttaacattatcttcaaaactaatattggacttcttagtttcttaaataatacgatatttgtatgaacaaaactacaacaatagaaaagtaaatttgagtcaattcagtgatattatttattaatattagactaatcattgatcaaaattcagatttaaatattaaaatacgtacacgccttaactatataaaaaagcgagtacattaatctccaatgagagctagtgtctgacgacgacccttcaacgcatcaaattaaatgaatgcaccttttaaatttctttttagtatgcgtgccaatatagtacatatattctaaattttcctttatcttgggaataagaaataccatatttttagggatggttgaaattgcagcatatggcaggccttgacggcggaggctactataaatcggacatccgatctattgcaaaagatcagatgcccacgtcagcatgacgtcatcaagcatgcatgcatgcaaaactattttaaaatatttttttctcttaaattatttatccaaatcatgatccgattacacgattaaattcgttgtaattaaatatttaaaacaagaccacacatggatatattccgatgaaaaaactagcttattattgaatcatttttaaatgttgcacgttgttccactaagtatatcagaattgtttcactaggtagataaaaaatgtttcaatcttttaagtcgagcgttgttttaccttatatgaaaacaatgtttcagcaaatagcgaaagaatgtttcaagtaactgcaatatttcatccatacaaagtgaaacattataagtacactaggtcaaacatttttggtggaacaacaaatgaacgaattcccttaatagagggtttccatcatatgtgggtgatttgttgcaaaaaaaatatttcaattcactgcaacattagatctatacatagtgaaacattgtgagtacactaggtgaaacatttttagtggaacaaaagaaatgaaacgaattcccttaatagagggtttccaaaatatgcaggtggttttcaaaatagcagccaacctcctttcgggcagctgtgagtggcatgcagcttgccagcttaaccggcgaaaaagaatgcaactgaaaggaaaagaaaggaaggagggaagagaaaacgggttttttcgggggggggggggtcatagtgacgctggc

SEQ ID NO: 72876 - DNA, 4340 bp, Oryza sativa
gtgagatcgccctttttgtgagttcggtcgggggaaagagcttgcctctagagatcgcgtatccgcccttaatgctactaagtcacgtatgagcgacaagattatacatgttcgggccgctatggagcgtaatacctactcctgtgtgtgggattaaggttgagtgttacaaaggctcctaaactccggagagggctctcgctcttcttctcctaaagttcaggcttgctgagagtcgtcccttttttcggtgggcaaggtcctccttttatagctcaaggggataccacatgcaccgcctctacctactttttcatgggagggggacccacttcaccttgtccgtgccacgatccgcgccttcgctcggaagctaagcagcagcctgtccttgagcgcgacccagcgccgcccctcgcctgacacgagggacaaccctgccatcccctcataaatgggtgaagacttgtggtggtcctcctctcgtggagggagctccgaatgacgctccgatgggacgggtcatacctacctccactccaccggatacagaggcgacgtgggggcacggccgcctgtccaatcggtcttgaccggcgatgggccggtcacatacttggtcagtcctgactgacgtgcgtcagtcaaatggcactgcaagtctgcccctaccgcattaaatgcggtgaggggcagttggggcgccgcgcgcattgatagcggttcagcctgggtcccctccccgctcgctccccctaccacatggcagttgggcgagggcctcggggcaaggcagcgcgagggcccgaggggcatgacgtggcaccccgagccccccctcctcggccacttctgcaattcgtgaggcgtgggggtagggccaggctgtagggccacgtggctggatgggccactttgcatacccctgggcccatatctccgacaccctttatcctaaattgtactcctatttttttgaatggacatgattgtcgacgtttgatgtctcgactacggtatttggacagtatggggatcgtcggtgctaggatatacgcgagactgaggtaaaagagatggagacaggaatttttatacaggttcgggcccctgagtggtcaggtaataaccctacatcctgttggccggagccggagttgcttttatttaccataaccacaccagtacaatatgtggggtagcctatctaactgttgtcgacatgtcggtctgaaggtctgactcgtagtcgacaacagggtagtcttcctcctcgaatccgtgcccggcgagatcagagatagcgctttcgtatctcctgacggtatccggaggaatcgtaggggaatagccatgcctatcctgaagtcgatatccggcggcatgtcttggcgtatgttggcttgtatgttgtggcttctggtgggcgtgtgttgattgtcatgggtgtcttccatggtctcgtggtggtcatcgatgaggtggtcatcccgatcgtggtgatcgtgttggtcgtctcatggtgagtctgtctgtccccctgtcctcctaggggggcttgtatttatacccataggtattgtcacgccctgaagttttcccccctttgcttgctttaaaaattggctaaataaatcgtccgaagaaattatcttaattaacctagagctaattccctaattaataaatgcaaataataatcggaatcggcatgtggaatttttcttggattctacatgtcaaataatgctaacaggatttttagtggaattttcagagccttggaaataatttttatcaattaaaaatcaccaaagtgcaattttaatcccaggaaaatcctttcttcttttctttttcctttttcctccttttttcctcttcttgggccgtcggcccagtccacccgtcgcccgcgctcggcctccccttgtgggccggcccgttctccttccccctctctccgggacgctgacaggtggggcccacctgtcaggtcgtccccttcctccagccacccgcctccaacggcaaccgccgccgaatccgccacgccgccgcctcctccgctctttccgcgcccacgccgcgccgctcccgcgtcctccccacgtcgccgcctcttcccccgcatctcccggcccgcgcgcgcgctcgagagggcgggattcgagttcgaatcccacccctctttctctctctcctccccacgtcgccggctaaatcgggagggttcccggccacgtcctcccctccctcgcccattaaatcactctcccgagctccctctctcgtttcccccatttgccgtcccctcccgtgcctcctaccgagcccgcgccgctcgccgctagcgccgccgcttgccgccgcctccggccgcacgctgccgtcgctagagccgtcgccacgccgcgcaatcaccgccgctagcttcgccgccgcgagagctacctcggccgccgcttcgttgccgcgaatcaccgccggagcgccgtctccctcgcgccgccggtgagctcgccatggtttccatctccggccatttctcctcgccgtgccgcggctcctctcttctccctaacccggtcatcgcctttcccaggttgtgctcgaccccgtccgccgttgtcggaagcgccggccgccgctcgtctcttcccacgccggtcaccgccatcgcctcggtgaggaatcccctctcctccttcctttcctctctctcccatgagcgccgccgccctccgcgcgtgcgccgtcgccttcgtctgccgccgccggtctgtgcgccgtccgccgccgcctcccgcgccgtcgcttgccgttgccggcgctcgcgcgccgccgccggtcatcgccggtgaccgcgcgtgtcaccaccggccgccatggctgccggtcggctttgaagccgagccgtgcctagccggctcccccgcgccgtccgatcgcctttgaggccgatccggaccgtcggtcctgtggaccggcggtggaccacccgcgtggtcccggtacacggtggaccggccaccttgtgccgctgacccatggggcccgcttgccagccgccccctctccctctcttagtgccgctgaccagtggggcccgcatgtcggtgccgccccaccccttgctgacgtcagccctggggcaatattgcgcaataattaattaaggacttttctttattagtaaaaacacagtttatcttctaaaattcataagtaattcatccgagctccgtttaagtccattcaagtctcagtaaatcaagaaaatgcaaagaatccattaaaaatggttttgtttcctgtttctgtagtcttatagcatgttttgcttgtgtgctttgtttgtcgcgtaggtttcggccgtttcgtcgatccacggtttctcgaagacgttgctgaggtctcgtcagtgcgagagcaaggcaagtcatgcaatacgtttgatcatattgtacccaatttacaaatatcccgcatttctattaaatgttgcatccttttacaatgtcatgtgggatgggtcctaatactcagccatttattgtttaccttatgccattgataacttgggtatcaaaatgactagatgttggtttaggaaatgcttagccatgcttagttcaactagcacacacatggggatcacattattacatagactttgactatgagcatagctttggattggtgccaccgcaatggtgttagttaattaaaatacattgaatggtgggctgtgggtgcatggttttgctggtccacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgattggttaatattgattaattactacagctgttta

SEQ ID NO: 72877 - DNA, 4195 bp, Oryza sativa
ttgctatgagaataaaagaaatttgctcctcaatctcaatctcgattagtggtggctttagctttctctcggagagctcaggttttcgattgatttagtcgcgaggtttgcttgattgctttcgaggaatcgggggcatctgctcgagattgggattaggtggagttcgaggcttggatgcatctggtgccggtagaatctcgcgagctggcagaattggctgtccagcctataattctggagctttattatttttcttggtagaaagtatctggaaatcatctctctttgtggcagtccagatttggatcattcatgccgtggaagaaaataattttgcaaataaatgattagatgattccccactttttctttgtttggtggatctgcattagcatgttattcatagggatgctgtttttttttaattaaaaaaataatccgacatggtaatgagtactttgctccagctatactttattgtcttaaagtacgcggtaacattgttaaacaaaataaattatcttttggatgctgccgcgaaattcacggtggatgctggaaaatcttgtgctttatgccgcggtgatgctatcttaggatattgattttttttaacttgctttctcaattctgtgccttgaatcactggaaagtgttcatgtactcctgcgtactaagttatgctgttttattgtctttccattgcttagtaccactgccaccctgtcatctctgataggactatattcataagcatctttgccaaaatcctcaattctgccatacacaacctgcatcgtttgtaactgtcatctctgataggactacattcataagcatctttgccaaaatcctcaattctgccatacaacctgcatcttttgtaagctttgctgtgctagtggttgataaaccaacgtcctgggtgttgtaaccgttgttgttgaaaatctttgtggtttttatatatatttcactggggtttctatggctgtggaaggatatcgacatagattgcctttttttacttttagctctattcaggttttggctccagttgacgatctgatttctcactttcttctgatttcatttgcagcatggttcaaaggcagtttttagtatgtcaaggctgaagtgcgcacttcgggggtttgatttaagagcacttttgatcctcttgattggtctgccaattctgatctttgttatataccttcatggccagaaagtcacttacttcctcagaccaatctgggaaaagcccccaaagcccttcaaagtacttcctcactactacaacgaaaatgtctcaatggccaacttatgcaagttacatggatggaaagtcagggaaacgccgcggcgtgtttttgatgctgtgcttttcagcaacgagcttgatattcttgatatccgttggcatgagcttagcccttatgtgtcagagtttgtgttgcttgagtccaactcaaccttcactggccttaaaaaggatctccacttcaaggaaaaccgtcaacgttttgaatttgctgaatcacggttgacctatggtatgataggtggtcggtttgtgaagggggagaacccatttgtcgaggagtcatatcagagggttgctcttgaccagcttattaaaattgccgggatcacagatgatgacctgttgatcatgtctgatgttgatgagattccaagtgggcatacgatcaacctcttgagatggtgtgatgacatacctgaagtactccatctccagctcaggaactatctgtactcatttgaatttttccttgatgacaaaagttggagggcttcaattcacagataccgggctggaaagacgaggtatgcacatttccggcaaacagatgaccttctggctgattcaggatggcactgcagcttttgttttcgctacattagtgattttgtcttcaaaatgcaagcttatagccatgttgatcggattagatttaagtacttcctgaaccccaaaagaattcagcatgtgatatgccgaggagccgatcttttcgacatgcttcctgaagaatacacattccaagaaatcattgccaagctgggtccaatcccaagcacattttctgccgttcatcttcctgcttatttgctagagaaagtagatcagtacagttatcttcttccagggcgatgcatgagagagagtggctaggcacttgcagcttgcataacctgatgcgcatggggatcgtggatgatgcccctttggagaacaacatgcgagatattggttgtacctgatacaatttggctgacttagttgagcgatcgcttggcgatttgggtgagttcatgattttgtactggtgtagccaaacattggaagaaggcctgacagcatagcgcatgcttgggcgctgcgttcttgtttttttagaggagctcagcagtgtgtgtgcttttacctcctgagttttacccattacttccatggttgatatatgaactcagaaactcttgtagattgtgaactggatgacatccagaatttttttttatcttgttctgtacagtatcatttacttaccagacgagttaccctgcattgattctccgggcaataatcatcctcctgtcatttgatatatttgctgtacactacagaaagcacatgtataatgcagttggtgtttggtctcagctaactgtttgcaaacaaccagagcaaacaaccagagtcgttgcaggttggcaagaaatgcagtgttttcactgccttttatcattttatcctcttggtaatggttaatgagctgcttggctggcaggttcagttgggtaaactatcacattctcttatatatatatttttagttattgtgagggttcgtctgttcgtgccgttaagcgacatgttaaggcggcattttgtgggacgaagtgggttggaacaggctgttcttgtcggacgtccgcttcagccagattgacaaacatcatgtacaggttcatctgcctgacgagctccagcaagtattcctttttaaaaaaaaatgaaatatttttttatggatttttattctgttaaaattatttcaaatattttttgaaaaaacattgcaagctacgaattccgcaggtttaccttttgctctcatacacgttgcattgcgttgaggcgaggtctctcatggtcaggttcttagcttatctaccgtaactaaaatttaaatttttaacttaattttggaattgatttcagagtttttcatcgtaatcattttataacattatccttttttaaatatagtacaaacgcatgtgtctataatgcgtacacacttactcctatgaacacacatgcatgttcttctcttatgagcatcttcggaagactgtgccgcaatatcttgagaaacgaagtcaccactagcacctcgcaccttttaaaccactagtaacatgtagatataaaagtcctattgataaattacttttaattgtttcattcaatttttcttcatttttctatggcttacccataaataattcaaacattagagcataaaagtgcaaagcgcatcgctgataattctaagtggaagactttcgcagggtcgacgattggctgcccggaaagtggtctgggacctcgagtgagcatccatccacgtccaattgaaaatcgtcgaggcacactaggacgaaacaaacaaaacccaaaaagatttcgtggttccaagaatcatggccgagtagatccccacttctaatgtaatgtcgctattaatctttgcgtcgcccatgcctccacttaaagagaaagaaaatctcaattctgatgggtcaagtaaaagaataccctgaatctgaaacgcatctctctcttcctaaataactttggaatttagacatacggagtgacagttttgtggtcgttttctttctgataaaaagattaatcaatttctgcctagtttccaagaaaagatttaaggttgtaaatatatcttgttgaagactgtgggtgagtcccttaggcttagttgttgataaagcctcattgacttgctttcaggtcatgtacggcagtcactgaagggcatatatgctttacatttacatgttctctttttaccaaaccggcaaaaaaatgcaataagaatattttaatgtcccgagccatatttaaaatttgctggtg

SEQ ID NO: 72878 - DNA, 1805 bp, Oryza sativa
  unsure (1)..(1805): unsure at all n locations
tattgattaattactacagctgttttactgctttcaactactgctttgaaatgcctgctttatgcaaaagaacccctagcttcctttggttatatcatgcatcatacctcctcttccggtatgacttgctgagtacagtgggtagtactcagtcttgctctcttttcccccacagcagagctgaagatcttcctagttggagctgttttgtcaaagttggtttcgtcgctgccgtcaaggattgcctgtggagtggagtcgcccgctgctgaagtcaagcctcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaggtatccccttgtccaagtagaactagggcaaccaatatggatacaattcgagtagtccttgtcgtttccatgtagaactctggttgtctttccttatccggaactccctccataactgaagtcagtttccgtataggacatggtatgtggtgggtcctgccgagatttagtcaactactattaggtatgtggtatccataaccatacaatgatcttggagagtagagacaatagcagactataagccagctataaacatattttaaaaagataaaagaaaagagagaaaagcagcaggctagctgcagcacgaacatcaagacgtaatgtttatatgacaggtgagaccagatattaatagtatagtaagcaactattgtatgaattggctatatataatttaaagctagtagttggctattgcgctcgcatgccattcatttatagctctaataacttgaattgttgacaaaatctatgaaaaatatattgatctacaaattatacctttgactttatatatacatgatgctcaaaacacatgcataatccctacaaatcaaagaaaataggtcttatttacgtgtatatatatgtttttctcttacattacataaatctagttgggcggcccgcgcaattgcgcggctagcatcaatttaaaattatctattttttacacatgattttatttaaaattatcattcccgtgattccaacaattttatagattttaaaaggcacgccagtcgctaccccttacttctttgtcacctttttatttgcttgctcgatctaccactacttctatttattctctttggaacattagcccttatagttttagagtttttttgtcttgttgggtttcgttntcataaattttagaagtatcatcaaacatcgccaattttactactctatggcccgtccactgccacctctctttatcgtcattgggattttaaaaatcgataataattattgtttgtgttcttttttactttctataaatctcgccaaatctttagtggctttgccactgtactcccctgcaacgcgcccgctacctcccctccttattgtcattgagattttaaaaatcgaacatgattattattggggtttatttttactctctataagtcccgccaatcttcgtgaccatgctgcttaacggcatgcccatcattactcctcttaatcgtcattgggattctattgaggttttctttatagtttttaaatatcacatcaactattagcactctactcctttataggcctattgcttctcccctctttattatcattcgtcatcgttgtgttctagatggactttttttaaaa

SEQ ID NO: 72879 - DNA, 10490 bp, Oryza sativa
gccaccgcccttccaccccccgccatctccctccccttcgctctccccccaccacctccgccgcccaaggccatggcgatgatggccatggatacgccaccgaccaagggcatggcggtggggatggaggtggagctcccgttcccggacgacgaggaggacgagagcatggtcggcggcggcgtgagggtgggcaaagagaaggtgaaggagatggtgatgagcggcggcggcggcgggtgggaggccgtcggaatctgcggcatgggcggcagcggcaagaccacgctcgccatggaaatcttcaaggatcacaaaatccgaggtaaccaacaaatcatcatcaaattttgcgtgttttttgcaaaaattattcgattcgattcgattcctcgtgtgaaaaaaaggaaaagagaagggtttcacatctttttccttcaattattgtggcggcttagggtgtaaaacctgcaaaattattgtgtgctttttgtgcgcaattaggtaaagttgaggttgatgcttccgtcttgttcttcactactgctacctgcttggtcaaaattggcgctttgaccaagcttaagtgtgatgtgtacgatcctaatgggattagattgctggtggagcacacaattacgccacacggcctaacttttttggagatgctgtgaaaaattatttttggtccaaattgagtagtaactcgttttctgttcatggccttttgccttgaaatcatggcatggtatgttcttgcttagattcagattgaaattatgagatttgcctagtgttcattggcatggtttaatacaaaccccggtatgatcatctgtaagtgcaaagggagttataattagtatgttggtgaactcattcggctcaacgtagcaacttgtgttcatggtgccaattttaatcaacataacattagaactttcttcgaatttattcgcctttttcctaattgatctgagcaaccccttggattttgcgttaattgtttgccatcaagatctgttcacaaaagacagttgtatttgatcctttgctggtttctctggaaaggtttgcatgctttattgtttttcatggtgctaacatatttcgttcttgtttctgtaggctacttcagcgatagagtcttctttgagacgatctcgcagtccgcaaatctggacactatcaagatgaagctatgggagcagatcagtggaaaccttgtgctcggtgcgtacaaccagatcccagaatggcaactcaagttggggccaagggacaaaggacctgttcttgttatccttgatgatgtctggtctctctcacagctagaggagctcatcttcaagttccctgggtgcaagacacttgtagtatcaaggttcaagttcccctcgttggtcacccggacttacgaaatggagttgctcgatgaggaggcggctctttctgtcttctgtcgtgctgcctttgatcaggagtccgttcctcggaccgctgacaagaaactggttcggcaggttgctgcagagtgcagaggacttcctctagcactgaaggttatcggtgcgtcgttgcgggatcagcctcctaagatatggttgagtgcgaagaaccggttgtcgcgaggagagactatatctgactctcatgagaccaaactcctggagaggatggccgcaagcatcgagtgcttgtcagggaaggttagagaatgtttccttgatctgggttgctttccggaggataagaagatcccactggatgtgttgatcaatatatggatggagattcatgatcttgatgagccggatgccttcgccatcttggttgagctatcaaacaagaatcttctcaccctagttaatgatgcacagtatgtacagcttgccctgtatttcctttcaaagcctttaataatttggatgcgacaaaaggacggatttgacatttggttactctatgcaggaacaaagccggcgatttgtacagcagctaccatgacttctcggttacacaacatgatgtattgagggatctagcgcttcacatgagtggtcgtgatgctctgaacaaccggagacggctggtgatgccaagaagagaagaatcactaccgaaggattggcagaggaataaggacactccgttcgaagctcagatagtttccattcatacaggtgattcattggctattaactacactttcatctttttttttcttgctatgagaaaaaaaaataccatctaatttgtttaactgatgcttaatccttcaaggtaatacataaagttccatttgttattagtattacctgatcttgtgaaatatttcccttatttaaagttctatggtagtgttacttgcaattatttgtgtttcccctttggacaaaataatctgaccaattggtttcaatcttcaggtgagatgaaagaatctgactggttccagatgagcttccccaaggccgaagtgcttatcctcaacttcgcgtcaagtgtatactatctcccaccattcattgcaaccatgcagaacttgaaagccctggtgctgatcaactatggcaccatcagtgcaacccttgataacctatccgccttcaccacgctcagtgacctgaggagcctttggcttgagaagatcacacttccaccgctaccaaaaaccacaatcccactgaagaacctgcgcaagatatcccttgtcctctgtgagctgaccaacagtctgagaggatcaaaggtggatctctcgatgacattcccgcgcctatccaacctcaccattgaccactgcatagacctgaaggagctaccatctagcatatgtgaaatcagttccctggagagcatctccatctcaaactgccatgacctcacagagcttccatatgagctgggcaagctgcattgcctgagcatcctaagggtatacgcctgcccggctctgtggcggctcccgccttcggtatgcagcctgaagaggctgaaatacctcgacatttcgcagtgtgtcaacctgacggacctccctgaggagctcggtcacctgacaagcctggagaagatcgacatgcgagaatgctcgcgactgaggagcctcccgaggtcgtcctcatcgctcaagtccctcgggcacgtcgtgtgcgacgaggagacggcgttgctgtggagggaagctgagcaggtcatcccagacctccgggttcaggtagcagaagagtgttataacctggactggcttgtagactgatgttcctggatgcttttggctccaagctcacctttgtacagatgatgtgtatatttttccctgtctaatacaggatggaggaacaatccactctgcaattttgacatgttcagtgttcatgcaactgactctccagcagcagccaaagcttgctgagaaaatagaaccatagaattaatagagattttttcttcttggcacaaagcatatttacatacacatagcaaatacattaaccaatacatctcttctgtctctctgtttaatacaatacagaactaggttccatacaatgcttctcatttctcagtgttcccaagaaacagtcttgcatgatatcatccggtgctaaatttttggcacaacatacataattacatactacacaatctgctgcaactcagctgcagtatggttcatcagaaattcagactcaagaactaataggcagcagagcctgcttcctagtagcctgaacacagatctcttctggagctctacctgctctgaaacaagctgattttcagtgcagtttcattgcaaatgttgagatgattacatggcatatacgatctctccgctgctctcaatgtcaaggtcaaggtccgagtccatatcctccatgtcgtcgtcgaggtcaaggctgtcagtcaagaactggttgattccactggtgcctgctgctggaattgttgcttctgccagtatctgcatgatctcgttcatattctgcatcggctggtcaggctcctcgtactgattgctaaccatgccatcatccatgaggtcagccgggatgttcttcatgaaccatgggtggttctttatctcaggcatggtgatcctctgcaagagcaaatgattgcatatgttgtctcacatcagagctgaataattgaagattgtgtggcaggaatagaattggtactcacactagctgggttgccaacaaaaatcctcgtaatgagatcgcggcactccggagatatgtggacatagtctggaattgagtactgaacacccaatattttctgcaaattgagatcagtatttagacattatttatctaaaaaaagtatttaggcattactatttagctggctgattataactgtaaattgtggtgctgcaaagctgaatggttggcaaggatacctgaattgtctttctgaagttcttgggatcttcaggatcctcgaaagggtatgcgccaaccaacatcacgtagagcgtcacaccgcatgaccaaacatcggcaatctccatccaaagacaaattattagggattgagctaactaatgcattaaaagggttacttcacaagaccatacactacccatgccattgaaacatggatcaacacctttacaacacaatggcagcttctattgtcgagcaaaaggcatagaagttgggcagctgctggtatcagtgtatctttgcatgcaggatggcaacttttaaagcacaaaggggatagataatacctttccatcgtattctttcttgagcaaaacttctggagcaatataagctggagttccaactgttgattttggttgtgaatgaagaaccgatgactgcaaaatcagaaagcaacagtacaatattatccaggcagcaatcacatcgagaaaaatctagcgaaagttctctcttcttttcactactacagaaagtaatttaagccacattgtgcaccctaaatgtcttgtggatactatctaccttcagatcatcaaatcagtatcacatagtattgccaaatgatcaaagtaatcccaactaaaagcatagcaaaaataaatagaaaaacattagtaccttcgagtaaccaaagtcacatatcttcaagcgaggagcagtacttccatctagcagagtgttctccagctttaagtcacgatggcatacttgctgaacaatgcaaaaacacattaacaaaatcgcttcagctcaatgcagcaaaccgcttatagttatagacaagcgaaaatcacacggtaactttgaaatcaaaatgatactgtaccatggaatggcagtagctaactccagatatcagctgctggaagaagaaacgagcctgaaagtacaccaaaagttcagagttagccaatacaacagtacaatacagatactacacaattattggtgaaagaaatagacatgatcatagtgtatcaggacagtgatatcgacctcgtcctcgctgaagcggccggcgctgcagatgcgctcgaagagctcgccgccggaggcgtactccatgacgatcgcgagatgcgtcggcgtcagaataacctgaaaagattcgtcagagtcggaattgcaaacgaaacaagaaggaacaaacaaaggtgtccttttacatcattcagcatcagcaatcagcatgatctccaaagaagagaggaggaagaggagaatcgtgtcatggtcacctccttgaatcggatgatgttggggtggcgcagcgacctgtggttgatgatctccctctgcacgttctcgtcaatctgcagtcgaattccacggtcgatcaaaccagctttgattttacccttttttttcttctcaattttgctaagctaagctcgcagcaaagaaaagagaggaaggaaagagaaccttctcgccgcggtcgatgtacttgacggcgacgaggtcgccggaggcgcggttgcgcatgaggcgggcgacgccgaagttccccgacccgatctccttcaccagctcgtacctgtcaccgtcgtgcattatcggcatctccatccccagcggccccgccgccgccctctccatcgcttccgccggcgaccaaacgaacacaaacgcaaacctcgatccgactcaacacgccacctcctcccctcttcttcctcctcctcctcctccgatctcgtgatctctctctctctctctctctctctctctctctcttcccctctcgcttgctcgtgttcttgattttttttttctcgctgttgtttttttttctccttttgctcccgcgctttttcttattgccgcgggaaagtgggggaagacgaagcaaaggacgttatccacatacgaatcctaaacccacccaactacctacccactctatcacttacacgtgggtcccgcatgacaccgggcccacatgtcattgtgattgctcgtcgacgttcaggtgagaaaaaacatcccgggatgctgggacggatgcttattctacccgcatcctcgggtgggtggctgacaggtgggcccgactgatggtggggctcacaggtcggtggcgggtggggatgacggagggaggcggggaaaaagcggccggaaatatctcgcggtggggccgaaaagcgccaaggggtggttaattaccatcgtgccctcgcgcgtctggagcagtcggatggagatcggacggtgtacatgggttgactttttttatagggttgttgatatttccttggacggctgcgatcggattggcggctacgcggccacaaggacggtgagggtatttcagtcatatcatcatcgtctgccgctgctctttaattgggctggtgactgtagattttaagcccaatttgggatgagcatattatgggcctatttgagaagcccagatattttaacaggttttgtactaatgggccaaaagcccatcatttgtactggatcagtgtgcttttgagcccctttctttcgggcccatgtagttgaacaatggaccagtgatggccccgtaccacttggaattttgggcttgttcattttgtgaaaaaaaaacacttagtaatactcgattttggcattatcaagtttcggtagggtaaaattgaggtgagtagtgtttagtttgatgcattaccaaatactgagaaaagttttttgaatagaaagttaattatcaactattgataaggctattttggtattactaaattttggaatgattgataatggtaaagaagtgaacaaaccctttgttctctcaccctcgtttgattgttcgcttataagtcatagataaattttaaattttaaaacttattgagatattctgtcaattttcttttttcatcatggtcttttagaccattcagagcaaaaatataaaaggttctgctctaaaattattttcatggtaggtgacatgtgtgtgcgcgtgtgtttataggtatgagtgtgcatattataaacgtctacggttgtgctgtgttttttttaatttctcaatttcataatactagtacatatagctataggttatacaaaattcattgattcgtcgttattcatagcgggtgattacctgctcgactatgcttaaattgaaagattataaatttgactagttttctttctagtgaacaaaataaggggtgattttatatcatgaatattggtaaaccgaatttgaattcgggtctaaggatggatggtgcagcacttagtgctatccaatggagatctcagtatctcattctcacccagatcggatatcatctccatccatatttttgctgatcgatgcatcctcctgctcctgtcattttcctctcaaagcagatcagcagaacgagaaaacttgcagagattcttccttccacgagacacaaattgcagttcgcaacaaacagctaattaatcttttgctccacagagagattgagagaatcgatagttcatttcatttgtgagcagagtttttcagcgagctaagcgtatcatattcttcagaaaaagggcttctgtattagtactcttgtgttcatttaggcagaacagccgatcttttccatggcacgcaaaacatttttctttctttgactcttttggttttactcaattcatgaaaaaaaaaattaaactattaatttatttttatccataatggatttatgtgggctaatacatgaaattcttatgatgtttggagggatttattattctactaaggggtctatgtgtggaatacaacttatttactcctgagcaaaacgagtaatgtgggagcaaaacgagaagaaccattagctcgtgattaattgagtaggactattaattatgataaactccaaatttagatttatattattttcagaataaatttctatataacaagtttttcaatgaaacataacatttactccggtggtttggaaagcgtgcttacgaaaaacgatgtagtcgttcaatgaagaagagaggattcaaacacaatccagaatgtgtttatgttgttaggtaaggcaagagattcttctccataattcaggtacaacaactgcaaagaaccaacttatctgtggtccaactgcaaagtcagcctgtccaccaggagagaacttgaggagaggggcattctgaattctctgatcctgaaaaagccagcagatagcatacaagagaaaacagtgcacataaagtcgagatccatggaaaggaggaaagaaatatactcatactacgaacgatgataaaaaaagaagacgaataaagtcatgtgtgtgtgtatatatatggtccatttccattgctgaactgtgtgcgccaccatcagcagaatattctctgcaaccacacgaacaagattgcaaataaagtcaccatatcagaaaagaaaagaatttctcctcctctttttttttcttttctcttatgtcctcgtcgtcacggttgattttatgtgataataactttttaggttagtctagaagatcggatgaaaattttctgttcataataagtctgtccatgttagtggcagaaacacagggaagagttcataggctgatgctaggatttcagtcaagtttcagttaaaaaatattcaatgtctaggcttcagatagcaccaagatcagaatgaatttctctccttttatcagtccacagaattgaatacagtaggtttttgaaacagagcaccggctgggaatcaaacatggaggaattcctaacaatttttcactcgaatttcagttaaaaaaaattcattcatccagtttgtaaaggtcactgcatacagcatcagagtcagagaaccagacaacctcaccattcacctttcaggaaatttcagtgcaattttcccagatgctgacgtgtacacattccactctctctctctgtgtgccagagtggtgggccccactacgcggcgattcgatgccaacctgtgccactgacagcctgccacgtcagcacccgctgccagggagagaccgacaaacgcagcgtgcggtgcgagattcccttccctcttttcttttccacacacacattcaagaggaatctcttctcttcctcctctaattttttcccagggggaaaattgcaaaattgcacactgcattattaatttattaatcattttttagtgctagagaatcttcttagctactgtaccaatatgatgctactactgtttgcttatactttgctttatgtacaattttggttagtgcagtctcacctgcatcttgattttttttccctttttagaacatcattgctacatgcatgaccagtgaatttcaccaaattcatatgaaaaattgtgcgaaaacagtgggtttgctcggtgcgactagggggtgtgggtcaccggtgagtattgaacttttttttaagatcggcatgagttttgcgtacctgtgtatatatatggcatgtagaattcgtaatccaaagtctcggcttaaaattttgagagggaaaattcggtcaggggacaagtgcaactgctacaactttgtggttagtttggcgtttgtttggtaccttttctttaagactcttcatgccaattaagaaaaaggagataagctatggacttaagcatcccacacttgattagtaatgactgatgagtcagctggtgccctgtcacaatcttgtgagaatcttgagaagaaggtgccttgcctgcctgcccatggcaacacaccttcacacaaaaaggagaatatctgatgaatatggttggcatctccatgctcttatagcccaaccaaaaggaagggattaggatttgatctcacatcacccttaattaacaattcatcaagggttaagacatgataacataagatactaatatgttgcataatgcaatgtaaacacacatacacacacagagagagaaagctagaggagaaagaagacaagttgtgcaagtctttggagtaatctctgggggatctcacagagattcttctg

SEQ ID NO: 72880 - DNA, 23299 bp, Oryza sativa
  unsure (1)..(23299): unsure at all n locations
agttattttttgtgtagctgacatatgggtcccactattttaattattttttcgagataaaattgccacgtaatcgccacgtcaatgcccgtgggacgaagacctagtcaaaggagccacgtaggcaccacatagatgccacgtcggctaaaaccaccctccatactgccgagggaccttgtttacctggttttcgtaagttgagggacgggtcgtacccggttttacagtcaagggacgaaaatcagattgaccgacaaatagagggacctaaagtgaacttattctggcctatgttggatacttgccccgtggatttccggcccatcctgtgtacaaaatggaacatgagtacacaaacagtgatcctgtgacttcgaagtcagaataatgttatcaccgacatatattacctccataaaaaaaaacttctggtttacatgtagcctacgtgtagatttgtagttaacagttgatcttttaggatcgaagatgtaggttttagttttatagaagttagaagaatctgtttctgtgtacatttggtgaaaatatgtgaaaaaaaatagagatttggaggaagagacgtccctccaaatattttattaagaagaaaattatgagcgtgttgggaattgaacacatgccccttgctatcatatggtttctatgtattattagagtgttgataaagacgataatgtttaagggcgacacacaccaccgaatatgtacaccatgtttacacatttgcaacgatatttttctagcaatacaacactcacattatagtataaggttggatttttttgggggaagagagagctagcatgcgtttactttataatggaagacatgttatgacaaggtgtggcttaaaccaagcccgggaacagacacaaaaggtattcctcgtatttttgaatatccacaaattttagaagaaaaaaagacccttatatatataggtatattacatatcagtatatgtatacaatcgagtgattctaatacttttcttcgtaacttctaattaactaggtgaaaccccgcgtattgctgtgaaaatttagtatgagaacaattaaaaaaaataacgtgtaagatagctagataccatcagattaaggaaattaatatggtttatgataatttaaatttaaatagtatgtagaatagtgattcaaatgtaaaaagtacggtggtatgactttatggaagaagaaaagtagggagatagtttggaccgtagattaatcatctaaaggctaaaaataattgatgcgatatgacttaattagaggaaaaaaggagaaatataatttggaccatagattaatcatttaagcactaactaagtgaggatgaactatataagaacataggatatatcataaaacataataaagatatacattgaaacattatgttgaaacattatgtgaattatgttgaatgataatttaacatgtttatatatatttgaaaagctcttaaattataaaaactataaagatataacatgtttgcacgatgtttaaatgtgatgattgttagtggatgatgatgtagcatcttgttaattagtgaattagtggataatgatgtggtatcttgttagtggatgacgatgtggcaactttacatgttaagcttaagaagttagtgaaagataactttatagtaagataggatttggccaaataccttaaacctcccaaccctagccacatcccctgtcatggcacgatggggatagagtcgcactatggttggcacataccccactagtacatcttgtcacccctacatggctacgtagcaatacacatataatacagaaattaatgctcacgaaattcctgctaattaatactagttgattaggcgcccgtgttgcaacagaatcaaaggatagattggggattagggatcagaagcgtttgactaaggagcacaaaattttcactgacataaggaacccacacgttagtgatatgggattagggcacgtacaaaggtctctatttaccgtctctcatggttgctaatgaagaaaattcgctgatgtgaaagagagatgatagaagagagaaacaccgttgttttgcatgacatcggctagacaacactcatggtggtagattcactaccaccatttttatagtagcatagacacactccgactgagtcatgcgtctacaacttttccactaccttttccgactaattacccaattacattagcgatgatcatgcgctagcatttactccctccgtcccaaaataaaccaactccataccagatgtgacacatgtatcacatcctatgtagataaatttggacataaatatatccggatttatcgtactatgaagtatccaaatctggtacgaggttagttttattttaggatggatgggtgttttattttggaacggataaaagtagattatattgggtgcaacaatcgaggcaacacatatgtatatgcaaaacaaagggaggaggaagagtgtgatgccaatatcccggataatgcgtgccatgcccaaaaatttaattaanaaaananannangggttctgtggttctctgggccggctgtcgtccgtcgtaccccgatctcgagattgaccagaccagcagagccattgtattgttgtgtgcatgcggccggccggcaagtgcacggcctcataatgctcctcgccgctcccaactctctccagcaagctgcacccaccacatgtgtacatagtagcattcatcaccattcccctgataataacaagtccacgtgtcgcgtttttatggtgattcatccatgctgtgctttgggtacaactttggatataaactctccttattttctcctaggggcggagttgaatgaaatgaaggaggatgtcactggcttactttactttactttggattaagtttagactaatacaaggatctgaatttggactgaagggatgcacatatggtgaaaattgatgaactatatagttaaatagtttttggaccggatttatgaaccccccctccctctatgtagctctgcccttgctccctccggctgggaaagagaaaaacagaactctcttatcttgatctcacgtgaggtaaggagctccgtaaagggtagtgagtgccggttgatggtttctcgggcgttggagcagaaggctggagagtggttgtgtcggcggtgatgacagcctcagtatggtctctgcgcaacaaggctcagcaagcaataatcgattctaacatcaaggtttctaagtagatgaataaagtgacggattattgctgtatatgataaaagcaaggttcggcggcgcttcctctgggctggaacaggggacatcacaggcggcaagtgcaaggtcaattgggcaaagacgtgtatgctgaccatgcagcgagacctaggagtcttgaacttagagaaatttacaagggccctacgcatgcgatggctatggcacaaatagaaagacccgagcaagccttgggtgggcctcgagacgccttgtgacgagattgacaagatcctattcgtggcggctacaaatttatcgatcggcgatagaaacatagcacacttttgggactcgccgtgggctgatgggcgcaggccgaaggacgctatgccacttgtctacgcaatctccaaaaggaaaggaaagtccttgcgtcaaggaaaggagaacaatgcatgggttggagacctagatttggaagcgaacccgctggtctcgctcgagctaatcgactagcttgtggccttatggacagcagtccgcaatgttcacctgaacgatgagcagcccaaccagatcgactggaagttcactagtcatgggcaatactctgcatcctcagcttatcaagctcaatgtattggagcccccagcacaaccttcgactcgctgatttggaaggtctgggcaccgaggaagtgcaagctccatgcctggcttattatccaaaacagagtgtggacctctgatagacttgcgactaggggctagcagaacaatagatgatgtcctctttgccgaagaactgttgaaacagccatacatctcgttttcgaatgtcgcttctcaaaaaggatatggacctctgtggccagatgggtgggtaatcatcttcttgaaccagggcactgggagcctacgcagtcggtccaggaatggtgggagaaactggccaatacggtaggagttcccaaaaaaggatggcacactctcatcctccttgttgtgtgtgagatctggaaagagaggaatcaacggattttcgagaataaggagtccacaacgacgtatctgcttgctaaaatcaaagaggaggctaagctctggatgctagccggcgtctgaaggttgcgtgagcttctgccacaccttgtatagtgtacaactagccccttgagttttttcccttttcatctctaggggttgtattttttttccttgctatgcgcagtctgtgcctttttcccttaaaaaaatagtttttcccttaaaaaataataaaaacaaggttgaagtaaggaatcgctacattaccagtttaccacatactagctgctactggtacttattcacacggtcacacacatgcatgtgctctcctatacttttagttaaccaccaactttcttaactaatcacgcgcatcaattgtttaacttgtcctctgcaggtgatatacgactttgttgtgtattttgtcttgtctaggtataataattaatgtaacatgtatataatatatccatgcttcggttagactaatccacctttaattagtgttttctttcattgtggcaattaattgctttatatgatatatgcatgcttgctgcaatgcagtttaatgcaagctctatgatcagcttaagtgaaatcaatgtatcgggggattgattttagggttttagaattgagacttcacacgtccctgtctctcctcatctttcctttatagagatgtcggtgggactcgaggattaatctcctactagaatatgaactcgtttgtaccgatctcacaaaaacaaaatttatctctaagtttctttcttgatttggaagtaaaccggtgattttatctcctcctaattcttatcggcagttaaccaataatatcaaccaacaatgctatcgctatgttgccgtttgagtggatttgatattttaaaatagtcaaattatcagcaaggcgattttaatttgaaggccgagaattggattcagaataattcaaaatacaagtgaacggcaattcattgcaaatgaaagtcctgtttgcaatacggattataggatttgaattattatccaatgaaattcctattccaaaatggccaacatttttcaaattactgtaaaatttgcacacttcatttaggctgagttcgacatcatgggttgggaattctccctacatggcacgcaaaacgaagcagcagattatcatacaattaaataattattagctaaaatacctgaaaaacgagatttctatagttataattattagctaaaatacctgaaaaacgagatttctatagttttgaagcagcagattaacatgattttttaaacaacttttctatagttttttttttgcataaaaatacatcgtttaacatttagggaagcacacgtacgaaaaaatgagagtagaagttaggaagagggagtatagaacacagatttagactgagttactaaaacacttcaattaagcctatttgaacaaaattcacttgaatcggccaaaatgaaaagagtaattagacagattacaaccagtttaacatcaatctaggcctagggtgcggtgagattgagaccacacagtagacagtacatcagagaattaccccatctctgcaaatgccatacatactacaggactaaattcctcaggggacagatcatcacatttcaccagcaaagagcccagcataagaaaccaaaacaagcaatagaaaacaaagccatatgagtgagttcctttgaccagatcaggatatgtgttgttattgcctgtgttgcagctgctactgtgtgttgtgtgatgcatgggaagatatctttgtgttggcttctttgtctttgtgcaggtttgtagtctttagaccacacatccactccaaatacatggtctgcttctgcagtagagagagtgcaatgcttgtgatgctagcttgtagctagatagggccacacctgtgcctgcctgcctgccattgatgcaagcagaccatctttgtttcaggctttcagttgaggactcacagctgtacacattccaactgccattccctcatccttctccttacactttgcaaagacttcctcttttttttttgcatgtaacattgatcagtgattttcgtactagtagcacataaacacattttgtcagatgttaaaaagaaaatgcaagaaatcttagggctctctaccctttgtgtaagctttcctttttcattttttacatgtagcattcagtgatttccatactactagtacatatgcacattgtgaaaaatggtaacaaaaatgcaagaaatattatggctctgttggaatataggaagcatttcgctgacgataagtcgctgttttcgtttgtataaaattactgaaatatggagtttttattgttattataattcttgctcttaaaaaaattgtttgtgctttgatagggccaggcagccggccaagccagtgaggtgcccactcacttctaggtggtactcctttgaaccaacaaaattttaaccaagctttgtctccaagcctgtttttgactgcattggtgactgagaagctatgcagggtttttttaacctttctggattctgatttctattcacccaacagcaaccatatgatctctatctctattcatgaacaatctagattcagaaggagagaggataatagtatattatcatgtaacactttagatacaagctatcagatgcatcgattggttgaaccatgtattatagtttatcttttgtttggtcatcttaacattgtacagttgattagttcgagaaaatcttctaaacatgttgatttgatctacttcagttggacttgcaaatatattttttttctccggtcttcttgaccagctcgatctgaggtttcataagatggatgtagattggagcaggggcgaagctacatacaactatgggggttcctaggcatccggctaagagaaaagttttagctatggttaccccatctccaccatatatgcaccctctcatcccaacaatgtgtaccctcaagcagaccatcaggccgagcaaaggtaacaaggccaacagagaagtgcacagccatgaggattttcttgtggtgcagcatgttttgttgacaaatttgccctgcataacagcgttgttaactacttcacggtgaaacagaatgcactcggtggccagccgcagcctatggtcttatcacctattaatcgtagcaggcaaggggtgacgtcaaaagaaagttttgcaatttgctttcatagtttcattccattttttcgataatttcaaacgaaaaattaagctgttttgtcttttttttcttgagatgctgatgttggacgagtagttctccagttttggcaacctattggttgtgattttaatcttaacttcttcagtacactgcgctgataactatcgtcattgggaattcctattttggcaagtagttttataatttaccgctaagttttcgttcttatatcactcgttcatgttaatgtagatactgaaatcaatggttttagtattgtttaccataatgttctttgataaaacatggtaggtcgtacgtatatcattttcgaacatggtagtatatcgctactatagtggtgcaccaccctctattttgctctagcttcgccactggattggagaggatgaaaaccaatgcatttttctctctcttttggtatcaaggaatcaggtcttgatatgtgtgcaaaactttagtaatagcctaactactgtcacatatgaaggttctcatggctgtgatcttaggttttaatgacactctggatcagcatttgtatctatctagccacaaaacttgattttgagcataataagcaccacatagtcaaatttgtttcaaattatgtgcttatggaaaatactaattgaaatatcttcttatttaattaaatattgggtgactaggaaatgacaagagctaattaattttgatctttttgagatggcaccaaattaaattcttttgtcaatcgatgcctcgatttcaagtttgaccagacctgacccaagatgttctaaaagtctagacccaattcctctcgatcttgggaccctcatggcacaaacatgacacattgattaaacatatccaatttgaaccagccagacatgcctaaaacctctcaatttttgtactaattttgagttcagctttccatgcacctgccagcacaaaaactactcaacacacaaaaagaacagtgcttgagagcagcatcagcattagtgaccatgcttcaatgcaactaagcaaggaatccttttttttttcattttatcagctaagcaacatctgtccatcgaagcaagaaaactaagccatgaggccacatgaatgagagagaaagatgaggagctgcaatgcaagctagcatagagcaagcatgcattgatcaggttcagagattcagaagatggtggtggtgtggcttcagaaagtcactccattgcattgcccatgggggcattttcattgcctgagtgcatgcagctgcagtttgcagggcaggcaggagaaagagaaaagctctttttaccagctgtaaggcagtgtgcagcaatgtaagacctgcattagttagtggatgaacccagaagacccaactttagagggttagggcttaagggcacctctctgtgcatgtaaaggataatcattattattgtatccaagaaagtaataatatttcagcatgtgtgttgcttcatcttttctgctagggcatgtggcacatttcaagcctcctgttccttggtttgcattgtcatcaactgagagtgtagttttagtgttaaaaaaaacctccgaaaaggaggagggagttcctggttttttattatagaagaaaagaattgacccggtttattaagggaaaccagccctaaaaccttaccgctgcacggttaattaaaagaaaactgacgaaaaacctctacgaagagattagttttaatatagttagagttatcttaattgaagaacaggtgggctatcttattgtgttaaccatctcatcccagaaactgaagtctttcaatggaaagtactatactatatacatctaagtactcttattttagttagatgttgcagtgacattagcttggtttctaattaacacttgcctcgtgttgtctcttcatttgaactctcctttgtcctgtgcttcaactagtaagtgccagaaatatcaagctcaagtagttccccagactaaacacagtggttaggagttacatcacccaaatgctaatcttcatgcaattattgttgtaaagtaatctcatgtatcttgtactctaataccctcataagcaacatttgtcaccccttccaacaacagcaaacacagctgatacacaattattaccagaaggagacagtgtacttatcaatcatgtttgacaaaagagctttcttttctttacagatcatctcttcatttaaattactgtgaaaaaatttttttgcaatgaaaactatgccatgttcttgtttggacatttataatggaagtactgtaacagtggggattacccatgcctttgtggaatcaagcaagtgcaagctggttgtgcaatgtaacagggaaaagtttgcattggattctcacttctgacagggagaggaagaggagaaaaacagtggaccagaaactgaatgaatgaatgaatggcactggaaattttcagctgcagctgcagaacagaacagaactgatcaagaaacccacagggagctaggtcacagacatgcatgcatatacaccaaatgaaatcagatttcatttctcaagaacagggagagggttactggttacagaagcttacagtgacaaccaatccaatatggcatagcttgtaacaaaaaccaatgtggtatagtaaccccatgcaagtgcagtgcagctgagtgaaaccccacactctctcacacatcatccacttgcaagaagagagggaaaaaaataacagagaggctgtataaacaatggccaacctttttctgaacactgctgctggttttgcaacttctgcatgcaacagcatcttcaccatatgcagacatgcagtgcaatgaaacatggcatccacaatggcatttcaaattgtgcagctttggactaaagttttcagaggaaatgtgctccatttgggcactggaatttggggcttcaagtaactcaagctctcctctccttaggagagctcactcagccccttttttcctttgttcattatctcttctccttctcacaaaccaaaccaatccaatccaacaacatttgccaaatgccaaccaatggcaatggctcaaagaacctaataaatattttggaaacttatgtcaaaaaaagggagaaaaaaagaaggggaaaaggagaagatccaaaccaagcgccccctagacatctgactaaaaattgtgtgtccctggtggtgctagcttcctcaacggattcgcggcggctctggcctgagccgcttattcatcgccgtcgcagcgaaggcggcggtgtcggtaacatcatcaacaagaacagaatcatatgtactggtggtggtaatctcattggagtctgaacattgcaatggtcgcttgctgctcctcctgttgttgttcatgtccccaaccatcatactgtagcaggcatgtacattctcctgatcaaagaaacataaatcacaccacataccaaagtcaattacatatctaatttataacgacattttcataatcaaatgttgctcaactactactttgaattagtttttttctgttctatctgaaattattcaagtgactgtctgactgacattctcaatgttgagaaacacatcaaagttaattacatctaattttcatcatcaaatgatgctcaaatcctactgatgtatgttgggaattattattagtttgcttctaaaatgtattgaagtgagtgagtgaatgagtgactgaccttgtcaataagacaagatggagaaaggttgctcatcttggactccaatgcttcttttgtcagtggagctccataggatgcagccaagattgcagctgcagcaacagttgatggcctgtaatctagcacacttccagctgcatcaaacacaaatcaaaatcaaaatcaaatcaaatcaaatcagaacaatgcaacaaacaaagaacacaaatcaatcagatgccagatattttttagagagagagagagagagagagaatattctgatttttgtgtgtaccttcagctgtggcaaagatgaagccgacggcgttgagggcaacgcgggcggcggcggcggcgccatggccggcggcgccggcgccgccgtggtggtggcggtggaggcgggaggagaagcaggggaggaagtcgaatggcgtgacggcgcccatgcgccaccccagcgtggacagcacgagcagctccatccggcggatggagtccgagcagaacacgcggccgccgccggcgtcgaactccgacagcgccggcgactggtactcctccatcttcgccgccacggacacgcacgcgatagacagcagccgcgccgcccacggcatcgcctccctctgaacacacacagataccacgtcaccggcgagctcccaagaaacaaaaatggcggcggcggcggcgccgccgcggcgggaagggatggatggattagctagattacatcgacgcgtcgccggaggcagaagcggtcgaagtaggcgatggcgaggtacgccgtccggtggccgaacccgaagtaccccctcgtctgcaacgcaaaccaaaccatggcgtgtcaggtgttcgaccctgttctcgcatcaacaagagctaatcgagcttagctaagctagtggtatcgagctcacttcgaggatccacttgacagcggcgaggcgggcttgccggaaccagtccccgtcgccgtcgccgtcgccgtagccgtcgccggcggcggcgtcgaagagggaggaagaagaggagcagcagaagctagcctccttggagaccatctgctccacgtactcctcctcctcctcctcgtcgtccgccgccgcaacggcattgtagaacaagaatacgtcgccgtcgtcgtcgtcgtcgaccacgccgtcgccgaggtcggcgccgtcttcttggcacgtcagcgagaagccgcacgccgccgagcactcctccgcctcctccatcgacatcacccctactgtttattcaggtcagtcaagcaagaaccatgctacggccggcggcgatggcggcggcggccggagaaggaggagagtgggcagcgagagtgagaacctctcctcctcaatttaagtgggctcacgtttcattaactttttttttactgccgtgttttttttttaccatttgtgttgttgttgaccattgacagttctggtaaattcaggtttgtactaacagtacgtctctggggtatgaaagcgcagtccgtgaaaaacgtaatcatcatggatctggtttaagatccaaagaatttaatgtgccatttactctgcaaatgataagagtttatgcttacgcttattagccaaaatttgaatttttaactttaaatatggagatgattttgggttttttttttcatcgaatcttatttttcagtctttacttttagatcgttaagaacatgtatataaaagttttattcacaaattacttttcgtttgcaaatatgttgtttggcttatttcacgaataagcgaaacgatgaggcctttaatcacattgacatctatctcctcaagaactgtattttggatggatgcaaaactttgagcagaagcatggaatgtagctgcaatgtgattaagatcttccgtgtaaaatgacacctgatagtatggtgaagaaatctcaaattatattggtaaaatgatatacaaaagtgaaaatgttttaaagtaaccacatattggttggcttcagctcataaaccctaaaaaataaagagggccgggtagtaacgcatccccgtcccccctccctccccgcgtcgctctagcgcaggtggctcgggggttgtgcggcaggcggcgcgatgacggtggcctaggggccctcagctgcgactcaagaggtggcgttgccggtggtggcgcggcttggctgcgcggcggcagggtggcaactcgccactacgtcgctggaatggtgtggtgcagctagggcggctgggtgcggcggtagtagagcggcctgcacggaggcacgaccaagcagaggggcagctaggtgcggtgatggtggtgccagtgttggcgcggcagccggtcggctcaaaaggtggcgcaagcgtcggtgcagtgatcgagaggccgggaacggcagtggtgatgccagcgcagacttggctggagcaggcagcgatggcagtgccccttcttggagctcctcctcttctccttggggagtttctaggttggattaaggcggtagctggttaacgggggaagctctgaccgccgacacgacgccatccaggccgggttctcctttggccaaatatggcgaggaggccagcgagtggcgggacggaggaagcctgggccagcttccaagggtggcggcagggaacaacaacaagtgtgaaagtaggccggtggtggggtggaggcctcatgctgccactgtctgtgcggtggtttctgagctgatgggcaatgaatttcaagcaaggttgcagagttctaggcgaaaaccacgcctctctctcccttggcgagtttctctaggtgaaaaccacatctcccatagatggacgatggcggcgtccttgatgtcgtgacctccgtgggggcatcgttttcagagtctcgtcttctggtgttgtcgtaggctcagcggcaatcagccacgcatagctaagatcattttggttggttcctctctcagtgggttgtgcttatgtggttggcatgtggttcttggtcgtgcactttggtgcacttccgacctcaatagttttctatcgctttttcttaatatattcggatggcctcctttggccttctccgcgaaaaagaaaaataaacgagccagagaaacataatttagggcaggacatttatatttctactcataacggtttaaaaaccatgtctggaaataagaaaacaattaaaaaggcctagaataatgtaaaattaagtttgaaaatttaaattttggccgtgtcttataagccacaaaacaaacattgacggtaatagcatgcattatgcatccagcatccatatttgagatactactctaaactgacaaggcatgctagaatggtcctaacattttcacacaaaaagtggtattttagtctgtgggcaaaccctagaatctaggaaaaattggctaatgatctgaaaaaaagtaggttgaagcctctgcaggctacatataaaataaggattttgttgagagtgtaatctcaactaccacctagcatcatcttctccccaaaattctaaatgcagccaagaaaatgccacatttcctcttcagaatgtactcagggttgagacaaaaacactcggtttaatttggctactaatgaatcaatgtgggccccacccccatcagggaaaaacaagcaaattctgtgggtgatcagagacataatacagccacaaccatggtatctaatcaataataatgcagctactctatagcatctcacaacctaatcctccctagctactgacaaaatttgacagatttttaaccttgacaatttttttcagagttactgtatgatttctttttcccctacccatgtccatggaattttagccttcctcgtgaactaggacaagctgtctgcaatgtcccaatcttgctactacatccagatgctaattaatagtggggacatggcaaatttatatacacatatatatttacacgaaatttatttacacacttgaatatttggggtcacatgacatgagatggtgctgaaaatgttgggagagtgaacaaaaacccaggattcaagggccaatgttttggagtaccaaaacagtgccaattcaacacgcatcgtcccatgccaagatgcaaatttcagtagtacccccaggtcccccaattgcttgctgcccatttgaaaacaagggaagatgccaagatttggcctgaactcacactaagatcaaggagagcaatatggaccacttcttatccttgctgctcctgcatttggtgattcagacaacatgacgagcaaacggtccgcatctgaaatcaaaggatgaaatataatggagtgcagaagttaatataatcaggcatgtcaaatttacatatttgtttttagataatgtcaaactttcagatggagtgaaaacaaatggcaatctgaaagtttttatatatatatatggagcctgagtttgttgacagttcttgtgatggactgagacataaagaaatcttcgaatacaagcaaataacagattatggagtttgtaatttgcagaatttgtacaatcgaatatcataaagaaatctcaaattcagaattgtactttgcagagagagcttcagtacctcttatggagttttgctgatacagtgctcttcaaacaaacatcagcatgaacacgcaatgatgatagcatctagtaacactgatcatcaggtttcaactttcacctgtaagaacaaaacaagaaccatgaacaataacttctcaaggaaattattaaaacgattcacagttggtcatgttgaaatgtactgtgaccgacggtcctggatgtggatggagccggtatactgcatttaaggttgtgcaagccattctgtccaacatttcctgcaatggacaatcgtacacagtaaaaaaacctgtcctcctacctgaattataggtttcttcgacattcatttatggattgcaagcaagcagatgtgtgacacagatcaaacaacctcaggacacatcatatcatcaagtttgctacaggaccctgcataaaccagccttgaattcaggttcctcagtcccacatgagaaaaaaaaaaggaaaataaaacaaagtgaagaaagaggaggacataatatgtatcctagccaacattgaagttgcagcattcaaggatcaagccacaagtattgacttaacactcatcagcatttcagactagtaggcaaacctaatgcacacaaggtgatcagaaatatattcagaaaagcaactagcaagtaaacaatagtaatcagcatttgagagaagactatatattaagaggtagagtgttcttccaagctgcccccactttggtgaagcaaggggttcagagactatagtgatgctatctactctgccacttaagaccactcagtgatgtcttctttgaccaatgcttctacaccttcacagaagcaagatgataaataaatgaagcctaagtttggtcatgtcaatgtctcaatgcaaggggcccttcaccatctctccctatttcaatgaaagcagtgaactgtgccaatcactaggggacacaatgggcctttgcttgtgagatgaagcaaagcattaggaggagatcttgtccactaatccactaaagccacacagtggctaaactctactagtgccaaacttgggcatgctagttctagcactaacttagcttacccttttttgaatcaccaaaacaccaatgatattatatatagagtatgaaatgaactagattatggagctaagtacaaaagggggcacaaaatcttgtagacctatttgtttaccttttgttttccaggcctatttgggggtcaagtctttctgtccaaagaataagcaatttcttctgaatcaaccaaggaaccaactctactgcttctagcagtagacatagtaccattgcagtgtaatggacaacaatacctcaaggacaggttgattggatagctcaggacagatattgtgccactatgttacaaacattttgaacaagaccttcaacaggaatttgagtgcaattgaaactattttgtaactactaactgcatgtgatttaattccctcataattaaaaatgtacttccatgtttcatttactcgaacccaaacctaacagcgatttatagttgatcacgaataattttccttgattattaattgatattcccgcaatttatccgtataactttaacaaagaaaattgtctgaaatttgatgattttgccaagtttctgtcaaaatccatccacatcagctgcttgacacttcgacagtacagtatggtatttatataaaataaacaaaaccttgctccaaccatctaaaatgaaagctgtgtaggcccttgggaggctttaagtcatgcacttatgttgccatcattgatgaaaagctggataagtccctgcacgtcggctaagattatcagccaggctttatgccaacccaatcagattaaagtggctaatcaaaaagtctaaccttttacaagctttaacctaacattaggacagcttcccaatgtttgactggtacaagggttcagtcagtcagcaacaccaagaggagcacatgcaagcactcatgggaggcacttatcttgagtttcacaagaaaatgttacaataccaactgttgtaatatgctggttggcagatgagacaatgaaccacaatgcaaaggaaaagacagccgactaatagcaaaaaaggacttactatctcagaaagcatatatgtaagtgacatgataatgaagcaaatacatgtagataagatagttatacaaaggttaatgtagcaaatacatgtagataagatagttatacaaaggttaatgtagcaaatacatgtagataagatagttatacaaaggttaagtgggagggaccactaatatgtagtggtctcaccattttgttggcaccaattacctgtagtgtatctgtgcatgcgatgtattgtttgtgattttgattcttattttgcaaccataatagaatgatccatccttcaatgattcaatcttaccaggcaatcaataacaaatatgcagtatatatgtacaaagttaattttaaaagtttccttgaaggcatgataaatgggaagagccaacaggacgttgtacttgattgaaaccatagtatgtgcaaatcttgtatagagaagattgttccaaaataatcgaataaattcttcaggttacaatcttttgcagacagaatagttggtacaggagatgtgaccaatcagaatactgtaatcacatggaagtttctgtccaatgtctgtggtcttgagatcggtggaaacttgctggcaagtgacggtctgccccatcaggctatcactatacggatttcatacaggtttcaactcttaagagtaggaaggacatacagaaacatcaggaattgagtcaaggatataatgtgttgaaattgtaagtatctggcagaattctgaataaaccaatgccatgctagatagaaacactattatctgaagcaagtttggattatgtgattatgccaatgtgaggagcccaactaggcaggaatctctgctgtctttctggcactacaacaaaacaatttgaagaatatatgtcagcaactcagcataaactataagataaatgattaccacattccaaaatgacttttacagcattaccgtatgcagagaagatttttacagcacaaaataaaaggatgaagcgaaagattctctcttacaatatattcgggcttcactgaaatatcaagttcagtttccatcatcattttcttcaagcaggtactcttctatttgatctctgaaaaaaaatgccataaacaatttagcaaatcagtgcactgaaggactgaatagggcaggactttaacagatgaatgggccaactgcacatactacacatggtcacgttaaatcaaacattatcagacaaacaagctccaatatccaaaggttcaatgttttcatttgctaaactaccaatagcgctcactgtttataacaagaaatgaagtactccataaagaaacagaaaccactatcaccttagcaagctatggctgtcagatatggtatccatttttccagtccataattttggtagtagtgaaaagaaatgttcattcaagttttcaccggctggtagaatctggaaataacagctttgacaacaatgagcagtataaagatcaattttcttctgagccttgtgttttgtgctttccaaattctggagttctgattcactgaacggacttccacacatcagacagagaatctcagaaaaagtggactcatcgctatcaaacttctggaattttggacgtagtcgcgatggtaggaaatcatgatagccatctgccgagaatttgttaaaagagaagggcttgagcttttgcgcagttcttacaatggtatgctctcgagaagggttctcttcctgcagatggtaataatagctgtaaagatgtgttgtcctccaaacaattaacaaaaataactgctgagcaaggatgtagttcaactaagaataggtgaagtgtaatttgacatgtagtaattggcatgataggactgaacttacccgtagtcgtttaataaaggatgcaactaaactgttgatgccgttcgaaggcctatcgagatgttgctgtgtttttaaactaaacacattcagttagaatcaatggcatttcaagaaataaacaaataaggtttttcccccttctcttacctatctagttcacagaggagagtaagctcttgggctaggcaatcacggagtgggagaacaacaggtatttcccaccgtgtatcaacatactggacatcagcaggtaaagagtaaccttgcccctgggtagagatatcaatttcatagtgctcctctaatttccatcatgttcttttcaagaattatgaattggtaacaaagaacagaatacagagaaagcagcacatggtataccttcacagtcgcggacagaacatggcatgctattgcagaagcacatgatcctagcatgatcttagcgtacccgttttccatagcaatctgatcaacaacacatcaacatgaaacaatagacattaactcatccactgatcaaaaagcataatacaagagcaaaaaagcacactgacggaccttttgcaacgaaagcatgcgtaagcaccgaaggaaatcctccctcccagtgtcatcaccaatcatatccaccgcctccctcaacctgcgttccccatcctccgattcggtggagaacacatcctcaagacgcgcaatgtgcatcgctttaacgcctgttgacaaactcgacacgatcgacctgatatcttcaattgccatctcaatctcgtctctcggcttcgaacagagaacactttcatccacgaatgccaccccgacaccgaataccggtaaggcttgtgaattgctcacgtcccagctctcaatcgccttgcaccgcatctcatgtatgaattgcagcgctaccctataattacatcacgtagtagtacaattacacttccactctaatgatcataaacacatgaagattctatgcaaagtactataatacaataacacttccactctaatgatcataaacacatgaagattctatgcaaagtactataatacaataacacttccactctaatgatcataaacacatgaagaattctatgtaaagtataatacaataacacttcaaatctaatgatcataaacacgtgaagaattatatgcaaaggaagagtaataactttatgtagcacaaaagaaatgaaaattaggaaggaaaaaaaaaagaagagggaagcgaacctggaggcggggccgccggagaaggcgaggaggacggagtcggtggggcgaaccatggcgttgctcgtgacggcgagcttgaacttcccgagcaggttggcccggaagcactcgccgcacaggccgaggcctccggcgacggcgacggcagcggcgccgccgccgcacttgccgcactcgcgggagagtgacagggggcctaccttctccgccgccgcagcagcagcatcttccacctcggcggcggaggcgaaggaggagcagtggggcccgcagccggcgccgccgcaggaggaggacggcgccgccgcccatggtgtgggtacgcgaggcgggtaagcacgcgagcgcgtaggtttagtttagggctttgggattctatactactcctcgaattgggcctagctgggccgtctcagtccaggcccaatgggctttcacctgggccgtcccctcgaattaggcccatttttttcccttttgctttgaatatttgaaatgaaacgcaccagctggtgttaggtttcagtgtttcatattgatacagtactagcactttgctacgttatatttggatgaatgtatgttacatctttaaataatgtaaaagtaatgtggagatgacgatttgacattgtttacgtattaagttttaaaaatacaacaaaatcataaattatactatgtcatgctaacatgatatttaaaataatcgatataataattgttagtgagtgatgatgtgacgtacttgtatatgatttaaaatactatagataatacttaacagtggatgacgatgttgtacacttgcatactgagttttagaagttagtgataccaactatattaaaagtataagggttgtttagattagtgtcatttcaaaccatgtcttttttaaaaaaattgccaaagatatacatttagtttttttaccaaactttggtaaatatataaggaatcctatcaaaatttggcaatattacccacttaccaaaattttgacattgccaaaatttgataagatttattttgataaaataacagccagttaagaagaagttagaagattataatcatgtataaggctataattagaaaaaagaggaaaaaaacgtactcagggttcacaatctctgaattttgaacatctcgagctggcccgaatgtagatctcaaatgtttttgtttgattatttttcaatttcattcaaaatttgtcgaaattcatcaaaattaacaaaaaaaaaatctacgtctcattgtggcttgaaattcactggcaggggatcctagagtcgacctgcaggcattcgagattgtgaaccttgttgtcagttcggtatgttggctatttacaaattcatttaaatcaggtcaactccacgcatgagccaacatgaacaagtaaataaaattgataaaataataattctacgtgtgcttaagatcatgcttcgaggtggaaactggaaatgagatattgagacaatgggacttaaaaatttgcttccaaaaagaatcaaaagcgactagattttgcattgcttacaaaattcacagcaaacatatagtatcttaattttacaaattctcttcaaaagtatatgtctttcatgaagacaacaaaaaaattgtcacatgcaaatttgggggcaaattgaaccgtcccatgatgcaagtgtagtagtgcacaattagccttgctcgtcttcagttcttcacaagtttcaggaccagttccagtttgataccggtgttacctatgatccttcagtaactgatgacgaactggaactatataagtaattccagaatggctaatttgtgttgaattcattgcatggttagtatgaactcgttgtgattaacatgaactgcattgtccagttgtgagctgagacttctgaatcatgtatcaatgttcagatcgagcccaatgttcatcccgttgtacgcaattggcgcatacatccacatttcatcggagctgaggagctgcaggattggacaaaatatgataagtggatcttgttacaggataatggatgatatgaactgaactgtattctgtagatgctcacct

SEQ ID NO: 72881 - DNA, 14240 bp, Oryza sativa
ttttttggatgcttaatttgggatactaatatttacaaattttaccatgttggttttaatttttctaatgcattgcacaatatgatgggattcactaaccaagctaaaatttatttgattgttgcagagctgttgtcagtcagttggttacaggatatcttcccagtgtcattcttcactttctttcctcttatgtgccctctataatgaagctgttttcaacaatgcaaggattcatctctgttagtgggattgagagaagtgcttgcaacaaaatgcttcggtttacaatatggagtgtgttctttgcaaatgttcttactggctcagtacttggtcaactcgagatattccttgatccgaaggaaatccctaaaaggcttgcagttgttgtaccagcacaggtacagcttgcatttattgttgcctttaaaactgcttagtgagtgaaaaagctctttgttttgtagatattactgtgggcatttcaatgtaaaatctgctttcttaaacaactgtctcttgtgtagtattgtattgatctcttcctcaaccgtgcattgctaaactgtcctttgtttatgctttgctctacaggcctctttctttattacatatgttgtgacatcttggacaagtatagcatcagaacttactcaaactgctgcccttttattccatttgtggggtagctgtgcaaaatgctgcaagagggatgagtccaaacctccatcaatgcattaccatagtgaaattcctcgggttctcctgtttggacttcttgggctcacatacttcattgtatccccacttatcctcccatttgtactggtttacttctgccttggctacttcatatatcgtaatcaggtgagagtgttgcagttcatttatcagtactttataattttctgttcttctactcatggagtctttatgctgtaatatacctggttggaatttggaaggacatattagtacctaaacctgttcgaaatttggatagggactgaccaatttgtttgacacttgcatagtaatttactgaacttggttttgcagactgccagacttggtacttaaaattcacttacaccacaaggtgtagatggaatcaggataacgtgggtccaactataaataactttttcttagaatgtttagcacataatcgtagtgttgtttcctgaaagatgatctagataatctagtgatgtaatttgtaacactcagtctgaaaggcatccaacagttcaagtgttataatgaggactttcttgtgtgcaatgattgcctggtagaacagtagaaattgctttcccgcaagtatttgtcttctttcacatcttgcaaataagattaagtttggttttttaatctcagtgagatataagagaacaaagaacgccctttatatgttcttaagaatttcgagaacttccacagttgatttcatgcgtttgcaacggtcacatcatctataataggtgttgtaaatacttcaggcgtcctatttatccatgcatttggaagctggtatcagtataccatgtattctggttacactggtcctgcaaagattaaacgatgtattatttgttatatgaaaaattgccaaatcaacaccatgcattctaaaagtggattgtttagctggataaatgtgccataccagagaaccatgacacagttaaagtgatatttttccatccatatagtagttaataaggcaccaataattctacattgcatcatagtaatactttaggcccctttagtccgaccaatctggaatttgcacgtgtttaactctgtaaagcattagtttatccgtgtacacttcttaactttgcatagtacaaatgcagctttttaatgtatattcacccaagtatgacactggtggaagattctggcccattgtgcacgggggaacaatattttctctggtgctgatgcatgttattgcaattggagtatttggattgaagaaacttccccttgcatcaagtttgctggtacctcttccagtgctgacccttctgttcaatgaatactgccggaacagatttttaccgatcttcgaagcatattctactgaggtaatgtgtttttcattttgtccaagggtgcaatgtaattctctttgtgcaactatgtatcaaaacgaacaacgcatcattctggtccttttagcttatcacttcgatagttcgattagatataatgtgtattcacgttctacctttcgtgctgcagtcattgataaagaaagacagagaagaagagagcaaaccagaaatggcagaattcttcagcaatcttgtaaatgcgtactgtgacccggcgatgaaacctatccaacactcctcgaattcagatgaacgcactacacctctattgtcttagatccagataagtaatagcttgcagccttactgtcatggcgtgaattttggtttgacaccgataatcaggcatacaacaatacacctgtgcttcttcttgtgatgttactgttgtaaagcattactacatacttgactgtggagttgttgtgcatatttgatttgtacatcttaatttgtgcttactgcgtagagatgaataatgcattgctccttaatgaagtgctgtcaatgcaaacctgtgtgggttgtacttctagatatgtcaaatcacctttatttgttcccttcaaattttgtgtatatggatgttcttttgcttcaacctattcagtaatgagattatttggcagttggaatgatgtgatattagtactgatacattattatcagtttatttgagttatacttgtcctttttttgtgcccctctgagactattatcatatacaatttgatgccaaaattcagttttctaaatacaaaaggtttcaaaccgtgttgaacagaacataatttgttagcctgtttcctatagtttgctatcacccaattaattatatgctgagattatttgacaagttcatactctacagtcactgtggttttgaaaatgtcatgctatccttggatttggagcatactgttctaatatataaatagacatccattttcttttgtccctttttgtgtatgattctcaacatgctactccaacaaagatttgcttgcatcagattgagcatatatatacatgatcacaaacaatgtgaatatgggccccaaaaaaaatcagtcaattaaagatcagcaatattgacgtattcctaatcgattgttctattatttggcttccatggaaaggaaatgttcatgtgattgcctgccacttggagagagaacagaggtgtagtgttgtggtaatctatcttaagcaagcctgtaattagactcgtactgaggcttaagtcaccattaacaaagattatgtgattaatgttccatttggctcccatgttgtctgttgtagtagattgttgaatgctgatgaatcctaatgtggcaagtagaaggccatgtcaatgtaagccataggccttaaaaaaaagggtaggagtaaaagccatagcatattgtgccatttgtcttgattgttcaaaggaaatcttatgtagaaacatgctatgatgctgataatattttcctattggcaagttgcatggacaaaatgatatcacattcataccaagttggtatccctgttagtagtttaatccttttactttgtcctaaagtctctgtcatttgtgcctcacaacttgtagacatctgctggattcttggtcacaaagcatgaaaaggcattgtgatgtgaacatgatgacatatctaattggaatgtagggtatattgttagaggtccttttctaatttgtatgtcctcagccaagacccatggaactctaatttgcaactgattgcagccttgaccttttcatataccctatgtaagaccattagctagacttgaccaagagactgtgaaggagatgatgatgagaggctaggtcaagcagtcaataacagcaatataagcacgtcatgtttgatctcacaaccattaaaaggaagagttagtgactaaatcatgtacatatacaaaaccgattacatgtttgataaaaaaaaatcatgccaaaataaaaaataaaaatatgttgttatagtagaactcgaaccatgcatgctactcaactctcatcgaggttttaccaaaatgaaaattacaagctaaaatttaccaaataaccactactatgaaacacgttttgcagatggccaaaacacgtttttacatgtggccgggcctacgaccaaaggcaagtgaaatatcgcgtaggattttgtgggggaaatagttgttttgtgagcaatattgtttcatgataagaacatatgtgttccatacttgtagcatttctgatcatttttatatgccgataatttttgttttgaattcaccaatgggaatgaactatcctttaaaagctggcagcagatggatacatgacatatatgaaaagaatatgaatggtatattctataccacgaactactttagtttgtaagatttttttacccattagaaaccagtgatagagttacaatcattggttgaagaaagggcgtgtaaagggacattggatagaccgtcatcgtcatccatgacaaacacaaaaggataacaagaaaaaaattatatcgaagctgtttagattactcagttcaactggggatgaagtaagaaagcatagaattaaccacactcgttgcagttacttccaacaagcaaatatcatacacaatttacagtacacctttgccttgagaatcgtgatatataatttggcaatatgtgcgtattttttatactccctctatcccataatataaggcgtggttaaagttggcaaggtctccaaaactaatcttttacttataatttctcatatagtataagatttgtagcaacaaaattataaccatatgaaagtaaatttaaatgtcaatctaatgatataatttttaataaataaaattcatttcatattatattaagtattggacaaatgttttaaatcttgaaatgtgtgcacgccttatattatgggatggagggagtatatgagtatttcatgtatgactttgtcttgtatgccgtacagcttagaggacaaaactaacatttacaaagtataaagtatgaatctgatgaattgttccatgatttttaatgagtgaaggggacatagttattgtggtgtatttggtgaaactctgaacccttagcttggcaaaaaaatggactaattaaccacagttaatctcgatttactatgttgatcaaatgcttcatgctaattaaattttattcacaattataatctcacctgctagctaagtagatctttgatacttgctctcatgctatgctttgtttgagaccttaatttcaatgaactttgcattaacaaaactaagctggatcactaattaacttccctagctttttggttgtccttggacgacgttataatccaagttatgtgcattgccagtaataaaattaatggtgcaagttgcatagaatgtacaatgaaaacatactactagctatgtagctatagttgatcaattcaatcccataattcaccaaatataatataagccaagcttgcatcactctaaaaaggttcttgatttagcacgcaagacatgggctaatcgccaaaaggtgatatctggatgtcccggacctagtcaacaaggcaatgcaagtatgaactgggcaaggtccttttcatggttttttttaccctttgttcattgtcttacttctatgagaatgacgactacaaaattaatgtgagaaaatgatttacatcatagacagtacataatttgtttgatgtgtgacttggactatatatttataattcattgtagtttatgtgggtccatgtgtcgagtatgtgcgtacttatgtgagaaaccaatagcttaaatgtacacgcgattgtaaaaatcgcttaccatgttgcatatattaatttcttggcctttaggatcacatataatttggtgtggtggttccaatttgcatgttataaatttgatatgcggatgatcaaaagcccttgcaagaaaaaaccgcaaacattaaccaatcgcggagtgtctgtaaatgcatgggaactatattataataaggcaacaactcttctggtgcggtttacgaaataacaaagaggtagaatgacttagagttgtaatagaaaagtattcaacaatatggcacagtccatctctatgggcactccactccactcctactgttataatccaacatatattaattgttatagattgaaaatcatgtttctctagtatgatatgtgtcttcccaacaattttcttgagaaaaaaaaacataactttgaatgctgattacagatggggagtatagagcgtgagctgcaaattgatcgttctcttttgcctaactatatatacaatgtatggaaaccacaaaagtcttagcatataaaaagtgaggtaacaatgtctgcactactgcaatctcaatgtcatgtccacctgtcaatgactaggcctacacaaccttacactcatatcattagctaagcaataacatcaactgaattaactaagtatccaatctctctcactagattaccttgtccccctccacaatctatatgttcatcacaaacttaaaccacatctcaatccatcatcatcaacaacaacataagcacaatagattatatatacatgcatgcaatgattttccaaaacaatactaataatttggtctaataataatgatactacccatattctttacttgacatcctaaaatctccgccgtcaaactttctagagtttaactacaactataatacattactagttagcaaattaagggtctgttcagattgtagccaaaataaaccttaccaaattttggcaagatagcaatattgtcaaaattttagcaggatttcttatgtatttaccaaatttggcaacaaactaaacgtagacatttttttggcaactttaccaaaaaaatggtatggttgaaaatggcatcaaagtgaacatgccctaaatacttccgcttggccgttacacaactcttgacgttttggacaatgttaagatcaaacttttatatctttgcctctaaacaattctaaaactgtttaaaggtactggaacaaaatatatgtaaatttttcttacaaaatattataataaaagtaaaagtttgtttttatttatttattgtatataatatagtgaaaaaacatagtcacagatataatcatttcatttttaatataaaattacaaaatgtaagtctaattgtcatctcaatgactgcaaaatactaaagaaaaaataattaatcaaaacttatgcacaagcggttgcactttcaataggtttttattactaaagctagggatttatcactggactccatctcttcgagcatgtgtcatgaacgtatttgcaggtgtgagtgtaatgtgcatacatgatggtgtagacgtatgcgtattctgacagggaaaaaaactacaaaggtagtatacacaacctctctcctaaaatgtacgatgtcgttaacttttcgcatactatttaaccattcgtcttattaaaaaaactacatcaatattatttatttatttgttgtgaccatcaaataaattataatcttaacctatatttttatatatctatactaatttttttaataacacgaatggtcgaacgttatgtgaaaagtcaacgtcgtcgtacattctgaaatggagatagtactcgttagctaacttagcagttagcacaacataattatcagcttgtgaaagcttctccaccatctccatgtccccccttatatatactcctcgatgatcgccatggccttccacctccaacctcactcactcactcaagccaagctagcaatcgatcgatcgagctcaatgcctccatccatggcgacggcgagggtggcgtcaccgtccacggacaggaagcgcaaggccagcagcgaggacgacatagacgccgccgccgccgccgccgctctcacctcgccgctggcgccggcgagggggaggaagcggttcgtcggcgtgcggcagcggccgtcggggaggtgggtggcggagatcaaggacaccatccagaagatccgcgtgtggctcggcaccttcgacaccgccgaggaggccgcccgcgcctacgacgaggccgcctgcctcctccgcggcgccaacacccgcaccaacttttggccccgcccctcgccgccgcccgccgccgtcgcgccaccggagacgacgacgacgccggcgctgccgtccaaggtcaccaacttgctactgctccgcctcaaggctcgcaaccagcaggtcgtcgacgccggcgccgcggcgccgcaagaagccgctctgttgcagctgcagcagcagacgccggcgtcgtgccaggaggtgttcgtccgtagccacggcgaggagtacggcttccacgtcgacgacttcctcagcgacgcgtgcagcaacgagcagtactccggcgacagctcgctgggattggacgacgacgacggcgaggtggaagacgaggaggaggaggagctcgacttccagttcatggacgtcgcgcccggggcgtcgtcggcggcggcggaggcggggctaggcggcgagggcgcgctgtgctcgccgttcgagatggtcgccgcggagctcggcggcgcggtggacgtggccgcgcacgacgcgatgaggcagatggactacgagaggaagatctccgcgtcgctctacgcgctcaccggcgtctccgagtgcctccggatccgcgccgccgccggcgccaccgccgctgcgcgggaccacctcaccggcctgagagaggcttgccggaagaagcagaaattcgccgccgccgcggcggcgccgccacagcagcaagaaccatctcctcctccacagcagcctgagacgccggcgagctcaggcggcggcatgtcggagacggcgagcggcggcggcggcgacggcgacgtgctgatgtggagctcactggacttggctccgatttgccacatggcatagttattattagtagtaaacaccatacttaattagggctgtggaatttcttggtgatgacatgcatgcatggctgatggctcagacgagagctctggaaattattagctttgcttagctttgccccaattgttttgttcaacagcaaaaaataaagtttagttatcctctctgatcatctcatataaaccacaaattatagataatgaagtgtttgatgtgtttgttcatgattttcagatgagcactgtccctgtatacattgcagtttctcctctttcccttgatgttattttttttttcttttgtgatttgtattcagttgaattggtcatcaggtgtcaaatataatactactcccttcgtttttttaatatacgacgctattgacatttggcacgacgtttgactatttatcttattattttataaaaaaatataaatatcatttgttttgttgtgacttattttattatcaaagaaactagccttagcttatattttatatatttacactaaatttttaaataagacatacataaacgttatgcgaaaaatcaacggcgtcatataaaaaacgaggtagtactagacatgaactgtgatattctttgtattcatgacagtggatgatccactgataaaatggagccaaggaactccttaattagtccacttgactacatgagaagagctgaccaatatctgctgatattttttatcagtttaaattccaagtatagcacaggccttcatttgaaaagaaaaaaaagaaggcatataaaaaacatgaggcataacaaactgaaacattgacaggacaactaagcaaatccaaacggtagataaagccaaacaaagtcatcaatctatcatttttgtggtttgtagtctgtactgtacatgatgcacctctatgtaagtaatacagagaaaaggaaactcaagcaaaactcgcactttaaacggatgccgcatgcaagacccagtaattggccagttagcttcatagtcaccatatcatgtgaaacttgttagtgtttcagacagttaagaggagactccttagcttgtcaagctcatgttgctgacaaaattgggcgaactgcatcggtgaaatcttcatggaacctatgctcagaaaatctttgagcgcgttttcgtgctgctgttgccatctcatgcctctctgcctccggcatccgcaagaccttgacaattgcctcggcatattcttccttctcggaggctagaaatcctgtctgttggccatcctcatctagcacaatgtccatcattggtcctgccgatttatgggctgcagaaagcatggaacattatggctttgtttacaaatcaatggaatgacttatgacccaggcattttggttggtggcatcagaaaattcaacttctacttatgtatttcagtggcgtttgcttcatgccttaagaaattcatcctgcccttggtattgaacccctctgaccccccccccccccaacgcgcgcacacacacccaaagcacaaaaaagctaataataacaacaataatatgaaatacggaatgcagtcatatttggacttattcaaaccattgttatgtgcgtaccagacgaactagaggcacttatcctgtataccattagcagtcttggaaaatggtattaatccaaattttaccaagtcaataggcccagataggccattcttgacgaaaataaagtgctatgaactgaaaagatggatagggcaatctggaagttacttaccaattggaatagcaccagcagccatgtattcaacaacacttatcccaaaatgctcatctgtcattgaatggagcccagcaacagcaccacctagaagctgtaccaagtccctgatatatccatatgaatatcctgtaagtttactgaaagaacctgcatggtgagaatttcttagtgctaggttgaccacactacctgtaagagatatccttgtggaactccacaagctcatctatgtgtagttcagtggatctgtctttaagcttttgcaatctttccagatcctctttattccgacagcttccaacaaattgaagctttggcttaggaaattctggacttagctttttaagagcaattgcaaatgcctcaagctgaagtccatgggcctgggagaaataaatgggtacacataatttttctggaatgagtgaacagtaagctcttgcgctaagaatttgatccagttatagtaagttggcataccttttctggccgaaactgtgcaactgatataagaataggaggtgtagttgatctttccagtggaagcatctgttttatgcaacaagtgtttctgatgagtaccaatttaatcatcttcatttgattaaaaaaataatgcagtagtaatttatatcaatgccttgcttggttagtgtgtccacatggctatgagatagagctaattaggattgacaaccaacagtttagaaatatagatgtctagaatttggatatacctgcagggcagaagtatcacatggagggtataccctcctagtacgctctggtatcctccaaatattttcaatatgggatcttgtccacgatgaatttaccatcacaagatgtgcgcatgaaccgaccagaccatataaccaactgaatatgctatagtagaggattttgcatcgggacaaccatatgctgcatccaaaagaatactctgttattctttgcagctgagaccattgtatacaatattaatagatcatatgtaaggcacagagaaaagagaacatatggcatatgaaaagcacttttaggttgccatgatcaagttgggttgaccaatgattaggtacaaagaaagaagtttacataaatatataatctgttaatgcatgatcatgttcatcttgatatatctaataagagaggactgaacaagtcatatgttaaaaacataaatgatagatgaagaatgagaaaaagggatgactatgacctatatgattctgatccctaagaaacaagaatgcacccatgaattaaacatatcgattctccaataagaagaattagagttactctgtgaagtgcccaccttccagcaatacgagagtcgttattgtacatagaactgcgttgcttaacacgttcaaccatgtcagaactgattgtcggataatgagtgtagcagatgaccttacagccaaatagccgagccagtggatatgtaaaagcatagccgctcgtatcaaaatagaactgcggggtgaatttgttaagagcttcccatgcaagataaactgagccaagactttgcccaatcatcgtgaagtggggatacgtgcttgcttcaatccactttctcctattcaagtgaacaacctgaaaatgaagcccagacattttttatgctagtgcgccataatgtatctgattatgctaagagaaaacaccagataatgctttattttatctataaaagatagtactcaactttgatctccaaatatagatcagacaactcctttaaaattaaaattcgtcatcatttttgctcccttttactgtgtttttagcctataaaccaccaaggattctgactaggaagacaatcgtattctcctattaccagtgttagccttcagctacccgtccgaattgtataaaatcaacgaaatcttgtaataatggcattatttctttcatatatgggaacagagcatctctgagactacgtttctgagatcatcaagcaattccaccaaccagtgactagtgagatcccaccgaatttcaccctaacttaaatgaactatatcagaccaaatatttacaagaacaacttaataaacttctcagaatatccatcatttgagttaaaaaaaactaatttgcagaaagacgagcagctaggactgagatccagttttcaggaaggaaggggcacatctttctgaaggcccgatcgatcgggggacacaggaaggaaggaattgaaaccgaacctgcggcgggcggaggaggcggaccccgaagcggtcgagcgcgcgggcggcgaggccgtcgggggaggcgtcggcgtcgccggtgaagacggcgcaggggaggcccgggcggagctcctgcgcggcgcgcaccgcgcaccagagcacccgctccccgccgccgccgtcgttggtgtacgggtggaagaaccccgcggcgggcgcggggtgggggtggcggcggatgcggcggaaggcggcggcgaggagcgcggcgaggagggcggcgaggccggcgaggaaagccatggatggattttgcgacgcagatggtggggtttgggttttttgggtttttgggtaagtgggttgatgggttcggcccattgggccgagttatgggcctaggcgactgtagcatggggtgccttctgttgggaaaaagtacaccaaatgtccctcaacttgttatcgggatacgaaaacgtcctcgaaccgcaaaccacgggtcccttaactatacaaaaccggtcacaataggtccctcggcggttttgatcccggttttgtcctacatggctgctgagtcagcgtgggatccacgtgtgccctacatgtcatcgtgccatgtcagcctaccctctctttccccctcttctcatctctctcatctctctcttctctcagggcagcgaggaaaggagcggaggccatgccggtgtcgcacggcctctcgcggccatcctctcacaccgccagcgccgccggggaaggagctgagcgcggccgtcggggacggagcagggcgcggctgacgggagtggagcagtgcacggccggcggggtggagcttggcgcgtgcggcagccgccggggaaggaggtgggcggcggcagcggcggcggggaagggtaggcgcgggaggccgtcgccgcggttctcgccctctcccctcccccacgtctcggggtcgaagaggcccgagaggtgggagaaagaggaggacgtcggcatcggcgggggcaacgtcgttggagaaggggagggcgtcgccgcgcgggcgagctcgagggcgtcgatggcgatgtcgtggccgtggttgagcttgacggcgtg

SEQ ID NO: 72882 - DNA, 1992 bp, Oryza sativa
atccgcgcgcagccttgtgaacacgtctctaagaggttgagctgatatgagttttgatgaaatcatatgcttttataattaaatatacaagcaccatcgttaagtttataacttacacgtgaatatattgtactataagaaacctaaccaactgaaatatataatcttgtgattgcacttgatcgtttgtgtttccaacaaagatgagttttatgtgtaagggtgtgcttccttcaagacattatatgctttattgaggatttgagattgtgtagcacaaccctccatttcaatttgatcatcccctaaacaaatgacactaagaccaaggaaaacaaaatatttattaatctcaaattaatcctcattggttaagctcattggttaaggtgattcatcgcttcgtatcatgtgaattgctcatgttttaagtatcgtatgccattgcactaatagaaattaatcttggttggttgtatgcaacacattaaatgatgcatatttaatctttgcacaaataaacaaagaaacacttgttagacgataatcatttttaggaaaacctcaaaacccttaagggatgatcaaaatatgatggagggagtagtgaacagaggaatacaacattgtgctttatttctacgcaacctcaaaaaaattcttacggaaaaggttgtaggtgcaaatatgcttgtgttttaaataaacttttacaattatgtatgtacggcacaattatcttggggtgatatgtatatgtaggtgtcgtacctatctacatcaaagcatctatggactacggtgacttcactaatcttaaaatactccaaaatataatagattatggttagatgagatatatactaatactacaaatattgacaggaagctgtttagatttatagtattaagatgacggaggaagtatgttggtcggtgtacatgtgtgtgtttataaagacgcctgtttgtgggtgcatggtatgttgtgtgtttccgaaagagagtacttgtaggtatacaatattgatatgtatctcttcatcctctccccatcgtcctcgatgaaaatatctatttcatcgtgagatgagtcacaaaaagttccataaaaggtgattttcagaagaggatgacagtatgacttaaaagaccttgacttaatcattcgtttcatcgagagagaagaatattgaaactagaaaactcattaccagatgattaaataaatattaattattataaacttaaaagttaatatatttagttttttaaaagacaatttttatatattattttacgaataaatatacagtatagcagtttgaaacagaaaatgagaaagttaaagcatttaggctgcgttcgggaggagggcacgtaaaacgaaatacgtattattgcatgagtaattaagttttagctttttataaaataggttaatatgatttttaaaataatttttatatagattttttttaataaaaaatacacggtctggcagtttcaaaaacgagaaagctgagttagaaaactgagaaataacacaggcaggcttaaccctgacggaagatgcccccgtttgcacgaggacaaaccaagacccgctccggctcctctcaatccagcctcccccccctccacccacaaacggctataactagtcgcttccaattatcccaccctctcgcccttctcgcaccgaacccaaccccaacaacactcttccgctcccaccccccgcacactccccgtatttcggaacacgtccccgacggcccgactgccgcacgcggcgaggaggccgcggtaattacgggcttagtccgagggggagaacgcaaaaagaccaggagaagacgaccagggagcgcacgcgcaccgcctcccccccacctcgccgccggcgaggtctcccgccgccgcctgccattgggagacgtgggctggagagaggcgggagcatctcgtcagccgattcccgttcccccc

SEQ ID NO: 72883 - DNA, 1823 bp, Oryza sativa
aatatccaaaaccaaaaggggaagcagccgttgacgactccggtttcagggaaacaaacaaagaaacgaacacaagaactgcaacttgatatgcgccgcaagagggattgataattgattgattgattggcctgataatccagctgccgaccgcctgaaagacctgtttaattctgattttccctgatttttttaaaaaattacgtacaaacacaaatttcactcaccgctatatacgcatgcacgcacatcctacccttataagcgtctccgaaagactgagctgacatatcttaagattgtcgaaatcaccacagacgtattgttgtctatgcgcacacttattcctataatcgatcccccatgcacgtacacattacctattacctcgatgtataccttcgaaagactggatcaacatatcttgagattgatgaagtcatcacatatgggcgtcttgttattaatgggtacgttgtctattattgaaaaaaataactatccataaattcgagcacatgtatcaagtttaggacgttaaacgtggatggacatattctaccacaagtaatctaccagttaagctatgctcacttcgatgtctgttccttgatttattggcatgtttaattatcttaatcttgtaatgggggacatgatctcatgagagcaagtttaatagtatagtcaactacgggctccaaatcatatatagctaatctaatagcctattcatacaatagttagctataaaaatatactacatcattaatacccggtcccacctctcatacacatataatgttttggagtccgtgttacagttggttataaatctgtagctcgctttcttctgtcttcttttttcttcttgatatatggttatagctggtttatagcctgctattgtacctgctctgaggctttgccaatttaactgcatgtatagctatgcatagttcctttggaggatctagcacttttttggcattgctacatgcttagttactttcaagtctataaagtatttatttccttaacaatgaaaagtttgcatggttagtaaacaactaacagcacatggtttgccatgattcagacacaactgtctttatatattatccaaatgagaaaaaaataaacggaggagagaaacccagaaacataaagcgtggagtacatggaccagaatactacctccttccctaaatgtttgacgccgttgacttttttaaacatgtttgaccgttcgtcttattcaaaaacttttgtgaaatatgtaaaactatatgtatacataaaagtatatttaacaatgaattaaatggtaggaaaagaattaataattgcttaaattttttgaataagacgaacggtcaaacatattttaaaaagtcaacggtgtcaaatatttagggatggagggagtatagaattgaaagcgtctcgccgagagatctcattgtcagttacatctcataaatatgctcctcaatcctcatcatcgttcatactcgaatccaacctagctagacagatagacagaaagacaggcaagctcattagtgtatagttttggactgccgatcatacgccttttccttgagaaagcaaaaaaaaagcgtatatttgttttcgataatgtagctaacaagtgctgaaatttcccacgaacatagcacggcaccacctaggacgcgattgaacgaaaatggatcatctacaacaccgtacaatacttcttacggttggcaatttttttttcacacacaatataaacgctcgtatatggattaggatcctctaacataaaggtagaggga

SEQ ID NO: 72884 - DNA, 9756 bp, Oryza sativa
acaggaagcagcaagcctgagagggaaccatgttatagaatggcagaatattttgtcagtcactcttgatcactctagcaacagtcagaaagagtagtatgaatagtgatgtatgaattaaataaaggatgattatgttaccatggaaggataatactatggacaatgtaattaagcaacaaagcaggcaatattgtatccatgaaaagatatgtttacatttgagagctatctaatactgttgcctatcaacttgtctttcagatatttttacaaggaatctagtgtttttcaacttgttgcagatcaaggcgtgcaagtgaacttaatttgtttccttgtttgcatagtttttcacctatggatttattaaaaagagataattgcttatttgacgctcttttgtgttggaaatatagtcattaattggcatgttttaatccaaaaagttaaagcaataatcatggacaatcaaaacaaagacttttctaaactggacagtgggagtacatgtataagtgcaagtagatgtacctgtattttgtgtgccatagatcagtacgtagaaaacaaacccaacccagccgtacgttcttcaacatgcgatctgcttaccatctgatgcctctgctagccatgctactcatcctcgtccttgctgaccatacaagctccacggaagcagtagcaccggctgcgtgcctcccagaccaggcagcggcgctgctccagctgaaacgctccttcaacgccaccatcggtgactactctgccgccttccggtcatgggttgccgttgccggcgcagactgttgcagctgggacggcgtccggtgcggcggcgccggcggccgtgtcacctcgctcgacctgagccaccgtgatttgcaagccgcctcaggtcttgacgacgcactcttcagcctaacctcgctagaataccttgacctctcttccaacgacttcggcaagtcccagatgccagccacagggttcgagaagctcaccgggctcacccatcttgacctctccaacacaaacttcgccggcctggtacctgccggcatcggccgcctcaccagactctcctaccttgacctgtcgacaacattttttgtagaggagttggacgacgagtacagcatcacgtactactactcggacacaatggcacagctctcggagtcgagcttggagaccttgctcgcaaacctcaccaacctggaggagcttcgcctgggcatggtggtggtgaagaacatgtcgagcaacggcactgcacggtggtgcgacgccatggccaggtcctccccgaagctgagggtcattagcatgccgtactgctcactctccggtcccatttgccactcactctcagccttgcgatcacttgcagtgatagagctgcactacaatcatttatctggtccagttcctgggttcttggctactctctccaacctaagtgtccttcagctttcaaacaacaagtttgagggatggttccctcccatcatcttccagcacgagaaattaacaactattaacctcaccaaaaatcttggaatctccggaaatttgcctaatttctcaggtgagagtgtcttacagagtatatctgtcagcaacaccaacttctccggcacaattccaagttctatcagcaacctcaaatctctgaagaagttggctcttggagctagtggtttctctggagtgctgccatcctccatcggtaagatgaaatccttatctttactagaggtgtctgggttagatctagtaggatccataccatcatggatctcaaacctgacttctcttaatgttctcaagttcttcacttgtggattgtctggacccataccatcgtccatagggtacttaacaaaattgacaaaattggcactgtacaattgccagttttcaggcgagataccttcactgatcttaaatttgactaaattggaaaccctcctgctccattcaaacagttttgtcgggatagtggaactaacctcatactcaaaactgcaaaacctgtatgtcctgaatctttcaaacaataaactaattgtgatagatggagaaaataattcttctctagtgtcatatcccagtattagcttcttacgtctcgcatcttgcagcatatctagctttcctaacatcttgaggcatctcccttatattactagtcttgacctttcatataaccagatccaaggtgcaatacctcagtggacatgggagacatggacgatgaactttttcttgttgaacctatcacataataactttacgagtattggatccaatcctttacttcccctttacattgaatactttgatctcagtttcaacaattttgatggagcaataccagtaccacaacaaggaagtatcacacttgattactcaaccaaccgattctcatctatgcctatgcctcttaatttctctacttaccttatgaatacagtaattttcaaggtctccagaaatagcctctctggatacattccaccaacgatttgtgatgcaattaagagtttacaaattattgatctctcttataacaacttgactggatcaataccatcatgtctgatggaggatgtaggtgcactacaagtcttaaatctaaaaggaaataagcttgatggcgagttgcctgataatatcaaagaaggttgtgcattaagtgcattggattttagcgacaatctgattcaaggacagctacccagatctctagttgcttgcaggaatctggagatccttgacattggaaacaatcagattagtgattccttcccttgttggatgagtaaacttcctgtgcttcgagtcctggtcctccagtctaacaagttcattgggcaggtactggatccttcatatactagatacgggaataactgtcaatttacaagtttgcggattgccgacatagcctcaaacaacttcagtggcacgttgccagaagagtggtttaagatgcttaggtctatgatgtccagctctgataatggaacttcagtcatggaacatctctatccccgggagagggtacaagtttactgttgcagtcacatacaaaggcagtcacatgacattttccaagattttaacgtcacttgtactcatcgatgtctcaaacaataaattccatggtaacatccctgccggcattgaagaaacttgtgttacttcatgggctcaacatgtctcataacgtccttacaggaccaattcccactcaatttggcaaattagacaaccttgagacattagacctctcctcgaataagctttctggtgagatcccgcaggagctggcatcattgaacttcctttcaatattgaatttgtcttataatatgttggatggaaaaataccacaatcattacacttctccacattttccaatgactcttttgtggggaatattgggttgtgtggacctccgttgtctaaacaatgcggttatccaactgaaccaaacatgatgtcacacactgctgagaagaattccatagatgttctactctttctcttcacagcattggggtttggtatctgtttcggaattacaattctagtgatatggggaggccacaacaggaaacaaccttgtgagagagcaattttatacattggcagaatagtttggtagtgactcttggtcaacccagcaacatttagtaaactaatattaataatgaggcatgtatgagctaaataaagaagtgatatgttatcactgatatgtggttgttctaatttaagcaacaaagcagacagcattgtatgcatgaaaaagataattatgtctgagagctatgtagttctcaattgcagcatatttcacggcctccaagcacgcttagtatgacaagtgggctgcctagtcaaaaacctcagggtctaatggagttgcaattctctgataattccattcgttattgttgtagctaagtgaaatgtgtcgctaatgttgtagcaagatgatagttgtcattaaaattgcagctttttcaaacttattctttacaggtttcatattttgtatatgctgagctaacaaaaaaagtcacactgcagttcattagtttgggcaaataccctcacacgttctaggccatccgaactttacatatgtggtgtcattattttgaaataatgaatatagaaaaaggcataactactttttccttaaaagaaataaatcatgcagatggctcagtcccttcaacacgatcgttatattgaccatctgaggtaagacacaaactatttgtacatctacaaggttatatggttattaatgtaggagaacagtacctcttcggctctgtcatttcgtcgaacggttggcgggcgaaatcaatcaatgttgcagactacctttacacgcaccgaactaatcacggattcttctctaataaaactaattacatattctgatgctggaagatttctagtcacggggttaattactgcgatcgaactctaactgggattgcatacgaggaagaggaaaaatctggcggaaggcagcaagcaaaaggaattgaggattacctgaatggaaaaatcgctgccggaataccggagacaattcgtcgaggaggagacaaaagaagcgaagtcccgccggccgccgccgccgccgccaccgccaccgccggtcgccgccgccgctggcgttgcgtgtctgctcggttgaaattagttaggctggcacctgtaacgtgcatccaccgcccaagttttagatccaacggttcatgatctgtcacccgaatcaacgttaccaaacaattttgccaatgctatcttatcaaaactttggtagtttcgaaatttttatttcacaaaaataatattaaaatttgaaattgcaacaaactatacacatccagcgctaccaaaaaatggcaacgccaaaattgatttattaagaagttttccattttatattgtgctaaaatataaggatttctaccatccacagtactacttttctcatcaatcaccttatctctttttttctataaagctaatgcctactaaacacctaaatctcaacatacaacatactccctctatcccataatataagacatggtcaaagttgacatggtctccaaaactaatttttagcttataatttttcatatactaccaagtttataacaacaaaattataaccatatgaaagtaaatttaaatctcaatctaatgatataaattttaataaacaaaattcattttatattatactaagtgttggtaaaatgttttagaggttgaatattgaaatatgtgcacgtcttatattataggatggagggagtagtatttattagcattcctaaaatcaacatacgagcatgccacatcaacccactaagcacacaaagtttaacatacaagcaaacataatctacaacttatttaattctaaaactaaacatacacatgctaaatcatcattatcaaattattttcacaatatttcaatccaaaatcatttaatcatttctacaatatctcacatatatcccgcggcagagcacggttaatcatctaatatttaaaattcttctcattttatctctacctaccttcctacccccacatatctcttattaagggatattagagccttttcaaccttcatccatgctctttatattttaaaacaaactgacgtggttacatccatcgtatatccttgggatctgtccagatcggtgctattttaaaccatatattattgtttggtagaattataaatatataaaggcatttagtttgttatcaaatacgctgtccagattcgtagtattagaatacgtcacatcgacccaaaatcccttataatatgggacggatggagtattggtcagtctagagaatttaacaaatcacatttagtctattgtactaaaatttaataatgttggtaatttatcaaaattttggcaatgccaaattttaaaaagatgaaaatatctataaactgaactttcatccactgagaacacgctttcactataggaatatccgaagaattttcagggagatgccaaccgtctcccctttctacaaacacgagacgctttcactagcttttcaatatttgtcacatcaacaagtgtgaacacttagaatatgtaacaataaaccgtggtatcttctggagaatagtaacaaaatcgtttgcctctggagtcaagggctcaaggctgtaacatcgaagtgcttgtcaagaaagaaaaataaaccatagcactgatgatgatgagggcgacggatcggagaccacagctgccggcggatatacgagtgggcgctagaaccctgctccaagacccgaatattcatcgaaattatacttcaaaattttaagaaatagaacataaaatataaattttacgtagattatactatttaaactttagtcttgacaaaattctagctccgctgcacgcgcatgtcctcctccgtatccaactcaatatatgctatggtgcccactacagcatcgttaagtcgctatatatgcttcctatcttattaattttcttgtcagtatagtcgaataaagtattattttttatatgttgtatctaagacactactaaaaaatcctcatagggatcagtcttataggtgccggttcctttaaaaccgatacctataggccttttctcacctccacacgtggaaaaaaaaagaaccggcacctttaagacactataggtgcaggttcattagtaaaaagcggtaccaatactatatgtgtcagttttttaaaagaaccgacacatatgatatattataggtgccggtttattaaaaaaccgacatgtataatatgttataggtgccggttattttaccggcacctatacaaaacgacccgagcagacgagccgagcgccgtatgtcatccttatctactgccacccacgtcgtcgtgtccttatccacttgctctcgcaactcctctccctctcgcgtctctctgactctctccctctcgcgtctctctaaagacggagactacccggcggtggcggcggcctcccgaggcgggcggatgcccggcggaagcagcggctgcggcgccctcccctccgcccgatctagcgggaggggaggtggcggtctcccgcagctgtccggcggtggcggcgtgctcccgaggccagcggctgcccggaggtggtggtggctgccgcaccctcccctctgccagatccggtggaaggggaggcggcagtctcccgcggcccgacaaaggcggcagcggcagcggcgctcctccaccaccgccatcccggtgacccaagggcctcatagccgccgcatcatcctcaaggccgctgtggttcgagtgtgttcttttctctcaagttctcttgttcatatgtgtaccgagaatatgcggatttggatcggatgaatattatagttaaatggatgtaggaattgttgttgttattgacgtgttccttggattttgattttcgatgtgtggatattgttctgggatgtggaggggatcacgggatgtggaggttttttttttttttggctcgtgcagacgtaaaggtgccggttctattttacctattggtgccggtgctagcaataggtgccgaccaattggagccggacgggaaaccggtacctattgccagttcccaaccggcgccaataggttttttttactagcgacataatcagaccaatggaagttatttccgtggttattttcggttgttgccaatacaatacagaatcctctttgatcattattacgtgatatttatgataaaatctaataaaactttagaagcattaaccataatatattcgaattttaaaacaagaaaaatggtatggataaatttgctttgcaaaatacaatcataatatcataaagttttatagattttgtatttttattttaatataaattgatggtcaaagatttaaaagtttagccgaatattatttcaaacatcaaatatttatcaccggatatagtaccgactcataatattcttattgtctaggtctctctaacttgaggaagatcctcaccacagatacagaggtgcgcatcctatatatataccacaagaaaaaaaaatgaaggctaacctcaacttcatttggcagataaaaggaaaaataagtgcttagtaaacactgacaacatcaatgaagttgaggtttactccctccgtttcatattataagtcgctttgactctcttcctagtcaatttatttaaagtttacctaagcttataaaaaacataataacatttccaacataagacatatatatatatatattaccaaaatatattcaatgttatattaataaaattaatttagggttatagatgttgctaaattttatagaaatttagtcttaaaagaagtttgattaggaataaaataaaaatgacttataatatgaaacagatggatagattagttaatttcaaaattttgcatgcacatagagcgagttcacacccctacatccattagagcattgtaaatttctaggcctaatgaaaatatatgaaatttgcaaaacttctactatcatttttttttcatatcagtactagtatcatttaatttgacatgatatatatgacccaatataaaacgctgcagctctggttatggccctcactccgtcgagactcgaggcaaatcatgggaaaatcatgggcttaaagtgaattaaagtgattaaatccggtgaattaagtgaaattgaaagggaaatcatgggaaaaatgatgagagagtagtagggaatcgatttctataatcatttataggagggaatacataacgaggtatatcaacgtggcggcagtgctaaggctcagcccagagacaaaacaaaacaggcagataaacaaatcccttatcgcctgcgagaaaacgtaacataaaaaatagcgacgacagaaaaagatgaaaaaaaatggagaaaaagcaaaaaaattggaccgaagaaaagaaaattatagtggatggaaaaaaaaaggcgacgaaaaaatgtggacggtgaaaaatagaaaaaatggcgaaaaaaaggtggacgaaaaaagggaaaaagcgtacaaaataaagaaaaatggtgaaaaagggacggaaaaaaagaaaaaaaaaggacagacgaaaaaacctgaagccatacttattttttttattaggtatatgacggagctcgtggctcctcaccgggagaccgcgcaggcccccctttgccggttcggccgggggcttagggtgcaatctcaagctctctctgtatgtggaaagattactcgccggcaagacacacgagacacggcgatgtatacaggttcgggccgctgccaagcgtaataccctactcctgtgtttttgtggatttgtgtatgaatgagctacaaagtgtcagcccccttctcccctgttctaagctcttaatctcgaaaagaatcaacccacctttctatgggcaaggtcctccttttatacttcaaggggataccacatgcacccttctctttccaaactggactgttcttttctttatggacggagatcggtatggttgctgtccaaacgacacttcgatgggacagcttacacctaccttcactcccggcggagacgggcgcaacgtgagatcgtggctgcccgttgctgatgcgacca

SEQ ID NO: 72885 - DNA, 4746 bp, Oryza sativa
cgcgcgtgtcccggtcacggatcgccccggcctccagcttgaaccgtgacggcatgcgccgtcccgggcctcccactcccgcgcggcgcgtgcccgaggaagagacgccgccgccgccgccgtcgtcgtccgccccttgcgccgccgccgacgccaccgcgcgcgggttgcccgactgcgcgtgccacgcctgcgccaccgccttgagcagctccacgtcgtcctcgccgcccgccgccgccgagcccttcatgcccgccgccccgcgcgcgcgcgcgcgtcagcctctcgtttgcgctcgcatggatgtcccacttggcgcgttcttttcggattagtgtacgccgtttggcttattcaagattgagccggaacaagcacaacatatttgcaaataaaaaataatttattaataaaatttttatgcatgtattctaaataattttaaagcaaaatctgaaaaataaactacgatgaaaaaaatcccaaaattaacttaaattttaaggttgaaaattcaaattttagcttataagtataagcgaaaaaataggatgtattaggtttttggctaattagtcgcacgttaaacgagaaatatatttagtactccattcgtcttaaaatataagaagttctataattagacacggttattaagaaaataggtagaaatgagtagtgaagggttgtgattgaataagtagtggatgtatgtgagaaatgtgaatggtaaagggttgtgattggttgaaaatagaatgttggtggagatgctgttatattttaggacaaatcctgagtgctaaaagtttattttgggacggagggagtatatgattagttaaataataattattaatttttttaaaaatcgatttaattaattttgtaagcactttttttacaggacatacagtttaactgtttaaaagacgtgttaacaaaaatgaggagtaactaaccttaattagcactttagaacgcgggttgattttgacaaaaagaaaagtcagtaatccgctacaaaaattgtactacttccgttgatgcctgtgagaaaagcgtttttttgagtaaactctgacgaaacacaagaaaaggttcagagttgaaaacacaatcatgtgtaggtccacggtttttcagccatcggaggtggtgtgtgcacacactccacaaacagtggtaatggccactcactgtctctgctgctgacatgaacaccccagattcaagccacagaaatggaagatgctatggggatattccgaagctccaagtgactgtcaagtgtagactctgatgagcttttgttgcagaacctgcatccatggtccgtctaatgtctgctgctagtggctagataatcaaagttttgagaaatttcactattcgatatccaatttgcagtcatttcagtttccctgttctgtcatgcatggtgcaagtaaattcttgtgcagaaaaaaaaaagcagccaaacatttcctggcgaggaacaaaccagaccaaagaagaagagaaagatcaggcttctgaagaagtgatatttctggatactgtgatcagcactataaaaaacgctttggattgctacagaattggatatctgacacgcggcgaattgccatcctttaagtcatgtcaattgccatcaaatctttcttggtcagtcgagatggatctgcttcaaggtgtcctgggagataggcaaactggtggtagctcagccaaacatacacacatgtggtttggcattggcaaccggtggaggatgagcacatgatggcgaccactgcgtccatcacatttgagatattcagatcctagctagacgaattatccgtgcctttgtctcaagtcaaattgctctgctaatctgcttcttccaagtcgtcgtctcgtctctctcccggtggtctgaacttctgtccgctgcaccacacacacacacacacccggagaaaatcttgatttgcagtggtctcttatgtccatttttcttctcctttttgtcatctgtctgcactagctagctgtgtgtgcgtgctactgtggtgatcgccttttgatcgcaagaaaaagaagtggctgagctgaactgaaagtctgatgaaacgagtaggcaatagccatgcaatcgattggttatgaccagagaggcagagatgaactttgtttcagaacatgagaatttagcaagaatagcttgcaaattatacgattttgcagtaaaagctagtattgaaattccgccgttccaaacttgactgtcaaataaacacgagtcgatgttagtgagtttgacagaaacaacaggacttcctcctaaccatgatctcaacaacaactcattccatccaaatcaaactatagatttttcatattagcattgagtaggcaaaagcatacatgcgtgcgtgccaaatgtctctattactttgcgtcgtaatgacacatgcgtcttctctgaaatctcgatttgatgggcttaaatacattggaactttggaaatgtcaaggttaggcagccaagagagatcatcaatcacaaagatcgacctggaaaagaacacttaaaatttggacaagtgtctgatcacatagctaaattcatagttgttgaggaatcctaggtgacttttttccaagtcatgtgtagggcgagcatattccttaactgcatattctcttctctctctctctctctttttaaaaaattctatataagcatgtactcccccttcaaatgaatatgcttatctgtacttagtactacatctcttaatgccctctgttatgaataagaactacccataattaaggggctgtttggttggttgccacactttgccacgccacactttagccatgccatagttttttaaggcatgtgtttggttcgctgccgcaattatgttatgccacactttcttaactttgggatccacatgtcatgctctcaaaattagagataagcatgccacacttatggccaactatttctaagccacatttatgccaccataccacaactagtctaaacttagttatggcaatgttaggcatcaaccaaacattccctaaatcttctactgatacatataggacctggctgacataagagctgccctagttgaatggttcagcagattcctctgatcttctgtctgctcatatattaaacagagtattacgatgggtacatcttgcaccagttttatttacagaacttttgctgtcccttttttttttttacttctgggatatgtatatctacagaagataaataaatggttggtattgaagcgatggaacttccaagacactgttcaacacgtcagctctgtgtgcaaatgacttgtatggataggataggatcagttcagagatgcttttgttgctttatacttacagattttattttgttgcttttacttctggaccggatatgtatatttctacaaagataatggtgggtattgaaacagtagaacatccaatatactgttcaacactttgattctgtggtagtaactggcaagtgacatctggattggacggtagatgtttcgataaggctctgacctttcaagatcgcctcggactgagctcgatcaatgatctgcccaaaaagtgcaaaatagctagattttgatgactacttcctcaatcccaaaaaagagaattcctagcatcccaagacaaattcagtgaggagtaaaaatgatcaaaatgaccctcacaatggaaaaagtaatagtgatgataggtaggtaaagggtatttaaaaaataaaacttctcgttttatgagctgaaggtaagtaagatggtagaaattggttttctgtgggacaaaaatcaaactctagaaatttagtttttttttggatggagggagtacttctcttgtctcatctctgaattatactgaattaacagttagatgcttgttgctaagcacacattctaataacaaaacgatccattttatgtatgctaaattgctagtgtacataacggtttaatttgtatctccgattttggaagtagtactagctagtgtattacccagccatatatatgtgcccctgtctgatcagaacatgacgctttgtcattaatactgctggtgttgatcgagtccgagcatcactagacaagtggtctgagaaaattgcatttacttttagcgaattaaggtgtaagacttgcgttgtcgaggtcaactacacaggaatgtgatcaaggaatcacacgaccctcattaattctttttttttttgagaaacacagtacaaacgcaggcgctcacaacatgcgcacactcacccctatgaacgcacacacgcacaccctacccttcttgagattgacgaagtcaccacaggcgcctcgctgtcgacgggtacgtcgcctaccactgaaataataattagccgtaaatgcgagtacccgtgtcaaatctaggatttgaacccgggtgggctggttccaccacaaggaacctaaccagttgactatgctcacttcgcgaccctcattaattctttggtttcaaccacggaaatttcacgggaatcagtttatataggagttaacacttcacaagaaaaggagacaaaaatcgagtcttccgtgcttttcttgtttctgtcactcctcttcaaaagtacactgatagaggatttaataattaagttatgccgtgaaataatattttatgagtcactacatattc

SEQ ID NO: 72886 - DNA, 3630 bp, Oryza sativa
tgtgcgacgagatcgatgagttctgccacgcgcacgaggcagccttggtggatgccgtcaccgacctgccggtatggggcgatccacgggagctcatgaactccttgtgcagccccgccgagctgccagtatgtggcgatccacgggaggtcatgagctccttgtgcagccccggcgagaagcctgtctctggtaccaattaggcatcccacctactctattggtgctttctatgcttacggcttacctagataatttgcgttattgtggtcatctaatttggtggctgaaattaggctcatatgtgaatgctgtagaatggctgagacggccgctgttgtactaaggatgggggcaaatcagcatgttgtaactaatttaatttaattagggtatcttgagttgagatgttaatttatttttctgtgggatgccatcagaactgttggaattgtagctatgtatggaagagctgttgtgccttgtttgcttatatgaaattcgtgcttttcaaaaatgatgatcttttacttcttggagttcagcacaatattggcataaatttatttttgcaccttccaaatacaacttgctgtgtagacaagttgaaaactcaaattcttatccaggatattgctactattgtacagttaagttatgccagtttgtggagaaattagtgtttcataccataactttgaatgcagttggcaccatggcatctacagagtaccatctcagtttactgaatctctgattatttttgctctacttggattggaggaagaggaattgtgaagccagtatactgtccaaaggagagctcatatagtcttcttaatatttgttgtctcagaggatgtgtcggcttcctgccaagtgccgaccaccaaaaaatcaattctccttcaaattcttcccgtgacatctctgtttcttgttgtattgttcctttgttgaaaatttgaagacatcaagctgatctctgaactggtgacatcatctgccactttgcattggctgttctgcaggtatgaccatatgaatattttgttttgacaaacaagtgcaatttatggtgctttttgttaggaaaatgccaacattctttatagaaagttaacatgcaggttgtggttagttctctgatgcctgaatataattgcaattcgattacaaccaagcctgcatatttcaatttttgtccctacatattccaagtaaaattatacccttatttttcatttgttaaaattgttgctgttagactgcagtgttgacgctcagttaaagtggaattccttaggcttgctaaaaaagatatgtccacattaagtgaagtgcatgttgtgcaaacaaatatagtaggtagatatccgtcatatcaagtatcaagatgcatttgtgaggtataatgggtgaagcaggtgaaatgaagtgagataaatcagtaagattagttgtaaaatgaagctataacctattgtttgtattgtagtgttgtatttcatgcttttaacgaccttggcactgaaatgtctggtggttattttgtgcttgataatgattgctggtttctcttctcttagatcattatgtgcaggtaaaactagttcttttggttgtcgatattacttctcattgaatctgaacatattgtcacttggcacataatcttattatcaccctacttatctttctatcttttgagtttgtaatgaaatatattgtatcgttgtatgattaactgataaaacaactgtgcttgaaaattgtggcagcaatgcagcatgagttcaattctgagactatgatttgattgaatgactacacatatagcataagttacaaatagagcttactgagaacaactattacactttgttaaatgcatgttctaaaaatgaaatattccaaggtatgcatccatcgtacaaaaatgcatttggtgagatataccagctgaagatttaagagagcaaaagaaaaggagaggaatcaacgaagaagatgagctgcggctgcgagcaacaggaagtgcctaggaagagatccttatctccggacaagttcgtgactaggaccaaatcaagtgtcttgacgatgatgtctttaatggttggcatttttagtctagtttgtgtaagtttacatgcttgagttacaatcttagcatgttgcaagttatactctggtgcagaactagtgaatggcaagaaacattccttgccagcatcgtacaattcttttcaacctgcttatgtccaactgccattttcactttttcagcttgcctggagtatctcccattgcaaagtttgatctagctacagtttggagattgttactataatatttccttcttctgtcctagtaatatttgccaatttgcatccccttaaaatgtgtcacagttgatgtgtattagtgtttgtgtgtcagtgctagtgtgtcagtttgtgagtgtgtgttttgagaatatgttctgttaacaattggtcatcaattcattgagccccactcttaagatgttcccttagcagataacaccatgattctaacatatttcatactttggttcttgaacaagcagatgcaatatggctaacagcggcacaagcaccaataggtcaatctgggatgccagtggcatcatgccacaagctcaagctgcaccagcatgtataaccccttttgcagcttcatgtaacaaccactctgacggttatcacttatcagcaaagagctcaagctgtgccttatcttcctgcagctgcatcctatcagcaaggagctcatgctgggccatattgtgctccaccttatgcatatgccaaccctatgtcttaccagcaggctcatgggaatgctggctaaccatctgcaggttatgatcagaatgccatctacaagaatcctgcctaccctgatgatcatgatcagaatgccatctccaacaatcctgcataccaccatgctggctatgatcagaaaatgccatctacaactatcatccctaccctgctgggtatgttcagaatgtctactccaactatcatggctaccaggcagcttatggtcgcggcggcgccgcgactgatgcggtgagcgtgattcagacaagcggtggagcggctaccgtcgtcgtcgcgcaagcagctgatcccccttcagtccttctgatggtgcacttcaccccaaatccactggaggagctcagatgatgtatccctatctaagaatttctgtttctgttaccattttctgactgaatggatgaagtagaggtgctttctgcaacaaggcatcttgaattatgcttatgatttgattgttcgatgattctctatctgaaaaaacaatggagaagatctgtgtttgggagagctttacacctgttaatggggagaacagattttttttttcacgattgcggaaaaggattgcacgtcaatataatggggaggaagagagagcactagctgcgtggttcgtcgaacctcctggacgatgaccacgatgaccggaggaatatgctcctcaggctgcggctgctctccctcgctcgcttcacccctcctcctcctcctcctccttcccgcgtggtggcggcgcgctcctgggcggcgg

SEQ ID NO: 72887 - DNA, 1590 bp, Oryza sativa
tgggacccaattgtcagctccattcctcccttcttcaatttgtatgtgcttcaagccgcactatgacacgtcaaagtgcggcggtgtggcttgcggtgtgtacagattgaagaaggaggagtggggctgacaactaccccttcccctgtttttgtttattttcatccttaccacttacatgtgagacccatttatatttttaattcttttaatgactgagataccaccttaaccaagccaaattgctacatcagcaagaaccgctttcaaaaccaccgacggaatgaaaaactggtttttgaagttgggggaggtgttatatcctgttttgtggtttaaggatgtcatttgaccaacagcaagggatgagtgaggtgaaaatagacttattcctaaatgtatgatcggacttggatgtcccattaaagaaacatttcgggcctattcagattgtagccaaaataaaccttaccaattttttttcaatttggcaatattgccaaattttgatatgatatcttatgtatttatcagagtttggtaaaaattaaattgatgcacatatttaacaactttaccaaaaaaaatggtatgatttgaaatggcatcaatcttaacaacccattcatatgatcaattgatcatgttattacaagaagcaaaacaacttaaattttgtttaaaaacacataattatatattatcccaacaaataaaacgaaagaaaaattatttttcagagataacaaaactgaagagaaaaataataatgttacgtaacatggttaatcaacaagtctcggagatcgattagccactgcatccgaagttccgaacatccgtctcgcaaagtgcatgctcccagactgacagaagaaaaattattgtatgtttagttaacatcaaaattgaaagtttggttaaaattagaacgatgtgatggaaaagttgaaagtttgtgtgtaggaaagttttaatgtgattgaaaagttgaaagtttgaaatttttttttgcaacttatcacggcgtaaggcgcaagaagtatagttaaccaacaccagtaatatcgtacagtactactccaacatgtcaccaaacttctctcggcgcgcccggggtgaactccaatctacccgggatcctaactcgccaccaaacctcctcgtcgttcttcttttaccgcggccggacacggagcaggagcacgcacgcacgtacggcgcgcgctcgcctcactgcatttctatcccggccatcggtccggccgtcacgatgcgccgccgcgtcgctctgtgcctcgtgcttttcgccttcgccggcctgcacgcggcggcggtggaggccgtgacgctgtcgacgtcgtcgcggtggatcgtggacgacgaggccggcgggcggcgggtgaagctggcgtgcgtcaactggccgtcgcacctggagccggtggtgactgaggggctcgggatgcagcccgtggacgccatctccaagaaggtggcgtcgctcgggttcaactgcgtcaggctgacgtaccccatcgcgctggccaccaacgcgtcgctgtcgtctttcaccgtgcggcgctcgct

SEQ ID NO: 72888 - DNA, 16546 bp, Oryza sativa
  unsure (1)..(16546): unsure at all n locations
ccctgctgtactgcgttgtacgcagcgtgacacgcttgaccagactgcaataaatgctgttagtgagcacagctgtgctcacttatcccatatatgtggcgcagacttctttaaggggtcggggtgcctcggccctcggggccggggcaagcgcaacccgaccccccccctcgggggaaatcacgaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatctcccttcccaagggaagcggtcaggtgtgacgccacccctaaagcctagtgacaggtgggaccggtctccgtagttgggcaaaatacccaacggtctcaatccatgcacattggtattggtaactttggttgtccatactgggcggtctattcaagactgccacatcacttgagcagcgcgcgaatctgggtgagcagatttgtttcgctcggagatacggtaacgccgcttcggtcggcgagcgtaattaacgcgcgcacgatacaatccgtttcgattgccacaaccgcatatccacttcacgcgccgtaaacgggcgaatgggattagtggaagcgtgggtgcgggaaacgagggagcgagatagcgagatacgagggagcgaagtagtgggcgcgagaaacgaggagccaggcccagcgatggcaagggtataaaagcatcgagaaaaggatttgctcccttcctttcgccattgttcctcttgcctttgccgcttaagctctaactctttccctgctacgccctactttcgccacacacgctcgttcccaatcatctcttcctccaccgccatggcacggggctctgctctgctcgacggcagtgtgctgccgccttcccgcatcgtgaacgagaggcacgccggactgccgcgccgcttcatgccggagtccgccaccggtcgggagatagtgatgctgggagaggggcgcccggcaccagactacccggggcggtccatcttcttcctccccttcgcgatggctgggctggtcccgccattttctcattttttcatggatgttctggagttctacgatctccagatggcgcacctcacccccaatgcggtgatgacactggccatcttcgcgcacctgtgcgagatgttcattggggtgcgcccctctcttcagctgttccggtggttcttcaccgtgcagtcggtgtctccgccgtcggtggttggcggctgctacttccagccgcgggggccggtgctgaaccgctatatcccctgcgtcctccgcaagaagtgggacgactggaagagcgactggttctacaccccccttgccgacgaagcgcgcctccgccttccaagccagcccccggcgcaggtctccagctggcgggcgccggtagatctgggggaggagtacgacgccgtcctcgaccgcctggcgggcctgcgatcccaggggctcaccggggccatggtgttcggcgattacctccgtcgccggattgcgccgctccaacggcgcgcccggagcgcctgggagtacactgggcctgaagactacatgcggacccaccagggagccagatgggattgggctcctgaggacttcaagatcgtagtccaaagggtgctgaaccttagctccgcggaggcgtctcgccttcctcaggagatcctccccctctgcattgatcccgaccgcgtctccattctatccattatgttgggggtcggggcctcagaggagagagcccctaagggccacgacggcgcgggcgagagccgccgggggaaacaatctgccccaggagggggtcgtgcttctgggcctcgcgtcgggggcccggggagcagccgccctgccgacgcccaggggaagaggaagctgggaggaacacctcccccatctcctccccgagggggcggggcggtgcgtaccagcggtcggcgcccggagggggccgcgccgacgtctcagcccgagggggagcgcaagaagaagcggctccgcaagatgggggagacggaaccagcccggggaaacctaatttcccccccaaggtggtcattcaaccgaccccctcgcaggttcgtctcactctcattgcaaccatctttctccaaaaagaagttttttcttgctcactttgttcgtcttctggctttttcttctgcttcagcgatgtcccgtcgcattcctcccgccaccccaagtccggccagtccgaggccgaagatccagtggccgcagaggagcggaggcgagagtctgaccggcgcgaagccgcagaccgccttcgggaagctgaagaggccgcccgggaggccgcccgggttcgccaagcggaggaagctgctcgggaggaagccgcccgagcccgccaagccgaagaagctgcccgggaggaggccgcccgggctcgccaggctgaggcgacagcgtcacttgggcccactccctcgggcggccctcaggcgacatcctccgaggcggctcgcgacgaggccgcgggcgcatcgcctgggcctacctcaccgggcgacgcccaggaccaaacgggcccgggggacatccccgagcccagcgcatcctccggggggccaagccgcgtcgccttttctccaaggcggcttttctcctcctcttccgtcgccccggtgagcgccgagcccattatgcaggccttggccgccgcaaacaccgcggtgctagatggattagcgcccaggtggaggccttgcgagcggaacgagcggagctcgagnccgcatgggcgcgcgtcgaggaggggcggcgctcggtggacgccatggtggaggtgggccgtaaggctcaccgccgccacatctcggagctcgaagcccgcaaggcggcgctggcggagattgcccgagaggtggaggaggagcgagaggccgccctcgtcgccaccaccgcgatggtcgaggcgcaagacaccctccgtcttcagcacgcaagctgggaggcggagctgaagagcaagctcgacgccgcccaaggggttctcgactccgccgctgcccgagagcggcgggcaacggaagccgaagcggcgtcccggcggcgcgaggaggcccttgaggcccgtgccatggcgctggaagaacatgccggcgccgtggagaggggcttgacggaccgcgaggccgccactgctctccgggaggcgacgctggcggcgcacgaggccgcctgcgccgaggaggagtccgcgctccgccttcgcgaggatgcactcgccgagcgggagcgggctctcgaggaggccgaggctacgaccaaacggctggcggacagcctatcccttcgcgaggcggcgcaggaggagcaggcgcgccgcaatcttgaatgcgtccgcgccgagagagccgcgctggagcagcgggctgctggcctcgaggcgcgggagaaggagctagacgcgagggcgtctatcggcggggcggccgcgggcgaaagcggcttagccgcccgcctcgcagctgccgaacacaccgtcgcggagatgcagcgagcgctggactcctccaccggggaggccgaggcccttcgcttggcgggcgagattgggcccgacatgctttgggatgcggtctcccgcatgaagcgcgccggtcggcaagcgggcctctggggaggccagacgtcggtgccccccaccaatctggaaggcctcgctccgcacctcaacaggatggcttgggttctcgagcaactccccgaggagctcgagaagaccatcaaggcatcctcgagggacctcgcccggggggcggtcgaactcgtgctagcgagttaccaggcccgggaccccaatttctctccctggatggcgctggaggagttccctcccgggaccgaggatgacgcgcgcgcgcgggtcggggatgctgccgaccacattgtcaacggcttcgagggctcggcccctcggctcgcgttcgcccccagttccgacgaggagggcgacgccagcggcgaggacgacggtggcgacgaggccagcgacccgggtgcatttgaatgagcccccaggcccccgccaatctttacttttttttctttttctttcttctaaggccttcatgcctcttttgtgtatagatcaacttaatctgcaatcaaaaatgatgaaaaattttctatgttaactttattttgctatgcatatgagttgaggatgatctgtgccatggtccttttgcgccttagcttgaaataagggctcgcgcccaagtcccggtcctcgaatggctcgggtcggggctagtgcctggggagatccacatgtcgagactggccaggccgggaacgtggtgaccgagggttatgggtgacccgattgtgggtttctgccgattcccccccggagttcaccacgccccggggcacggctcggttctgggcccgtttggcgattttagctgaccgaaccgaacccccgagggcaaggttgagtacaagtgaccttattttaagtcaagatccttcaaaaggaaagaacagcacagacacaacctttaggaaattgaaactgcttttattgaaatgctgaaaggaatatatgtgcatgtgtggtagcccccggctaaccccgcacacccgaggggggtgcggggttggccggagccaaaacctgacacccgaccccccctcttcgcgggtagaagcgagcagggtgttcaatgttccacgggtttggcagctccgtgccgtcgcccgtggccagctgtaccgagcccggccgggggacaccgatcagtcgatacggaccctcccacattggtgagagcttgctcaatccagcgcgcgtttggacgcggcgtaggacgaggtcgtcgacgcagagtgatcgggcccggacgtggcgctgatggtagcgccgcaggctctgctggtagcgcgcagctcggagggccgcgcgccgccttcgctcttccaagtagtcgaggtcatctctacgaagctgatcttgatcagcctcgcagtacatggtggcccgaggagacctcaaggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatgttgaaggtcttggttttgaggcctttaaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacgattaggtactcaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccaggacagcggtatgatctgcagggcctgggccggctgatggatttgcttggcgtggaactgacacgctctgcatcgccggaccagatcgactgcgtcattgagagccgtccggccaataaaatccttgacgaaaggccttgccaaccagggtacgcgaggcggaatgggctccgcactcgccctcatggatgtcagcaagaagctcaacgccttgttcctgaggaatgcacttcaggaggattccgttagccgcgcgccgatagagggtcccttctaccagcacatagcgtttggaaatgcgttgtacgcgttcactcccttcgtggtcctcaggtagagtcttatctgtgaggtatgtttggatctcagagatccaagcaatcaatctaagggagcttggaacgctctcttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccttgagagttcgtcggctatcatgttatcccttctaggtacatgccgaagttctatcccatcgaaatggcgctccatacgccgcacttggcgtacgtaggcgtccatctgtgggtcagagcaccggtactccttacagacctggttaacgactagctgggagtcgcctaataccaagaggcggcggatccccagtccagctgccactctgagtccggcaaggagtccctcgtactctgccatattgttagtcgctcgaaagtcgagacggaccaagtatctgaggacgtctccgtttggagaggtcaacgtgacccctgcaccggcgccctggagagacagagaaccgtcgaactgcatcacccagtgggcggtttgaggcagctgtgaggggttcgtgctggcctcgggcattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgtgggtatcgggtcttggcgtcccggagggcctcactaacaaagtagacaggccgctgcacccttcggtggggccgttcctctctgctaggggccgtacccccggggcgttcttcgtccaagtggcccctcggggcgcagtcgtcttctgtgccgatgacctcggggtcggaggacgacaggagcggccttcccacagtggcctcggggccgtcctgggggtcgggggctcctggcatcgtcggacaagcgggcaaagggccaactccggtcgtcaggggcctctggcctccgttcggctcgggggcctcttctccctgctctttcccgggtcgagtcagcacagggttagcctcggggtcaaagggcgttaagtgcggccttcccgcagtggcctcggggccttcctgagggtcgggggcacccagcaccgtctgacaagcgggcagagggccgtctccggtcgtcaggggccttaggccaccgtttgactcggggacctttcctccctgcttgctcccgggccaagtcggcacagagtgggggtgcgcagaatgaggattgtcctcatcgcgctccacaaccaacgctgcactaactacttggggggtcgctgctaagtaaagtaacagggactcatttggctccggggcgactagaaccgggggagagctaagatacgcctttaactgagtaagggcatgttcagcttcctccgtccaagtgaacggccccgaacgcttgaggagcttaaacaagggtagcgccttttctcccagccttgatatgaaacgacttagggcggccatgcaaccggtgacgcattgcacatccctaagtttgctggggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaggtttccgctagatctgaaagtaaagtttcttggttgcgcgtttttacaaccaagtcatcgacatacgcctcaacattacgtcctatttggctacccaaagaaattcgagtagtacgctgaaaagtaggacctgcattctttaacccgaagggcattgatgtataacaataggttcctacgggggtaatgaacgcagttttttcctcatcctccctagccatgcgaatctgatgataaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccgggtggatgacttcacggatgaatccggcctccagaagcctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacatcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggccatccgctgcctcggggcggtgggggcagaggggccaagcctctcgtcaccaccctcgggcttggacgcagcagcgaggcggtccgcgcgctgctccatacaagcgagcgcgactttaaggtcgccacggacagagatagggccaccggggcccggcatcttcatctggaggtaggcatagtggaccgccgccatgaacttcaccaacgcgggcctccctaggaccgcgttgtagggcagactgaggtccgccacatcgaagctcacccgctccgtgcggaagttggcgggtccaccgaaggtgaccggtaggtcgatgtgacctaatggccacgtgtgccccggcgtcacaccgatgatcggttgagacggctggagcaccatccccggggccttgatagcatcaaaggccgcgggggaaaggatgttgagagccgctcctccatctatgaggacacgtcccaacttcacgttgcagatggtgggggaaaccaccatcgcaatctgccctccccgggcaacacacggtgggtggtcggtctgatcaaaggtgaggaccacctccgaccaccgcgcccgacgtgtcgcctcatgagtaggggccatggccagaagctctcgcttcatagccttgaagctccggcgagagacgtgagcacacgcccctccatcaacggtggcaatggtggccccaggttcttggaaacctaggtcatcatcaccatcatcgatgtcaacagcgggggccttctgcttggcctcacttcgccgtttgccggaaggaaccgccggggacttgccctcacggcgttcctgcctcctgtcctcctcccacttcctcgttcgctcagccaaatttttgactgcgcgacagtccgctagatcgtggagggaggtgttgtggacggagcaccacctgccggcggggcgctccctgctgggagtaccagcctctttctttttgtcgctcgcaggcctcccctttcgggtggcccgcggagcgccctcgacggcgaggacatgaccctcgtcgccggaacggtccgacctcttcttcctcctcctgtcacgccgccctgtctgagcggcggatccgggggcggccgaagctgccactccggaaccggaggagttccatgtccacgcttcctctttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatggtattgcggacttggcaaaaccgctgaatgtacgagcgaagcgactcatcatcgccccgctgtactgcatgcaagtccgcttcttcgcctgggcgaggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccggccgggggcacggagggctgatcctcacgtccatgtcgaggtgacactctggacgaggaggcgccctccgttgcacggggagtacgccggttattgcgccggcgctcgatgtcgaggcgggcatccggctccccacgctgatcctcccgagtcgacggtgtcgacgagggagtggcagccgaatgacgtgcagccgccgccgctcgccgcgccctccgccttgacgacacggagccggtggtagcggcgccggaggtgttggtggtggcgatccgtccaccagcacccaggcgctgctgtgcagtcatgaccaagttggccacatcttccagccatcgttgggctggagactccgggtcatggacgacaggtgggtgtcgtaggagcgcgccagcagcctgaagcgcaccctgaggcgtgctgccgtcgccgtagacgaggaggcggcgctccccatcttgccgtcctcctgcaccacctgcgactggtgatgccatggacttgtcgaccttctcaagcgcctccccctgcttagggcttcggcgcggaggagatgggggagtacgagctcgacggcgtggattcggctccccgtcgtcgccactcacactcggagagaggtcgtgcgcctttgcttgctcggccattaggctgaacaagggaaacttggcgcctacggaagagtctgagagctcagaaaacacacgctgagcccccctacctggcgcgccagatgacggagctcgtggctcctcaccgggagaccgcgcaggcccccctttgccggttcggccgggggcttagggtgcaatctcaagctctctctgtatgtggaaagattactcgccggcaagacacacgagacacggcgatgtatacaggttcgggccgctgccaagcgtaataccctactcctgtgtttttgtggatttgtgtatgaatgagctacaaagtgtcagcccccttctcccctgttctaagctcttaatctcgaaaagaatcaacccacctttctatgggcaaggtcctccttttatacttcaaggggataccacatgcacccttctctttccaaactagactgttcttttctttatggacggagatcggtatggttgctgtccaaacgacacttcgatgggacagctcacacctaccccactcccggcggagacgggcgcaacgtgagatcgtggctgcccgttgctgatgcgaccagtgtcagatcggtcattcttgtccaccacgcgtcagtttaacaacgtgcatgtttgcccttcttcgtgtaacaccttgcctgtatggttaggatgaagcctggtataaatctaaccagggctaacgtgccatctctaagagataacacgctagctccggcttgagacgagttgccttgaggctttcgtcttgacgggatggggcgaggcgtgcgtcagaccgcagtcgccacctaacccttgatctgaccggtctgtgactggtcacagaccggataaaagagcgtgctgtactgcgttgtacgcagcgtgacacgcttgaccagactgcaataaatgcggttaggtgagcacagctgtgctcacttatcccatatatgtggcgcagacttctttaaggggtcggggtgcctcggccctcggggccggggcaagcgcaacccgaccccccccctcgggggaaatcacgaggagggcggacacctcaccctcgggcccgacgtccccgaaggtgccaggccacgtgggcgattgcgtctgcctcaagcctctggtcatgatactcccggtcccatatcaccgacagtatacataagcgaagagtgatgcctgatttcgtaagcatgttttttaaattactaaacgacgcattccgtacgaaaattttctatatgaaagtcgcttttaaaatatcaaacatatttatctgttaagtttataataattaaaacttaattaattatgtgctaatagttttctcattttacgtgctctaacttaatctttattcttatgagttttaaacaccaccaaatccaaatccaaatggagacttccctgatacgaccgcgacactcgtaatattcttattccctaatacgcattaccgagacttccctcatgttagccgtccaaatcctaatgcgtagtatagtcatacgccttcagacttcaattggttggacttgaaccgacgaattgaaattatccagttggatttcacccctctttgaccatgcgaatatatattgtgcgataaaaaataatactggtaaaagttacgatgagagcgagatgactgcctcaattgaaagaagggttgttatcatacgtgtccgcttaagaacgaagtaggagtaaagtgagattgtgacgtacttgcgcagtttcttattacggagtaagtgaaatcatttacttttgtgataacattgattatttatcgtattaaaaagtttttgttggacttattttatcattaaaaagttttaaacatgacatatattttgaatatttacattatattttaaaataaaataattatcacacgttaggaaaaaacaaaacaacattcaactacatactatacgttcccactggcatccagtgccactggaccagtcgcatcccgtagaagtagaaggtatttataatctttgagactttgacgttgatgccggctataattttcgaaataaaaaaaccgggaaaaaaaatctccgatctgcgatactcgtggagctcggggaggtgccaccaccatcaggtggagctccggtaggaagacaaacatcgccgccccagttcacaccataggagattttctttcgtgggcttcaccacgcccgccgcggcatcgccgagctttcgactgcagcttcaccgtggcatcatcggatctgaagcgccgacctcctccctcccgccgcagccacggcccctctgaagtcgaagatgtcaatacttaaaaaaaaaaatgatggtgaccaaaacacgtttacactgacgggcagatgctccgtctgcattctccggccaatgaaaatcatgtattttcacaagcgagtggacgactgcctgttaaaatcgatcttcacgggtggctaaattatactgctcgccagcgaaaatcgttccagcgctaaaaaaaaacaatcacagcggacggagcggcgttgctccgtctgcatctacagtcgcagccgctcctcgatctgccagatcatatccaatccagtgtaattattctcaaatccacaaatgtgaatcccaaattgctaaatccacatagcaccataatttatagcatttacaagtttcacaaatttacaaatcagtaacagaaaaacgagagacaagacttacaacattcaaaaatttccaagctacattgaggccctgtttagttcaccaaaaagttttcgcaaaaacatcacatcgaatctttggacacatatatggagcattaaatataaagaaaaagaaaaactaattgcacatatagggaggaaatcgcaagacgaatcttttaagcctaattagtccatgattagccataagtgctacagtacccacatgtgctaatgactgcttaattatgctcaaaagattcgtctcacagtttccaggcgagctatgaaattagtttttttattcgtgtccgaaaacccatccgacatccggtcaaacgtctgatgtgacacccaaaaaatttcatttcaccaacaaaacaggacctaaacagcaaacaaagatctgcaagcttcctcagccacagcaacaacgatcttgtcatctcctgtgagatagatcaccaacccatgcatccatgaattggaaacaaaaactaggaaatgaggacgggagggtacatatacttggactggggaagggaagggagatggagtggaggaaccgcgtcgctagatttgatgcttcaccgcgctagagggatcgaggagccaacaatcgtcgattggatccgcttgccgccacctcccacagctagatctagcccttccatggccggatccgtcaccttcaccatcgcagcccatacctttgtcgccgctagtcgccacagcccttacctccccctttaccaccacagcttgccagatctgggagagggaggggacgtgatcgagttgagtggaggagaaccgtgccgccccctctttggtcgccgcccaacttccctctggctagatctaggagagggaggggggtagggagggtcgccgccactatttgttgttgtcaccaccgccgttgctgtcgcgctgctagcgctgccacctacaccgtccttccctctagccaaatctagggaagggaggggagggctaccgctggcttgatttggaggagagtggaggggatcgaggagaggagaggggaggtgagaggggtggcaggctaagagaggtggaggacttgggtgcacagttattaggaccggatcggaccggaaaaaactggaaccagagcctccaccggtctggtccagttaaaagaccgcatgtgcaagtgaactggtaaaaactggttggagctcagagggcaggtgctaggtaggattcgaacccacgatgggttgattggaagcacatcacaccaaccacgaagtcatgcttgtgtttatgtatgaggcaaatcagttatatatttaaacttctaaaccgccttaaaccaacagtccaaccggtcaaaccaatgaaccatcgaactgagggccttgccagttcaacaaccagtctggtctcaataactatgcttgggtggggagaagtcgggtgcactttcttttttaattcttcgagtgcgctcgctcgatgtctgaatttttttaaagcctccttccctttttgcacgcagatgtcttgcttttcgtaggtggggcttgaacttagggaccatttgttatttttacatgtgggatttttgggtccatctagaaaaataaaacccatgtgttatgaaaaatcgtgtgcgtcgtcatcagggttaggcgctttggatgatacaaatcgcactgccgcgacgacgacttgacgggggagagcaggcgttgtagtacatcgacgtcatagtcttgctcgttgttgaggtcttcgtcgtcccccacgccatccataccattgaggtctaaggcacgtataacaagtttaactagaaaaaagttaaagtaaacagacgaagatgaactaaatgattttgactatatatttgcatagctaaatattttatgggagagaaagagagtaccgtttaatgtgaatggaatatattgagccatatatagcgacatataaatacattcaactttgactagtaattaaacaaatataatatgtatgtttagtgtcacatcttatattttggaatatatagagtatatgatttagattttaaaccgttgttactataagatggaaactaatcacatcttatagtaagtcatatataacaatcggaacctataacatttatgccatattttaacatcttccggtagtctagcatttaagcgtgagatatatagacgcttaagactgaagtagaaatcggaaaaagcgctcaatgatgataatccttcctgctgatgtagaagttgtggtcatggctacagctagtcgttcactgcatcatcacggcaagtgcggtatacgacacaccaagcgcgaagagatagcgagagcgggcgtaggttgagaagccaacaagcatgaacgcatgatggtgttctgagtggatgagtgacttgtgacttgtatgtgtgtggtataggggacagcagacacaacatcaaaaataaattataaataaaataaaattaaaaaaaatctacagtgacgagtgccgaagatatgtatgcattgatgtcggatagtgtcgctgatcaactactttctctattccaccaaaaaaaaccctaatatcggacaatactctctctatttcgtaaaaaaaaaatctgatgggacatccagtactagatttgtcttttgaagacggagcgagtagtcaagttaagcacgtcttcaatctcagccttttatgaagttccatcacctcactgaacttctaatcgtcacaagcaactagcaagcaccttacggttggtgctcatgacatcctcttgctctgctgtacttctttcgtcttagaaaaaaaaactacttttgagtttgaatttgaacatagtttatgttcaaattcaataagtttttataacggacggatggaccacacagatgacttcttcagagatccggtta

SEQ ID NO: 72889 - DNA, 2960 bp, Oryza sativa
  unsure (1)..(2960): unsure at all n locations
tcgtccgccgcccgcgtttcgtcaagtgtgcagcagccccgtcgtcgtcttcgtcctcgcctccgcgtcgtcaagcctcgtgccggctgtgtctcgccttcgtcccaggatcgccgccgaagtcgttccctcgccgtccgccgcgcccgttcgtcgttgtcgttcccacgcctcgtcgcgtggtggtaaggatccgtcctctcgctgccccgtcctcgtccttttggtgtcgccccgtacccgttgtgcggtcgtcgaccccggtacccgtgtaccggtgtcggtagtcgttcacgtgtgcgggtggtgaccgtgtagtgtccgtgttagtgtgttcgctcggtagccgcgtggtttccacgtgtgcagcccgcgtggtgtctagtggagtccgtttgtcggctactcgcctcggttgacacacggggtccgcttccgtcgacctgtggaccgtctctgtgtacctggtctaccgcggtcctttaggttgacatgtggggtccgcatgtcaacagcgcagccttcctgtcttttccaggctagcgcttccacatgttttattgttgcaaagcttaattataataatccgcaaatctccatataacagcactaaacttcggatgatcatatcttggtcatacgaactccgaatcgacccgttcaagtctcttaatgtttgttataacctaaagaactgtttgctttctttttatgtgttgttattgcttctttataggcttgtagctttgcttgtgtgcttcgcgtagctttcgtcgttccggaggttcccgaagtgtggttcgcggtcgtcgccaaaggttcggaaggccgttctctctgagcaaggcaagtcacatcatccttgagcatattgaatcccagtttataaaattattttgatttaaattaatgcattactgctttatttaaattcccgcgttatcactgtttatttagccatgcctatttatcattgttaagacattattattgctattgttattattaccttgttcaccctaggaaaataaaaccccaactagtgggtactctatttatggttccactagtgtgaacttaggtagatgcttcgctggttaaataggcaacattaggtggttttataactttagactttgggaaatctcatatcatttggacattatggaatggttggcttatggtggaattggacatacacctctcttcctctttcaaaacccctaaaacctgttttccggtggggtttgggtgcatgccagttgtgggaagtagcaccctggccactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcaatcctgcctacctgtctcggaggttccggccgtaggtggggttgggtcggtactcttgtctatggctaggatgggttggaaactatgtcatgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaataactaaaatgtggaatggttggcctgggttggcttgggacgagctgggacccagggtcgggttgccagttcggtctgaatcatcgtaggccttgggttaaggcaggttcgtgagggttcacggccttgattaataattttgtgtagctctaggatcgtctttataaaatggctttgggcaactaagtgacttttaaatgctgtttactgcaaaacttaacccctatattattatccccttgtactcccttgcattaattatgcatctgccggtgtggcttgctgagtactgtggttgtactcattcttgctctatctttctccccccttcagtaagagaagcttcggagaagatgtcttaggtggagtcctggcttataccccagttgagcgcctgtgaagatggagccgtaggcccgctagtccgctgctgtttatttttgtttgtcaggcctgaagtgccttgtaataatgtatttattatcgatataataaagatgtgccttttatatcatgtttgtttggtgtaccccggcttttcctgggacggggattaatacactagcgttcgggaaaaggcaattttctcggtcgcgacaagctggtatcagagccatctcgactgtaggataagccaagggataaaacctaaggacatattttataaataaaactatttgcgaaagttcctgtttcctcctttccctaatgctatgtcacgtcctgataaattcatcccgaaataaaaatcattttttaaaaggaataatagaattaattaaaattcagaaagaaattggcaaacactaaaatgcgtacaagaaaaattcgaatgtggcccggagaatttttgttaaattctccttggtttaaaaggagccctcaaattttacttgaattttcagagcaccggaaataattattaagcaacaaaaacaattatcaaagtttagtaaaaagaaaaacctaaaaataaccttccttcctcctttgggccaagtttggctcaaagtccactctctctctctctcggcccgcggccgaagtccctctctcctccctctttttctctccctctccctccccctcccctctctctcccgggccgntcctccctcccctcccggcctgcccggtcccgggccgccctgccccctcccgcctgggccg

SEQ ID NO: 72890 - DNA, 3839 bp, Oryza sativa
attcgttgctgtcagttaattttcttcatttttggtggtcagttcaagcctgcagtagtagaattagattggttcatgttgtttagttaagagaaaccaattgtatcatgctgctctgatctgaatagatggttgtgttcaacacctagtcaactaccattagcaatttatcataaatcagcccgtacggtatttgcttttgtaatgcagccagtgggcatcgatgctgattcatgatttgtaccaccagcttctgttaaccttgtattgtgccacgtggaagcctcataaccataggcatattcaactcctgttgttctaattgtctaagagaattaacaaaattaaaatcatgatagagccgcttgttgcttaattcttgcaaatatcttgccttctaagtcatggaataacatgcattttacatcatgaaaattctcagttattcattaccaaaccaatataatgatggcttgctactgttttcttgggagacaaaacaatgccagggcaattttagtttcaatatttctaaataccgtacggtctgattaatttatgataaatatgttgtcccagcagagaccaatgcatagaagttaatgctttttttacttttcggatgttgctttcctctggactaaatttctgagcctcactaatcacactaaatttgctattgcaaatgttccccttgtattgtactgattccattgtacttgttccgtttaattgcacatgctatgttgatatattactttaactagatgacaaaaataaaatgttaacatatggtgcggttctgaaagaaagacatttggaatagatgcaaggtttattgacaagtttctattttctgttgcctctgtatttaatcaattcttgaagcctctggggatgccacggaggcatttgaagatgtggggcacagcacatcagccatcagcatgatgaacaactacttgattggaagcatcaaggactatgtgcctcctagtgcatcagaggctacaaccattggcggcaatgatgtgccgccaaacttcagaaggatgccacagaagaaaggacctcctgctcccaacacctttctggacttcctgctccctctgtttgtgctcggccttgcctttgccgcttggtactacctgaccttcattgccaaggcctagtaaatttggtgaaggtttgaagtattgaacattttactatgccacgtctgcttcagcgacacatggagatatattctggtcagttctaagttttattatgaggtttctggctgtgaattagaaatgtcatcgtattattatttgttaccaaattgttggctttgcttcgaagttggtaccactcttacatgtaaatggcgatggctgcatcagtaaaatgtatggatggggcattttccctttcgctatcaatgtctctacgtatttgcaatgctgttctcaaagtccccagtgatccagttacttttgcctgtacactgaaatcacaaattctcaaggatgtactgactactgagtggctatctggataatcatgtctaacatggaaagaagtactaatgcaagtgaaaataagcaactttgatgaattttgagctgtaggatggtattactgtttttctatatttcaatgcatggattgctatttgaacatattatatatccaaaattttttgctagacaatatgtgaaagagcatctagcaatctataatacttgatttaaattttacaaagtcttgtaagggagatttgaaaagaaggtgagactcatttctctttcacctataaccagattggccataactatatcaaaccaagacatgaattcttccttagtacacaaccatcaaaaaattcataatctaagtagatattaagttttttttaacctatctatcatgttttcgtttgttagttggaacagtagtaactgcattcagaaacaaagaaacttattataaaattctccttgccatttgatttcataggtaccggctgatgactgattgttacttgatgtaccaacgttagagaacaaaactaaatgtccaaactccaaactaacaaaccaatcatctcatttcaacacaaaatcgcaatgcaatgaaattttccccagctgaccttgacacggtcatgtaagtttcttggtttataatacatcaagtggcagggttagctcaaaatataacaccaatgcttccattgcctattttctgttcttttcctaagtagctggatcctgaacgacaggaaaatgatattttataagtgaaccagattctccatgaatttcatgacaccataagcaatctattatcattccctccatatcattcaggtcaaccgtataaattagggagaaacagaacatataaaagatagacatcttatagaacatttgttgttcttttcattaattgcaaactttcaatcaaagtattttcagtaccttatacgctgtcaatgaactgtgctgcttaccttcaaatctagagctgtcaaaatcactattaaataactcgcacataattaaacaacaaactttacatggggatgacactattaaacaaaatcttcttttacataatgattataaaatcatgtactagtatatatgtttcaaataatttgcttgcttaatcttctaaactgggcattagccaatgaaatatatcttgatgtatcacacaatatatacctgaagtccttaaccacacccaaaatttcaagaaacccatttgatatcaaaaatggatgggctcgtccccttgatcttcaaggtgctcaagaagaagaaggccatgaggtactaccgctccctctgttggaattaatgaatgggccttagcccactcgaagattaattctttggaaaatcacaaaagcccacctcatgggatggcatgcatgtggagtttagtaccaccttgcttattctaggagagggggacctccttaaaaggaaggatgccctcctagccacttgaagcatgtgtggtggagagaagaggggaaacacgcgcgcgctcgctcgcctcgcctggccgggcaggcggcgcgcgcgtgcacgatgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcatggagtccggataagttacgcgcgacttatctggttcggttacgcgcagtagagatcgtgcgggcgccctgatcaagcgacccgtctctatataaaccgacctgccgtcttcacgcaacacatgcgaaatcaatctagggtttgcctcctactctgtactgcgccgtcgctcgtagactactccatcccgctcgccggcgtgcaccggcgatcgggagagcaggtctccggaacctctgccttcgacgtcctgcaccgggagaaggcggcaataaggtttttgggaagcgcttcgcgcgactgctccctgtttgttcgcgacggctcgccttcctcttcgctcgcgtgtttcgtgccttcgtagacacctgcgaaaagtttcgaccaagcagccggtctttccgtcacctcggtacgtgttcaatatgttgcgcatatttgatttgttcatgttatactgtgtagtttacatgtatagatctaatgatgcgttcatgctagttttcttctgtaatgtcatgatttatttatggaatagattaaatcattatatgtctataatctcaacaatccaaaaaccttattataggcactgtgattttactatggctg

SEQ ID NO: 72891 - DNA, 20913 bp, Oryza sativa
  unsure (1)..(20913): unsure at all n locations
tgacgatagagattatactgcatgatcatagtgccctgtataaaatccatctcaatgatgaagatagcagttgataggacaccgacagtttttgttgcttactgaactgtcttatctcccctgaacttttttttccctatccaaagtgatcaacttgtcaatcaaacactccatttgctgaatgccagaaaagggccagtggaatcagcaaccaaatttttgcaagaatgatgaacttctgtataacacaagcatgcatgctccgagttcataggttgagacatgctttatgtcaatcataacccttgaggacagattgtttctctatgaatatattagctcacatgtgccaactcgattactaaactccgcttgaatcagctgtgaaataccaaagtcctccattcgaatcatccatctcataatttgtagagtatatatactggccatttaactccaagtatgctatcatcaagttctgaagctgcaaagttttgcctaacggcccaggcgcccagcaaacaaacctaagattgcatcttcgatagatttacaggctttgagccttatgagcttcttattagatagagctatgggctttgagcccaaaagagcttctgagaactcacgagctagctaagtttgtaactgctaattgacatgttcttgtcaaaaacgtttttaagtggccatgtttagtaacaggactaatctagaatgcatactaatatacttgtaaatattattcagtatgtgagttttttcaaggcagtcatcagtatgtaagtttattttttcttgggatgtatgataaagtggttatgaagaactttagaacataaagggagtaaaagaaagttgtgcagactcgtacgaaaaaaagacagatttttcaaagaaccttttctctgaagcatactttgtcggtcttcatctccatgctcagttacttgagcaacttgctaacctcgtcagcatgcagagatccagagtttagataagccaagaaatctgcacaagaaaaatggtatcacaatctgctttcatctgcatgagaaaagggccaagagagctccccagtttggtgacaacacctgtaataagcactgtaactgctactgaaaattactgtccaacgtttttcagatccttgagaatcccaacaactgcaccttcgaggaggagaggtcagtgtcacacgaaaaggcaggcggctaatatggacataagattgagttaggggtgattgtggaggcaggcctgatcgagtccaaaattttattgcactcttgtcaaccattctctgtactttgtcagcactaagcatgcatgtcgccaaaagatgtaaactttttctcctttctagacaatacaaaagaaagtatcatttaggatcctataggtgctattgtggccaaacatgatccaaagatcaagcccctttttatatgactatctgcaatcagctgtcatcagtgcagtgcaatgtctgatgagtcaccaatccagtaatatgaaatggcagacaacagtgattatcacagggaaaaatcccagagaagaaattttatttaccttttggacaaggggatatgtatgactaatcctcctcatttactaactgttgtgaaaaaggtttgctcatttatcacatgggatggataccagtacatgtctaatcagtttgggagaactaatgcagttgccctccctctgaagaaaggtatatctgaacaaataggatttttcccactttcacattcagattactgaactctcaactgtgagccaatgaatgcaggagctggatttgagctcatcttacaacaagatttacattattgagggctagttggtacctgaagtgacatcagcatagcacttgtaacagggcaaacaattgatgtgttcctgtttaggccagagaaaagaagtgatcagaagcaaagacaaagacctccccctagtaatgatcaaatatgaacagaaagaggtttgcacaaaaacaaattaaagaactagataccaatgggtccctgagaaattgcatagatctgcatatcttgatgaaagcgacacatgttgggtactgccccctgcagatatggttaactatgtggaaggaagctaggtgcctctccttttctatcttgatcaagttgactagtatcaaatgtaagctctatccatcaccaataaaaagcatccatcctccccaatgctaacatcatcatcatcacacttgcacaaaacaaaggaaagctaagatggcaagaactcagcttccatctcccagcaaaaggctacctaaaaagtacagggcggtcctcctccagtacgcttatgacagcaagtctcccactaaagcaaaaaagaaaaaaaaaattgatgcctaacaagttaacagcagatggccacaatatatctgcagtatataactccattattggctcttgaaaggataacacgacgcataaaacaattctattcgcctcaccactccactttagttgttagttctcacttgtcacttctcagatcggattgttataatatcaatagaagtaacaagaaggatgcatgtcttcttctttccatcactatctttgaaaataatagtactccaaaaagaacagtgatgtaattaactaattactattactgctggtgcctatatgtgctgcttattgtgaattctgacctaaccatcatgctttttgtgcaagttaactaatttcagaaaaggtgaactatggtctacggtacatggtaaaaaaaaaaactgaatattttatatagctactattacagtagcatctatccccaggatgttcaacaggagcacatacaaagaaagtattgtaggattgcttcttatggcctaacctaaccatcattctagagccagaagctgtgggcttgcctgattagactagaccaaaaatcctaacaagattcatgactttgttaatgggaaatcgctttcatcaaaccccctgacgaatagtcaaacggcgcctgtatgaggcataccagccaatggaagaaagcttgtcatggaaatttcatgccttgtatcatgattcttgttttcttttaggaaaaagagcaggggtacacacatcaactagtgagatgtgtacaggaaaagatgacagaagcatatgcattgtgccttgcccctgggatatgtacaaccagggtagcatagcaccactacaatgtatgcaagggccaggcaagaaaggaaggagagataagcaactaaaagagagatccactaactccagacaaaactcttttacctcctgattcctcacaaagaccctccacaagcctcaattattacctcccgaaaaaaaaaattcccctctgccttctcctacctcgtcatcctttataaaagccatctgaaaactgaaagaagatgcaccatacatgagttgcaaacctgagagccagaaagcttgaaccacttacatggtaggagatggagcaggcagacgagtcgtcggtgaacaaagagagctcagagcagcagcagcttaccagcgagcaagatgatgacggcgcgacatggctgagcctcactcttgccacacagggatcaccagaagaagcaacagccgaagcagaagaaacagaagcagcaaactgctcggagtctgaggctcccaagccttcttctgcaccacacaaggtgttctcatgtaacttctgcatgaggaagttcttcagctcgcaggctctgggcggccatcagaacgctcacaagcgagagcggagcgccgcaaaacgctcctaccatgcgcagaggatgatgatggggctgcctcttgaggcacatgctgcctttgtgcactccctgagagtaaaccagagctcagtgattcagaaggcaagccagcaagcacagatcaggacagcaccaaggtttcatgaaggcagcatcagctggccaccgattgcttatgaggaggtgccgaattcgacatggccagggagcttcagattgagatcacagccttcagaccaaccatcagaacagagtaagatagacttaaatctcaggctttgataggttgatgtacaactctgaccagtacataagtccctcctcaagcttgtccttctgaataaatgagtttgaagtaatcaataggttcagctcaccatcagatcaaaatcatatggtggtactgaacttcgaaggtattgttgttcatttggaattcttggcagaattattgaaaaaaaaattcagagacaagttactgcactaattttatagctagaaacttattagcatgatcatagttgattcaactgtgaagaaagacatgcattccgcagcaattcttacacgaagaatatatcccgtctttatcagtaattcagttatattgcaagtgttctcaatttttatttcccaacatgtagctgaagttccaaaaaaaaaaacattcagaacagtggcgatcttgtccaattcctacaggaaatgaactgactaattttaaattccagcaaaatcctatgaaattccaacgcaccaaaagctaagaggaaggtaatttaaggttggaaaggacagtacagttcctcttttttttatggaaatggtagtgaaggtgaaagattatcaattttcactcatatgaaacacattgctaagaaaagttttggaaaagaaaaggtagtgcagcttatgtagaaaaacttcatgatggaaagggtggggcgaaaggagaaaactttatgtacctttcaagtttcaagttgcacatatttataagtagaaaattagaaatggcatctgaactactctaggctactgtattgcacgtaacacaaatgtaggcatcacttataagacagaaacaaaagtaggaggtcatttctgctgcattagttgccctgaaagaaaatcaagtttgtgaatacaccacagtaccacaccaagtccctcaacacagtagtcttcataagccaaccgcatcaaatatttctgatgattcattagcaaaggcgcatgcatctatatgttagattgaacaaaatatgttgatacaaaattgtcacggtaaatagcacaagaggtgtcaacttgtcgagcataactgttcaagtcaccagtgttattcaagtccatttgtgattctacccttaaatagggaaaagaaggtactgagactgtaaccgacaatttcataaaaaaagattaacaaagggaatggaccagcatatcaaacattacaagtttttctcccaacaaaccaagacaccatgttgtaagttataatacagaactacaattttacaaaaacaggagaatgcctgttagcctgctagcgattcagtggctcctaaatagactctgaaatctccccctaaggctcaggctttaaaaccattcagcatctaaatgcttagagcactctaacttagctgagaagctgccctgcaactgtaattcttcctttatctccgggagctcgagacaagctcagactgttaacatcgcaaagttgcagaccaaaaacagctactctgttaaatcttggaggtatgacgcagggatatcaacagggggaagcaatgttgagacacacttgaactgttccaaataattgcagaattagaccaacgctacaattatgacaataatctgattaagactacatgatgcaggacgtgcacaaaccttgtgttgcttgtacttgtcgcgaattgcagttaagtttgaacatttttttctgagctgcaagtcatgaatggccaagatgcaatccttcagttcagacaccttgtatcctgtcaacttctgcatcttcttgctctagaaccacatgcagtacagtttttagccttcaggtatagatccacagcagcactttatacaggggaatagtttttagttcttacccaaggattggtgtacggatcaatgttcagtttagcaacaaacaccactgaggcagcaaccaccgatggcaagaaccggagacagccgtagtcaagtagactaagctcagcaagataactccccatgaactccaataacaagctggagcgctgcaacgagtatacaagaatccgtcagatacaccaatttatgcacccacagaagcaaaagagcaagaattaaatgactaatatgatgaatcacacggattgatgcttacctttttgtcttcctggcaagatctcgtgaaccgcctgaaatttaagtggaacaaaggggaaatgcacaaaatgagtcattcagccacgaattcagattgggagcaagcatttgcagaggattatgatcatttgggggggtcagtatgcccacctgaggaatgtcttgatggtaggattgcccatctcgaactcgagaagcttgagtatgtcgctctccatcttgacaacctcctgcctagtgtacgtattatcagtgatgtagcagaaatcctccacatgaggagggctaatctcctcgtacttcctgcaaccaccaccaccaccatccaacaaccaaactcaatcccccaatctctgatgcaatgtgaggagactagaggaagaaaatggcggcggcggcggcttacgcagcgatgagcatggcgccgacgccgaggagctgcagcctgttgcgcctgagcgggtgggcggagaggtagcggtcgaggtaggagacggcgaggtagagcgtgtcggcgacgagcttgtactcgtcggcgacctccaccagccagtccacgaggatggcccgcatgttcgccgtcacgtccacctgcaccgcctcgatgtagtccgccgccgactgcctccgcgcctccacctgcgcccacccaccatcgtcgtcagatcccaaaccaaaccaaacctaatccattcgaatgcagatcgaagcgcgtacctccatggatcggaggtaggtgtagatgtcggaggcgtactgcgggtcccaaccggaggagggcgacgccgtcgacgtcgacgcggatgacacgggggagccgccgccgccgccgctgggcgccgccgcctccgcggcgggctcgggctgcttggacgacggcttgatgacgacggggtggtgcggctggcggggggcgacgacgacggcgttggagagggtcgggaggtcgctgagcgcgacgcgcttcctcttcgccggcggcgcgccaccgtcggcgacgcccgcggcggccgaacgcttggcctgcgccccagccgccgcagacgagcgggtgagccgcgccgcggaggccggggtggagttctccttgtcagccatctcctcctcctccggcgtgcggcggcgggtggggctagggttttgggattcggagctcgaggaggaggaggaggttaagtagattgggggaatgggagagaagagcgcgaaatggagaattcgaaaggaggggagacgcgcctacgagatgaatcgaatccgatctcacgaggagggggacgagggtttcgtggaatcgtgtttcgcttttttttggggttttggattttggatttttgggggaatctggggatcgcgggcgggatctggggctcgatgaggtagggtttaaaactcaaattacccatgactcggcgccaaaacctttttttacagagctagtagtaaatgattttgcaggttattactgtagtactgtactactgtattaggcattgggaattccatggaatttaactatttgtcacttttaagattttacttatccaaatgactctcttaggtccacgtttaataattttctacttgagagtggtaatttcttaaatatttatcacttttactccctccgtcctaaaatataagtattaagtattttggaactttgacatactccgtcctaaaatataagtacttttagacttcgatacatatacggcggtcgtaggtagaaggagaggggagtggctcacaggtggggcccacgttacttttcacgcggacacatcacgtagacaaaagtggcaaatagttaaaaaattacctcttttcagtggcaaatttttaagcacaaatgaggagcatttggataagtgacgaacctaaaagtgacaaatagttaaattccccaggaattccaacccacacagcccagaagaatccaacattttttttctgaggtagacgaactcaacttttacaaaggaaaaaaaaagagattcttttacaaaaggaaatagaatggaaaaattaagagatctttttacacaaggaaatataagagttttacatacatactactagtataatgttatatatacaggatgcaacaccaacgttgctacaaccaaaataccagtacatcggtgaggaaatactgtatactaactccaggatttgtacacatagcacaacacaaactaacaagaaggtgaaaagcacatttaaccatgatgaaatggttaatcctatatggaaatctgacgctactgagcaacccaacctggttcgagctactgcagggaccatgacctgacctctaccttggccatccatgggtttgctcctcttctccctctcctatgtatccccatactaatgttgcagcatccaaattggatcgattcgcatgatgcttgagagtttcctgtttccgtctttgtcatgcagaagtagttcgttcagctgacagaagctttgcagagcatttgctgttgctaccagactaggggagatcatgaatgtgcatcactggagactgccaggaggtgcatcagctcaagccggcactcctgacctcggatgtaatggcccagcatcatgcacctgaacagccatcgcggaatcacaaggtcagaacgttgtcaagtatcggtaggcagcacaggtaaggaactgctattattaccagaataatagacgggcaagacggtcgcgaggaatagatatcaggggctgaaatgggagggacacgtcctccacgagctcagtgaattcatcgtcctcctccatcccaaaatttacagctccacccgccatgttctctgaggtcggagagcgattcgtatgcattttgggggagagagttgctagcagaccatgtaccacggagtaaacagcttcttccacaccagggcaggaagactccgagagttcaacaacctgttcaaaatggttattagctcaaattgaaacaaaaaggtgccccaggaaactgggaaacttcatcttgctttgattgctatttgctgtttttgttcacatggcatccaacaagaggaaatatattagttgcggaactcaaaaggccagaaacagaacaaccttctcaggtgacagcgatctcaagtaatacagcagctcgtttttctcttctccagcaaattgctgcatttgttgggaagaatttttcttcttaagttcatgtagctcctgcaaggttaaaaataatataagaatacaatcaaattctgaattggtagttttcaagtgaaagcttaaacctgcaaagatgttaaagaataccaatgggattaacctacagttcaaagggaaggtgaagttgacctctaatattacactagccaagcttgcactaagcagagattcttgatacagaaaaaagtgtgaaattaacgagccatgaaattttcactgtgcataataggtatgacaagattggcagatatatgcagggcagtcaatatacatatggccatcactaccaatcatctatgatcatccaatcaggtaagactgtaagagatggttattaccttttccatggaatccaagcgagattgcataccgagaatgagtttttttgcttcaatacttaagctacctagtccatccatatttccacataatttttcatctgccatttctgattcgattgtcaagcctacatcttctggtaagctgagaaacatagaaggccttccaacactgtgaatttcttcacagctatctcttttcttgcattcagtttcttcttcagaaaactccagcgttctttcaagggagagtctgtactgagcattgaataaagtatacctggaacaaaggcaaagtgacattagaaattaattttccttggcacatgcaaatcaccccatcaagtgtttatgctaaatgccaatgagaaaaataaaataaaaaaatatgtaaatggtctggcctttcttctaagttaagtgaaagcattctatttcaccataccaacaattatgggtgaaaaggaatttgatgccatcaaaaaggttaatatttatttcttcttacttttttgtgaggaagaaggttagcaattcaatctgaaattttgaggaatcaagtttaatttgaatgaacaccaagctgataccaagcaacttatatctgtcatctccttcgtgaaattatgaaaaggaatgcaccctttaagagcaattaacaggggtggaagaatagctagttccaaagaaaaatgggatgtgactatgtgagtgctgaagcaatagtggtagattgtatgggtaacaatttccaggtagaccagacaagggtgtacacttggactatatgctcgaggaaaaccaaaactactagacactgtacactaaaatctcattggcagaaatgctgtaggaaaaggtttggagttcacaattcacaccctcaagacatgctttgacataccacatacatgaacgaaagtgctgcgattgtcctgacgaactcagcatagggaaatagcatttgtatttcatgcatatagatgatagacaagagctatgctacagctggccaccaatagctggccacgctacataattatttatcttaatgcattgacctaaaactacacgctaagtcatttgctactttcctgtgcacatttcaaaaggtgatcatgcttaaatctgacttcttttgaccaactagaatcaacaataatcaatacagtggatgaacatgaaagctaagtttcgggcagaaaagcataccctgtcattattgaagatgccaacagcttgaagaaaggattccaaagggactctatgaccacatggaactgatcggatggaagaaggcccaacatgcctgaaacagtcctcttcattgcatccacagtttcagaaggaacatctttttggattatgcttagatccaaaggttctatgtcttttatcaagttccaaagggcagatctctacaagcaaacacaggagcatcacgataatgaaaagtgacaatacagaaattcaaataggaccaaaagatgctaatgctctcatctagataagtttgacagtagggggatgacaagcatatattctttgttggtgaaagctaaataacatcctcacacttgtgaggagagacattctaacttttgttgttgctcaagcatgctgaattacttctccatcactgccatccaactatgagaggctaaataatgtgtatgcatactcaaaaaagttaaccatattagcactcggatgcacttttaggaagctttatactgctcaagggttaagacaaactgtgtgccaagattagtacccagcatgacaaactatccaatgagaaagataaagttgcagctttgcgcatcgacgctagtatcgtttacttttgtgttgccgactttaggaacatttacatctctaaatgaacagatctatatacggttcaaatccttccaatcccccatcacttcgctccaatccaaatcccacaccaactaacgcaaatcatacataccacctactgctgctcaatcgagtatttgcaaaaggctgaaagctatcgtttcatactttcgcctcgattcttctgtttcgtataacatggaggaggaacatggagtttaaccccctcggctgtgctcgctcgctcacctcctcgtaggcgccgccgcggaggggcctcccgcgcgcgtgaagctcgtcgggcgaagacgacgacgccgccgccgccgccaccccgaccccggcaagcccccttcgccagacgccacgacccgccaccgccacggacgagggaggatgacgagccccgaggaggaggagcttcctccccaccgcggacgacgacgaggaggccccccgcgtcggcgcgagtatgccggaggatatcggcatgtggtgacgcgcccgccgtcgcgttcgccggcggcgaggggggcgggaggctttctccttcctttcccccctcgcgggggtgggtatgtgggttggtggtgggcgcctcgctggcaggggtgaggaggcgatgcgcgtgactgcgcttagctggacccacgctgtctctgtctctctcacttccatgtgggccccacggcgcgtgggtgcacgtgtgacgtcgtacgcccgcccgttgatattttggcaaagatttgtttgggttcgttttacggcaatattgtttcgtttattctttgaatttgtttggagagcttaagattctgagaaacagctgattgaaagccagcttctgataatttaaaaaagctgggtttatcagcttttgacttccagttcattttttggattctaataactacatctttttataatctggaccaaaagttgaactatatgaggagcttatgattatgtaagaaactgctgcagctagaagctccccaaacagacccatatttacaaacgaaaataatttgtgaataaaactttttttatatatgtatctttagaaatctaaaagcaaagattgaaaaataaacttcgataaaaaaactttaaaatcaactctaaatttaatattgaaattttaaattttagctgataagtatgaattgaattctgaaaaaaaaatacgactagaaggtggcggcgtttaagtgtacctggacttgttcagctgcacgtaatcttggctgcgatctccccataagaaaaaggaaatatcatcacaaactcgttttggtccaaagaaggaaaatatatatattaatttattagtgtaccggttcagcacgttttagctttgtggtattttagttgaatttccagtgttaaatttggtcaaattttgctgagtaatcatggattatagaacatggttttcaaggtttgtcgtgcctaagttagaatggtcagtggctacctttgtccataaatcctttctctgctaaaggaaaattatactcaaacttttcaatccatgcacttagtttaagaatcgagtgatgcttgcttcggcctttttctgctacgtgaccgataaaaagacgcacggtataataaataggtaattttcctataatgtagtgatagagtattttattcttgctgcaaagctggatggttttacactcttgatgtatcttttttaaatgcggtaacctttaagattggtcgaatatcgtgagatacagtaaaaaaatatttatatatacgtaatcaagaccgacatagatatataaatcatatatctataattttcatgcaaagctcaattatattctaaaatggcatgtgtctgttgtttttcttttgttaattgagcaccgtccaagtgtccatcaagtatcatctctttggtcattttgattgtacagtattgtttttggccttttggcaggcacaggatgctcactgtgctcctccggttcacctcaaccgtccatccccaattccagaggtacaatcaacgtgaacagggataagatggatgcttggttgttcaaacattggacaagggaatcattaggttatctccaacaaagaaaccttgtccagtgtccatggtgtggtgatgtcgatggatttacatgatacaccatgctttttttattcagatacttactactctgtaaaaaaaatgaatttctatctacgagcctaaacacacatgtgcgtccaagttcatatgtaggattggtcttttttagatggaaggggtagtttatgttggaactttggtcataattcggcatattttaatccaaaataacaaaataataaatatgatatttacaatgggatttgatccagtgatagtggtgaatgtaatcaacatgagcatgcttaatgtagaataagcatcaacaatcacataataacacaatgttgacattgcgatgaacattaacagtaaaacttctaattgaaataatgtaagaaggttataccccaagaatggtcctccgctggagtttgaggcagtattgcctccgttggtgttgacgggagcctccttctccttgtatccagtgttgccgttgtctccagtgttcgacatattggtgaagatgaagtagatgttgacgaacagtgagtagtcgcgcgttgcgctccccaaaaacctgatagcccgcccgtccgtgcaaacgtcgcagcagcgcgtagtttcggaggcctactctcccaacgcgtgtgcacacactcgtcgggatgggattaccgtagcagcaacagcgttggaaaatggatgaaagtgtgtctcactattctcgcgggagatcaaatccattctcattttataagaggaatggaagatgaagagtaagagtcatggaatagaaagaggaatagagcaactaattgtcatcaactagccatgaaccatcctccactacacaaccatcaaccaacaatcaattaagagtaattgatgtaagttaccaatggaataggaagaggaatagagcaactaattgtcatcaactagccatgaaccatcctccactacacaaccatcaaccatccatcaattaggactaattgatataagttaccaattccctaatcaaatggattaattctcaaaactcttcatcccattgatatcccataaaagaatgaatacacatgaattcctagcataatgagccttggaatttatttgaattaattgatttaaatggatcaattacccaattaaatctatcagtttatactccctccatcccaaaaagaaccaacctagaggggaccgatgtatatggatatagagggtgtccacatatattgtcctaggaggagattattttcggaacggagggagtaagttgtttacttgttcttatcaatcaatcttaagctggctgatttctggccagctgattgactcttctactctcctttatttgcacgacacgtggcaaaattgtggaaagagcagtgagagactgagagtaagcacaagcacagagaaaaaacaaaaactatcaagagatgagaccaccagagaagtagggaaagaaaggctgatggatctctctggactgatcgattgatggccgaaacaaaatgagagacttttttggattagagttatgtccgtagttggtctttagaaaaccggctggcgaatgggccatcaagcccatgattgaaagaaaactaaaatatttctattacaagtaaagtgcgatgctctttacaaatactcctttttttcttaattgaagtacagctatatgcattacaaattaaatcataactcaattcagcttgagtaaaaataactaaactaaatccacaatgaattatttatacaagttcttcatgttaaattaaaataataaacaaattactccctccgtttctatatataaggaattttggttggatgtgacacatccgtataacgaatctagatagatatttgcttaatactatcttttacctattcctcaaagataaaggtcttattaatgagtttttaatttggatataagaatcttatttttaactttacgttcaataattaataggagtcatacggattacaaaataccacacgcaccaaatggcacatttgtttttagaattttgaaactacaaccagtcagtttttatcgcgtatggttatccctttagtttattatttaagtgatctagcttaaatttataagagacttgaaccgaacttatataagtgatgtagcttatataagtttattatttaagtgatatatatactagcttatttaagtgatatggcttagcttatggcccgttcttctatagttactagctatgatcacaaaattatcaccagcacacactttccaagtttctagacaatatgatttctctgagaactattttttatcaaatatgaatcatttttttgaaatttctaatgtttaatccatcgatccgttcgttccagagaataatctccataattaaccttaatttcatgtgtcattcatcacattttcaaacggaccctaaaccaccgtgtaagactgtcatgttggggcgagggggacaattttagatattcattaattaagactaaatatcatgtaacgacaaattgaattgtaaatgcgtatatgtccatgagatatcctagtacgaatcttaatctttgtggctttattccaagctccccctctcccatctaattaatatgatcttttgccatatgttttatcaaaagcgatggataactaatataaaagggcaatagatatcattccatacttttttcttttacaaagcatccacaaaagctccagcacaagtggtgaaactctatgttagtccaactccatccaatacaattttttttccatacatcccattttcttgcttagcagtacatcagtagtcattttcattattatcgccatcgatttcgctaccactccgtacaactttgccttaaatcgttgacttgtccgtcaaaataactcagaaagtcagaattaacaaaaagaaaattcatcaaaccatgtaaatccaccatgtttgagttatcattttctccggaccattaacgtgaattgtatttgattaccacgataaaaataacattttaaaaaaatcatcttcacaaatagcttggaatgagcggtttagtcaatgcaatagaaaaaaggttattttagaaatcatatatttagaagcatggagcaaataaccagtggcaagaatgcagggaaaaaattctaaaaagaacatggtcataaagctgaaaattaaggaccgagaaaacaatctacatatgcattgtttttttaattcttgttagcttattgttaacgataaaatttggtaagtccggagtaatcatcgacttagagtcagtatcggtttcagagtcctaaaatcggccgatggaagttatcaagtcgccaatagtcggatttctgctatattcggttaaggaaattaatctactaaaggaaggttatccataagcgaccgagtttaacgaggatgcgacatgacagtttatctattagttaggaatagtttgttagtttccttttatctttagaaaagtgtgtttagtgtccgataaggactttatgttttcctgttatctttagtaaagtttctttttttttgtcccacaaggtctagtatctacccatgggtataaatatatacacccggggtcattgtaatttactccctccgtccctaaatgtttgacgccgttgacttttttaaacatgtttgatcgttcgtcttattcaaaaaaataagtaattattaattcttttcctatcatttgattcattgttaaatataattnttatgtatatatatttcgcaaaagtttttgaataagacgaacggtcaaacatatttaaaaaagtcaacggcgtcaaacatttagggacggagggagtatctctcaatcaatactactctcagcgcatcgccaccttcttttctgatgttttacttattaaccggcggaatttggcacctgacgcggggctgcatcggttcagttcgatctctggcgaaggggtaagtcctacgttccgtcggccctagtatatctatcagctacattggtgttgttcaaggctgcatcgcttcgatatcttagatcgctctggtttggttgatatatttgcctacatgatatctcaattctatctctaattgcattgtgtttagagacgcatcggtttagttgggactgtctcggttaagtctgatcttctgtcttagccaatatatctctacaatcacaattctattataaatagatttattatatccatcacattagacggatctatcggctcatcgagtactatattatcatatataatctcgtgctgcatcggttaggtccgacctactagattgttgttgataatataaatcttactaagctgataggttcatgctagtgttttatcggggtgctagccgataagttatctggacattgcatcagcttacaaagattacaaacaagttggatttagccgattgcaacaaaggtttcactgtttatctaaatcgattggattttatgacatcgaacttttagccgatgtatgctttaaccatcggatcagtacttatcctatcatattaatattattattattagtcgattggtttttattggattatattattgttatattttattaccagccgattgtcattatatcattatctacattggacatataaccgattgctcaaaaccctatcggcatcggctgaaatcggcatcggctaatatcggctatcggttggaattactccatcggcttgtcaggtgattggctgttttatctgttgtttacctatcttatcagttgcatgatcaaactgactggtacgcccgtatctcatcaacctttggacctgcattggagctaagcagatctcctagaccagtgtgtgttttttgcatcaacacttatcagacgtaactctgaatttaaattttactagagatgattttaaggttttcctatggtagtttgtttatatattcgctttaatattaagaacgcatgtataaaagttttatagcatggtacaattttccatggttttcagctgaggagcatgtttggggagcttttgatttgagaagcaggtggttgctagccaacttctaaaaatctataaaagttgggttttctatcttatagtttattttctagattctacagctacattttcttaagacgtaaaacatagaaaaaaactagattatttagagaagcttatgattctagaaaaaactagaattcttagaagtttcctgaatatcggaggagtactacccctatgaaacggacaaggagtcgaataggaaaccaactcctctaagggcctgtttggtagagctccaactcctaaatttaactccaggagctgagtatagagtggagttatggagctgtctaaacccaactccacctctctagttcattttgtgagggtgctctacccagttccgctctcattttaagtggaactgaaaccgtttggctatgcttcagctccacgagaggtagagcactagagttggagttgtgctaaacatgccctaacttagggtcccgtttggtagggctccaaacttcaactcccaactctaaagtccaactccaataggagctagctcctataggagctgaaggtgggcatgaaagtggtttactagattggtcagttccacgccaccatatcctgtatcgctatttcgtcaaacacctagttggtgttctgtggtcttgccgacgttgtcatcgctcagctaaggctagtcgctgccgaaccgctagccctagctggtcaagggaggatgaattgtggggaagagagatagaacgagaggagaaggggtagttcaatgacatatcgcgtaaacacatgaaaaaaaaataaaggatagtaggtcttttagggtggagtggagcgggaaaaacccagctcaaccctcgtagtatgattttgtggagcaactctgctacctccgctcaaaaattgaaacacatctctaactatagggaagttggagttgagagctaaaaatgtgtcaaacgggcacttagttttctcttattttgagtggcttgatgtgtactctagatacgttgagtggtacccaccatcccatataaaaggccgtaaaagagacgagagactgtttgcacgtcacactcacaaaagcctatccccacgaatacgggtggacagaaaaagatcgaaccgaaaagactgagaccgagacgagaaattcggtcatcaattcggtactaggcagtgaaagaccgaattttgttcggtcaattcggttagtctctttggttaaccgaatataccgaattaacagaaaatgcctaaatgtaacctacagtccactaagttcaataggattaaactataactttcacatccctacttcttctaggcatgcaatctaataagagtctttactcatacttgcttacggattttcttttttgtgatttttgtgttgaaaatttccattatttctttgcacatatgaaaataatgctgaatttcggtcagaccgagaccaagaccgaaaagatcgagaccgaatttgtcggttctaacattttttgcgttgaaattctgttttcacttttcaaagaccaaagatcgagatcgaaaatttcggtcagaccgaatgcccacccctacccaagaagatgaggcgggcgagtgtgcggtgctgtggagtggaggtggtgttgcctagtggagtcgtgcagaaggagaatagatggggattgggatttggggagggttgactagggttagaagatatatatatacttgttcattgggcttcaattctatgggtcaaatgacggataaattttagaattggtccctaactccaatgaatacatgtcaccatggaagatgggaatgggtcccgatggtgatgagttttgaatcattaaatttcccataaatgatagatatcaaccatccccatccctaaatatgaattcaccgtggggaatcagtgattgggtcccgttgccgtctctgtacggcagtagtacaagtgagaggaggtttttccggttgagtggtggtacccaccatcccttataaaaggcccgtaaaagagacaagagactgtttgcgcgtcacactcatcacacaaacacaagccccatccccgggaagacgaggcggtgtgtggcacgtcacgtgccccaccccgct

SEQ ID NO: 72892 - DNA, 37500 bp, Oryza sativa
ggcggacgcagtcgagcaacgtgggcgggggcgtggcgggagagccagcgcgcgatggcggtgtcggcggcctccatccggcgggccagctgggcggtgcggtacacgttccaccgcggcgccgacgcggcgcgccgcgccagctccagcgcctccctcagctgcgccgccagctccgccagctcgccggcgctccgcccgtgcccccaccctcctcccccctgcgccgcctgcggctgcaccagcggcagcagcggctccacgttccggcgcagccgctccgccgtcgacctgcagaagaacgtccccctcaccgcccgcagcagctccttcaccgcctcccccgccagctcctcgaacagcctctccatgcctccacttcttcaaaatcaatccaacacaattctttccctgcctcttcttcttcttggatcttgggatgatgaaatcaattgcaatcgaacagaattctttctattctctgcctcgtcttcttggatcttggatgatgaaatcaattgcaattgaacagaattcttcctcttctttgcctgtctcgtcttcttgaatcttggatgatgagatcaactgaatctctttgaaattgtttgtatccctctccctcgtgttcttgggggtggcttggctcagccgggtaagtggtgggtggtggccatcgccatggaattgaggaggaggagttggagaagagtggaaaagaagaataaatataggaggagatgagagagggttggaggggtcaaccgccgcggctacgggtcactgacactgccagttaccgtgtggggcccactgctcagtcagtctaccactagtattagtacactgcacattgaattactactactgtattagtgggacaaacactgttcaaggtttaagtagaggagctgatagctgacctaaagactatgatctgagagcatctttgatcttggctttgagtcaaggagcaaagcaatgggtgttaggggtattagcagtatgcattagaatggttcaacatgtaacttatgggcatggtgatgatgattttgatagattatggatatagagaaaaaaatatcagttcataacgatgaactaaatattataaaaagcgaacaaataacttttaaaaaacgtattttagaagtgcggcccaaataatccataccaactctattaatctcttagaacacgccattacagtttaatagctctaccaaacgacatatttacaaatgaaaaataattcgtgaataaaacttttacatacgtgttcttaacaatcaaaaaacaaaggctgaaaaataaactacaatgaaaaaaaacctcaaaatcaactctaaatttaagattgaaaattcaaattttggctaataaatataagcataagcaaaaagatgaagccctaaatctatttatgcataacgtataacagggcatcagtatgtatttgttagcgattagcgaagtcatttattcaccattggcatgtgaggtttcgctcagggtgatgctaggaggataaccggaagagtatcttgcacccaacaattgaaggtggacaaatggtattctaaaaaaaatggtattcttttctccgagggaacaggaatagagctcttgcaatgcactataaaataaaagaattgattcagtttataaaggaaaccggacccaaaaaccttacaacgacacggttaattttagataggagttggattccttctagagaatttgtagtaggtcagatgaatgcagacttataggttagcacgggtgcagtggtggaagtagtacgtgagtactagatatatatgcttagggtgaaggaggagatgcgtcaaaggcaccacaatggtggagaaaaaaatggattcccaataataatacaaggaacctagctaggcaatgaggacgtcgccttcgatggcattccaccacacatcgcttgcagaatttcacgtacgagcatgttaacataactaagtgttgaattggtggtgccgttacggtgactttgtctatggtggtattttatgtgtgtgtggttgggtggggtaatgatgatcatgattggcactatagtctactcccttcgtctcaaaataaaccaatctcgtatatgatgtaacacattctagtatgatgaatccggatatctttgtgttgtatccagattcatcgtactagtatgtgccacatcccgtatgaggttgatttattttgggacggagaaagtacatcctagaaggggagccgaaaccacatccgttgagttgaaattaagatgcatgttactgaagatagtttgtcacgcaccttgcttggaagatgatgtgcatcctcgtccgtatgatccgaatgcaaaaaattgtatctatatatgcatgcacatgtacgtctgtatgtgcgcaatatacattaccttacaaacaaaaaagaagaggaaaaacaagatgatccctagcacatatggctatccatcaagccatattgttgaagaaagtcattgcctacgcctccttgcctttgattttctttttccctgcgtccacctctgttgactctgtttgctatactgctagaaagaagagaagatcaggatatctatacatcataaatagcagggcatgacaatagcatcatggggactttcatgagcagtacttgagcaattaaatgagcatcaacaaacttctctatgggctatgaccaagcaatccaatccaccaaaggacactgccctcttgtattattgttttgtgacatgcccaaaggaggagtccatgtccttttgtttcccaatctaatcataatctctctgttcttggtctagatcaatggtggtacgaaggaattaaaaggttgttgaatttgcgagagattatcgcaacatttttgagatctcccgattcttgttacttgttttttataaaatggattaaaaaatctatgctctacatccaactggatgtatacaggcttgtccttgttagttattattaattagaacttttgaggttaaacgtctcctttggtaacatcaatttatgatgaacaataaccattgaaattaaaagacaacatatatgtagatcgaatggagggatcttgaaagaaagagaaattcaaggaccctctcggattcatcatgtactgttgccaacgacaacaaccagatccaaaaccggccctgatatggctattacgaaccgacactgataaggtaaagcacggtcactcctatacatgggtggatctcaaaagaaaggaacgcggtttgaggaccttccaggattcatcatataccattccaaattcagtatagccttgatcatcagtcatcacagtaggtcagcatggttgctctgcctgaagccgaacatgccaatgaagccgaacatgacaagtgatgatggtgacgaaactgagaagaagtcggctaaatggcctgatatccggccataactgtagcataacctacaaagcatttacaagccttcaatatgggtgtgtttagttcacgctaaaattgaaagtttggttgaaattgaaacaatgtaatgaaaaagttaaaagtttgtgtgtgggaaaattttaatgtgatggaaaagttggactaaactcggccacactgtctgaactcctctcactctgcaagcacgtgtgatgttccaccggccagtatatttctaaaagtgaacattattgtagggttttatattttatcctccaaggtgtgaatagaacaagctttaattttatatgaagaaagagtgtctaagaatatggactctgctgaagtacttttttttaattcacgaaacccacaattttcctcaaagtggttatataatatatgatgtgacataatataatatatagcaagtgaaagtcttttctgaattgattctggccataaaatttcgaccatcgcctatgaaaaatttataatatttgtgtttcatcgtggcatacagtaacaaatttacactcatatcactattatgttaggaacaactaaattagaattcatccaacgtattccaaatagtaaattctcccattgcaaatagatgtagccatccagtatcttcaggacaatcacaacagtgttttttactacgaaaaaaactgaccaatgccatggagatgccaaagcactgaaagcagtagaattattggatagatatatagatgctaatgagcacatgctaaatatgtgagttgttgtcaccttgcaattagaatatgccatccagctgcaacatccaatccaaccgtccctttctcccaaatggttttttcccattaaaattatcagcttaattataattccttaagttttgattcccttcaatgaacctggtcaaagttttggaccatggaccagcaggccatggaccttgactataaactccatctactaccacacaagaataaattgaagaagggacaaatttttttttgattgctgaaaattgtggccatttcacatacatccgagctagatgtgaatttatttgtaaaaccacatgtgtgacagatgaatacatgaatctaatttcagacctttcatcattttcttttcagcttatcaatcgcaacaaaaatttaaattttaaaacttaattttagagttaatttttatgtttttttatcatactttaattttcaacattagcttttaagtcactaagaacacatatgtaaaagttttatccataaattatttgtaagtcactagtaatctttacggcttataatcaactacaggtgaaaccatatgacttgccacaaggcgtatcaccatactttcgagacttaatttgtggtatagtaccaaactttccacctagtgttattttgttagatcatttttggtttttcatctacatggtagcttgttttcgactgaagtctgaaataaggcgaatcatgatcgcaatcgaagcggaaatcgaattcaaacgagggggggggggggggaggtcaaaaaggaggaattgttgctttgcagcaatcaaaaccattacaagatggatggatgtgatcacagtttgctgccttttgccgtgtgtgtatgcagatgtggctttacagtgccaatttgtgtcctggcacgaggcagcagaggctacacggcagtgaacaaaaaaacgattccttctgctgcatttaccagggaatatgacgcagcagcagctgcagatggcaattgcaattctgattctctatcttaagtgaacccatcgcttttcttagccgaatgattgtctttttaattaataaggcctcgtgtgacacaggagataaaaagagctcttcaggtcgtgttcatagtacccatcgtcttcgtcgtcggttagggcctatttggttgcatgcatgatcttaatacgaaggacgagtgtttgaaatttctaaaatcttggactcctccggcacgcaactaattcgtctgaaattatgtttttttgaatttagtcaaagtttgtttaaagttactaaaaagttgtttgaaatttccgagatctcgtaaatatgtaaaacgaaatttcaaaccctcgacggtggaatattttctgatgcaagatgacaggaaaagtgtgccacaattgttggctccatttatcaagcgacatcgaaatcacagtaccatcaatagatttattgggagaaattaccttacttgaaagttacagctttatataaggtggagtatagtggggaatattgcagggttgaatgtaattggtgaggtgatgaatataaaaaatggatgtggagattatggatacctcatatctatatgacagttatactttagtcggatatatggtaccaaatatagatagaatatttttatggggactcgggttagtttttaacttgtatgtcaaggaaatacccgggatcctagtcggttacgattgtattttatctataatcccatattccgttaggatatggactgtattttgtaaagcggattccttcccctatataaggagggtccgtgtgcctcttggggggcggttcttttttctagtttatacaatcaataacacactcggcggaatcatccctggacaggagtagggtattacttcttgaataagaaggcctgaacctgtataaaattccttgtctccaaacccatccactttcctaacttgatagctacccccttttattattgccgaaatcttgtttcgacagttggcgcgccaggtaggggcagcgtcaagtttttgccgactaagtgcgatgggttccgtttctgtcaccaacgacttcgccttccctcccgggcaggcgttccggttcggcagcctcaacttcatcaccaaaaacttcggcaagatctctctccttgactcggattcaaaccagtcggggagagaccaggtccccatgccgttcggtattccgaactcggccaaagcctacgccaagatcatctctcccgagtcggcttcaaaccactcggacgagatccaatctatttttccacgaccagatcaagacgacgggtcctatccctcaatcctgatgaaacttcctgatgatttggccgctgtcttcacagtcaagacatctcccactcgaagatctaggcgagctccggctttagccccgatccgatctagatccagggaggttggcgttatactccaacctcttgggacagtctcgacggaagagttggatggctacctcagctcccccggcgtcagttctcgaccaaccgagatcctcgactacgacgacttcggctaccactacgaccacggtgacctcgacaacttcgacgacagctatgaggataactacacgcccctcttcttcggcgtattcatggctgacaacgaaacggaggaacagcgccaagcctgaggagcggacaaagatcgcgcacggcaagaagctgaacgtcgccgactggaggaagagcgacagcgacaagagcgagaacgactacagcgtgagcaacaagatcacgaacggattgcaaaggaggctgaagatcgacgacaacatgccttggaatctgggcggcgagcgagagagctcattgggcaacaagacgtcgatgggacagcggtttttcgcaccccccagcagaacgcggttgcagcgatcactctcctcgacaccctcctcaaggaagacgcactcaaccaagctgatcatgtagtcaacatcttgaaccagacgaagaccatgatcgctgcctcggttccagccaactccgcaagcacccgcaccctgactggtagccgagtccctcatcttcgatctcaagactatcaccagccaagcctcagcattgccggcgtcgaatctagtcgcaggagcaggggacatgatgaacggtccgttcgctcgcctcccgagcgatatagggagcgccgagttgaacgaccacactccccacatcgaaggcgccccatcgatcttcgcgataccatcaatcagcgctgtgcagcaagaggccatcattcaccagatcgctacgacgacgacgtggacggagttgctgccttcacaagcgacctgtgtcgagtggattggccagccggctttaagccgactggaatcgagaaatatgacggcaccaccaaccctgagtcttggctcaccgtctatggtctcgcaatccgcgcagcaggaggagacagcaaagccatggcgaactatctacttgtggccttagcggattctgcccggtcatggcttcacgggctaccccgcggcacgatcggatcatgggcagagctacgcgatcacttcatcgccaacttccaaggcacttttgaacggcccggtacacactttgatctctacaacatcgttcagaagtctggagaatctcttcgagattacattcgacgcttctctgagcaacgcaacaagatctccgacatcaccgacgacgtcatcatcgctgcctttactaaaggcattcgccacgaggacctagtcggcaagttcggacgcaaacctcccaagacggtcacacagatgtttgaaaaagccaatgagtatgccaaagccgaagatgctatcacggcgtccaagcagtcgggcaccacttggaagccaaagaaggatacgccgaccgcaggagggagtggaagtaacaaccacaaggatcgcaagcgtaagcccgaagaacttgtggcgaccacctctccatcttcccgacaacgttcccgcgtcaacaccttcgacaagataatgaactcccaatgtccgcatcatcccaactccaaccacgtggccaaagattgcttcgtctacaaacagttcgcggagcaatacgttaagaacgcacgtaaaccctcagacggagatcaaggcacatcaaagaagaaagatgatgaagacgatgccccgcctggttttcaagatcatcgcaaagaacttaatcacatcttcggcggacccctagcttatgagtctaagagaaaacagaagctaacagaacgggagatcaatgcggttcagcctaatacgccccaatatcttcggtggtcagagatagcaattaagttcgaccgctcagatcatcccgaccgagtggtccggtaccccctggtactagacccagtggttcgcaatgtcaagctccgacggacttttatcgacggtggcaatgcactcaacatccttttcgctaagaccctggacgatatgcagattcctcgcacggaattaaagccgagtaatgcacccttccacggtgttatcccaggattgtcagctacaccactcggccagatcactcttccagttaccttcggcactcgggagaattttcgcacagaaaatgtttgtttcgaagttgctgatttcgagacagcatatcatgctatacttggacgaccggctttagctaaatttatggccgtcccacactacacctacatgacgatgaagatgcctggtcctcgaggagtcatatcactacggagcgacatcaagcaggccctcacatgtgacaaagaaagttgcgagatggcccaaacccacgagactactcttgcccgcgaagagatccggctgactgcgaccacggcaagcgagggagaagtgcctgcaaccaagctgacgaagaccgaagaaagtgatgccaagacaaaaaagattcccttagatccctctgatcttgataagactgctgtaataggcgctgagttagattgtaaataggaaagcgcgctcatcacctttcttcagaataataaagatatttttgcgtggaaaccatccgatatgcatggtatccccagagaggtgattgagcactctttacatgttaaggaagacgccaaacccatcaagcaacgactccgccgttttgcacaggataggaaggatgcgatcaaggaggaattaaccaagctgttagcagcaggcttcattaaggaagtccttcatcctgactggctagctaacccagtcttggttcggaaaaagacagggcaatggcgcatgtgtgtcgattataccgacctcaacaaatcttgtcccaaagacccttttgggttacctcgcattgaccaggtggttgattcaacggccggctgcgagttactcagcttcttggactgttactcgggatatcatcagatccgactaaaagaatccgactgcttgaagacctcgtttattacaccctttggggcctactgctacatcaccatgccctttggattgaagaatgcaggagcgacctatcaacgcatgattcaaagatgcttttcaactcagatcggtcgcaatgttgaagcttatgttgatgatgtagtcgtcaagaccaagcagaaggatgacctgattgcggatttagaagaaacttttacaagcattcatgctttcaagatgaaactaaacccggaaaagtgcatcttcggagtaccgtcagggagattgctcggatttatggtttctcaaagaggcatacaggccaacccggagaaaatcaacgccatcctcaacatgaaaccgccaagctcccgaaaagacgtccaaaagctgactggttgcatggcggcgctcagccggttcgtctcacgactcggtgagcaggggatgcccttcttcaagttgctgaagaagactaacaatttccagtggggacccgaagcacagaaagcctttgaagacttcaagaaacttctcaccactccaccagttttggcctcgccacatccgcaagagccgctactgttatatgtgtcggcgacctcccaggttgtgagtacggtcctggttgtcgagcgtgaagaggaaggccatattcaaaaagtccaacgtccaatttatttcgttagcgaggttttagcccactccaagacaagatatcctcaggttcaaaagttactatatggtgtcttaattaccgtcaggaaattatctcactactttcaaagtcacccggtcacggtagtcacatcgtttccactcagggatatactttataaccgcgaagcaaacggatggatcgcgaaatgggctttagaattgatgtcttcggacatatcgttcaagccacgaacttcgatcaagtcacaagctttagctgatttccttgccgagtggaccgagtgccaagaagacatgccagaggaaaagatggaatattggactatgcattttgatgggtcgaagaggcttacaggcactggagctggggttgttttaatctccccgactggagaaagattgggctacgtattgtggatacctttttctgcgtcccatgacgtggcggaatacgaggcactactccatggattaaggattgcaatctctttaggcattcgccgattaatcgtccttggagactctcagttggttgttaatcaagtcatgaaagagtggtcatgtctagatgataatatgaccgcttatcgacaagaggtacgcaagttggaaaataaattcgatggactcgagctcacccatgttctccgacataacaatgaggcagccgacagactggccaattttggttcaaaacgggaagcagctccttcagatgtgttcgtcgaacatctttacgaaccgaccgtacccagaaaagagacagtcaaagccatggatattcaaggcgtaagcatgatcgaagctgactggagagaaccatttacaaaatttctgagcaaacaagaactccctcaagacaaaaatgaagccgagcggatttccaggcgcaacagactttacattattcatgagactgagctgtacaagaaaagtccatcaggaatactgcagcgctgtgtgtctttggaagaagggagacagttgttgaaggatatacattctggtatttgtggtaatcatgctgctgcacggactattgtcggcaaagcttaccggcaaggttttttctggcctacagctgtgtccgatgcggacaagattgtgcggacatgcgaaggttgtcaattttttgccaggcaaactcatttgccagcccaagagttgcaaaccatcccgttgtcctggccgtttgcggtctgggggcttgacatggtcggcccgtttaaaagggcagtcggcggttacacgcatctctttgtggctatcgacaaattctccaagtggattgaggctaaaccggtcatcacaatcacagcagataaagctagagattttttcatcaacattgtgcatcggtttggggtacctaatcggatcatcactgataatggcactcaattcactggcggagcatttaaagacttttgtgaagacttcggcattaaaatttgttacgcctccgtggcacaccctatgagtaacggacaagtcgagcgcgctaacggcatgatactttaagggatcaaagcacgagtttttgaccgactacgtccctatgctggcaagtgggtagatcagctgccgtccgtactttggtatttacgcactactcctagtcgggctaccggccagtcgccgttctttttggtttatggcgcagaagcaatgttgccgagtgaagtggaatttgaatcactacgatttcggaacttcaacgaggagggctatgaagagggccgagtagacaacatcaatcgactagaagaagcccgagaagcagctttaattcagtcgactcgatatttgcaagggttgcgccgttatcataatcggaatgttcgatcgcgagcctttttagtcggcgacctggttctgaggaaaattcaaacaacacaggatcggcataaattatctcccttatgggaaggaccgttcataattgctgaagtcactcggccaggttcttatcgactcaagcgcgaagacgatactctcatcaacaattcttggaatattgaacaccttcgtcgattttacgcttaggcatttcgtttggatctttcctctttgactgctaacttcaagtttttccttgaagttttcagtcagggggctactataataataatggagtgtgatttttatcaattcaatttgcttacttgatttatcattgccctgtttggtctttcaacttagctaatgaggactgaaggtttttaatagcttttgcgggttttaggctcaataaggcttcacaaaggcttttaagaaatcagaagctaagtatggaacaccaagcatagcataaattcatcagtattgtacaaattgagcctccaccgtcattgatcatcaaaatcattgttatatcaatcagtatcagttttttcatcgttggacttatcaaacccagtcggctgaaggtcgacatcttggaatctctcaactacatcagcagcaatcttgtcagcggctttctgcgcattactgatgaggtcaagcgcagcttcttcgctcgtcctgtctgcaaagccatcaatggcatccatatcaacccttggataaagggatttggttatcaccaacgccagacttgctcccatacttccagcttctttgatgttcttgaaataagtatctggagcgactcttagcttgtcgaagatttcggtagcatcaagtgtactcgaaccggcgttattgaagaacatggcctggatgagtggagtagcggcattagcgactttatccctggctccttcaagcttgttgatcttgtcaactaagacatcaaactgtgcttgagatttgatcttgcggtctgcatcaacagattcacattaatgaatcagcatatagaagataatggctttcgaagtattgattattggtaccttcaacctcctttaaagccgaatccctctgtcttgccagctcagccttgtcattttccagagtttggatctgcttctctagttgagatatcttggcagcttgcactacattaacttcggttaatcaagattacagagataacagcgcaaatcagttgggcagagtttgcgcgaaccttttgatgagccactcagttcgaaattggactcctagagctcagcaatacgatccctcagatcgtgttcattcttcttggcaagttctctggcctcgtgcagttgactcctggtggcttcgagggttccaagatgaggactattctctctagggtcgcggttttcgcctcgttcctaagatgaatcagcgctcgagccagatggcaaacaagatggctgaggtcaggcgtcaaggaacttacatttacaatgcgagtcgcttggttgagtgcctttttcagtaggcagacctcttcgtcttctttttgccggtttattacaattccttgaggttgcaagttgtcatcccaccacttgaccagaatgggagggcacgaatcttcggttgctcgtatacgggggatttcttcttcatcaccaatcattggtcctaatgtattcactgacaaaggttagacaattgatcagagttattcaggtcaacatggtttcagacaaagtgtttacccgtattgatttctggacgaggatgagtggattcggatgcctttaaaggagatccagatctctggttattgctggcgttttgtccgcgagggctgtctgcttgggtttcgacttctggttatctcttggcttggccctgcgtccgactggtttccagtcgggggctcctgattaaatccggcttcggcttcggccgactggttccagtccggggttgatcaccggattctacattatcggttgccggctgattgtcctcggatgatccccagcagttggcccggtttctttggaagaacttgtgtccgtgttagtcgggtcagagtctttcccagacggatctatattagatggtttcctgcaaatttgattatcagtattattgccgcaatgggtgtgcatcaatgcaagagagatcgttatatgagttgcacctagaagacttcctgatctttggcacagggcgactggatgtttctcttccttggagtagcctgttttggtagtttcttggttgtctctcggtctccaggcctcctggtggtatcatcggcttcgtcatcacttagaaccagctttctctttcaagaatctgactggccgactggatcagaagcacttggttgagtttcagaccgaattcttggtcctccgctcccttgcccagtttgatggcggggagatcggcgttgagcgattgggggatccaacttcatcaaagcaaactcctgggtgtaatatccttcattgttaactgattcaacaagaaaacaagatcatattttgagaaaggttgaagtgtatgaatacgtaccggtggaggaggattgaatgcattgaacggtacgactggcagcaagtgtgagtagctgacaacgatggcgtttgagaagatcttatacatcctttccttcatgaccttgaagtcaagagaatctggatcttcacggtttgggtcatgcttgccgtcaaattcaaaggctgtgcgagatctttctttgattggagctaaccgacacttgataaagtgccgggtgatttgttctccttaaaggccctgctctttcagctttatcatcctctccatcagttctactgcttgtgcagcttcatctcccgttggcagtgagttccaagtatcccgataaactggaggaagacaggagtactcgggaagaacaggctcggggttttgaacataaaaccagtttgcgtgccagcctttatttgaggtcttgaagggcatggagaagtatttttggcttagtgttcccctgagttggaaaccagcacccccaacgacgcatggtttgctcttatttggctggggcttgaggaagaagatgcggcggaacaaggcgaaatgaggcctaatgcccagaaaagcttcgcatgcatgaataaaattggcaatatgcactatgaagtttggattcagatgatgcaagctaatcccgtagaagttcagaatgccccggaaaaatcttgaggttggaagagaaaatccgccatagaagaaatgagcaaatactacgatttcgtgtgtatcgggggtcgggaatgcctcaccaaatgccggtcgccacccaatgatctcttttgctggaagaacaccgtgcgccaccatttccttcagattgtcttccgtcacattggagggcgcccactgactctcgaagctttctctttcttccgccatgaatgtgaactggatggtctgatttagttcgagatatggctagaaagggatggggaatcggagcgatggatgcggggagaaattttgtaaagtttttgagagtggattggagcggattgatgaaccctagtttgcccggcgcagttttacactgtagcaggaaatggggaaaatggcgagagtctcggcggggaagacaaagagacgtttttcactttggtattattagggtatcgggagtactaatgggcctgggcctgtacagtacttcagcccaatactataatcagcgtggcctgttgtgatccctaaggacttaggcactttttgctttggcaatttgtgttcacaatggtgtggcccaatgctgttaaaatcctttttaacgcgatttaataattctttgaaattattatgatgcacataaaaaggtgcccgacagaaaggtgttatatccttttttgtaagctttattaggttgcaaaagctgtttgggttgatttgagatgactggtttattaatagtcattcttttagcatgttatatgcttattttggttatggtaagggtcacagcctaagctattagactcattaattaccatgattttctatcatgtttggtgggtcattttatgagatttttacccggattcctatcaaacatgtctatttctggacctttgagtgtttatcactcggcccttcttgtattttttgtccttggtgtgttcaagttgagaagcaggtggctgggtatcttactaagtaccatgcgtgcttcgctataaaaccacttggttcttgactatatgtttagtttttcaactaatcacatagtcgggggctacacctaattaggtgcatctactcgatgcaccatgttttattttcgcccttcacagtttttgatttttagtactcggcaagctagagcaagttgaattgaagcactcggactattgttttttgtttcgagaaggttatttcgtcaactgcgaaggtctcgggggctactgtggagattatggataccccatatctgtatgacagttatactttagtcggatatatggtaccaaatatagatagaatatctttatggggactcgggttagtttttaacttgtatgtcaaggaaatacccgggatcctagtcggttacgattgtattttatctataatcccatattccgttaggatatggactatattttgtaaagcggattccttcccctatataaggagggtccgtgtgcctcttgggggccggttcttttttccagtttatacaatcaataacacactcggcggaatcatccccggacaggagtagggtattacttcttgaataagaaggcctgaacctgtataaaattccttgtctccaaacccatccactttcctagcttgatagctaccctttttattattgccgaaatcttgtttcgacaatggaggatgaatggctttgtgtgaggggcaactttgtgtggtggttgcagcaagagggtgtcaccttcaggatccatgtcaatttcccctaacttgaaggttattttgtcttttaagtcgatcacttgatgcttcactctaaccactgacatcgtcctcaacatttcaactgattttagaggacatatataagttatcctcatgtccaattcagggcgattaaatcaagctaatcagtcactaggagcttagtactgaaacagtcttcatactttgaaagatcaaggaactcttttgcccttttttttttattaatttagaggtggtgtctctttgtgttctttagctcaaaatgcagaaagttaaaatgtcatatatgttaccactctagtcgagggagctattagaagttgcagcttctcatagaattttcatctctcctaaacggcctagattctaacctgtattatgagaatctatagttgtaaaatctagaaaataaactagaagttactatgagaagtggaagctgaaataaattgttcaccagtaaaatctatagtagtagaagctgaaaatttgttcaccagttgagaaactcaaccttttcaggttttcatggcttaaatatgttcttcaaagtccaaacaagtttgtgaatggacaattttctgtgcagtgtgccaaccattgttggttatgatgcagtagcctgaaggctatgaccagaatggtctttctgacgtcacaagtgaactgtgttgaaaccggagtgacaagcacatgcttttgcattaccatgagcaagaatttcaaagataactgaaaatgtgccctccactaagtgtgttcttcagagtcctctccttcctgcaagtctgaaccttgaaagatgataagctttgacccctaaataaaagatagaaaaaaactcgtgctggatctagttgcagttgaaccgtacatgctcattactcacatgcatgatgcatctccagcaatctctctgacagctgttgtctatagtactaaaaaaacccaaacatagggacaattatggttcattgtatctgattctgatctcacttctgctgaagacacacatattttagtatatctctctctttatttttgcatggtaagaagcgatatatcctactctctctagtttttaatatatgacattattaactcttaccataaatttatgaccatttatcttattaaaaattatgtaattaacatttattttgttgtgatctgttttgatactttaagaaagatttatattgttgcatatttctataactttttacctgaaatttatataatcttttaacaagacaaatgtttaaaagttaataatgttatgtatatattaagaagcggagggaacagcacacaagattactactatgaaaggggaaaaaaaacggtgaggatgtcatgcagccaatcagataagaagctcctgcaatcatgtggtcttgagaagaggcctaatctgtgaagcaacatctagaagctcacgtggtgaatttatatactattctttgaatgagtgaaaaagaagaggaggctcatcaccaaaagggtggccactagcaaccaatagtttcttggcagcgacatcaaaccacaacaactttcgctagcttttaggtcagcaattgcggttggcatccagcgaaaatatccggatgcaattcagggctatcttgctagcatatgtaccactgttttgtgtgcacaagctagtttgtaagagaagccttcctttcagacacctctttaattacaggcagtccaatatgctagtcacaaaggagtaagaatgaattttcgcgatggtcactgataagtgggtctgtggacgaattcgatgttttgcttggtccacttatctcaagatagtgagtatggaaaaatcgatgttactgttgcgcttaagatagtgagtatacatggaattttttgcgaagaagataattgaaatacttcaaacctccgggaatttgccccctccagagaattttacgctggcgtggccaccggcgtgtgccgacgcgtcagcgaggcgctggatggcgggtggtttttgcgagttctcgggcgtccgcgtcgtcgctggcgattttgcaaaaacgcccttcatttacctaataatttgtaataggtccctaggccttagttttaacgttgtgctttcttacttagaggacctctgaagaaaacaatattctataggaagaagcgaaaaatcaaaaaattggactgcgctctgaaaactagaaggttaggggtgtttttgcaaaacaaaaacaaccctaacccccttccccaaaccctagtactcttcaaaaggaatgaacttttggtgtccaatttacaatggttaattatgttgctgtctctcctcaccaaaaaaaaaaaaaaattatgttgctgtcatgctcatttgggcaaatcaggaagaccagtaaattgtttcttgcactcatgatgctgatggccatgcacatatagcactctcttgatctccaataatggctgaagatgtgagaaaggtcgccgtttgcatgatattctatattaatctcaaatgcgatagatcatcatgattaggaatatattcagataacatacaaaattaggcagcagaattgtcatcatatctctcttaatcaagtgacaccttatcagatctaggacctaattagggctctgaacctctgaaaattgcagaaatctctggatcaaaacctgtcgaaattaacaaggatgtaccacatgcacatgaaatgtgcatgtgtgcaaacagtcgcatgtacagtgttccgttttccttggtcaatttttgtacaccaaactttcaagttagtagttgaaaaacttatggtgctttagaaaataagggaaataaggttctatacatatatacttggagaagagaattagtatcgagttaacatgacaaacttataattacacaatttcaaagtgcagccctgaatgatttgagagaaatctgaatgaagataaccatagatgacttagcttctgattgactatccgagggacagtatttgaactacatggctaggacgaggagtcggactccaactcgagcaatcgcgcctgaaagcttgggcaacgacaaacctttaaacatgagaattcctgatgcttcacaaacctacaattgtaaattaagacattagatcgatcggacaccatgatcggttcatttcactagcttagcttgatcagcttgcatatctctattcctcaatcttcacttgctctttttatgagacaaactaccgcaggggatcacgattttgcgtaagatgtactgtttttttttaaaataataaaaatgatttccatctttggtctctgccaataggtatacaactataaataagatgtactcctttggtttcgtggaattattcagcacctaatatttgaagctcggttgtgagactaccattgcttggatgtgcgtacatgtcagcattcaatcttagcccgtaaatgtttagtcagctacttagttaaagttaaagttaatggatttcttttactttactccaagattaattggatcatccattttatgtagatccaatggttgatattcttattggtgttaaagtaatcgtacatcttgggaagtaattttgagtacccattgtttaaaaaaaatgctaggacaagagaattagtactctatccgtcccaaaataagtgcagttttgcactatttatgtccagcatttaaccgttcggcttatttgaaatttttttatgattaatatttttgttgttattggatgataaaacatgaatagtaatttatgtgtgactaattttttaaatttttcaaataagacggacaaacgtttaaacgttggatacggatatccacgactgcacttattttgggacggaggtaatattgagttaacataacatacttattacacagtttcagagtacatgactgaatgattggagataaaatcaaatatgtgaacttccaataattaaccctacttgtataaatcagccgttgtacagaacttttactaggaagtttttttttcttccaatttaccgcatagatacttctctcaggagtgtaggataaacacttgtatttctttcttaactgtaagttgctgcgtaatgaaacgaaaagctcagttacctctactctccctgctctgcttgtaccagaaatgagttctgattgaccatccgagggacagtaactgatccacataagagtcagactcaaatgaggggtttgctcctaaaacattgggtaattacgtaccaatgttttttaagcatgaaatttcctgatgcctcctgaacatataccattcttgcagagacgctaagctagatcaatcgggcaccacgaacggttcattgcagtagctgcagtttgcatctctatttctgaatcttcacctgctctttttatgggccaaattaactgcctgccataggagatcacgatattgcgtaagatatactgatttggtaatttcgtgcaattattcagcacctgcagatatttgaagaccatagttcgtaaatgtttagtcatctgctcacttcagtttaaagttatactagtaaacagtgggcaggtctggatcgttggatggtgatccaacagtctaaaatccaattcattttattcttaacaaaacagttacattgctccacagacaggcctactcaaatttaccattccactttgaaccagggattgaaatttcgccccccaccggtaagcacatatctcacatgcatataacattatcattttgaaaaactaagacgaattgcaaccaattaataccacaatgtttctatctattatagtgtatgctaggttcacagtaacccaacaactccagatgcctcctaggcctatcctagccaacaagtaactctcattccatgaaatccacgtgaatttgaacaaccattttaaatgagtccttttttcccttctcagcactcctaactcaaagatattgcatgactagtttagcgattttcttatagatgatgcaagagtgtttcctcgtttttttttctaaaactccaacaagatacaaatgtttcctcgttttccgttaacacacttttcaaactgctaaacaatgtgtttttagtataaaaactttctacatagaagttgctaaaaaatagaataaatctctttttcaagtttttaataattaaaattcgattaattatgtggtaatgacttatgtcttttgcgtgtgcacttaatcttcatccatattggagaatcgaacgagacctgtgtgatacctttggtctctgcatcaaggatgcatagaacagtctgttcacacaagtggacagagtgcccacaagatatacccctccatataaagaatccattaggcaatttggtgacaattaatactgcacttcctctctatagctagtagttgtagttgttgactttatttgcagtcttgcttaaagtaattgttcatctctgcaagtaattaattttgggtaataataactcttgtatatgatgtctacactagtatgttccttgcttgcactcatggtcttgatgacttcatgcaccctccatttgtgaaacgaatggaacattgccatcaactagcttgtgtacaaaagtcaggtcaagaactcactcatctcagggctctaagatgttggaaaaatatctggatatgaatacacacattattaatgttgaactttattattctttggtattttcatttgtgccaattttatccacaagtataactaaatggcatgcctatcccaagttccaaaacctacacattcaagaagtcgtcacaacgattagagaagaaataaatgtcgtatattttaagattgcctgaatgaaggtagcatatttgtgttgcctctctccaagttttgcacaaggtagatatatcattaggggtataacaaatgggtatactatccgagtcaatccgaagtacataactagaaagaaagacaaaggtaggaacttgcatataatggcatctaccatggggcatctctttccaaattcctaagggcatcaccaatgtatatttaccaactacgccctccattccaaatcgatctacatatatttttttaaggttattcctaaataatctatatatttgtgttcatttattaagtctattcgttatttatgcattggagtaaatggatattgattcatgcatccatgcacacaagtatttataccacacatgcaatatcttgatttgctattggctaggaagtagtggggatgatgcatgaattgagtttgttgctagagtaaatatagtatgagagagttattagcttttcttggtcttgttgtacctatgaaatatgtagatcaatttagaatggagggagtatgtcggagatatgggcccgggggtatacgaagtgaggggaatctaccttcccatcctgccacgtatccctatagcctggtcctgtccccgcattccgcgaaccgcaggagcggccggggagtcggggcctcggggtgccacatcatgcccctcgggcccttgcacttcttcgcctcgaggccctcgcccagccgccgtttggcggggggagcaagcgaggagggggcccaggctgaacttcctttaatgcgtgcagcgccccaactgccccctatcgcatttaatgcagtggggcaaacgtgcggcgtgctaaactgacgcacaatggtcaagaatgaccggtctgtgaccggcctgacgccggtcacgtctgactggacggacaaccgtgctcccacgtcgcatctgcttccggcggagtggaggtaggtatgacccgtcccatcggggggtcattcggacggcggccaccacaagtcttcacctattaatgagggaatgacagggctgttccccatgtcaggcgagggacgacgctgggccccgctcaaggacaagctgtggtttagcttccaggcgaaggcacgggtggagttccagtcaagatagggtgggtccccacccgaaagaagagtaggtagaggcggtgcatgtggtatccccttgaggtataaaaggaggaccttgcccaccgagaaagtggatgactctcagaaaatctgagcttgtggaggagggaagtaagaatgttctcccgagtttaggaactgttgtaactctcagtctaaatcccacacacaggagtagggtattacgcttcatagcggcccgaacctgtataatttggttgtgtgcgagctagctaggagccttggggatggatacgcgatttctagaggcgagcttcttcccccggccgaactcatgaagggaggggggtctcacgatcttctgctagagaggatcactcctcgacagctggtgcgccaggtagggggaagtcgtgcgctttaacgagaagtcgtttccttccgtcccaagtttcccttgaccctcgatgatcatggtcgaggtcctggaggaggaggcggtggtgttcacccccacttcgtctgggagtgaggatgctagcgagagccacggccctcgtcaccaccgccgcaactctccaactcctccccgccacgacccctcgcggagggaggaccccaaccgttcgggtggtttggccctctccccgcccccgggtggagggaggccacgacgcatcggggcatggcgccgcctcacttacggtgacggcggctcgccccgaggcacgcttcaggcggcgggtgcccttctgcggcatccccccgtgaactcggagccggagacccctgtccagcgctggttggacgacgtggccaaattggtcaccactgcccagcggcagttggccgcgggcggccgacccgccgtcaccggtacgtcgcgtacccccattaccctctcctcgtcagcgaggaggagggcccgtcgatcagccacggcctcgaggcggtccacggctccaacatcgtcgggggcctcgggaagccggaggtgtcccgatagtctctacggggagcaggatgctcgaatcaatatcgagcgacgccgggacgagcgccgagctacccgcatgggggaaggcgcctcctcatctggagtgccgcgttcctcctcacgagacagccctccccccacgctcacccctggagggactggttgtagggccttcgtggcgagtcttcggaatgtccggttgcccccgaagtttcgccccaacctcacggagaagtatgatggcagcatgaatccctccgagttcctccagatctaaaccacgatcatcgtggcagcagggggcgatgactgggtcatggcgaattatttccccatggccctcaagggtcaggcgtgcggctggctgatgacccagccccccgactccatccactcttgggaggacctgtaccagcagttcgtcacaaactttcagggcacatatccccgcccaagagaagaggcggacctgcacgctgtgcggcggaaggacgatgagtccctccgctcgtacatacagcgcttctgccaggtccgcaacactattccatgcattccggcccatgcggtcgtttatgcgtttcggaatggcgtgcggcataaccgcatgctggagaagatcgcctccaaggagaccaagatcaccgccgagctcttcgagctggcggacaaggtggctcggaaggaggaggtgtgggcctggaactcccccggcaccggcgcggcggctgcggctacccccgagtctgttcccctctctaagcggcgagataggaggggcaaaaggaaaccggcccgctccgatgacgagggccatgtccttgcggctgatgggcccacacgggccccgcgcaagggaaaggccaccggcgacaagccgagctccactgctccatccggcgagggccgatcggcagacaagtggtgctcggtgcacaacacttatcggcacaatctcgccgactgccgctcggtcaagaatttggccgagcggttccagaaagccgatgaggagaagcggcagggtcgacgagagggcaaagcccccgcgaccccaaccgaagacctgcgaggggaggccaagaagaaggctcccgccgatgatggcgataacagcgaggatctggagttccagatacctcagggaaccgtcgccacaatcgaccggggggaggagggggcttgcgttcacacctcccgccgaggcttcaaggctatgaggcgagagcttctggccgccgtcccgacccacgaagcggctcggaaggcacgctggtcggaggtgaagctcacctttgaccaagagcgaccatccaacagtgctcgctcgaggtggaaagttggccctcgtggtctccctgaccattcacaacattaggatgaagcgcgtcctggttgacgggggggccagcctgagcatcatctccccagccgccttcgatgcgttcaaggccccggggatgaagctccagccgcgctgccggtcatcggcgtgactccgggacacacatggcccctcggccacgttgagctctcggtaaccttcggcgactccaccaacttccgtaccgagcggatcgacttcgatgtggcggaccttaatctgccctacaacgcggtcctgggcagacctgcgttggtgaagttcatggccgccacccactacgcctacctccagataaagatgctgggccctagtggtcccatcaccgtctttggcaatgtcaaagtcgccctcacctgcgcggagcagcgcgccgacaacctggcagtggccacggagccacaggccccggaggcctccgcatcccgcgcctccaagaagcgcctcacctcggctgacgaggtgcccgtcaaggagatcccccttggcgacgatccgtccaagaccgccaaaattggcgggaccctggacgccaaataggaaagcgcgctcgtcttcttcctgcgggcaaactccgacgtctttgcatggaagccgtcggacatgcccggggtccctagggaggtgatcgagcaccgcctcaccgtgcggccggatgcgcgatccgtccggcaaaaagtgcagcgtcaagccccggagcagcaggccttcatccgagaggaagtggcgcggctcctggaggctgacttcatccgcgaggttatccatccagagtggttggcgaacccggtggtcgtcccgaaggccaacggcaagctccggatgtgcatcgactatacggatctcaacaaggcatgccctaaagatccctgccctttaccacgcatagatcagatagtcgactccactgtggggtgcgaccttttgtgttttctagatgcctactctgggtatcaccagatctgcatggctagggaagatgaggaaaaactgcctttattactcctgtgggcaccttttgttatacaactatgccttttgggttaaagaatgcaggccctagttttcagcgtatgactcgtattactttgagtaatcagatagggcgcaatatagaggcgtatgtcgatgacctggtggtaaagacgcgccactaggacacgttgttgcaggatttggccgagactttcgacagtcttagatccacacgcgtgaaactgaacgccgacaagtgtgttcggtgtgccggcgggcaaactccttggttttctagtctcctcccgaggcatagaagctaatcccaagaaaatacacgcgatagagaggatgcgcccccccagcaagcttagggatgtgcagtgcgtcagtggatgcatggccgccctaagtcggtttatatcgaggctgggagagagggcgctgcccctattcaagctcctcaagcgctccaggccatttgtgtggacggaggaagctgagcaagctctcaatcagctgaaagcttacctcatctcctccccccatcttggttgccccggggccggagaaaccgttgctgctctacttagttgcgatcccccatgcggtgagtgccgtcctagtagtcgagcgcgaagagagcggaccggaggcccccttgactcacgatggcccttcgtcccccgaagacccggtgcccgaagcccccaacccccaggaggaccccgaggcccccgtgggaggaggggaggctttggcgagtgttcccgaggcctatggtcctgacatgactcgagacccccccggggcccctaggcaagggcgccccagatcatctgcccctggcagcacggaccggctccaccgaaaggtgcagcggcccatctactttgtcagtgaggcactccgagaggcgaagacccgatatccacaggcccagaagatgctttatgcaatcttaatggcctcaaggaaattgcaccactacttctaagcacatcgggtttccatagtgacatcctaccatctcagccaaatcttgcacaaccaagagggtaccggtcgggtcgtaaagtgggccatcgagcttgctgagttcgacctgcacttcgaaccacggcacgcgatcaaaagctaggtcctagctgacttcatcgcggagtggaccccagtggatgaccctgttccgtccaacgttccctccctccccggagatggagaggacccaaacaccgacattcgtggtgggcactgggttatgcatttcgacggctccctcaaccttcaaggtgcaggtgccggagtcacgttgacttcgccaagcggggacgtcctcaaatacgtcgttcggctcgacttccgagccacgaacaacatggcggaatacgaaggactcctcgcggggttgagggcggcggccggaatgggcatccgccgtctcctggtcctaggcgattcccagctggtcgtgaatcaagtatccaaagagtaccagtgcaccgatccacaaatggacgcatatgtccgcgaagtgcggcgcatggaacgccacttcgacggactcgagctccggcacgtgccccgacgcgacaacacagtcgctgatgagttgtcgcgtgttgcgtcggcacgagccccactccccctgggaccttcgtggaaagactcgcacagccgtcggcgcgaccgaaccccacgagggaccccgacaccacgccctccgccccgacccttggcgacctgcgggcctcggggcccgagggggtcgaccacgacccccctcgtcaggttgtttggatgactgacatccgggcgtatctcgacaaaaatactcttcctgaggatcgcgcagaagttgagaagctcgcgcgcatctccaagcggtacgtgcttgtagaagggaccctctaccggcgtgccgccaacgggatactcttgaagtgtgtttctcgggagtaaggcatcgagctcatagctgacacccatcagggtgagtgcggggtccattcggcctcacgcactttagtcggtaaagccttccgacaaggtttttactggccgactgcgttgcaagatgcccaagaatgggtccggcggtgcaaggcgtgccagtttcatgccaagcaagcccaccagccggcccaagccttgcaggtcatcccactcccttggcctttcacggtctgggggctagacatccttggaccattcaaagcggctcgaggcgggtatcagcacctatacgtcgctatcgacaagttcaccaagtggcccgaagcttacccggtcgtcaagatcgacaagcattccgccctcaagttcatcaggggcatcacgtcctgattcggagtgcccaaccgtatcattacagataacggcacccagttcaccagtgagctgttcggcgactattgcgacgacatgggcatcaaattgtgctttgcctcgcccgcccaccccaagagcaacggccaagtcgagcgagccaacgccgaaatcctcaaaggcctcaagaccaagacgtacaacgtcctgaagaaacacggggattcgtggctcgaggagttgcccgccgtgttgtgggcaaatcggactactccaagtcgtgccacgggggaaacgccctttttcctggtgtatggcgccaaggcggtcctaccttcggagctttccttgggatcgcctcgcgtcgcgctgtacgatgaggccaagcaggatgatcttcgccgcgacgacctcgactattttgaagagcggagaaggcgcgcggccctacgtgcggcgcgctaccaacaaagcctgcggcgctaccatcagcgccacgtccgggaccggtcactgaaagttggcgacgtcgtcctatgccgcgtgcagtcgcgtctggggctaagcaagctctcgccaatgtgggaagggccatacaaagtgatcggcgttctccggctaggctctgttcgactaaccacagaggacggcacggagttgcctaacccctggaatatcgaacacctccatcgcttctatccatagcgtcgcgattttttgctttccaggagcttgggccaacccccgcacaacccctcggcttgtgcggggttggacgggggctactgctgtgaattactttgtatctttttccctttccaggcaataaattttttccacctaaagtggaggccgttacgccccctttttctcactctttcctctggcttgtcctggttcaaaggacagttcgcgcttactccaaaccctaagtggcattgggcgacctgaaaagcgccgaaagggagcctaaatgagggccgcgtcctaggttgcgccgaaccccaggggctcggaagggcctacacacggccgtcctcgacccccggtcgtcgtagcctcggtctggccagtcccgctgggcggctccctcggggcgacggtcttgcccctcagtacttaggtaccacgaaccgagcgcgcatttatcttttcacaagaacgagcccgagggggggggggggtgggggcgggggcggatggggtaaaaacggcatttcgatcacagggaggttaattatatacttttgctcttgttttttcttctttccgtgccgcaggcattcaatggagaaagtaaaggggtagaaagtgcgaaggggaagctttatttacagacaagacggcacgatggcctaaagacaagaagtgtccgctgcaggcacacaacaaaaggaaattaaaagtggggataatcacggagtgcccgggcccccgaggccggcgctgctaaccacgtcgtcccagtcctcgccgtcgatgtcatcaccaccgtctccgttcctgctctcctcgtccgaggcaagcccgaaggtgaaccgaggggccgacccctcgaagttagagacgatcgcgtcggccgcctcccggacttgctcccgagcctttgcctcggtccccggggggaaatcctcgagtgcgcgccatgggacgaagtcagggtcgcgggcttggtggcttgcgaggaccagttccaccgcggcccgcgccaaggaagccgacgacgatttcacggtctcgccgacctcctcctccagcctctctagatccgccgccagcccgtccagccagagcgcgagtgctggttgtgtgggcgggagcttgctatcccagcgcacggagatgccgactcggcgccccgcgtgctccagtcgatcgacggcatcggagagctgcccgggtccgatctcgttggtaaggcggaggccgcgatctccccagccttgtcttgcaccaggcgctctaggtcggcaagagtgctctgagccgcggtaagctggctcaccaactctgcgtcaccaggctgcccacccgccaccaggtccttctcctgggcctccagctcagaagcccttgccgccatcgccgcgcactcggcacgagcactctccagatgccgagcctcgcgcccggcaacggcctcctcgcgtttcgcgagttgctcgcccagccggcgcaaggccacctcacggcggttcacctcggcttcgcgctcggcacgcctcttcccggagccgtagctcctccgcgcgacgggcctccgaagctttcgcggcgagggtggtccggtcacgctcggctgtggcctcctcacgaaggccaagggaggcctccgtctccgccgccgttctctcgtgggcggccaaggtggactcccgctgatctagcaggcacgctcgctcctccagcgcctgagcccgcctctctagctcatgggctcgctgtgcctgttcctggctgcgctcgtcctgctcgcgctggctccggtcaaggacctcaattcaccgacgaatcgtggcctcaaactcctgcgcggagcgggcatgctcatctaaggccatgcgttcagcctcgagcgctgccgtccgagcccgcagcgaggcatcggcctccaatacccgctgctcttgggcggcagctgcatcaaggactacgcgggcgtccttaaccctcttcgccaggtcctcggcatgggcctcgtactataggcggatgtcgcccaacgcttcatccaggacgcttgaggcaatcagtgctgcctgccgctcttcctccgtctcccgcatgacgatgtccagcgtctcctcgcgcgcctggatttcagccagttgggcttggcacattttgcgtcccaccttcaccatgtcgtccacggcgcggcgcccctcgtcaacccgcgcgcggtccgcagcgagctgtgcccactctgcctccagggctgctcgctcttccgccagggcttgaacttgggcattgagcccctcccggacggtggaatcggcggcggcgagcacctgcaggagtggctccatacttgccggagtcggagaagaaaaagttgcggtccacccccgggacgacggagtgctgctggatcccccgcgagattgggggctgctctcagcccaccttctgcgcggccagccccgagggcgccccaagtgcaagggggagtggctgttcctctcgccccccgcttcgggccctcgggtagattcggcctcgggctcgggctcgggcccgcccctagtttcggcctcggcctcgggcttagggccgcctccagccttggcttccgggccgcgacctccctcggcccccgctcccgggtggcgctccgcatggatccgagcctcgaagtcgcccccgggagaaacgctgccgccgcgagcgatagcattcggactttgtcccctacaaagggtcgaaccccgagatcccatgggaagtaatctcgctacagaagaaccctgatcgcgttaacaaagaaaaaaagaggaaggaacaagagaccaagatgagtaaaaagcaccgaagcgggtgccggcagtcatacctgcggggagggcggttgaaagtccacttcgggggctcaatgaagctcccccgacacggctccgtttgacctatcttccggagccgcttcttcttccatccagcctcgggcgcggcagggtgcttgtggcccgccggcggtcggtccgccacgcgctcggcgcccccttcgcgcgggggagagggcggtcgagatttggacatcttccgcttcccttttgggtcgctggccgagtcgatcccgggtccacggctcgggccgggtgccctggagctgccacccccgccggagccgctggtccgactcccgcctacggtcgcgccaccgctacccacgccgacagcgccgtcaccggcgccgccccggcgggaccgacccctgccggcgccgacggccgacatcacagccatgatactctcccggtcgcggtcgctgcagaggggaaggatcccgtctggaatcagtgtttgctcggcggtgtccagacccagcacccgtcgaatcaccgtcttcgtgtcctcctcgccccatcccagcgctcgcccacatgcgtgcgcatgggatcgttgggtccagagtactcccacgcgccatgggatcgatcttggagaggcgcgatgcggtggcggaagtaatcgctaaagaccatagcccctgtgaggcccaggcttcgcaggcccctaaggtgatcccgcactgcgtcgtacttctcgcccagctctgaaaccgccagccatgcggcggatcgttcgggagggccgccggggagccgaagtcgccggtggtccggcagcgcggtgtagaaccagtccttcttccagtcctcccatttcttgcggagatgactctcgatgtattgccccgctgtgcctggccggggctagaagtaacatccccccaccaccacaccttgtagcagctgcgggacgaagaaagactagaacagccgcatcgttggccgcaccccgatgaacatctcgcacaaatgagcgaagatggccagcgtcatcacgacgttgggtgcgagttgcaaggcatggatttcgtagaaatccaaaacctcatggaagaatccggagaatggcgggatcaaccctgccatagcaaaggacatgaggtgcacggatctctccgggtaccgcggccgcggccgcgactcccctgccctcacggcggcgtcttccggcatgatcttgcgggggagactaaggtgtctatccgtcataatacgcgatgccggaagcactgcgtcgctggcatcttgagccatcatgaccggcggagaaacgacgaggggcttgatgagcggagtagcgtggagtggcgagaatgttagggcttagggagcgagtgtgcagttggcgaaaggaaggaggcaaagtccccgcctccgtatccttttatccctgcctcgccctcgctcgcctccttgtttcacgccctctcggttgcccccacgattctcgcgcctgcagtcgcctcgtcatttcctacgaccactcatcatgttgcccactgaatccgcgccccgcatttagtgcgcctgtcagcggcacactcggcgtagggcgtgcgatggtcacgggcgtaatctgggcaaaccgtcactagtaccgccgcatgcgtggcaggcgagggagtcgaggtgtggtccaactaaccccctgattttcacgccttaagcatcctcatcatcagcgcggtctgtggtggtcaaaccgctgttgttgttgatacgccaacctggccatgcggcggcatccgcttagattccctgccaggcccacaaccccagcttgggaagtcgtgaggcaccacgtcagaccgacctcaggaggccaatgtccgatgtggtgccgagggctactgtcggagatatgggcccgggggtatgcgaagtgaggggaatctaccttcccatcctaccacgtgtccctacagcctggtcctgtccttgcattccgcgaaccgcaggagcggccggggggtcggggcctcggggtgccacgtcatgcccctcgggcccttgcactgcttcgccctgaggccctcgcccagccgccatttggcggggggagcaagcgaggagggggcccaggctgaacttcctttaatgcgcgcagcgccccaactgccccctgtcgcatttaatgcagtggggcagatgtgcggcgtgctaaactgacgcgcgatggtcaagaatgaccggtctgtgaccggcctgacaccggtcacgtctgactggatggacaaccgtgctcccacgtcgcatctgcttccggcggagtggaggtaggtatgacccgtcccatcggggggtcattcggacggcggccaccacaagtcttcacctattaatgagggaatgacagggctgtcccccgtgtcaggcgagggacggtgctgggccccgctcaaggacaagctgtggtttagcttccaggcgaaagcacgggtcgagttccagtcaagatagggtgggtccccacccgaaagaagagtaggtagaggcggtgcatgtgttattcccttgaggtataaaaggaggaccttgcccaccgagaaagtggacgactctcagaaaatctgagcttgtggaggagggaagtaagaatgttcttccgagtttaggaacccttgtaactctcagtctaaatcctacacacaggagtagggtattacgcttcatagcggcccgaacatgtataatttggttgtgtgcaagctagctaggagtcttggggatggatacgcgatttctagaggcgagcttctttccccggccaaactcacgaaaggagggtctcacgatctcccgctagagaggatcactcctcgacagagtagtaaataaggtgggacctagtaaaagtaggtatttgttgttaaaagttccacaatgtataactagtaataaggtgggcccaagccaatagcatgaagggagagtgatgaggatcaatacatgccaaaagaataaatgtttttttactccttactactaggttgtagtgctcttgcttggtagtagctatttactggttccacaatgcttactacctggtatgaagattaaaatattgcctattacttggtttgggagcacattgtggatgccttaagagatgacatattcctatgagagctccagattcctgccaagcctaccatatacaacagtcgcagaagcatctccatgatctaactgttcgtctattacatattactttctagtactagctatcagctatgtactagtgtatatatatatatatatatatatatatatatatatatatatatatatatatatatatatatatatatatatataaatatagagaccaagagagtaagagagatcgacaataggattgggccatagaaagctgggatcaaatctagcagcaatactgagcatcccttcaagaaggtgtatacatgaaaatatggcacctcgttgggccaatgccaaagctctaattttgcccaaagaccaatgacttgacaaacttactaggaacatgcagaaaactgattgtgcatcagagttatcaggcatgaggtcgtttctttaattccttggaatgatcaagcaaaattcgttgtcctgttttctgttcatgaagtgtacttgagtaagtgaaacaaaatcggttgttgttttataaactttggctttcaggaacgtaatacataaatatatgttgtctatgcagttaagaaaatccggaaattcaggatgatgatgcattaatccattgagaaaattcttagcagttacttgatactacctccgtcccagtatataagtaatttttgagttggatacggttattaagaaagtaggtaaaattaaatagggagagattgtaattggttgagaagtaaaggtatgtggaaaaaatgaatgatggagggttgtgattgggttgggaatggaatgttggtagaaaagttgttgtattttgagataaattctgagtgctaaaagttgttatattttaggacggagggagtacaagttaaacactgcaattctttaaatataatctatctgtattacacatcaagctcatgtattttcagttcatgacattattatgggcattgggcta

SEQ ID NO: 72893 - DNA, 740 bp, Oryza sativa
cgctggccgcctcatcctccgccatggcctccaccaccactcactcgctcctcccgctctccggttcaacctgcgaggttgcggaaggaagaagacgacgctgaggtgagctgaggtgaggcgagtggagtggaggtaggaggaggaaatcttggaggtagaaagagctcacccgagctcagctgagcaggagcacgccaagagagccgccgctggagctgaagctcaggtgtgtggtggttggtcgctggttggtggtggtggtggtcggagacgacgacacgttcggccgtcgcggaaggaatgggccgggcccttcttgggcctcaaacatgggccgccttcttgggcctcaaacattctgttgagcttccatgcttaactcttttttttttattacacgtcatatgcgcgcacacgtatcactacgcatgccaatgaatacaccctcctaaccatgctcaaagagtccgaaatcagcggcatattcttgctctcactaaaacccattgaaagtccatttacatttgcgtaatactcgtgagcattaggatttaaaccatggtgggtggattcatgtatccacaacttcaacacatattactggtgcttccctaagttttttttttattacgttcattctttttctgaatgatcaagttattctgaatccagtaaatattggaggggagtagaaacaactgaatttagtgaaaaagaaacctatcttgcttgtcatt

SEQ ID NO: 72894 - DNA, 10244 bp, Oryza sativa
accaaaaatatgaagaatcattgcttagctcctagaaacaaccacatccgaagtgtataccttctggcttatctcgctctcaaaacaggaggctacagcgtcttcgagccataggtcaaaaagaaaaggaggccgaagatgtggagaataaaatatgtaataatttagagcctcgaacgacacctaagcgagtgtggagacctaaagaagtaaaaagtaagagatcggtgatttcccaaagtagggataaatccaatttgatgagagaagaatcatcggtcattagagataagtctccttcacatgatgcaatggatgttggtgcggtgttcgtcttgcctttgaaatcgtgcaatcaagaaagccgattttgcttggggggcaagacattatatgctcatgagggaaccaagagaagatgaatggcgatggatatgacatcacatctttgagccaccgtttgtcggatgctaaggcaaggtatgggtttattgtgttcaacattatattatatgcctatgccatgttagaacattgcttgctatctagcacatgtgtgttttgcttatcaaattgatattatacatacatgttgcaaatgccagttctaggtagtagaattggtaggttggcatataatttgtttgaagtatgatttggctcatgactctttgatatttatttaaagccaaatcatatgtgtttttatggatcaccatgtaagatatagatttcatatttattgcaccatgaaagttttgcttactcgtaattcggctaatgtcaatggtcaatgtgatgatttgctctagagtggttttctttaggaacattggcattgttaatattttacatacatgctcaagctgattacttacatttgtagtttattggaatctgtacatgtgacacatatgactttggtgattcattattgattatacttcaattggctaagtgttttgatgtcatgatgattattgtttcaaaagccaattgaattagtattcatctagacatattagttgaatgttataatttttcatatgtctagagagaagaagttttggtccaataatttgatgcaccaagcatctggctattatgtgaagaaaaattatatactaaaggccgatgcttgatttcaaaagtttggacgaaattggcaaagtcatagaccaggggtggtctgaccggcattgcacagcggtctgaccggtggtacctgcggtctgaccggctctgcatggccggtctgaccgggcagacagggtggtctgaccggcattgcgtggccggtctgaccaatcccgggcagagagctggggggcacgttacaattgatttaaagaccggattaattgtgaattcggatatttgtgcccataagtcagaaatagattggagaatccctttgaatagaatatttgaaaggtcctagtcttggggttgatcggaagattctgtggtaagcgttcaaatattatatcgccgaaatatagatggagtgctattgatgtgtttagacaatgatcaatctaaagttgctaggggagatgtgcatgaagggatttgtggagttcatcaatcggcccataagatgaattggttgcttagaagagtggaattctattggccgaaagtaattgatgattatttcaagtgctacagagggagtgaaacttgtcaatggatcggcaatgttcatttggcgcatgtcgctatattgaatcctatcatcaaaccatggccgttccgaggtagggctttggttttcattggtcagatttatccatcgttatcaaaagggcattggtttgtgctagttgcaatggattacttcactaagtgggccgaagccgtgccgctcgagaatattacttgtacgaagttgaggtaaatcttggctctcttcggtatttcaagcaagacgacttgtcggttggagattacaagaccttgatgggaattttgaagacgtcatcgacaagcgtttgaagactttgaaggaatgaagatgcttcaagatggtgttttcagagagcaattaatgggaaatacttgaagaaatacttcccgagcatttggcaaaatgcttaggaagtcctatggccggtaattggattatcgccctaagacaacatgttctatgcttttagaatcacgatgttcatcaaaaaggcaggggggcatgtgtttacacccaaatttggcacctatggacgaaatagaggaaaattgccaaagtttggaaagtgctgggtttccttcacagggtcggtcagaccgcaggtgtatgggcggtctgaccggctagtagggccggtctgaccgcaggttcgtcgggtctcgggtttcctttctcgggaaggcatgtttcgtgtttcctttggtttctatcctgagttggacgtggagaagggcctgtagagggcaagaccaacccctatttaagggacaaggccggttcattgtaaaaccccccgaatacaatctacttgaatcgttcttttactatgttttctattttaccctagttttagtccatctttgtcggtttgcgccgtaaaccgtccgccgccgctgcgagagtgcgacacctctttgtaggtttgtcctgaaaaccttccgttttgcccacgagacgggtagttatcctcatatcgatataaatcagcctagaggctgattttgatctctaaatcggctccgctagccgatttagcttttctttttgcaaaatccatcttgatttggccctttggctagatcggggtggttggcgactccatatcaccgcaaggcgtttaggtgttgcggtcgtgcttgtcgacttgtcaaaaaagttgccaacaccagcatctgaatctcatgagcttgttctactacagaacggtcatcgaccatcttgtagtcatagaactgctccatgacatacagctcactaccggcgtcagaaactccgaacttggcctcaagtgcatcccacatgtccttcccagaaggcatgtgcatgtacacgtccactatgttgtcagcgagtacactgatcaatgctccccggaacaggcaatccgaagcctcgaacttagcctcttcctcaggagaaagaggtggttcacttcgtttgccccgtgaaacatagaagcactgcatcgctgtcaaccacaatagtgcacgtgctttccatctcttatagttagaaccatcaaaagcatgtggtttcagtgcagcagcaaagccaactaccgaaaatggcctatcaggtttttggattgttggaaatatggtcatgaatcggcatattttaatccaaaatgttaagacaataatcatggcataagcagtgtagggtgatctagtgacaacatgtaacataaccagtagcatactaaagacatcatgcgcatcatgaatatcacgaacaagaacatagcagtaacgcaatagcatgctagaggcattattcatgaatatcaggaacaggaacatagcagtaaagcgctaacaacgggaacaggaacaggaacatagcagtaaagcgctaacaacgggaacaggaacaggaacatagcagtaaagcgctaacaacgggaacaggaacaggagaaggatataccccgagaatggccctccgctagattgtgaggcagaattgcctccgttggtgttgttgttcgcgccaccggctccagctcctggcgcaccacctccggctccagctcctggtggcgcaccacctccgccatctcctccagcagcagcagcggcgccggctccaggcgcagacatggtggggcgagaacgagcagtcgtgcggaagcactctgtaacataccgaaaattaaccattttctaattctgcatcatgctgagtcttatgttcttaataacttcctaaacctaggaaaatataattagagggaccttctaaaactaacttgcataaaatctctttctggtattaacttcttttgtgtttttcatttaaaatacatgtggttgaattgaggtatttcttgatttggtttaaaaccttcttttgactaaaatttctttattcaaaattagtttgaaaaccctttctatttttttttatggattatggtccaagaaaccttcctaatttttttcccttgaacctaaaccaaagtaattccaattttattggaattaattattagcccattctttgatcttaaacccatcctttgattctcgatacaaatatccaaattcttccttttgatctagccactgatttaattcctgtggcttcatttcctcttcggcacaagaatagtattattgcaaatattgtgaataattgctcttgtgctaagaaaataccaatttatattctttactcaactttccctattagccacaaataattcttcaaatacttctactatcaaatttaggattcaaatcctatttatctgcctctatttattacccctacctttcatttgagtgcatcaaatttcaatatattttatctccaaattattgcactcaaaataaattgggaaaaatatctcctttgttagctttctccaaatttaaattctcttcaaaccaaaccattcaaattcctttcaaaattgagaaaccaattctacttaaattgggccgaaattctttttctccttcggcccaagccggcccaacacccagccgagccgccaacttgcgccgccgctgacaccgtgccgtgttcgtccttctccgccgctgccgtgccttgccctcctcctccgccgttttctccttctctaagaaaccgtcgctgctgcccttccttcgccgccaagtcgcgccgacgccgtgccgtgtcctcccttcccagccgcccaactccctggcagccgacgtgtgtgcgcgccgccgtcgacatccaatcggagcacagagccgacgccgtcattttcttttccacggcgccgtcacgaagttctccttgatcttcccctctggaaccgccttgcgccaccgccttttgccacctataagtattcggcgaggctgccccttttcccctccacaccatcgagctctccgagctccttctctcctggccattaccggccaccaccatcattggccgatctccctcaccggagtaataccggccaatacctcgcgccatcgagctttcctcgatgagaggattccatttttcccctttcccctctcctttagccaccggcaccacccatcaccgccacccaccattgccggccgaagagagctcttgttgtcgccgttccggcatcctccctctccctctctgccagctaccgacttccctggatgcgcggtactcgggaacactacccgacaccggcgtcgccgtcttcaaactaccgaagagccggcgcccctcctccctctctcccttctgttacccggctggaaggaggagaaagaaaggaacgggaggaagaagaagaaggaaaagaaaaagaaaaagaaaggctgacaggtgggcccctgcacagtaactcttcgtattttctctatttaattcaaatcctaatctttagaagcctatatctcctaaaccgtagatccgattccagtcaaacttggacctaaattcatataaactcaaaatctatattttgataccaaatttgctattttaagattttatttgaatttccttaatttattcaaatactatttgaataaatatttgattaaatcttataattgaatttacaacttaaatttatatttgcttttcaaatattttcttttattccaaattacccctttagccactaaaaagccgccggtggaactttacgtcttccatggggacgttcgcggtttactatccccgacgtcggaccgttggttgtaaagcccggcaaaaaccaaacctaaggtcgaagtgctgctcctggcaccccacgccttgatgcgtatagtggtcggagcttcactattccctcgacctccacagcacgccgcacagttagctcttgggctctgtgtgatcctagccgctccgccgccactcacggttgtcggagtaacacttccgccccactaaacccacacaaacttcataccccactagccgttatgctatttgttgacaccggccagagaagataccaattctagtcgttatactgcccaactctagcaacgactagcaaacacccaaatcccagccgatattcatcctacctcgatatcagctgcttaatcaaatgaaaccccagccagcctactatccaaactccataccaaccatttacccttctactacccatagcctatgcatgaaatacgagccgatatgctatcctatttcagcatcgactcgagaacaactaaatcctagccattctcctaccaaagcccaacctcgaccaatgctagccacatatccacttaaccagttagattattcggtatatcccctattatccaagaaaccaaaaaccacacataaaatataagtgacaattgttacttaatcccctctagcctccaacccttcagaacatacacatattagcccagtaatccctacaccctataaaggagataggttataccctaaaccctagcccttttagttgtttatcgttttcttgttattttatggattttattgaaattggttcttcctctttcttagtagagtctattttattttggatggcaacctgtggtatttcgaggatcggataatcaggttgtctatcttggatttatttgcgttggagcaaggcaagttattattcctcccttgaacataattaccctatattctatatttctattctatgcattagccattcatgattttgaatgcataacctgaatatatagcaaaccagatatgctagcttttgcttagccctgcctagttagactgcataaaaatataatgaacttagattgggacagtacgtaaaatttggttgatttccgggtggctagtattgtctcagtcgatataagtttaccaaatacttatgtcaaacgaacgagtacgaccgcagcttctagaatagggacagacctagatattatgttaattaacaatgtgatacctctgtacagtggttccttttgtatgtcctcgcgtaggaggcaatcttatgccgagcagggcatcttatgatatttaccgaggcgcaggtaaatatactgattttcgctcatgagctatgtgtgtgattttatggaaacctggttgagatgacgtggggtctctcatccagttctctctaaaaaccccgagaacgccagaactcctctcgctgctgataacgttacgttcagagcgcatggggactagagttcatggaacaggtgccacaattattgataacctaatactgggccatgactaagctaatgaatattggcaagtcgtggactgcgggtaaagcgtacatctactgcagtagaatattcatgaaactattcgaatagccgtgctcacggaattgagtatcgggactcatatggtatttggttagaaacttaattccaaattttattaaatactgttgcatcaaacacattgcaggatttatccttctatattctctgcttactgcaagtaatcatagccctactgaaatactactaattcatacattcatattgaatataatagcttgccgagtacattgtactcacccttgcttcaaccccctttttcagagtccatttggatcgagttcttatcaaagccgggagttcaatcacataagttagttccctttaaacctagtcttgaaatctagtattgttagatggtttaactctatagcaaaacattagagttgatttattctatagtttctgctatattagttagccacaagtttgtaaatacccatgtattttataataatatctcccttggagccatgtcaaaatgtatgcaatgaagatccagattgttgaacatgtatcaatctactgatctagggcttgatacagtgtaaacatgtcggtttctgaatcgttaattttgggacccgacacactccccaaaaacttgatcacccgcctacccggtgcagatcgtgggaacgtggacgcgctgttgcggaggcagtcgtgggaacgtgggttagtggctgcaggtttctgaatcgttaattttgggacctgacacactccccaaaaacctgatcacccgcctactcggtgtagatcgtgggaacgtggacgcgctgttgtggaggcagtcgtgggaacgtgggttagtggctgcaaaagagtagcgacgtgacgcatgcacgcacgcccgcctcgacccccacctcaaccagtcaacagggagcctccaataattccctatttaggttgagatattcctcgcttaaatcctaaggtggttttattattcttaacacttattatgggcctttgagatttaataggataagttgggcctagcccaattattctaacatggccgacccggcgtcgcaggggccgctacccccgccgcaccttctaccagctcgtcgacgtcaacctaacttgctctgcctccgcaacaaccccaaactctgcccctccatgacagacgtcacccgagcactcgagcacgtacgtcgcctcccagtcccagccatgggaagacaagcaacgagccacgcctgattgattcagcccacctccttctgaggggcagacccacgatgattcatgggtattcaaatgaatacccaagatttttaaacaacaaatatatatatgaagttccatatgtatatatgaaaaaagaaaaaaagcctacctattcaaaagaagcttaaactaaaaacgtttcctatccctcccaccatttttctccccactatttcaggcccattggtccaataccaaaaaaaaaaaaaaaaaagcccaaacactagtctaagtttctaaccctagctctcaccaccatcccaactctcccggtccagccgcaaggcgccggggcggcagggcggggatgaggtcacattagccgacggtggtcatggtgacgcagaagcaggatttgcaatttcggtggttgctgaaaatttggtgatacccggactaaaattatttgaatttttaatatattttgattgaatttgaataaattttgaccaaatttacaaatatttgacaataaataaaaaattttggagaaatttgtgtttgccagtgggggccgaaattatagaatttcgaatcgaaatttcaaaccatgcttagaagtaaagggcgtcgaggcgcgattgatgcgggtgccgaacatgtggagagaaggaggccgctaatatgcaggacctacgtgggtcccacgcgccacgtctgcttagaccagagagtatactgcctaggatctgcggtgtagcagttttataagttaagggactcgttatatctagtatttcggttcagggatgaatttcagtctcggtgacaaatagagggatctaaagaaaacttgtcctagatccacgggctaacgttatccttagttcctacaatactacatccattttcattttcttttaaatagatggcaccgttgactattgattatgatatttgatggagtaattattgattttattacaaaattatataatactcctatattttaatgtgacctgctttatcattaaagaaattttagtatgaataatatactatgttttaaattagatgaatatggttaaatgttattttcaaaatacgggtgtagtacatgataccgaattattgattaagagaaaatgtttggttccttcgccaagttgtcgagagtgggttttttcttcattcaagcacattgtgacacatggataaaaatgcttccaaaatttaatcagctactgttagaactcggttcattaattagcgtacaaaatggatataaacaactagtaatattttttttatgaaatctggataaatctattttgcaatttgattattcataatatgcctccgatggtactaatttgactaatgaaaaaccatcgttagtaaccccatacaacatctcagagattagatattgtttgacacaacttcagtccaagatgttggaatttcgtattcctagctacatggatctattgatttggatgtgtgattagatggatgagtgtgcgtacattgtaagcgtctgcatttacattgtatttctagaaaaaaatgattgacaatatttagaagaattattttgttcattttttctgcgaggggaaggg

SEQ ID NO: 72895 - DNA, 6221 bp, Oryza sativa
ccatccacccccatccgggtaacgatcagacgagccctaaaaacaacagcagaaaaatgggtgaaggaataggggaaagaaaatatcactagtcacctcgccatggcggcgcgggcggtgcgtcctgaccccaaccacgatcagcggcgagtccgcgaccgcgagcgagacgcggcaccaccggaccaccccctcccgaaccaagcaggctgctcctcctccctccgaacggcgaccaatgcagcggcggcggcggcggcgatcgatcgatcggcgcggggaggggaggatgcgccccccagcgacaccgcgcctccgcccttatccccctctctattgaaccccccgggattccggggcgctgcctgccgccgcaatggcggtttgctgctgcttttgcctttgctccgcttcctcctttcttcgcaagccacacgcgctccccaagagagagacaccactcgaggggaaatgcaaataaaaaggaggagcgtttgcttcggtagcgccgcgccaccgcgtcttccggtttctgatttgcgggcccattagggcccacttagaatgtgttcacgcctttggggccgtatgggcctgttgtgcggcccactgtaacttgggtatggaatatcggcacggcataacacatggccctctgttcggataaagttaagatctgattattggttggaagccagtttcaaagaatatgataatgttaaaaaaacagaacttgtggtttcttgtttattgtttgaatttttaactatagcttctcgaatctagatgaaaaatttatctatttagggaagtttttattctgaacgaagcaattgccgtaagctcgtcgaaaaggcttgacagaggaataatattgtttccttaaaaaaaaatgaaagacctaaatcatttgtaaatcattggtggtgttttttttttataaccgtataggattaactcatgaattaacgacaggacagttaacttgcacacaattgtatcgaaacaatcacggtagacgcggccgcgcacttagcgtgtggtgcggttgcacgaaacggactgtaaatgacgagccatctcagttaagtgatcagcccattaatctccctttttttacagctgacgcaaaaaaggttaaccatctttcaggttattacactttaacctgcagagaatttcgtagcttttccagtgatccatcacaatcacataacccgtccgccacgaaggccataaatccgcctatcaattgatcaatccaggtcattatcagcgtatcaggagaagtctagttagctctagccacatgccagcgccacccaaacgaccaggtcgccacagatattgttttatattttaatttggcaggaatttgctttcgtaaaggaaggaaaaatctaacgagctttttggttgcgcgcccatgcggtttgaatgacccggtaaaagcatccgggtcgtcaaacacacagcgctttgtggtcgtaattaattaacaactttgtggtctaattataatttgttaagaagaaaacaagaagatataataagatggtgcttaatccagcctgaaatgaccacgcggtgtatgttgccacggtctacgccgttgttagttcacgacatcaaacctgcattctctacgcgtctcgcagtggtgtaaaatatatagtgggtgagatcgtttgtggactccaaatgaaaactttctcattatctatttaatgttatgtttttttaaaaaaaatacatataggattacaagttttcttgaaggatcatattaatctgtttttaatgatatgttttttaaaaaatattacatataagattacaagtttttcttaaaaaatcttattaatctatttaatggtatatgtagaattacaagttttttttaaaaaaaatatatcttataatctatttttaaatttataataattaacatttgatcaatcattaatgtcaatggtttctcgtgccttgtgtgctgctaatttcctaaaccgaacggagcggtgggtgacgtacacccgcttccgtgcaaaacccaaaaaggaacttcggagttgcacaaaggttgtgtttagttcagcacaaagtttagattttggttgaaattgaaaatgatgtgactgaaaagttatgtgcgtatgacaggttgatatgatgaaaaatgactgaagtttggattcaaactttagatttaaacacagccacatttccgttcggaatccccccggtagagttccaacggtcactgcggctgaacgatctgcgttgctcgggtcagagccgtcacgaggaggaagaggaaaccgacgcggcgaagcaaccgagagacgcgacgcgctcccttgtccccgcgcccgcgccgcagttccatacgcccccacgaacgaatccgcgacgcacgcgcgcgccagcggcgagccaacccaaaccgaccaaacgaacgaaccaacacgagtcgacacgcttcatccgctcggggatgggaaatccctcgcccgcccatgccaaattgccaatgcggcgcccatgtcgtccctggtcagtcatggctggcactggcagcgccgccacccagccgcccgccatgatctcctcgaaatcagaaaaaaaagaaaatccgtgcagcgacgaagcgtgacagaaatagaatttcggttttgatatagttatgtcgccataaatcttctctaattacagtcagtttttagccctcaaagtttcgtttagattcgtacaggactgcttaatttgccatcgtgcgtgcaagcactagttcatactacatacacatgcatctgtgctgcttgctgtgatttatctgatcgatcacgttcctttgctatctacatgtaaaattacactctatataattacatatataatttaggaagttacaatgtaaatacatgctgactattttttggtgaaaaatatggcgccataaatatagccagaattttggttcagagatttttgtgccgataattctacagctatagtatgtgctcgtttgtttgcagggaccaggcaacgtgcgatgctgctgctgcctgccagcacggaacaacaaaaattaagcgcgtaggatcgcatcgcattcgctcgcatacaggggaggtgagtagaaaaatgagccaaatttgcagcgtgttcgtttgtcaatctggctgaggtggacgcccccgacaggaacagcctgttcccaccataaagaaatgccgcgttcacaggtcgcttaacggctcgcatacagggagtactatttcgttagcaaactagcaaagtctagtggtgatggattaccggattacccaactgaaactgccagcctgatgctgctcattgccaaggatgagaggacaactggagaaggccgaacaatagtagtagtgctgctgcgagctcagctcttgccaacctgcaactgccaccaacatgtcagtaaatgtctcagctgctttacctattattgggctcaaattgaaagggaaatatcctgcgtgttcttttgactcaaaacgtgttactactacagcaaatgcatcaaagggtaaacgaattaggaacacagggggacactgtcaacagttacaaggagatgaacatcatagtcggggtcaagaagagaaaaatggtactagtatctcatctgtaagtaaatgacgatgtacaccatggagttggaccagatctagagtgtcactcagttcacaatttacaaatagttttgaggtcatatatcaatcatgggagcaatgaataaactcgggtggtataagcacactctgccgagctcctctgcaaaacaagcacgcagcacgcccaagcatgcgctatgctgttaggccttccaactacacagtacaaaatcatgaactcaaaccaaccaccaattggtcgctcaactaagctagtcaatcgtatcagctacacgctgtggcgcgatgttcctccaaaggggcattgtgcatcagatcataatgcaaatcatcatccctagccactttctcgcatgcagttgcccggaagaagatagcggtactggtccattttctccaacagataagcaggaaggtgaacagctgaaaatgtgctagggattggccccaacttggcaatgatctcttggaatgtatactcttcgggaagcatgtcaaaaagatcagctccttggcatatcacatgctgaatccttttggggttcaagaagtacttaaatctaatccggtcaacatggctgtaagcttgcattttgaagacaaaatcatttatgtgccggaagcaaaagctgcagtgccaccctgagtcggccagaaggtcgtctgtttgccggaaatgcgcatacctcgtctttccagcccggtatctgtgtattgaagccctccaactcttgtcgtcaaggagaaactgaaatgagtaaagatagttcctgagctggagatgaagcacttcaggagtgtcatcacaccacctcaagaggttgattgtatggccactggggatctcatcaacatcagacatgatcaaaaggtcatcatctgtgattccagcaattttgataagctggtcaagagcaaccctttgatatgactcctcgacaaatgggttctcccccttcacaaatcttccacctatcataccataggtcaaccgtgattcagcaaattcaaagcgttgacggttttccttgaagtggagatcctttttcaggccagtgaaggttgagttggactcgagcagcacaaattctgacacatatgggctaagctcatgccaacggatatcaagaatgtcaagctcattgctgaaaagcacagcatcaaaaacacggcgtggagtttccctgactttccatccatgcaacttgcataggtttgccatcgagacattttcatgatagtagtgaggaagcacattgaagggctttggcggtttttcccagatcggtcgaagaaagtaagtcaccttctggccatgaacatatataatgaatattagagctggcacaccaatcaagaggatcagaagtgccctcaaatcaaacccccgaagcgcacacttcaaccttgacatgctcagaattgcctttgaaccatgctgcaaatgaatttcagaaaacaagtgagaaatcaggctgtcaactgaaaccaaaagaaacccatcttcttcacataattatttcaacaccaatcaactgcacaaaacacaaatgaaaattcaacagcattggttctaccaaaccagaggatcaggttatcagtacaaattgccaaaaattctaagttgtaacatccaccgtgaatctagtagcagcaataaccaaaggatagtaattttttttatttaacaacaacgttacaactacaggatcatagacagtagaatgtgtgcatattcccggttaaaaactcaatgttcatatccatgataagctaatgcatatccacccaaaaaggaaatcagctgattgtttatgttccatgaaattgttatctttggcggcatgaataatccctcgggaattttgcaaaaagtaaaaggcagatacttgtaacatccttatacaaaggaaaagaaaagaaagattccaggattaggctggacaaccaattcggccagctcgcgagattctaccggcgccagaagcatccaagcttgaacttcacctaatcccatctccagcacaaatagcccccaacaaatagaagattaaaatattccaatcagcaagcacttatgaattattatgatcccagagcaataaccaataaaaaatcgaagcagcaagcaagcagttctgcatccctacttttattcgatccaaacgcaataaaatagccaaaatcgaagcatcaagcaagcagttctgcatccctactttttattcgatccaaacgcaatagaatagccgaaaaaaagcaaggcaccaagaagaacgaggggtgcttgggctttttccgtggaccgagcaatccatcgcgaaaatcccaacgcggcgggagagaaagggatagatctgggtgggacgagagaggaaaacagaatctcacctcgctgccgccgcagacgcccccgcagatgccgccgtcgttcttcttgcagttgtagtagcccgccgcctccatcgcgtcggcaaacgcgcggagcagcaaaggtggggacgcgctgctcgccgccaatggcgacgcgtgcgtgcgtgcgcc

SEQ ID NO: 72896 - DNA, 3004 bp, Oryza sativa
attacgattttggaaggaaaaaaagggactactcgtacaatatattttttttaaaaaataaaagaatcttgtaaaggttcatgtggcgtattggtattgggtctatatttttcatctcggattgggatttgggaagccttttcaacaacggattgaagtataatttattaagtattataacatgaacaaaaaaaggattaacatgtttttctttctaaagcaccttttgtttataatttttttctcagaaaaaaacacactatttagctgttcgggatgcgggtgtgttagaaacgagcgagtagaagttagaaatgtgtagtatggaacaccctaactctcaaatcaggcaaatgagaatttagtcagcggaattatgaaataaattatggactgttcagattgtagccagaataaatcttactaaattttggcagtgtcaaaattgtgtcaatttggcaattttctcaagtttttgtaggatttcttatgtatttatcaaagtttataaaaaactaaatagatgcacatctttgataattttaccaaaaaaaatagtatggtttgaaatggcaccaatatgaacaatccgttagtgcatgtagctctgctcttatttaaattaacctgattatgatattaaacgagaaaattagaatttatttgagggtatgtgaattagtacttttttacatgtagagccaatgacaagatcaggaaaacacggacggtataaaaagctgaaaaggacactgcaaagatatggggtgtgtttggatgagctatggcttttgaaaaagtagctgtggcttttcgaaaagcagttgtgaaatatgtgttgtggcttttggaaaagctcgtttagttcaatagctgtagcttttgaaataaatagtcccacttacaagcgagccccacatgttatacacccattggaaaagaggggaaaaagagagagaaaaaacaaagacgcgcgcggcgtcggcctcggcggcggcggcggaggaggaggcctcggcggtggcagaggaggaggcatacgcgtgcggcggcagtggggaggcagacgcgggagttgaccttggcggtgttggagtcggcctcggcgtcgtcggagtcctcggtggcggcggagtcgtcctcgggcgtcggcggagtcagcctcgatggcgaggaggagcggcggcagcggaggcggacgtgcgcggtggcggggcgaggaggagcggtggcggcgacgaagtgagtaggaggaggtgcgacgcccgtggaaagcgatgggagaaaaaaaaacaagcgaaccgtttttttaatggcagaggtgggtaatttttttctcccaaaaataggtgaaagcaggggggtagatgtgcttttgatttgtactacaccaaaagctggctttgggtaaaagcagccgtagcttttgaaccctttggttggcttttggcttttccaagcaggttgaaaagtccaaccaaatacacccatagtataccattttttaaggaaaaaaatataaaatgagatgccggggttaatatcgatttgcgttaagaccataatacacactcaaatgtaaaagagccaaatggatgatccgcctctagatggggagattggcaaaattcatgagcaacactatttgttttcttctagttttgatgactcttttaactttaatttgtgattatagggaagatgaataatggttacgattggttgagaggaggagtatataaaaaatagttttgtttagaataaaattattgcgctagaaaccaaacgtgtttctacccatatctgtgtgtaagtatttcccatatttttattatatgaaagacatgtgcacgcatatcactatatatgcacatcgcacacactctccgtaaatgtgtccttaacacaccctcaaattaaaatgcacatggcaacgacaaattcataaccttcaattaatttcctttttatctctctctcattatatgataggtaaatcgatttttcagtgccaaatgtgtatctttggcacgctgttagtttgaaactaagtcgaaacaaatacacgctttctcaaatatctttggcacgaaggaaaaaaaaccctgtcctggttggattcgaatattttttgcatggatgataatgacgaggatctaggatgtaataacaaatcaggcatctcggcgagatgcttcctatatgctgatccatgtacttagtgccctgcactttttttttctctctctccattcattcttttcatgacatggaagtatggaactatgttagactggggctaaatcatggcagaccatgtgcaaattgccaactagcgtgtggccttttctccatattaataacatatgctaactgcttgaatgaaataaagtaatcccaaacgttaaaagcagctgagcatgttaaggtgtactactaagatatataaagtattgacaatctagtaagttttcttccaaagagaaagagaaggttatgaaccgataagaaaaacatacatttagtacgtcctccctccattcttatttccatacgaagttggttagttcaaattcaagtaaccaatgttacataagaagaaaaaaaaaagggagcatataacaaaaatactgcaacaatgtgaccaattctcatcgaggaaataagcgcgcgcacataataattttattacctgataatgaaaagaaaatcaacttagtactcacataagctaacagaacggccatctcgaagaaataatattagatattttctccggttttcaaaagatattgccgttaacttttaaaaatatgttcgatcatttatcttattcaaaagctatgaaaacatgtaaaaattataagtcatgtgaaagttacctttagtgataaactaaaccacaacaaaaataaatgataattattatgttttaatacgacaagtgtgtacttataatcccataactgattaagaaaaccattccaactgaatcattgagaaa

SEQ ID NO: 72897 - DNA, 715 bp, Oryza sativa
cctgcaccccaaacaaccaagcacatgtttagcgcatcaccaacagtctactaataatctatcgccaaaatttaatttttgggattcctaaactgaaaataggtgttgaaaaaaccccttcctccaagagatagcctaaattcaatcccaaaaactaaaagtgggcccttctgttaaactaccaatagaaattctagtttttttcttttcccgtgcgcagaaggagatcgccccgacgggggaaggagaggagaaacgcggaaggaggggagaaacacgcggaaggaggggattgggagtcgttctctcgccctcaaatacacgtaccgagaaaattggagatgggaactttaaaacatcaagagctcttttgggaatctgttggaccagtttttttaaccaaaatcccaaaaatataggattggggatgtaatagctagactgttgatgatgctcttacatatttaatctgaaaaacaacttcttttgaaaaactcaacaatatttatgagtagtttttttaatgaaagatgtacgttgcatattcagaaatatgagtagtactcatttcgtcctagaaaaaaatcaactttttaaaacgaatctagatagatgtttgttcaatttttttattttacttagagcgagaataatattagagctcacttcctactattagcccatcttaagccaacatatattatagattagctat

SEQ ID NO: 72898 - DNA, 1040 bp, Oryza sativa
cagagcggttgccttgcttcaactcttggaattcccttttcttaagggccatgactccggcgggcacatgggtcctccggaaagcggcggtgaagcgggcccaagtaataggctgtccttctggctgcgtagcctggaagtggtcccgccatagagatgcgggcccctgcagttggtgagcggcaaagatgactttctcctcatcgttgcactgcacggtgtctaactttttccccacggcatgcaaccaatccaaagcatccacggggttattggagctagagaaggtaggcggacggatgcggaggaactcggcgagtttagagtgttgcgggggtggtggtggaggtggagcattatgctgtggcggattttggatgtggtggaggaaagcagccatcatgttggcctgctgggcgaggatttgggtgaggatggagttggtgtctggtggtggtggtggaggcgggggaggaggcggaggtgggctgccatggttgttgtggttgctaccttcgggttggttgccatcaccggtagtagcacttctcctggttgtcaccatctgaaaatcccacatagaaccggcaaacagagagagctgactattaaaactaaccacccacgactaccataattcttgaatttattactgctattaaattggttcattaaggttcaagttgcttaagcaaataaaataaagacaggctccgacacagttataccacacaccggtataaccatgccccacacgactctggcagaaaaacaaacgagaagaacacacgcgcaagcctactaactgctcgtctacttctgcgacgggccagggcggaaggtgagcagcagcgcatcctccgtgctgccaacgccggaggctccctcctcctgaggaaccacaggcgcgggctcggcacgaggggtctcgacgaagcaggtccacgccagggactgacgaacagttcgggcctggaggtactcttgcgggcggtgatcttcaggctgcggcagacgcgacggcgcttggggcgacaaac

SEQ ID NO: 72899 - DNA, 1422 bp, Oryza sativa
atttataaaatttatatatctatcttaagatggacagtctttccacagttgattggaccacatgatgtggttaatgttaagataaatctttaaaaattacagagcataaaaaatacataaatccggataataacttttccatatcctatagaataccaaactctgtgccccattaattagaaaactaacaattcatataaattctggaggtttcgatattttttaacccttgcaattaatcaaagaaatgcttaatttcttcaaatcaaaataaaatgaagaccaaagctgaagaaagaagatgtatttacttcttagtctaaaattaaaaaaatctggaaaggaatacagatattgaagaatagggcctccacttcatcttcttcaatcgattaaaactgaagaaaataacaaagatcaaagtgtgaaaaggattaaaaaggaaaggaaataaacaaagaaaaacattcctcgaactaccgatcactacttctcaatggctaccactcccacaacccatgttgttgataatagtgtctttttatgtgcactaaaaacaaggcaaacgagcaataaacataacaagtgggttataaaatttaaagtgccagcgcacctattttctagtgtcttttaaaaacggccatccaatttgcaagatttttaggttttgccacccatattgtgatcttgtcgctccgtgccactcggtgtatctgaccaggccgtcctatagtgcgccaggatggggccaaacaagccggataattgtgttagcttagataattaggatggatcagctaggagcttgtgtcacaatatattcatccaaactcgagtatgtggcttcacttatacacatctttataacaatatataactatagttagtggaagatgattatgccagcgtgggttcgcggtgtcaggactccatcactgaagacgcagagatagccaacgatgctgtgtcctgccggatatgctacagggcaagggccaagtccggactcgacagaaaggagatgggccgagacaaggcaggcacaacccaagagaaccaacgcgtacataggcccaggaacgtgataggtgagtgagtgagcaagaaccggagatagatcggagtagaacacggcggagacggtggcttgatcctgttggatcaagaactctgtatcgggttccttccatttcgaatcaagcaactaccgattctttctcccaaatcccctttcatttcattcgctagagctcacacgcggccatgcgtgatcacggtgcgtcacatatacgtgtttggatgccatgcgcgctgatggtgtggtgctttgtgtttaccaaccgcgatttctaccaatctctgcatacgccggcgacttggcacaatcggctatatggtagatataattttgtcgggaac

SEQ ID NO: 72900 - DNA, 3967 bp, Oryza sativa
caggttgcgtaagtggaccaacaaatggagacacaagatgtgaggaaggacagagtatctttttttttttaaattacacagtgcaatacagacactcacaacgcacgcgcactcacccctatgaacgcacgcacgcaaaccctacccctatgagcatcttcgaagattgagccagcaaatccttgagattgacgaagtcaccacaggtgcctcgctatcgacggatacgtcacctaccactgaaagcacaacgctattaaatcctagaaaattcgctcccatgcggagtcgaacccagggcctcaggtgctactgaagctcttgtaaccactagtctacatgtcttttcgcaaggacagagttttctcattcacgttcttttcaccgtatacaaaagcctcgactctcctccctttatatagccaattctcatatgtggaaagtagggtaaggcctattagtgtgttgggctggtcttcttgggccaaaagcccaagtttctcaacaatccatttttttttatatattcttggatgtgatattaatgtcttaaaaccattaaatgaacgacatccaaattctgaagatgtagtccaataaatgaaaatttgttttcctgtatacgtggcaattgaataccatagagttctattaaagtattgaatgtatatatttaattattatttagtatctgaaaggttcattgtctacttctatataagtaaggacgaatgaaaattgccaatatacttacaagcatactgaaatataagagaaaattagaaacacaagaaaggaaagaaagctataggtatatcgcccgcgatatggcgattttcaagaaggatggtactgctgttctctttgtcatgtctcttatggtcatagctatggtctctcttcctgccaagcaggtaagctcttccattctttaattttatatttgttgtatatatttactaggaatatacacgtgcattgcaaatatccatgcatgcatatgatgcaaaggcccatgtgattgggatgggttgggaataccatccaatcggttctagtctcagcaattaatggaaagtttttttaatttgaaatatggacgcgtctatgtagcgtgcagtagcacgttagtcttaaatcaagacctctcacttttccaatttcatctgttacttttgtcacataccccatctactttctaccatctaaaattcaaataaaattatttatccgatctacaatctaattacactattgtgtttattgtaattaaatatttataataagatcttacatgattatattataataaaaaaatttatgttgtaaattactttgattatatatctaagttacttttatcatatatatataaattacttctagattctattaattactttttagacatacagtgaacagtttactttattggttagttttataatatgtttattaaatttaatttctagatagacttatgtttctagccccacaacagatttacttttaatgtcgtaacaagttactttcttctttttaagttactatatgtaaattacttttaagctttattgaatttatttttatatgtctaagaagtaatttaatgaaatctaaaaataatttagatatattataaaaaaatgtaattttttatctaaaatataatcatgtaaaatcttgttataaagatttaattgttacgaacataacggtgtaatcggatcataaatcgaataagtaatttaggagaaaatttcatttgaagtataagtggtatgaatatattttctacttacttgatggactactactttaaaattcttccgctcatgcgatgtcatcgctggttacgactaaacgagatgctctcggtttagattttaagttgaaatatatatatgtatgtttctcacaagcagaaattaaatggagaaattaatatctgaaacggaagcacatacaaattaggcgtggacaaacatctctacacttgtggaggataaataaagaaattaactagctaattaacttatcagtggtgttcaaggatttaacttttttcctatttaattttctaataagcatataaatatattaatctggctgaattatacatgcaatatgcagctatccatttcaacttgcactgcgccgacctgccaaaatgcactgaacatgaatgcatggcggattgccaccgcagaggtttccaggttggtgtgggactagtggattgcatggatggacggcccgatcaatgttgctgcagacatgggcttcttgatcatcgtgatgacaagttaacgactaattaattaggcgatggattaatttctcacatgagcaatgtattattgtcaatgattaattacatgtgcaattaattgctgcaatgagctgatcgatctcttcgatcttattgctagctcttttcatgtatgtgtcgatcgatccacctagctatttgatgcggactcaataaacaaagtttacatgggaagaatttggctctctataattggcttgatatcttgacttataagcatcattgtacattttcatactgttcatgtggagctatagcagcatctaaattgagtgaattaatgggtatagaaaaataagacaagcagcagataaagacgattatatatacttgactccggtcaagtagctagcacacaattaactattgaacgttgtataggtactctctcatgttaataaatacttcctccgtccaggattataagagattactaggtcataccccgcgttttgctgcagtattcatggatgagtatatgttaaatatttttgaaatgatgaaagttgaaatactgagaaaataatgtgaggaagatgatttgacacatacttgtcaatctctataatataatattgtagatgatatgtgtcatgcttgcatgagatttaaaatatgctagaatagtaattgctagtgagtgaagatgtggtatgcttgcatgggattttaaataagctagaatagtaattgctagtgggtgatgatgtggtatgcttgcatgttgagttttaacttctaataattgttagtgggtaccaactatatggaaattgtagatttcccatttagcaataattaaggaagtgtcactctggtgctgaatgatgaattagcaaattagatatgtaaaagtacacactgctgctgatggggtaatattattccctattgttttgggttgtgtttagttagttagaagttttgggaaagatgaaagtttggaaaaaaaagctagaagtttatatgtgtagtaaagttttggatgtaatgtgatggaaagttagaagtttagggtagttggcggtgaattaaacacggtagggacggtagaagtagtcctagcagtactttttctctatttgttttttagaaccgatggggtaaatgaaaagttgttgctgttgatagtgtcattgttgtccttgcttgcctcgggacaacaaaaataccatatattcttgaacagagggtcatgatcctttatattcaccgaaggagtacgaaccaatgtcatcttaatgtcaatatatatatgctgaataaataagttaaatgggctaaattgggttgggcaggccatgagagtttctagagtttaccttcaaacttttcgtattcgtaattctgtatttggattcaaattccgaactggactacgcttctactgcccaccttctccccttagttaagcaaggtcgaaacaaattgtatttcaaactttatacatattaattttatataatcatgaaaaaactttatatttcaaattttctactacatgcaaactattatttgagctattctctcgtcgatcgaaaaaaatatatgtagtaactatctacataaaaaattacacatagagggtttctacgtagaaatattcgtataaaaaactttttaaattaaatttga

SEQ ID NO: 72901 - DNA, 21170 bp, Oryza sativa
  unsure (1)..(21170): unsure at all n locations
gttgtttgggacctttctttaagactcttcatgccaattaagaaaaaggagataagctatggacttaagcatcccacacttgattagtaatgactgatgagtcagctggtgccctgtcacaatcttgtgagaatcttgagaagaaggtgccttgcctgcctgcccatggcaacacaccttcacacaaaaaggagaatatctgatgaatatggttggcatctccatgctcttatagcccaaccaaaaggaagggattaggatttgatctcacatcacccttaattaacaattcatcaagggttaagacatgataacataagatactaatatgttgcataatgcaatgtaaacacacatacacacacagagagagaaagctagaggagaaagaagacaagttgtgcaagtctttggagtaatctctgggggatctcacagagattcttctgcccttgaaattatgttggtcttcattggttatttttctactactcttctctctttctgttgatgtttttcatgtgaaggtttgcagccaagtcaaagtgtggctcttggaaccctggcaggggcaactggccaaccaatcctggtccatatttttcataccagcttacttacaattgctacttggactttgaatgcttcactttggaccctagtcattgtcattaattgaatagtgcttgtactcctacttaattagatctaataaagctgtcaattttttgatgctgtaagtttatatttcagagctaccattgtactaccattgctaatattattagtgcaggcagaagcatttttatggcccacaaaataacaatagttaagtgtttgcgtgttaatttatatatggagtacctttacggtgatctctactagtactattctactactaattttatcattagtaaaagtgatcttcacggttgatttacaagttctactaccaatagaaaaaatattctactaccgatatatgatccattagcttggaaaatatgagcggtctatgttaattccactaccgttaagaaccattacagaacacatctaacttataataatagtcttatcaccaaggactgtaaaaagtcactagtacaagggaaattctctttacaaatgcaagtgcacaagagccttttggatgattttttttttacctactcaaccttatgactaccagtaagatgggcaggctttagggggacagccaaagtcatcacatccggtttgaggcgcacttggaacttaccagatcagcacaccaaaaaacagcagcacaaactaaaagttgaagccatctagattggtagtggcatgtgtatgaaacccacaattgacccggagatacgataaggatctcgataggcgcagggcatcgtcctgcggtgataacctagtacaattgatcatgcattctccctttcctccagtgtgtgtatatatatatcgctgacaaattgagaatatataattaatttccttcgttcttaaggagccctaaacttctagaggattataagtagtggccatcatcgttgttgtcgtcatcgtcgtctatctctccacgatatatacaacatccttatagaatgggtgctttggtccccaagtgaatggaggaatctctctcatgcaattttatctccttatcaccagtactagctagctagctacaccatcaccaacaaacagcatcaattcaggcagaatgaggaggaggaggcagcaagtgatgttttcactatgcaagtgcgcaatccacgctatctatctactagagctagctccctttctatgtaaaggcatggctcatgtaaaaggtggcagcgtgcagtgttggtgatggcccatgcatcaacaatggcctccaccaccaccattaccacttatccactcaattcatcaagagggaccatgtcaccatatatggagatggaacgagaaggggatgaggagactcgtatcgtctgccgttcaatataagttgatcgtatgtggttggaaatcaacaagtataattccggcgttgatggaaaattgcttgggggccttctcttcttttgtcaaactaggatatcaacgtaatttcgactgtgtaacacaatagtgtgaaaattattattttttgtttatgttcgtatatgcatggttcaattttcaattcaattggatgttcatgttttaatttacacctctctatcaccttgtacatttggaatttcacataaaatagttctaagtctagtaagtatatactagaaagttttccttcattcaaaataggcttataagctaaaatatgcatacaagacatttagacccccaagattttatccttgttgcatcagtggttatttctcacggcttttataccacataaaagttgcgatgtaacccatgaattccgaagtggaagaattcatggtccaaaccgtccacccttgccaaaccaaaggtatagcacctaaccttaatttgaaggtaaacaacaaatttcaatttccaccttttcatggttcatttagatgcatgtagcaacttttgttaaggttgaggtaaaattactctgatgctcctatatataagttcattactagttcgaaaaagatcacacccaaaaatgcaacaatataacataaatgtagggaatcatgatagtagtgcatggttcgattggaaaagtaccactccaaaaatgcctatatttgcggataaattttaaacgctaaaaatgtttatatttgtgcatggggaagtatatgacttccaacattattatttgcggatcaatattttattacaaattatctacaatttccataggaacttccattccaaaattatctacaaaattaattaacttccattccaagttcagaaatgtatataattatattgtttggaatccattgcaacccccataattacattaattaggatatggattctctacagtggtctcattcatgccaaggggggatgcatatatgcttggatcaaagctggatgctgctttcctccagatgcatgcggtgatcgatatcatatggtacgaaaaagagagagatggggagagtttagtacaggggcagcaaagaatccaatggagaagagatcgagaagagagaatcccatcgatcaatcgatccaaatattcgtacgatttgcattgcatgcgatggcaattattcacggtgtcgatcccgtccttgcgtccaaaggcacatgtaggccccctagctcccagccagaatctccacagatccacacacccaatcatgccgtgtgaaaaacgcttatgagtttttttataacaaaaatcactttgctttttttttcctataggtgacctttgaatttggtctgcccggcctctagtgagaccaaaagtcctacaaagaagagagagagagagagatctttttcaaaatcttggtcaaattcaatcggaatacgaagaaattttatgtcaaaagtaatagtatagatgaccttcccaccaaacacatgggagcgcatgcaagtcatggaatgtgatgtttgttaaggttgagtttgaaacagcttctcaatttggctactttcttattttttttcatgaatatatattttatgagttatatttgatagttcagtggcaaagagtatgtgtggttttaactccgtgttcttgtgttcaatccctaacatactcatattatttttcttaaaatttttttgatggatgtctctccctccaaatttcattttcttttataagtatgttttctgaactgctaaacgatacattttctgccaaaactttttagacaaaaagttcttttaaaaattaaataaatttattttttagtttgtaacaattaattaatactcacttaattatgtgctaatggctcttctcattttgtgtgcagccatcccgtggcatcaaatgcaatcaagtgtattggtagttggtggctgtatcacaaagatatataagaaaggaaaaaaatgcatatgtgtttgatttatgaaaaaaataaaggtgagatgaattttttggggggaaattcattttggctctgaatttggatatagtggttagggactagtggtggatactgttcaatgttctatccctcttttcattgacagcgagtgcttttgacaaaatggtgcacaaatgggaggatgccaaatcatggaatcccagctttatatatgcttgtggagtttcaactttcaacatctggaaggcacctccttggtacaaaagggggaggtcaaaaagaatagcttatttcagactaattgcatgatcagatgttctcattctgatctgtcaataaatgcggttaattgaagcttcaacaaactggagcttaagtatgtgctcttaattaattttaaatcatctcatcccatcttctagtgagattaaaaaaattgtttttccctgtagtattcaattgaaaatttgagtagttagcaaacgaagccttaatgttttggtattgaaagtaaaactattgcgcaattctaacttttacgaattcaattttagattatatttccatgaatgaagaacttcttacttcaagaaagaaaaaaaatactccctccttcccacaatataagggattttgattttttttcttgcaacgtttgaccactcgtcttattcaaattttttttacaaatataaaaaacgaaaagttgtgcttaaaatattgtggataataaagtaagtcacaaataaaataaacaataatttcaaaaaaaattgaataagangagtggtcaaacgttgcaagcaaaaactcaaaatcccttatattatgggacggagcttatattataggacggagggagtatatctttagtacaatcagtatactcccttcgctttttactagacatatttttaagagattactagacatattctgatttcagaaatatgtatatcctctatttaaagaaactaacttctgattacaatctaaacatagattttttaaaaaaaactaagtgagtagaaaatatttgggttcgttagatggtgtttggagtaaatcttttgtgcacacaaaacatagcgacatattaaaatatgattaattaagtattacctaattttttttaaaatagattaatatgatttttttaaaaatatatttttattgaaaattattttttataaaaataagcaagataagttaggaaagaaggggaagaacacagcctatagaatctttgaggcggttcacttcaccctaaccaaaagaatctttgcagcttgggaacggtgacgttgcctttgtctccttgatgagaatctctctctctctctctactttggcgtgtcatctcagcaatggcggcagcaaaatcccatggagatctcatctcacctctgtctttctctctctctcatggcccactctctctcatggcccactcatacatggaatccttagccccttgccaaattgctgttgccaataataaattccaaacctctctcccaaatgagggaatctcaattgtcactatgcccaaaccacctgccacgtggaggacagccattggctgggaggatgaacaatctttggagtagtggttctactgcacagagacttgcatcatggctgtgatgatgaaaatgatcataactttaatttggtgaaagtaaaaaaaaacacatgtctttttccatggtgaaaaagataccagaaatcaatttcgtaatacctagtactctctccgtctcagaatataataatttagaatcagatgtgacttatcttagtgctatgactttagacagatcccctttccagattcatagtactagaatatgtcgcatccaattctagattgttatagtggatagggataagtggagtacaaagctatctattgtcctaaaatataaacactttttactgagataaaggatagttgtgatagtaagagatgagaaaatgtgtggagaagttatatgcatgaaagattgttgtgattggttgagatgaaggagaaatcagataaaatctcaacatagaactagctatattttcgcactgagcgagtaactaattaattactcttatatatgggctttgtgcactatactatgtgtaacttctgtgtcaaggcacaaatccttttcagatttgacaagggtcagatgcttgaattattgcattagctacagtacttgttggaaaaaatagaaaagtgaacctctcactttcacgggatcaatgccatcgagatagatatccctaattaatctattgcatgcactccttccatttcacatgtaagactttctagcatttcctatatttatatagatgttaatgaatctagacatatatatgcatctatattcattagcatctatatgaatatgagcaatgctaaaaagtcttacattgtaaaacagaggaagtactaatctaacatttaccaatagcagatagagagagaaaacagtaccatggcaattctctggtcccccaacctccctaaaaaaattagtactaaaatgactttcaagatgcatgaaagagtgaaaaaaaaatgaaatagtgatatatagactgatagctattactaacatatagaagaactcgatctgaattaggatgtcttttgttttcacatttatttgatgtcaatttgcatttatatgatgtcgttgacatgctcttcctaccgataagcaccgaaggcgtgctgcatgaggtagaaacaaaagtccaacacacttttttggtcatgagtgtcatggaaacctcatgaaatctatctcctaggtcacattaattttatagttggtacattgggtactttgactaaggatgctatttatgaatggtaataataatgtgattctcaatagacctacccctcctcaaaataaaaaaaaaagacaaaccgtgcgtccgggttcgtagctaggattttttttgacagaatagtaagtctcataaaaaaataagtaaaacggagacataatttgagtaaggaggtgtgttggctagctcattaatataatgcggggtagaaaggttagagaatgttactccttgtgttttagcatctatcggttggcaagtgatggtaacagcaataaatttattgccagaaaaccacaaagcaacatatcaatttctttgttaaagaaaaccaggtttgaccattagctaaagacagaatttccataaaactaaacttctatttcatgagggaaatctttcaaagaaaatgatgataagtagctttagcttcgagatggcaccgacgaatcgtcaagcatgtatgttcaaagcttgttggtgccgcatcgaaccggctcaaaaaaaacatgaagaagaagcaaaataattaagtttagaaattttgtggaaaggaatgtattgtgggatctaaacacatagaccatttttatcgaaaaaaaaacaatgccatcaattcttcttcgaagaaaaggaagaagaaggacgagaaaagagtaataaagaacacacgaatatatccgtgtgtatcccttgatgaaacctacccctcaccaactcttcccccctgatctcaagcatctagcatcaacaagaagagaatagcacaaaacctccttgctaacgacaacataggaaaggaggaagaatcaactttccagcaatggatcctcttgtcttgctgtccccctcccttggtttcttattaattcacatcgcatccaaacacacacagattctccatcttttcttttttttttctttgcaaggacaattattcttattcgaaaagcaaattaaagaaactcggttcggtttcagttggaacacaacagacgccgtcgcgataaggcagaaaaagaaaagaggaagtgccatttacaatagattctgcaaggtacgcagggacgtgcgaggacgatttctctacttataaaaaacccaatgaaattaggtttggttctagttggaacacaacagatgctgagacagaaaaaggaatgaaaagaaaaagagatagtaagagctgtagaatattggtgctccaccagcaagtgcaagtgcagggacctgaatgaaaaacctgaaaaggacccatatgaaattgaggggaaatgtgagggggtggtgtgtaaaagagagggtggtgtggaggaagaaagattcgtggggaggcggtatcctgactgtgtttggtgatggttgggtgttacgcgacgaaacgcctctgatcccccatccatattccacgggcggcatcttttctccgactctcacctcccctcccctctcaatttaccatcctacccctctcccctctccccttcatttcatcactagtaaaataatactactattcatgctatgtactattattttttttttctaaacaagctataatttttttaaaaacaggctattcatgctataatggggttgttcggttgagctagctatgctgtggtagccagcccaatacaactataccggttgtagtaaccaattgcagcagcagcgtgtgttcaaacttgcagtcgaatggctagggttgcgtagcatagtctagatcgctgcaacgacagagtatcgaacaaccctaatactactacttcgtaggatttttcattgttccaatctaaactgaattttcttgtgaagttctagcaaaattcttgtttggcatggctccacgtctggatcaactcttggaatctcgaaaaaaaagaacttatacattaaattaacatgcattaatcctcttattttaattttaaatatgaactaaatatttcgtattattgaaattaatcaaccatcacctacaactcatgaatttccggagctaaagatgtctcgttatcaaatattccatccgtcttttttgatattttaattttgaaccaaccaacatcaaatattaaaggatggtggcagtaaaaaaaaaacttggagatttttacgtctagaaaccatcgttacacataaatttaggcaggaaagttttttttcccaactcagagcattttagttgcaaaaggtttatgcaaaataaagcagaaaaaaaactactaccagtatcttttacatgcacagatcagaaggaaccagtggttgtacagataatagcagaagctagtggtatcttccacggccgattctatactgttccacgtcaaattaccattctaccctccattctgcctgaaccggaacccccaaccttcctccggtataaacgcggcgagagcgcgacgccgcaaaccatttccaccgccaccgtctcctcccgaattccggcgaggtgttgtggacgatggggtcgtcgtcggcgtcggcggcgcagcacgaggaggcggcggcggcggcggccttcgtcctcggcggcgtcgacatgcggatgctggcggcgaggacggcgacgggcgcgctggcgagggcgggcggcggcgaggcggcggcggcggcggcggcggcggcgaggttcgaggattgcatccggagcctcgaggccgagaaggccaagatggaggtgttccgccgcgagctccccatcagcgtccacctcatcgccgacggtgagctctacctccaccctctacctgctcgatcactcgatctgcctatagatttcatggatgattattcgctgagatcttcttgggcgtccagtgatcgagtggctcaaggacgaggtggagaagcagcggctgctacggcggcggcaggtggaggctccggcggcggcgccgccaccggagatgttcgcgccgccggcgacggcgaagaggaagtcggcggcgtcggcggcggcggagggggtgaaggcggaggcggacgcgaacgacaagcggagctggatgagctcggcgcagctgtggagctgcgggagccacacaagcaccagcaccagcaatggcggcagcgtcaagaagcagcagcacaaggtatttttgtttggttaagttttgtagtttttttttttataaaacaaatcaagtttatactagtttgaagggaagatatgggaaaaacatgaatattttgtttggttaagttttgtcaagtttgtcctagtttgaagggagattgttttggaagggaagagaaggagtaatgctactcctactagattttttttgaagaaacttaatttgcaaatttatgcgatactactactactagtctagtgctactaaaaaaaatggagaaaattgtaatattgggactgcaaacacgtgggcttcgctgttttgacactccgagtggatgacaaatgggtccatctgtgtgtatgaaatgtgggtccagtgtcattatagcaaagtttaatgtttgccgtgttataattgcaaatccccaaaaaaaaaaaataggaatctttacaattcaggtgttcaatgaaaaattctctctctttttttggtttctactagaaagaggagaaactttttccccatatcaccatgtagaatagaaatggaaaaatacagaataaaacaaaaaaaaaacaaagattcattttgttcgatttcttgtaatttgtcaattttttctatgttattccaccaagaaaatattaacacatgttgagcatgcatagctttgttgtcaatctcatgcatatttgtctgtattttcgctaacttttttctcaaaagagtatattttttcctaactagttctgtcaatttcaaatcatgatcaggtgtccaatgcgttcatgccactggccaccttgccggcgtttgcaaaatcactggagaaagccgacgccgccgtgccagacctgtccctctcctcccgggtggcgatggccgacgccccggcatgtccggcggcgccgagcgccaccagcagcgccgtcacggatgtcgctgtagcgcagcggcagcaggcggtgcaacggaaggccagacggtgctggtctccggagctccaccgccggttcgtcgccgcgctccagcgcctcggtggcccacaaggtgaggatcatctcattctcatcaacctaaattgtgcaaattgccacattttattttagattcgatttttttttccaatgataattttagatgattgtattttctttctgaactgtttagatgattgagtgataatttgtggtcacattgttgattgctcctagtaaaattgtttgattaattttttgattggtgcgctgaaacttgcttaatgtttttttattgttgatgcagctgcaactcccaagcagattagggagctgatgaaggttgatggcctcactaatgatgaagtcaaaagccacctgcaggtttgttcagtctcaactccttacttttacaacctaaaaaatattgccatatgtcggtggcaacaatttggtacgcctcttttataaaaagttcacgaacctcaaagcaaattgtgcagaagtaccggctgcacacgcggcgggcatccgacggcggtgatggtggcggtgaccatcagacggttggcggccgtctatggccgctgccaccggagcaatacaccacctcgcagcacagcacatcgcagtctggctcgccgcagggccccctccagctcaccgtgtcgtcgagccacgccgtgtcagtgaccgccggcgatagctgcgacggcggtgaggaggaagaggaggacgggaagtcggggagctatagctgggagatgcagaatggggcaagggcatcatcatcatcttgagcaccattaattaattgtctccaggtgctgcacagcagcagtgaccgaagaacttaggcctatttctgtacagtggttgagagctttttttgggctttttttttggaggatgagattaagtacgggagttacccatgtgagtaatttgagttgttgttgtagagggtttgagaatatgagaggtgttaattacatcacattgtataatctttgggctaaattgtgatgtcgagattaattattcttatgtgaggagaatattgctagattattgtccacctttgatgcctcctgttgtgcaaatttatttatttttttgaatatgcaaggaacacatctttttattaaggggaataaagtttatttacaacgataattttatacattataagccataatggcttatcaaaaataaaaagtattttacgaagaaaacttttatatatgtgaacaaattatgggaaaacacgctaaaaactgtaaaatgattccaaaattgagttttaaaattcaaatttgactacaagttataagtgaaaggcatgttgatttgtttgtaaaatttcatcaggcacactactggctgtgataataaaaaaaatgtaactgaaaaattaacaactgaggtaaaaaaatgaaagtgagatcattcgattagttgcttgcatcttgcagtggatcttgattggagatgttctcttgtgccaatgaatctggatcaggatcaggatcatttaaccctttttttggtaagtgcattggtgagcatcaagagagtggttcactctaacctactcatattaatgcttaatcaatcaagtggttggtactgcgtgcaagatggtataattatgaacttcggatcttgacttttgccgtgcatttcgtactggtttcatcctttggcgggaattggtagaggaagctacctctagggttcattgttcatctcttcactgtacgaatttactagtttttttctttaaaaaaataaaaactgtacgagttgaatcaggaacagtttataaatttgtgtccggtttattgggtttgaattgaattgggctgaaaaaaatgcaggtccatttatttcctgggccgaaatgggccatcccttttctgattgagccgaataaattgggctaaaaaatccagcccaatccacagtggtagtgaggggaaaacctccacgatttctcgcgccgccgccgccgccgccgccgtttggctgagcacctcgccgccggcgctattccccaccggggaaacctcgccggcgtgtctgtggagatttctgctgcgagggaagcttcttcgtcgactccgccggtgcggttgcggttcaggagctcgccgagcggcggcggcggcgatgagggaggcggtgacggtgcaggtcggcggcttcgccaactacgtcggctcccacttctggaacttccaggtgagtcgccctctctctctctctctctcgtctccggcaagacccccagcttgttgctccacctggtgcaagaacctgacgcttcttggggtcttcttcttcttcttcttcttcttcttcttcttcttcttctccaggatgagttgctcgggctcgccgacgaccccgacgccgatccggtcttcaagaacgccgcgctggacatggacgtcctctaccgctccggcgagacgcaccaggtaaagccgccgctcatcgctggcatgacaaaatgcgtcgtttcttttctttctgtatttgtttctcttttttttttggcgttgttgttcatcttttactgactactagtatacactgcttgatttcactagggtgttgctacctactgccctcgtctggtgtctgttgattctcgaggtaatttgatgctgaatttggtccgaatattattgtagtgcgtaaaaccccatgtttagcattcaacttataagcataaacgaaaattttgaatcttagaacttaatttcagggttgattatggggttttttttttcatcatggtttattttccagcattttgttttaaatcagtaagaacacgtatttaaatttttttacccataaatgattttctaatcgctaccagtccatttcacttataataagtatataagcgaaacgatgaggaaataagaactaagaactgttattttgttattggtagtgtatatactgcatgttcacggtggtatcatttgcagggtctcttggctctttgagttcatccggtaatctcggtcagtctagtactgctgcagatcaactcaatgttgctacatggcaagtggcgctctaacttctttagaatatgttttcatgtttggttttgcttattgtgcccaccatgaataattgaccactgtgatttggcatgtacgacctgcgcagaaggcggctgttgtttcagtttagttttggattgcttgtgcgaatgggttacagatgtgctaggatcgtttaaataagcttgcatatctataactgggggtaattctgacaaatggtgaaatcatgtctgcatcgtcaaagcaagcagatagcaaatacagcagctttactatagcactgttatattgatacagttctaggaaatttctgcagcctgagcaaacaatgagctgttcttaggctgataataagagagtaataaactggtaataatgattcatatgctcatccagctgctgtggaagtgatgcattgcatctgcctattattctcgtagagttgcattcatcttttgccttactgttgcttgttttgcactgctatgtgcaaatcattcaatgtattagtaactatatatatatatgttgaataatgtgtcgggctcataggttaccatgatgaattttccttgtttatgtaggtctggaaatgtaacaagatcagtctcaaaacctcatgggcggaacttgtttctgcaaagcttagttgaagaagggcagaatccaagcactagcaatggtggcagcaactcccagaaaagtgttgaatataaggacctgattgaatgcctagagaatggcatcaacttttggacagattattcaaaagttcactatcatcctcagagtttgtatgagttatatggatcatggacagactttgacaagttcgataactatggcagcgcacaagaggttgtttcagactggtcgcaaatagaggaaatgaatgagaggctaaggttctttgttgaagaatgtgaccatattcaggtcctacccttttttccccagtaaattatcagcaaactctacttacagttttgcaacaagctaacgttcacttatgcaatcatttttgccatcatgcatattatttagaccattattttaagcttaattgattcataatttaccacagggcatccagtttattgtggatgattcaggaggtttttccagtgtagctgcacagtttttggagaacattgctgatgattacacaaatacacttgtattgctttactgtgtgagggatccaatgacccttggaccatccaggaggaatcaaagggagtccattatgagagctcttcatgatgctgtttcattttcaaaactttcgtccttttgcaacctgatggtacccataggaccgccttcattaagtagaagtatactatcctttgcctgaactccacatttttagtttatcttttgttattgttattctgtgattttataggacttctttctggttgcctagttttgcctttgattgcttcaagtatactgatattgtgccttaagatactgcacttgattgcgtttctattaaatatcaactccttttgttcaagctgtatattcacatttgatttccatacaatattactttcatgaattcccttaaaaaaatactttcatgaatatacagaaagcttattctgaatgagattttctcacaaatttcctttcactctgtttcatcaggttgcatgtcaccgtacctttatatacaagatgagaaaccattccatgctagtgctgtttgtgctgcagcaatacattcaatcactgttccatttagattgcaacgaacgggaccgagttcagacttagcacattcatctggtaatcttgacattggcgaacttgtgcacattttatctgatcaaggtcggcagaacatggttactgctctggatgtagcgatgcctgccccttctttgacaggtatacaacataacatatgccctactgttataccaacattggatggaaatttaatcttgcttgctaattgcacactttaatttgcagatagagatgctatggggaacatagagatgaagctgcactctttgacccctgaaatcagcgatgaggacgaagatccttattcagttgaatcgctagtggttcatggagctcttgatagaggtctgcacatcttatcttttgccttaggatctgattaactcctattatttgtcatgccaacagaacttatttttctattgttgttaatacttacaatattgaacatttaacaacattataggcatggtggctaaattttggttatacatgtagaagtacaaagaattaacaattgaaatttgtttgcacaggcgggcaaaggacttccatatcacaagtgaaggactcggtatgttcagtctacgaagccagagagacaaagccaaaattttcccatctctcagcatctctttgccccctccctgtcccccttccgttcccgtcaatcttcagaggcaacattggccggcacggggagatccttagtgaccatacagaagaatcccagccaaagggctcacttgacatcgaatcgataccaatggcggcacggttacgatcaagcagcgccgtcctgcctttcatagagaggcgatcggggagcctccagaagcacggtgtcgcgagaggcgccatcgggtctctggtcctccatgactggggcttcgggagggaggaggtggaggacatgggggagcacctagcgaagttgctccgcccgtttcaccctgaaatggatcttacttcggattccgactagatcatcttcgaaaaatcttacttcgagaatcaagcatgatccatctgttgcaatttatgtggattgtagtaatactaaatctttttttttcagagggttttcagatactgaaaattcatgctcatgtggctggctgttgtgagatcaagaatgagagatctgaatctatggccctgtttagatccggagggctattaaatagccctctggaatcttactatttaagagtattaaacgtagattactgacaaaacccattccataacccctaggttattttgcgagacgaatctaacgaggtatattaatccatgatttgctacagtgatgctacagtaatcagccgctaattatagattaatatacatcattaaattcgtctcgtaaaatagcctaggggttatggaatcggttttgtcgataatctacgtttaataatcttaaatagcaagattctgaagggctatttaatagaccagaggttctaaacaaggcgtatggcatggtagaccttttttgtgttctactcatgtgcatttgagcacgggtgtaggctgtgtatgccacatgctgctgccgtgacattctgcggtgtttcaggccatgtacagatcaaccgggccctggcttctgtcaagtcaagcagttccattttcgttgtgatgtgaggtcacactccgtcggtctgtgacagtttcacatgaaactggagtactcaatttctgttaaaaataactaaaattcccgcatttcaaatataaaagccgataggctgtatatatcgggttttagccacattaggaacatggaaaattttcgccattcctatggagttattctataaatttcagcctcttttggaatgttggatttttgaggaatttcgcataaattgagttgtttcctgtaaaaatcctacggagggtttttggaacaaaagaattttataggacttttgatcgattgtactcctaaggaaaatcctttaaaaaacaaagatgatttcgggaagattttcaacatgatatcgaatcttttggaaaaattgattaacgtctacctatcttttcttattcatgtatttttcttgctccattcaaacaatcatttctgtagtttttacatgtttttctatccataagatttgagtatcagtgtcttaaaatttctgccattttctaaacagtgacaaaaaggcctcctatcattttcctggaccgaaacatttctttcatctcttaacccaatacctttcatgcctctccatcaagcatctgtacaaatcttgttgactaaccaagtccattagcacggtcaccaagaacaacactaaaattaaactgtcattcaagtatacaatacggttaataaataattcagagctgtcaatcaacgaaagtttggcatttttcgcatcaatgattggtggcgagcatcacatggccggcccgaccggtcatgtgtccgaaaacgcgtgaacatgtttataatttaaaagtgtatttgtaaattgtaatcgcaaaaacaaagacacgatgattttttataattattagtaaaaaaaaaaggagagactgactgacacacacacgaccaaagacatggattgattgattttttttagtgcaaagcgatccggatcttgaggtgatgcgctctttcttaattgtcgttccatgcgtgttcaggctcccatattttttttaaaaaaagataataaaaataattccaaaagtttgatttttcggcgtgtttttttggatgtatgcattttcttttttgcgatgaagtttcctatccttttcctttgtgaaaaaagttatgtgttttttttccaaaaggaaaaggaatagaatctctaggttctttttgcctttttcataattggtggatggtatcaagggaaaaagtaaccttttttttatgtgcctgttctaacaggttttatttttgaaagcgactttgtgttgaccgatgaaaattagacacacaacaccaagatttttcttaaactttagccctcttaactataaaattcatgaccaggagtccaggaccacttgaccgctaactcttttttttggtgcaaatctgataacctgtcttagcttaatctagaccggtctcggaaatccaaatatgtctgttgatcgcttccatttttactcaaccagccgctgcccgttggtgtattacgatattctaaagagccgtaatatttttcacaaacgttgaatgttaaaaattcgaaaattatgtacatcctccgcttaaagatgactatgaatagttgaacccacagaaggaggaaagaaagaaaaatctcgagtttgtgaggaaaatgtccaggcagtacttatcaatgaagaaactaaaatctcgagtttcgtccttaacgacgtcgttgacttttcacataacattatactaaaagaacatataatttttttattataaattatcttatcaataaagaaactaacttatattttttaacagggattatctgtaatactgctggtgcagtagcatacaagaccacataaatttaggcagtacatatcaaacagaatcattatctaaaaaaaacatatcaaacaaaatggaaacacacttgccagatttgagcaaattattcttcaccaactactgacatgaagacatcatattttgcatagcttacaaaacaatgttcaggattccaaatttttagcatggcttggttgaactgaccgtttcagcagaacagcaccaataataaggtaaacgcataccgaacatactgatgttccaacttttctagcttaatccagtgacttgcctggctgtaaatgtaatgggctactaagcttatggagacattgttttaacatctgcatcttctccaagacatgagcaaaatttgacaaacagattacaccatagttatctcattcagattttagaacaaactacgtaaatttagcctgtacatatcaaattcacagtatgtttggatgggcctgaatccacggtctacttgcgggaataagttcacccgaggtccctcaacttaacagcgagattttttgaggtcccttaatcacaaaaccagaaatttccacccctaaactatacaaaactgttctcaaggtccctaggcagtatatatgggtgatttcgctgatgtggaatcctagtcagcaaaaaaaaaataaaaaaaatatacgtgaggcccacatgtcagctgcacattccttcccttctcttttcttctccttctcctcttttctttcttctcctcttcttcttcaatgacggatcaaggtcagcggccggtgggcggagcagcggcgggcgagcgcgccggggtggcgaggagaacgacggagaaggcgagtgaggcgggcggcgaccttgctcccgttcgcgtgcgtggagttcctccgaccttgctcccgtccggcggtgcgtccagggcgcgcccggcgctgtggagttcctcctgtccatccactggtggagaaagggtttgtagtcccagttggtaaccctctgtagtcccggtttttcaaccaggattacgaatccgggactaaatatgtctatctttagtcccggttcgtaacaccaaccgggactaaagtttttttttcttttttttcttttctcatgttcaatctctccaaatcattataaaaataacaaataacaaatcacaccacaaatcacaaataactttctcatgttcaatctctccaaatcattataaaaataacaaataacaaatcacaccacaaatcacaaataacatatagcacgaatcacagatacacgaatcatagatagttcacatatcacatatctcctaatatcattcacaaatcacagatcgcatcacaaatcacagatcgaacaaatcacacagatcgcacaaatcacagtcatccacatcacattaagaagggaaaaagaaaaaaaaagcaaaaaattccatgccgggcggcccgaggcgctgcctgccgccgtcggggcggtcctccgcaactgccgcggggtggcccttcacgactccgctgccagccgccgcggggcggccctccgcgcctccgccgccggccgccagccgccagcgcctccaccacctgcctccgcgccggccggcgcttgccaccgccggccctccgcgccggccgccgcccgctgccgccaggaagacaggggagagaggaaggggaggaggagaaggagtggaggggaagaaaagctaaggataagactgaggaggagggtcagacaatggacacgcgaagagataaacatcgcgcacggcttggggtgatttttagtcccggttgttataaacaaccgggactaaagatggatctttagtcccggttgtttataccaaccgggactaaaaa

SEQ ID NO: 72902 - DNA, 17346 bp, Oryza sativa
cctgctactgcatcagtagtattgtaaaggatatgcatcatatatttatatatatatatacactaagctttaattaaaataaaataatcaaacgttacgtgaaaatttaacgatatcatggatgaggacagaatagtatttttcataataacacaagtggtctcaaagactggtgcagtagagagaagagaatagtgtggtcagtagagaggaggaaaagcctcttgtcgtctctttgacccaacgaccccgccattgctcacctccacctccacctcacctcctcctcctcctcatcccctcgccggagcggccacgccgccgggagggagggagctcgccgcagccgcagccgcagccgcaaccagccagctactgcgtgctgcaacctgggattttcttttttcttttttttcttgtggatttgatctgaagtggaggtgggaggaggaggatggagagctacctggaggagaatttcggcggggtgaaggcgaagaactcgtcggaggaggcgctccggcggtggcgcaagctctgcggcgtcgtcaagaaccccaagcgccgcttccgcttcaccgccaacctcgacaagcgcggcgaggcccaggccatcaagcacgccaaccacgtactccctcctcctcctcctcctcctcctcttccactcccgctcgctcgctcgctctgggatctgggacctcgccgccgaggttgctagggtttttcttatccatcctgcagagcgatctggagttgggggcagttggtgtgtgtgtgtgtgtgtgtgatgtgatctcatctccaccaactactagtgtttgtagctgcacactgtgtgcgtaggaggaggatcttgagcttagcaagtagtagcaaattagtagcaattttgtggatatggatgcggctgttgcagcgagaaattgcggagtctgatagtgatggctgttgctgagctataggaggggatccttgttgcttcatcgctttcgacatgtattgcggtggtgttgattttagtatactcgctatggtttgggaattaggaaacccggttcgcaagatcggagcatctgcatgtaggcgcttttcttgtgaacattgtgtagcaagcccgtcgatcagagcctactatcctttccttaattgactccagagtgcagctatgtagtagcttcgcactcacgaatggattttcgagaagttatagttggaaggttttcggtgctcacgctgctgcattcctagagcgtgctaagcttatttttcgcacttaattctaagaggttactgaatttcgtactgtggatggttttaacaggagaaactgcgggttgcggtgctggtatcgaaagctgcactacagtttatacagggtaatcatgtaatgattggatgctgtttcataatgtagaacgtgccttgttttggtattttcttatatttctgaccatttttagtacctaataaacatgccatcaaaaatacaaatactcaggtctttcacttcgaagtgagtatgttgttcctgaagaagtcaaggctgcagggtttcagatttgcgctgatgaactgggctctattgttgagggtcatgatagtaaaaagttgatcacccacggtggagttactggaatagcagacaagcttgcgacatcaccagcggatgggttaagtacagctgaggaaagcattaagcgcaggcaagatgtatatggactaaacaaattcacagaaagcgaggtccggagtttttgggtgtttgtatgggaagcacttcaagatacaactcttataattcttgctgtctgtgcctttgtatcgttggttgttggcattgccatggaaggatggccaaaaggtgctcatgatggtctgggaattgttgcaagtatcctcttggtcgtgtttgttaccgcaacaagtgactatcggcaatccttacagttcaaggacttggacaaggagaaaaagaaaatacaagtgcaagtcacaaggaatggttttagacaaaggctatcaatatatgatcttcttcctggagatgttgtccatttagcaattggtgatcaggttcctgctgatgggctattcatttctgggttttctctactgattaatgagtccagtctcactggcgagagtgaacctgttgttgtaaatgaagataatccttttcttttgtcggggaccaaagttcaagatggttcctgcaagatgctgattacaacagttggcatgcgaacccaatggggaaaactaatggctactctcagtgaaggtggcgatgatgaaaccccactacaggtcaagcttaatggtgttgcaactattataggcaagattggtctatttttcgcagtcataactttcattgtcctttctcaagggttaatcagcaagaagtaccatgaggggctgcttttaagctggtcaggagacgatgcactggaaatgttagagcattttgctattgcagttaccattgttgttgttgctgttcctgaggggttacccttagcagttactttgagtctggcattcgcaatgaagaaaatgatgaatgacaaggcattggttcgtcacttagccgcatgtgaaacaatgggctcagctacgaccatctgcagtgacaagacaggaacactgacgaccaatcatatgactgttgtcaaggcctgcatttgtggaaacataaaggaagttaacaatcctaagaatgcatctgatttgtgttctgagcttccagaaactgttgtcaaaacccttctggagtctatttttaacaatactggtggtgaggttgtgattgaccaagatgggaaatatcagattctaggtaccccaacagagacagctttgttggaatttgcattgtcacttggtggaaattttaaggcaaagcgtgatgaaactaagattgtgaaaatggaaccctttaattcaacaaaaaagaggatgtgtgttgttcttaagcttcctggaggaggatgccgtgcacattgtaaaggtgcttcagaaatagtgttggctgcctgcgataagtttatggacgagacaggtgctgttgtcccccttgataaaacaactgctgacaagcttaatgggattattgaaagctttgctaatgaagctcttaggacattgtgccttggttatcgggaaatggaagaaggcttttctgttgaagaacaaataccactgcaagggtatacatgcattgggattgtaggtattaaagatcctgttcgcccaggcgtgagggagtctgttgcaacctgccgatctgctggaattatggtgagaatggtcactggtgacaacataaatacagcaaaagcgatcgctcgtgaatgtggcatacttactgaagatggcctggctattgagggaccggagttcagagagaaaagtcttgatgaactactcaagttgattccgaaaattcaggtttgctatgcatatattaccttattgacttaagtttttaccatctatatacaaacataattcttggtgattctgtgtattgaaggtaatggcccgatcatcaccacttgacaagcatacacttgtaaagcatttgcgcacaacattcaatgaagttgttgctgtaactggtgatggcacaaatgatgcgcctgcgcttcatgaagcagatattggacttgcaatgggcattgctgggactgaggttagattatttaaccatttgaagagatgaaaacttcgagttctattctctctggtcacaactgtgtgtcatttttggatgttgacatggcgtagcaaatgcaactttgaccactaatttccattgcgataatgataaaactcagtagaattaatattatgtaagcatttttttattcatattttttttgtaaatccaacataaacattcggagatgttagaaacatatggttagaaaacatcatttgtttttgactggatggactaaatggtattaatcaactagcagatatttcatgatttataattttttattcaagtcatgcatttagtcaatttatccagcaccatacacccatacaaaacctaaatattggtaatctgaaatatccttatttatgtcatccagtaactaatgcttgcttattcaggtggcgaaagagagtgccgatgtcataattctggacgacaacttctccacaattgttactgttgccaaatggggacgctctgtttacgtcaacattcaaaagtttgtgcagtttcagctgactgttaacgttgtggctttacttgtcaacttctcttcagcttgctttacaggtatacttcatatcattgatgattctgttaactccagaatttggatatcctctcctgaccttttatattatgcaatcgcaggaaatgcacctctgacagctgttcaacttctttgggtgaacatgatcatggacacccttggcgcccttgcattagctaccgagccacctaacgatgacttaatgaagagagagccagtgggcagaacagggaaatttatcacaaatgttatgtggaggaacattctggggcagtctttctaccaattcattgttatgtggtatctccagacgcaagggaaaagcatgtttggccttgatggccctgatgctgaagttgtgctaaatacaattattttcaactcgtttgtcttctgccaggtatgtgtaccataccaaatatgtttctttttttcttcggctaggagtacgggtgttgtcaaagttgccctatgcatgcagaggcctcatcactaattcaattagttcatagtccatcacctgcacacttaattaatcaacatttttttaaaagaagtgtcctgcttttctccagttagcatccacattgttttagatgccgatatgttagggccaatgcttataaaaagggcaattcactatgacggaattcagtcagtagattaacagatgtctagccagatgtgtggctaacaaattgatggccacaccttaggcagggtatggcaaaaaaaccgagtcatgacatgtgggaccataagtgtggcaaacaaaataaacaataggctcataaagtgtgacaaagtttggcaaagtgaggtagtgaaccaaacacccctagtcccagaataacatcaatcctctcttctctgtactagcagttcaagatccatttctcttgcaatacatctgtcataatttgttgaaataaggagggtagtccaacagaagatgataattgtttcactgccaacctgataaactaacctggtatatgctatttcaggtgttcaatgagataagctccagggagatggagaagatcaacgtgctgaggggcatactgaagaactacgtcttcttgggtgttctcaccagcacggtagtcttccagttcatcatggtgcaattcctcggcgagtttgcgaacacgataccactcaccaggctgcagtggattgccagtgttctccttggcctcattgggatgcccatctctgccattatcaagcttcttcccgtcggctcgtcgtgatgaagatgagatgatatctgcagtgacagtatccatactgaccaaattccatattgtttggaggagctgaactctccatgcagtcttttggaaatgcatgtggggcaagcagtgggaataggcaatagctgcactttgacaagtttttttgtagaatatgaatgtgtcatatttcgcatcatattgtaagaagcattttgttttggcacttttgctggttcagttgtgtagcaggatttcaaggttggtgtttgtattggaattcggtgacgagaaaattatgtggattaatgaacagaagcataaaaatatctccttttatcccctttccccttgcacttgattttgttatgttcattgagtagtggttagtgatacaccgcattgcactttgctatagcgtccatttttcctccttttttttcacctatgaaattattatatcctgaattccaataggatactctttctccagccatttaagattttaagaattttttattgatgaaatgaaacacaattcttgtacgttttgagaaaaaaatgtcttggtttatctattaaaaaaacaccatggtacatcttactaagaacaataagtctttactaaaaaaaacactaaaagaaaataagtctttatattataaacaatttactcttattctgatcggtttgacccgtttatttttttaccacttattataagctgggaaaagaatatacacaaggaacctaattaacaagctactccctccgtcccataatacgtcccataatataagagattttgagtttttgcttgcaacgtttgaccacttgtcttattcaaaaacttttaaaattattatttattttatttgtgacttactttattatctacagtactttaagcacaactttttattttttatatttgtaaaaaaaaattgaataagacgagtggtcaaacattgcaagcaaaaactcaaaatcccttatattgtgggacggagggagtagaaaagagagggggggggggattttcctttttttatcagtccatatattatcttctgggtggattgggccgtgaattttccctaccccggcccatcgaattatgcaagtagaggaataagttcaccggaggtccctcaacttaaccgcgagattttttgagatcccttaaccacaaaaccagaaatcacaacccataaactatacaaaaccgttcactcaaggtccctaggcagtatatatgggtggtttcgctgacgcggcatcctagtcagcaaaaacaattaaaaaaagtacgtggggctcacatatcagccgcactcttcttcagtgagggaggccggcgcgagcatagagcggcagcggtcggtgggtggcgggtggagcggcaggtggtttcgccggcgccatctcttgctggctcccaagatgtgccgcgacctggagccccgcgcgagtggcggcggtgctcgagcaggccaccgcgggtgacctgctgaccatcgcgctcgacggcgccggtgagcgcgtccagaacgtcgacaacgtgcgccgcatcatctccgggcggcgtgaacggccggagccggaagccggaagccgagactacatgacttctatagcaaagcaaacaaactttggccacatcgtacgcgcacgcagcacgcgatccacttaatttggcagccactagctagccgcatgcacgaagctagtaactgctatgcgacacatgcatgtattgactagctctaactaatcagctaactaagctatgcattgcatgcacaccactaacagttttgtactggttaggcggtgctgaggcgctgagcgcgctctactacgaccagctcaagctccagcagcggcaatggcggaggagacgagggcagcgggtgggaatggcgtgatgaggtcgtcgtcggcggaagcaggcgaagaaggaggcgtcgctcggtcgctggccacgagaggtagctcggcggccgcagcacgcacgccaaggtttccaagaaatcttcaccgccgctgccctctaagaccctattgaagctctcctcgaagagcttaagtgaatgcaggatgctcagagccgcctcctccagcgagctcaccttcgccgaatcctgcacgccgcacgtcatattttcctagaaagaacgaaccagcggtgtggacgtcgtcttgtccacggtggtggcgtgctgctccttgacgatcactggtggagaaaccatctttgatcggtcggctcaattccacaatagtcccggttccaataaaaaccgggactaaaaaatatttttagtcccggtttaaaagctgaggggtatttttttgatctttagtcccaaccgggactaaagatcatttttactcctggttgaagaggttgtcaggtcgtatcaggctccaattatttttagtcccggttggtataaacaaccgggactaaagatccatctttagtcccggttgtttagaacaaccgggactaaaaatcaccccaagccgtgcgcgatgtttatctcttcgcgtgtccattgtctgaccctcctcctcagtcttatccttagcttttcttcccctccactccttctcctcctccccttcctctctcccctgtcttcctggcggcagcgggcggcggccggcgcggagggccggcggtggcaagcgccggccggcgcggaggcaggtggtggaggcgctggcggctggcggccggcggcggaggcgcggagggccgccccgcggcggctggcagcggagtcgtgaagggccaccccgcggcagttgcggaggaccgccccgacggcggcaggcagcgcctcgggccgcccggcatggaattttttgctttttttttctttttcccttcttaatgtgatgtggatgactgtgatttgtgcgatctgtgtgatttgttcgatctgtgatttgtgatgcgatctgtgatttgtgaatgatattaggagatatgtgatatgtgaactatctatgattcgtgtatctgtgattcgtgctatatgttatttgtgatttgtggtgtgatttgttatttgttatttttataatgatttggagagattgaacatgagaaagttatttgtgatttgtggtgtgatttgttatttgttatttttataatgatttggagagattgaacatgagaaaagaaaaaaaagaaaaaaaaactttagtcccggttggtgttacgaaccgggactaaagatagacatatttagtcccggattcgtaatcctggttgaaaaaccgggactacagagggttaccaactgggactacaaaccctttctccaccagtggatggacaggaggaactccacagcgccgggcgcgccctggacgcaccgccggacgggagcaaggtcggaggaactccacgcacgcgaacgggagcaaggtcgccgcccgcctcactcgccttctccgtcgttctcctcgccaccccggcgcgctcgcccgccgctgctccgcccaccggccgctgaccttgatccgtcattgaagaagaagaggagaagaaagaaaagaggagaaggagaagaaaagagaagggaaggaatgtgcagctgacatgtgggcctcacgtatattttttttattttttttttgctgactaggattccacatcagcgaaatcacccatatatactgcctagggaccttgagaacagttttgtatagtttaggggtggaaatttctggttttgtgattaagggacctcaaaaaatctcgctgttaagttgagggacctcgggtgaacttattcccgcaagtagaccgtggattcaggcccatccaaacatactgtgaatttgatatgtacaggctaaatttacgtagtttgttctaaaatctgaatgagataactatggtgtaatctgtttgtcaaattttgctcatgtcttggagaagatgcagatgttaaaacaatgtctccataagccttagtagcccattacatttacagccaggcaagtcactggattaagctagaaaagttggaacatcagtatgttcggtatgcgtttaccttattattggtgctgttctgctgaaacggtcagttcaaccaagccatgctaaaaatttggaatcctgaacattgttttgtaagctatgcaaaatatgatgtcttcatgtcagtagttggtgaagaataatttgctcaaatctggcaagtgtgtttccattttgtttgatatgttttttttagataatgattctgtttgatatgtactgcctaaatttatgtggtcttgtagtataagatctgaatgaggcaactatggtgtgatctgtttggcaaatttagaaataagatgctagaacaatgtctccataagccctacctcccaattaacctattcacttgagtttctactctatctttgagatgtactaatatctaataattccacccaatatcattaggtgaaccagaaaaaaagtgagccaattgggtttatcaattcaaagccgtcaagtcattgcaccaagaagattgatctttaaaccaaaacaaaaaaaaaaaaggttcaaacagggggttcatcagagagcagccgccgccttcgtgctcatgctcgaggagaggaggaagaacaggttgacgacgacctgaacgccgtctcggaggacgtgcggggtgggagcagcaacaatggcggcggccgatcaggtcggaacagagctcgatctttccacggcgaccattgagcgactccggtgtccaaattatgaggctgcgacgaaatataagtgggcattccaggccagatcagcagaaacacctagcttcctaggcttgtcaaaggttggggaaaattgagatgaacttatcatatcttactataaagttatcccccactaactccttaaacttaacgtgcaaagatgccgcataatcattcattaattaacaagataccacatcatcatccactaacaatcatcacatctaaacatcatgcaaacatgctatatctttatagttttataatttaagagcttttcaaatacaaacatgttaaattatcatccaacataatttcatcccactaatctatactttctataaagttataacccactaactctaaagcttaacatacaaccatgccacatcatcacccactaacaatatcatgcaagcatgcaagagcatctacaatctatttaattctacaaattatcatgcaagcatattcaatcaccacctctcacatcatttccacaatagttttacaaatctctctatcatttttataatatttaatatatacttatcaacatgttctacattaaagtgcgaatttcatttgtttcatgataaatattgataagccctaagattttattttttttctttttactcctagctgaattgtaacgaaaaataatattgaaaattacttagtaattcacgcagcaaagcgcggggaatcccctagtttaaaagagaactatatgcacttgctgctcacacaggcaaaaagagctatgtttccaatataacagtttattacagttggtaggtactccagtaaccaagtactgatgctgcactgctttggcatccttggcaagacttttgatttatctctggctgtcaaattaggtcagaaccaccctgtcctagtcagaagagaatcagccaggggccataggcatcatcaagtatatgatcatgaccatgccgcttgtcactgatagtctgggttcaacagaagtaagcaatcctagtctagattggaatatttgaataagaaatacgtttggaattttagatcagtacaaaccccttgtgtgtcaggatccgggggcatgcgaatatcataaaaaaaaaagaaaacaccagaacaaactttctcaaaaagggagctaacaacttgttcataagagcttgaaatgtggcatggcgttagtcaatccaaagggcatgactatatactcaaaatgacccatgtgagtgctaaaagctgtcttctaaatatcatctgggtgcatgcgaatctggtggtaccctgacctgatatcaatcttagaaaaatatttatcaccatgcaattcatctaagagatcctcaatggcagggatatgatatttgtttttaatagtctgagaattcagttgtctgtaatcgatgcaaaggcgccaagacccatcctttttcttggcaaggatggctggggaagagaaaggactgacactgggtcatatagtttgagaatccagcaactgttttattagatcctccagggcattctttttatgatggggcagtcgatagggcctcacatttactggctttgcattgggaactagtggtataggatgatcacaatccctgctaggaggcaagtgtagtggttcagcaaaaacatcatggtaattatcaacaattggcaagagacttggtggggtaggagtagcttgtaagcagaacactgcaattgctgaacaatcagaatagctcctgctgccccctgagacaacagtttgtccagttgatgagcttggaccataaaattgcctttaggtactgtggctttaaatgatagtgtaagtggtatagaaccattgagggacagagtcaatgttatggtatgaagatccaggccgtgtttagttacaaaatttttcttcaaacttccaacttttccatcacataaaaactttcctacacatacaaactttcaactttttcgtcacatcgttccaatttcaatcaaatttccaattttggtgtgaactaaacacagccccaatgtaattgggctatgttcataaatgggttaattggatccagaaaaaatttgaaaatataccatttattttttttctcttagaaatattcgggttgtaatttaatttgcacaaatataccgttgatattacgatcacgcacaatgaaaacgcgagatcgctcggtgtcacgcggcaagttcgcaagagtgagcggtcttgcaggctcaaccagcgagagcgagcggtctcatagactcaagtagcgataccgatccttgccgctaatcactgattaattagtgattaattatcttaattagcaattaatcaattattaattgatcactaattattattaattaatcgttaatcattcaattttcaaaacgctctcgcacactcaccatgcgagactgctcggtctcgcatcctcttcatgcgagaccgcccgtgtcgtcagcccacgtcagtttcacgcaatggtttagcgataccggtggtatatttgtgccaagaagtttatatcaagactatttatgagaaaaaaatatgaacagtatattttcaaatttaagtcattggatccatgtcattataattttatcattttttgaaaaataccattactattcatctatttggaatcgtgccattgtaattatatagttagtcagtatatgccactacttacccgttcaaaacatattgtaaattttttggaccaaattaccctttttcatccttcatttctgaaagttcaagtgccattgatttggtttgatgattaataacaaatccaattatgtgagactaatgtttttataagcatttctttgcctagtctcatgtggatatgaaagtggagtgttggtggacctaaatcacaaggatgaaatgcatggagatcaagctatatgtatcactctttctcttcatgtacatattgatatgatcgtatataatatttccacgtgattggcatatgcatgtgtgactaatgttttgtttgagtattatctcttatttagtctatttacattgagaacgtggagatgatgaaggtatttttttagtatctatatttgagaaatgccttctattcttgtataggataagctctcaatgtttaatatcttgttatgcatatacttgcttcacacaaatattttgtatgcatacatttagggggagcaaatcctatactttagttatgcatgtaatcgatccaagttattcaccttcatttaattgggatctttacatttgaacatatatttgagtatatgacacttgtggtgttgattaatactcatcatttattcatatccttttatacatgcgatcggttggtcaacatgtggaggttgacaaccggatcattgggactaataattttattgagttgaatgaaagaaataggtcccaaggattacaaaggtgttgatgctcaagtgatatcattacacctaataataccaagaatgacaaagtgaagatattgaagatgtgtgatacgaagtggctattatagcaagatggtgaagggcaagcgatgctcggtcgcgatggaccatgcggcggtgaagggcaagcaagggggcttggcgccgaagaaccaaatccggtggtgaagggcaagtgacggctttgtcatgatggaccgtgagagaccatttgaagctacaagtaaccgcatcaatcatttgaagaatatatggtgaaacggtatcggcattggcgtccctcaagacaatgaaagaaagatgaaaaaaaggcattcctaatggtataattatcttcttatttacatttgagtttaggaatgccgtactattaagagggatgctacgtcgagatgtttgtgtatgtctcggtgctcaaagtgacctatcatagtgctaccttgagagaaacccaacctttaacctattctttgagtggttttagaccttgtttttggttgagtttggtagtcctctgagtgagctttccatagagtccaagttcataaaaaacggactcccgagcgaaaagttatagtcgttttactctgtgcttttcggaaagtccgaaaaattaccggaaactccgaaaatttctccgaaaattttcggacattccgaaaatggctgtgaatctgagatttgcttcagtaagttttcaaacttgtccgaaaatgcttttcggaaactccgaaaattacagtcttggcctccaacggttagtttttgaggggctcgggtatataaactcctccacccctcctttgaggggctgctgctcttggggagtattagacacatccaaagcccaatagccatccctatttccctacctttgtggtgcctctttgtgaggaggatttgagaagggaagagagtttgattgagagagtgaggagttgagagctagtgagcttcactccatcctttgtggtgactctttgtgagagggatttgagaaggggaaagagttggattgagtgattgagaagttcagagctagtgagcttcactccatactttgagcactcgagttcatagcaagcaaatcttcgattgtgtttgttactcttggggactaaggtctcctagacggctaggcgtcgccggtgagcacctaaggttgtggtgtgccacggaaagtttgtgaaagcttcgatttcacctctgcacggaaagaaatcaagagtgaaaccaaggagtgcatttgtgcaacctcgtgaggaaagggttgaaataggcccggcccttgtggctcctcaacggagacgtaggatccgtggaaccgaacttcgggaaacaaatcacgcgtctcctctcttggtttgcccatttgtgcattctctcatattgtgtttgagcttgtttttacccgatcgacttgcatgcttaattgatttagttggtgaccttatatcttgtttagataccttatttgtcaccttttgattcatatacattttctttatttgagctacaagttcatagctagtgttttatttcattatccgccgaacttttcggttgagaccggaacttccaatctcatatcggaagttactatttgaaccgaaagttctcatcattctaatatgctatgaagttgtgataatttttaggaacgcctattcaccccccctctaggcgacattaaggtcctttcaatttccatctttctactgttcatcttctccaccgaagctggatctgatggtcggtgccataaagctaaagctcgaagcaggtggcgccagtggtggcagtgggaggatgaagcaggaacagaccaggggtggggtgcagcagaaaggatgcgacaaaccatcttgtcttgtgcaatgcaaccgcccaaatcctgaaatgatatccatggctggtgccactagctagctagccagaaagtttccctccagattcttttgattgctgatccgtcgtctctgtctatcctatcatcctctcaagctccaatatcgatcaaccgtagaaaccccacgagttcaagggggatcttgcgcacaaaagacatttatcaagccctaattggacttttgtgtggaagatccgggccctgccaaaggtgcagttctttgcttggcttctgtcaaaggaaagactcccaacgaaaggtaatcttctcaaaaagatactccctccgtattttaatgtatgacaccgttgactcttcgaacaacgtttgaccattcgtcttattcaaattttttgtttaaatataaaaatatttatgttatacttaaagaatatttgataataaatcaagccacaataaaataaatgataattacataaattttttgaataagacgaatggtcaaacgttgattaaaaagttaactgcgtcatatattaaaatatggagggagtattgtgcaatcggcatcttgtgatctctgtcacctgactgaagaaacggctatgcttcctttgccccttcgctgttgatttctggctgaagattggaattgtcccaaacatcagtgataccagggaacttcactctctacaaccaagcggtagtctgccagataaacacttcagcaccttcttcctgctctgcctatggggactatggaatcatcgccatgatgttgttttcagaggggaatccccttcacttaatcgtttagcttctaagtgcatagaggatgccactctctgggctgaaagactgaattgtaccgacaggatagtagtggagtcctggaaacaaattctctcttctcctctccgttcaaatgtatcatgactttatgtattcgatcttcctttaaatgaaaattcaggtggggaagctctcccccccggtgaccagtctaaaaaaaccgtagaaacctcatgactagttgctgcgcctgcactgcatcacctcctcccgctgggagaacatcaccccatctgcatctctgtgcgccatcccacagattgctcgacgtgttgctcttcacccccatcccggttcctgttgcctcttccactgccaccacatactcagatctagctccaatggtggggaaatttaactatttgccacttttaggttaggcacttatccaaatgcccctcttaggtttgcacttaataatttgccactggagagaggtgatttcttaactatttgccacttttgcctacgtggcatgccatcgtggtgtgcacgcgtggaaaacaatatggaccccacccgtcagcccctttcctctcttcttatctacctccggcccgagcaggtgccgcgccaacgcgccgtggtgaggaatccaacgacgatgggcgggagcggcgcaatgaggctgctgcacgcgaggacgtgggtgagcgcgaccgccgagaggccattccgacggaggccgtctaaggcgaggccgcggcagcgaggtaggacaatgagcattgtggccgtcggtggcgaggccgaagttgcacatgctgagctcccacatgacgcggtggacccgggtgttgtcgacggcgagccctacctggagcggtttgagctcatcgagacgtcg

SEQ ID NO: 72903 - DNA, 37518 bp, Oryza sativa
ctagcaccgttgtaattggcatcatagtaacaaatagatgatccaatctccaataagggtcggacatctaattttgagcatagaaaatatcaaatagtattcggataatccgatcgccaatgaggaccggaccagccttataccattgattgtataaatggagtttgatgataaacgtgtttcggctctcattgatctggctttaatcatcaagatcaagatagattaagaacacgcagatgttccgatcgccaataaggaccgaacatctattgtgtttaatctagaaaattaatatttattcaatgtgctcaccatccagcgcaaatatcttgaatggcggcatgttgtcgataaatgactcgacttgacgaaggacgccggctgcggtgtttaattttctccgcagtggcagcggcaccggtttgctatcaccaggcgacttcaatctcctctcctgattttcctaatctactaagaagaatgggatgaatgaaaatgggcagatgggtgtctcctgtggcgtcctcggcgtcccccgctctagatgggttctgctccttatataggcagcggtgacggaaacagcctccgaatttccagcgccccgtgctaatcctcctgataaaccgatgcagggacgagccaatgcgtcgccgtgtactggagataattatgtgattaacatgcctaatgacggtgggcccatgtgtttaatcgcctgtcaatttccaaattggagataatgatcctcacgtagcaaagcaagtaacgatagcacttgcttatttcttttcttttaatagctccaatcttttgaatcgtacatcggatttaaaattcatttgaaccattactttctattcgaattatacatcaaaacgagtccaatatcgaatatattcggacaccgtgatatttaaaatttctgggcccatatgtcatatagacacgtctcgtatatatttaataaaattgggtggcagataatattttcgtacaaaattaaatgcccaataatttattatatcttatatgaatttttttgcacaaaaactcatcaaagaaatgccccccaccgagtatagtctgtacgcgaagtaggacaggctaatactcggtgaacaaatcatctattcagataaacctctccataaacgattaattttgctggtaactatcaccagtatatctccaacaagtccgagacgtatcaaaactgattagtgattaatccggcatggactccatatcgccgggcatatatattctcagcagccacgcctgcctagggtttcgaatttgtcgtccttctattctgaagtaattttctctaatctttgttcgtctcactagtcgggacaaacgaaccgatctacgtgataaagaccaggtttgctctacttgactatttcttgctttacatatcttgctaataccttgaaaccctcacgatcaggcatgtacttttcaataatcttgtcagctatttttgcctcccacttttgatagtactttaagatggggagagagagcaaagaaaacgttcaaatccgtttcagggcgagcgagccaaaaagaaacaaatcaccggagatcaacacgatcgtgatcctgaattgattaatacggaggagcaatgcgcccctactgatcaccagcgaaactccatggaatctggcagttcagaaggttctcgtgacatgcgcacaggataccttaaaacaactgctcacaatgtatgatcaaccttgaaccactttattgttttaaaacataagcgtgaccatactacttgcttgatgagcttcctgaacttcctttattatttctcttttattcttacagaaaatgccaatctcaatgtacatattatttagcgggtatgaaagagaagcaccgccgcaagaagaaaacggagaagcgttattgtggtgagaggattttgatttttttaaggatgcagagccaaccggtaatttacccgaggatgcacaatcaaccaacaatggtgaagcaaagaaaacagatgatttcatgagtcaggttgcttcatgtttgaatattaagtggggtcaacaacttatacgtgaagcagagtggatgtcgctcacgcagagtcgtgactgggcagcattccgtgtcccgacaccattttaaaaattacttgccaattgcaaggatgtccttgtaggtcatcaagatcaaccagggacacagccaagagggaggcctggcagcatgtgtctcttgaagccggttttatttaatgactccgggacttttgatgtgccacgtcatactggtacattggcacaaaagttcattacctcaagaaccaagcgatggttggaagatcagccaatgcagttaaggctagaaatttctcccaatgacaagctaatgctatgggctcgtatgctaatggtgaatccgtacgaccgtacatatctcaagaaggccggcgtactccgaggcataatggcgtctatttataaatgcaagatagatccttcattagtggccgcctttttaacttattggaatgtggatggacacactttagtcaccagccagggagagatgggttatcctctccatacaatgtacgatgccatgggcataccaatttcagggcgcctttatgaagaatttatccctttaccatccacagctcgtgggcatgtgcagactctgcacaatatatatgttgaggagtgtcccctacaactaaatgagggtcctggaatagtaaccatcgcgacatgggtcaatcacttcttcggcgaccaccctgtgccttttcagtcatttttacccaatggttttgctgatccaaaaaaacctttatatgagggcccaaattttcgtgttgagattcggaatggccgacccactgctatcatgtgtggtctcgaaatgacttacgtacacacctacccattggtggtgtaccgggcagcttttatcgccgcatggttatgcacatattgcgttccagtggaggaaggcaactttattcgccccgaggtttttactatggcaatggaaatcgctcaaggcagccgctgggccattggtgttacaagcatggcatttttatatcgtgccctggacaatgtctaccaccaagtagctgcacgtcaggcttctgcgagtgactgttcttcatttgtgccaggccattttattatgggctggtttgcatctttttggagagggttcctacgtcggcaactttatcttgcccggtgatgaacccgccctttattatagacttcagagactatgagtctatggatattaagagcgcacatagcttattttgggattttaatgatgctggaacggctttacgttcactggacttcttgggacggtccagcatccgttttcccacatccgaccaggaggtcgagttatttgatgaccgttctcccaaggcacacagggcaatttccatggcagccgtggatttcttggtcagctgcactgttggcggcgtcacctataggagaggtgaagtttttgacaatttggtttactgtcctcatcgattcgctcgcatgttcaactatgaccagcatgtccccaatttccttatgatcaccattaacaggacacgtagccttgattttccaagttacctaaatggcaattctagggatgaatcgctgcaacttttgcaacggcgccacctagcttttcataggccgaggggtcactcaatatttattcaacctttcgcccgggacaccatacgttcacttgattacatcaacgggtgctctcaagctttcaattttctaaagcatccgagcctattctgttcacggtcaaaacactccaccaaagctgcaactacgaaaaatgcacccggggcagaaacatcaggcatgcagtttaccaaattttttttaaagaaaaatatatactctgttatcaatatgaatggtcattggttactgtttcctctaatttattttcgtcccccttcttttttttaggaggttcaggaggtagggtgggcacacctaagcaaagaacagccaagtctgtctcgatctctcctgagcaccaggaggagagcgctcaaaccgagatcaagacaacgttgccattacccgcctcgagtgcgaaccctacagagattgtgagggtaggacccgaccggtctggaaaagacatcaagaaaatcagaacatgcattgccaacccagacaatgtcacaactcatgtgtctgcccaagcctcacaacaggagttattagtgttacctcctcgaaatgagactgtactcaactcgtcagccatgacgcatatcgacccctacagtgaagggttggctattccacatgatgatataggcactctgcccacagatcttcttacaggcgatttttctgatctagccactcttttggatggaggggcaaaccctgaaaccagtctctgtttagattcgcccatttttccgggtgctactcagaaggacaacgttaattcgcatctcctagaggacgacgagacgcgtaccgaggcttgtgctgatacagtaaaagggggcacctctcatcacggtacaactcatttattttattttatagacatttctgtttgttcctttttttatacaaataaccaatttcatgcactcccttccttcttatgtgtttcagcttcactgactggagttgaagagttgtccaatgaatccaagaagttatctatggatgttgagcaaatcgtcgcacaaattctaaaggcaccgaacgtagaccctggtgcaggggaaaactcctagttcaagggatttcatgggaacaactcggtgaccctgccgaaactttcagatgatgtttcagctcgtggtcttaaacatgtctggtctgagatcaaagcgtttcaagaattactcaaacaacgcccgatacagaaggatattgtgcttaaagagataagcatcaatctggatttgtggagtaacttcttctcaaaaccacctcctgaaataattaggctaatggaagggttacgtgtgcaaaagggagcgctatcagaggaagcgccactgccaaccactaagattgaccatcatattgatatgctccgcactgctcaagacaaggtggagtcatcgtgcgtcgctttggcagcactaacgagtcaatataacgtagaacgggctgtagaagaaggcaataagagggagtgctctcgacaagcccagaaaatcaaagcagagatagcaatgttgcaagcaaaacttcaacaggtggaagatgattattcccgtgctcaatgccaccaagatgttgtaatagagaacttgaactcccatcttgagcgacatcgacaagctaaggatcgaggatatgagattgcggcacagttagagcaggcgagcgtacaccaaaagtctctccaaaatattgaagactttactaagccagacgagtttggtctgtcccaatatgtctacaatatatttgattttttcataggctgctcattagatgagtagacgctgttttaaaatcttgtttcaggcttgtaatagctcttcagatattttatttgtttctgatataacagagtgaactcctttatttgctattatatactttgatttgcaccagaacaacggagtgaactccttcaaatttaataggagcgttgcattgttaccaaccgtctttgtgcactggcttcttccttttttttctttatatatatacatttcctcacataaaagatgctcacgttcagattttttagtggctttactactgtagcagtaacagtaacgccactaattcttcacgattctggttcagccatagattttttttattcaattttttttactggcttttaaaagaccagcctccccgctatagaaattatagcgaaattcatgcaacaatgcaaatgtcgataaatataccatagcgaagattcatgctatgacataaaattccttgtggcgaagaatcatgccgcggcgtgagaacaaaaaaaaatttaaggaagaaaacgtagcgaaaaattcgtgccacacactgatgattatatggcgaagtaatcataccatcttataaaattctattgcgaccaaaataaatcggtgccaaccaatagaaaattaatcaagctagacgcgaccgttaaaatggttacggtactaggcgtctaaactcgaagggtttcacagtcctgcattgaccgtactggcatgctttactgctcccaaatattgactgaccatcatccgaaaatcatagatgctggttcagtgcaactgtacgtaattgactgggccactgtgagaacgcgtcccagtataaacttgataggattaattgccgtccgaaaatcatagacgttggcataatccaattgttcatgaaataataagatcactgtagaaaaattcgttacagtgcagaattgttggaattaatcgtcgtccgaaaatcttggacacgggtgaaacccaattaaataataaaatcactgtagaaagcacattacactgtacaacttataatattaattgtcgtccgaaaatcatggacattggtatgatccaaccatatattaagtaatcatatcactgtaataagaacaccacagtaaacttagtaggaataatttccgtccggaaatcatagacgttgtcatccttcttttcttttgccacgtgttttttttgccacgcgtcataaaggccttcttcacacacatcttgtaaattcaggcttcaaatattattagcatatgagacggatgcccccgccgagtagagttcatgtgcaaagcaacagggactcgactcggggaaacaataaatgagttgtcttgtttccaaggaggagagagaaaaaaaatatgtgggatttttttttgtgtgttggcttttcttccggtcgccaagctatgaggtaacgaatggcaaactgctggaggatgtaatatgccctcaatttctgaataacgacgggatctcgcttaatgcttcaactccctcgtgtaacttgtgataatgagctcacgtttcatcaggatctcttgaaaacaaaggggtcttttctgagttttccttcaattatgtgcctcatattttttacctttatcccaggaaggaggataggataaggctatatttcaaaggtggtttgggtcaataggctatgaaattgccattacttttgctgagggtgggagatgactacttcccgctttcagattgaagaagagcaaccaacccggctacaggctgctgccaagacattgccatactttcgctcattttcttgacgatgtcgctcgagatgggagttcaagttctctgttacaacatcttgtcggtgttgtgcactggagtgggcatcttccacttgttgaagtcttgcttgcaacactgctatctctgctctaactttccgtgcttgtcgtgagcactctctcttgttgccctcctctactgcttgctctacattatattgactcgtcagtgcctccaaagcgacacacgatgactccaccttgtcttgagcagtgcggagcagatcgacgtgttggttaatctggtcctgttgtgcgagaacaagattagtagttggcagtggcgcttcctccgatagcgctcccttaagcacgcgtaacccttccattagcctaattatttcaggaggtggctttgagaagaagttactccacagatccaggttgatgcttatctctttaagtataatatctctctgtaccgggcgttgcttgagtaattcttgaaacgctttgatctcagaccagacatgtttaagaccacgggctgaaacaacatctgaaagtttcggcagggtcacggggttgttcccatcaaattctttgagcagggagttttcctctgggccacagttcatgttcaccgcttgtgaaaattgggcgattatatgcttaacattgatagacaacttcttggattcactgaacaagtgttgaatcctagctggagcacatgagaagaagggtagtgtgtgaaattgattacataaaaaaaaggaaaacagagtggacagagaagtataaaatgaaagaaaccagttgtaccttgcagagtggtttctcctgcccgcatgacagaattatccccattacaatgcttactagtggcttcggggcccactgccttgttagaaactccatctggtcgtcatcaagaagcttactagtaggttgagttgggggcatggtgcagatagtatcacacggcgtgtttgatcctccgccggaaaaatcaacatatgttgcggtatgatagatatgttatgtttccctgtgaggaagctgtgatgatccacatgaaaaaataagtcggtggccctgtttgatgttcaaacaagaggctactttagacaaccacatccacttcttcgctgtcccgattgccgttacatcttcgggtgagatattttgctggtcaatgtgatagaaaaatttgaagtcatcacaccaaagaaacatctcgccattatcttctcttggcgccttcttggctagtccactgtataatgtgtagattgaggacgcctcaacataggggttccccttttaaaaaaaagaggcacttataagatggatcaattcacggaagagtttaacgattcagaacctaacttctgtcccttttttttattatgatcttttcgccgtgagatttttgcatgccaaggcccctcccttgctgggaagtttccttgataccttcatcactatcatggccaggcaatggtgggtcatctgggatctcctgccaagtataagtggggttgcacacgctggtatgatcggcacgatcactagccttctgcattttcttgtcttgaacagtagcaaagaaattcgatcgactgctttccccagtcgatcaccgttaatttgcagtagctctgatcgaagattttaacgatctaacatgagctctgttttaattactcgattaagaagctgtacagactttatttatatatataggacatacggccatgagcccgtatgatacatgaactcggcttcaatatatatcagatcatgcacgtcatttgccgattggcagccagcttgtgaatcaagccatgtaccacacggagatggattaatccttcgtaacaatatactactgagtatttcaccgagtgaagtctgtcctgcttcgcgtacaaactacactcggtggggggcatttgtttgatgaatttttgtgctaaaaattcatagaagaaataataaattattgggcatttaattttatatgagaatattatttgtagcacaattttactgaatatatacgagacgtgtctatatgacatgtgggtctagaaattttaaatattatggtgtccgaatatattcgatattggactcgttttgttgtataattgaatagaaagtgatggttcaaatggattttaaatccgatatacgattcaaaagattggaactattaaaacaaaagaaataagaagtgctatcgttactacgtgagcatgcatggtcattggctgtggcgattaaacatatggggcccactgtcattagacatgttaatcacataattatctccagactgcagtacacgttgacggattggctcgtctctgcgtcggcttatcacgaagattagcacagggcgctggaaattcggaggccgcttccgtcgccgctgcctatataagaagcagaacccatctagagcgggggacgccgaggacgccacaggagacacccatctgcccattttcattcatcccattcttctcagtagattaggaaaatcaggagaggagattgaagccggccggtgatagcaaaccggcgccgctgcggagagaattaaacaccgcagccggcgtccttcatcaagtcgagtcatttatcgacaacatgccgccattcaggatatttgcgctggatggtgagcacattgaataaatattaattttctagattaaacacaatagatgttcggtccttattggcgatcggaacatctgcgcgtttttaatctatcttgatcttgatgattaaagccagatcaatgagagccgaagcacggttatcatcaaactccatttatacaatcgatggtataaggctggttcggtcctcattggtgatcggattatctgaacactatttgatatattttctatgctcaaaattagatgtccggccctcattggagattggatcatctatttgttactatgataccgataacaacagctttagatatttccaactttcattggtgattggataatctaaccgatgttttacaaaatatattttgataccatgcacacacatgggagctattcgtgatctttggaagttaaaaattatggccgagtatttacgaggccggtgtcacgatattattaacatgtccaaacatataggaacggatacatgttactaggttccgacgaggcaaaagtaacgatatatccacatctaataaaggctggcatatatgactgggcaccgacgaggcaaaagtcatcccctttgttatgatacctgactcatgtatggacatggtgataatatattgtgaccaggtttcggcaaaacaaagccacctatatcacagttatcattaaatctctgcaccaacttcaaccttcggcgagcaatcaattttgaagacgacgatcacaagcgcagcttaaaataaaacaaaagaaataagcaagtgctatcgttaccacgggagcatgcatggtcctcggcgtcccccgctctagatgggttctgcttcttatataggcagcggcgacggaagcggcctccgaatttccagcgccctgtgctaatcttcgggataagccgacgcagagacgagccaatccgtcaacgtgtactgcagtctggagataattatgtgattaacatgtctaatgacagtggaccccatatgtttaatcgccacagccaatgaccatgcatgctcacgtagtaacgatagcacttgcttatttcttttgttttaatagttacaatcttttgaatcgtatatcggatttaaaatccatttgaaccatcactttctattcaaattatacaacaaaacgagtccaatatcgaatatattcggacaccgtgatatttaaaatttctggacccacatgtcatatagacacgtctcgtatatattcagtaaaattgtgctacaaataatattctcatataaaattaaatatccaataatttattatttcttctatgaagttttagcacaaaaattcatcaaacaccagatgaaaagaaccaaatgctgataacttgttcaattgtgcttacctggaatctcttgcattacattcacttgtttcttttgcattacgctctcttgctttgccttctgcatcatttgactccgtagccgactacaccaaaataaatggtaaagcagcaaaaacacaagatgattaatgcaactagctccagattgtgataaaagaagcatatgtacataagacacactagtcaaataaagtgtgaacttgttcagttggctgtcttaatgcccagtattaaattttgcttttcagcagagcaaacggtcatcagactgagctgtagtttttgacactgcaatcatcattttcttttatatcaagctgtgatgtttataattggtaattcgtaccaagactaacttaggaccaaatttattaaggtcatgtgctggcaaatcagtacaacgttcacgaaatgacaagctctactagttgaactgcacagaaaatagagaatgtaatgcaatttactgaagaggcaatgacaacgtattatagaagagtacaaaaggataacaccaagttagttactgcttgaatcatcgttaacaggaaaatagcatggcgttcagacaaatatgttcatgtctcgacacagcaaagcaatcgccgaagtactattagttagtcatttagctcataaagacatgctatgtttcaatacagccaatttgctagccatttaaccaacgtgttccctttatgttggaaaacaaacacaaagtagccagtgctaacctaaagaatataaccaaacagaagggacacatatcgaacctttggatgggattctttctcagatacgaggtgaagtggctggggaagaagtattcgccgtgaaagactctcttataggccttgcaacgggagggtccttgtacctcttgcactttctttatttcatcatcatcttcttcttcttcttccacctggatgtagagggtgggcagtgaccgcagcaccttatttgtcatgtccaactcaacgatccaaaacaggaactcatcatcgatcttttccatgagcaggaaggaaacgacacctggatcaaccaagctcaggtgagaaaaagtcggcacagcacgcggaagagcacaggtgtgacctacggaattagcacaaagatcccagaactcggcggcttccattgtaaaatccagttcccaggtcttttggtcgatgctgaccagagtccatgccgtgatggtgaaagcaggagggtatacatccttgtctgcggtggcggcaatggtgacgcagaccagcttgatgaagaagccactgtcactactacctctaacacaaacacagcgaactgggtcggcgcagtaggactggctgaacaagcgggtgctgccatctctcaccggtttggggagcgggatgaagctgaattgatgtggctcgtccccagggttgaggacgtcgatgagcaggatgccctggtagtagtcgacccagcacaggaagcggtcgtggagggggagcacggcgtcggtcctccactcgccgaggttgaggccgagcatgctcatggcgcgacggacacgcaggggagtgatgctccactcctccgcttcccctgattgcacaacacagagctccacctccttgctcccactggatgtgaggtgcgccacagtgaagagcgaccggccgtcctcgccgtcgccgtcgccgtcgcggcacaggaggccgacgtctcggctgcacatgtagcgctgccgctgctggtggtacggctggtacaactcgtcctcctcctggtcggtgaagccgccgacgaagcaaggcggcagccgcgtgagcaacggctgcgaggagggggaggcggagtagatgaagtagtcgagggggtagtgcccatcgacgttgaacccgggttcctcgaaggggacggcggcgacgaagaggatgcagccgcggtgggcggcgatgacgtcggggtagcggacctcggggaggtcggccggccactggggagggcagtggaggtagaggcgggagacggcgggcgggtcggcgacgcggagggaggcgcggacggggaagccggtgcaggtccggccgaccttggacgccgtgatgtcctcctcctcgtacttgtgcctcctccgccagctgcagcggacgtacgggtcgaggacaatccagtccgccgcccccgccggctccggcgatccccggccttcttccatgtcgccgcgccgcagttcggtgttcggttcggatcggatctagctagggttttacctcccactcccagatgtctcgccgccggctggagtgggattggaacaagggaaaggggaactgaatggggatatttcctcgggaacgggaaggaacgaaacggatcccctcctgttgaattttttttatttatacatttttttattaaaatatttacaaaaataattttttgtttcgaaaatttacaaatctaattgcctgccgcctttaaaaatcaccctctcaaagggcggcaagggacctaaatacaaaatttttatttgtgttcaaacccttcccaccggttttaattgcttaaaaactaataatgcttattcgatactccaaatgattttaaatggaaaagtgataaactacaaagttagatctcatcaagatctacaactttatataaagtttatctccatccaatgtcgtttgaaatgtagatctgagattttttaaaatgtgttttatattttgtaacgaatatttggatatctaaaacatcttaaatgaaaaagttattaactacaaagttgtagatctccttgagctctacaattttgatataaagttttatttcatctgactttatataatataattttaaattgtaaaattatagagctaacaagttatgctggaaaatttacatttaggtcccttgccgccctgtggaagggcgatttttaaaaatcgccctcccaaagggcggcaggcgattagatttgtaaattttcgaaacaacaaattattttttaaatattttaataaaaaaaagtataaataaaaaaaattcctcctgactttggggggtggaaagttacggtgtcgctgcacttggtttcatccctgccgaccagttcatccaacggcacacatccatcttccctcctgcataccctattcatattgggctacccagttcggcctgcaactgtggccatcggcttgcccatcaggccacattgactttgttgcctgctaccacatgcgcgaatgcagattttctttatttttaattttatatttattaaaatattttgaaaaataattttctattcgaaaaatttatacagaactagtagcccatcgccccgacgattttatcgacgtggcagacgaccattagccctcgcctaacgaccggccaccgagagcaccgaaaatttacaggcggtcccattgccaccctcccagagggtggtttttggctctaggtgcccgcctataaaagggctaggagggcggcttggagtcagcaaaccggcatggcttcgccgcttcccttttgctctctctctctcgcccttccctccttttggattttgagtgaatataatgtaaaatcggagaggtacaaggggttttataccccgagggcataaaatcaccctcccagagagtggcaagggggccacctacaagtgccatgccatcctcgccacccttttgcaggcgacctcccgcacataaaaaaaaaccctctggaacgggacaaggggtccacctacaaaaatgctgggccgagcacctgcacattaaaaaatcgtataatcgaccgcgttgaataattcaaaataagacaagtttcaagtaacatcattcatgcactgtaaatcgacaactaagttttggacaacactataaggcaaatggctattgtgactaaaacaagaataattaactatttaccacgtttacaagtggtgataaagaatttgtcactggacccatatatcatagacacatgaggacccacatgttatagacagtgtcagattatgaataccgcgtacctaatagtagttgactaaatctcggcatgagccaccacataccatgtcctatatggaaacaacctgcggatataggaggagttccgggtaaggaaagacaaccagagttctacatggaaacaacaaggactactcggattgtatccatattggtttcccctagttctacttgaacaagagaacacctataggtataaatacaaggccccctatgaggagaggggatacgaccacctcaatcaacacccaccatagaagacaagaacaatagatcaagacacaagatcaacatataagccaacatacgccaagacaagacgtcggatatcgacttcaaggataagcacggctagtcccctacctggcacgccactgttgacgtttgatgtcgcgattctctcgaactagtacgtagcaatctcccgcaccgtaacctccattggtattcgagagatgattctactcgctcgctagttctcgaaccagtacatagcaatctcccgcaccgcaacctccattgatgttcgagagatgattctactcgctcgctggttctcgaaccagtacgtagcaatctcccgcaccgcaagcttccattggtgttcgagagatgattctactcgctcgctggttctcgaaccagtacgtagcaatctcccgcaccgcaagctccctggttctcgaaccagtgcgtagcaatctcccgcaccgcaagattccattggtgttcgagagatgattctactcgctcgctgggtctcgaacaagtgcgtagcaatctcccgcaccgcaagtttccattggtgttcgagagatgattctactcgctcgctggttctcgaaccagtgcgtagcaatctcccgcaccgcaactttcattggtgttcgagagatgattctacttgctcgctgggtctcgaacaagtgcgtagcaatctcccgtaccgcaagccttcattggtgttcgagagatgattctactcactcgctggttcgcgaaccagtgcgtagcaatctcccgcaccgcaacttccattggtgttcaagagatcattctactcgctcgctggttctcaaaccagtacgtagcaatctctcgcaccgcaacttccattggtgttttgttttataagagaggagaggtggctacatggccctatatgttttgttttattttttttcctgatgaggataccacgttagcgaaaccaaccatcgatccatactaccataagacttagtttaacccaattttataagttgtagggtcatactttctccatcccaaattataggatgcctcttcttaaaaagttaaactcgataattttaactaataatcatactaaccctatcttccaatcactaaccatatcttgcagtaaatgttgaataggggatgcatcggttcgtgctcctccatgtatagccgcttcccaagttcccaacctcctcctcagtcctcacgttcacatctcccaagaacgatacgcgtgggacccaccatccccacgccccaattcaccacccaagccgactgacagcgaggccccacacctccaaccccaccatccgaccccacacgtcagccacataacccaaaccacccctcgtacgcaaagaaaataatctccgccgcggcagcgcgctgtcccctctgcctctgacacgcgcagcgccaataacgagacaaacccgaggaggaggaaaaggatcgctggccccacctggcaggtgacacagccgaggaggggggaggaaggttggcccccacctggcagtgattcatcaggggccacgtggcgtgagggatttcaaacctggtggtggtttttgtccatggggtcagccatgatcgctgcggcctgagctagcccgaaacggcaaaagaccaaagctgcaaaactttttccctctcgctcggtctctcctctctcgaggagagtgcagcggcaggagtgggggtagtcgcagcagcggatcagacacacgaacagagagagagagagagagcagacaacgagtacttcgctttggtttgatttgtctccttcccgtggtgtgttggtggaggaggagaggaggagcatttgagattggagagggggagggggaggaggaggaggttggtgcagtactgctgggtgcggttcgggggagaagcgcggatgtgagaggtgaggcgcgcagcgtccagcgatcgaggagatcgttttgatgttgattcggtttggggggttttggttgccttgtttctcagattcgtgtgttttagttgggtttctcgtttttttcgaggattttcgccgggatccgtgtggttttggcccccctctttttgcgcgtttcgtttcctcgaagctctcgtcgcgagcatggcgtacgtcgcctctgttgctcgccgaagcgacgagagggggaggaaatggtgctctgtttccggtggtttcgtcgtgagatgttggggtttgacaagcgccgggttctcgctggcttccatttgcctggagttctcgtggattaaatatgccgttatgtatattgcgatgatgcggttttttttcgcttgtgctttttgcgttttgtgtgggtttgggaaaatttttaactaccttgcggtgctttcatttgatttctggattttggattgatttgcctcatttgacaaggatttttgaggattttaatcattccccgtgcaaagtaggggaatgcttgattattctcttttcctttttcagaatctccgttcggatttgtccgatgcacaagtcatccatgcgtactgctaatatgcgtcgtctagtgtctcggcgcttctggattgaccagtgctagggttttaggtgctgttcgttgatggcttcatgccttgttttcctttttttttttttggagatttgggcttttcgatgatttacgttcgtgtgtattccacctatttgtggtgccacgattcgaccaatttcagccgccgtgcgaaattttccttgtcgtgcctgcttaaaagcagaggcgactgatggattcgtggaattccatttttgtgaatctgtctgcagtttcagtcccatctcctggttcttccgcttgctgcttttgtttgaaaatgtttagcgtacagtgcggcgatggctcgagtttcgtgggtttctttctgtacagagatgatattttgtttcttgatttcgtttatgtgaggctatgggttttcggttgatgtaaacttgagcgaaatttatttatgtgttcgttgtgttcatctgtgtttcaagtgtttgaagagttcgttttgtggtttgattttggcaggacgcgagtgaagagacgaccgggagcatggatcgcgccaaggcagcagcgcgcaaggacaaggcggcggcggcggggaaggagaccgccgtgtcccgcgccgtcgcgttggacgacaccgcgctgctgctcgcggcggtgggaagcttcaggaaggagggctccgacgcgtcgcggatgctggaccaggagatgtccacgaggctgctccacctcgcctgcaagcacgacgccgtgcagtgcgccaggctcctcctcgagggcggtcacggtatcaccgcgtcacccgtggatgccagggaccagctcacgcggacgccgctccaggtggccgccgaggcgcactcggccaggtgcatcgagctgctgctctccaagaacgcgcgcaccgacctcaagctggtcgatggccggcctcttctcgcgctcgagatcgctctcttgagcagaaggtatgcacgctagctagtgtcgtccattgcttgtgatggtgatcactgagctcacttctcaaattctctccctgcaatggctgtttccctgtactgactgatgttcttatccagagctcaagttaaatggtcactggacaactccattgaggatcttctgtcttctctgcaggaaaaggtctgtatggttactaccaatgttcattcgctgtctcatcatagctggtccatacatcttctcacacagaaatgccaccttgttccatgtgtaggatctgaatgtagtgaggctctggcagagaaaaccagagaggttggggaggtggcctacagatatgccatggagggtcgtgttactgtgttggcaatgctgcttctggtggctgaagagaagatatcggcaccagtcagtgtagtaatagagggcgtcaggacaaagaaatcaatctactactctattgtggatgaggctctgtccattggggatgctccagcccgggacagcaatgagaggagaaaggccctgctcagtgagattcagctacttaaccaatttggggcagcgttatggagagatcgcaacattgacaagagaagcctgccccctctgcttaaagctgccaaggtacctctgttcatactgctgttcttgttgacagttcacagagctatttcagaatttccttgcttgacactttatgtggtatgcatactgatgagttacaattaataccatgtaagctgagcttttgagtcattttcatgccctgcccaatttcaaaactaaaatttctccaattatggtccatgcaagatgcttaaaatgtgctatgcataacaaggtgaagtttttagtgttacaactgtatacaccataagactttcttctgactgacctctcctgtaggttggagatgtaattacctgacaattcaggggcccgaatctgtataaaataccggcttcggccaacaggatgtagggttattacctgacaattcaggggcccgaacctgtataaaataccgctttctgtgaggaaaccaacgaaaaccaagctacaaccccttttcgatcgcatgtccaagaaggtggccggttggaaaccgaagtttctctctccggatggtcgtctttgtttgatcaaatcagttttgatggccattcctgtccatcttctttcggtcatgcagctcccgaagtgggccattaaagatattgaacgctgctgcaggggttttctatggaaagggcaagaagaagttagtgggggtcactgcctcgttgcttggcgagtggtctgcaggccggttgagtgtggcggcctgggcatcagggacatcgatcgcttcggaaaggctttaaggttgaaatgggaattcaacagactagagcaagaagacagaccttggacaatggtgcggtggaaatctgataaggatgttcgcgacatcttcaattcagtggcacagcacattgttggagatggcaatcgcactgatttttggagaggtaagtggctgccccgtggaggaagcattgcaaacaactggcctattcttttctcctttgtgggtcgcacgaagatcaccgttgcacaaggcctgctaaacaacagatgggtgagggatttgcaggggtctctctctaatagagctcttgttgattacctggcgctttgggatgagctgcagctcgtctcgcttcagagtggtgaggcagattcagttttatggcggttctcagctaacggggtcttttcggcttcttcggcttatgagtttctcttctccacctcaatcaaatgcccccacggggagctgatttggaagaccaaagcgccagcaagagtgaggttcttcctctggttggcggtgaaggggcgttgcctcacggccgacaacctcagcaaaagaggttggccacatgatcccacttgtctgctatgtcaatcggcgccggaggactgcaatcacttgctcgtcaaatgccctttcactaacagagtgtggcagcaattgaaggcttgggtgaatgtcacttttcctctccctgctcagcttggcatggaactggcagattggtggcattgtgcccgccgctgttttcagatgaggttcaggactgcttttgattcacttttcatgctggtttgctggagagtttggaaagaaaggaatgccagggtttttgagaataaatcggttgtggctgatcgcttagttgcagacattaaggaggaagtcctgatctggagagcagccggccttttctcttgcgaggagtagccttaagctctttggtgcttgtaaatagtctttctcagttttcttaatttttcttcttttattcggggttcttccccggctcgacagtctaatgtcgtgtaatactggtaactcttctttcatcttaatgaaatttggtcggcgtccttccgccgacccggcaaaaaggttggagatgtaaatgtcacaaagatgctcctgatgggggatgttgatgtcaatgaagccgatcctgaaggaaacacagcacttcactggtgccttagtggtagttcaagcacacaggagccaaggtatgctatcagaattttgttctatcaactgttaaaaacttaaaatacaacatactagttcttactgctctttgcattctctttacttagttgtcttatgtatttgtgcaggattgtgtggctcctgctgaagaatggtgccagagttttccaggggaacaaacttggtcttacaccagtacacagtgctgcagctaagggaaattataaagctcttcaggtagccttttgttgcttctactcacacgatggcattttttgagcttataactaattgatagtatgtttgtttgctctgtaagtcacttctgcttcacgctcaagattgcgttgatacaccttccaagaccaaagaaaccccattgttcttagcagtgaagaatggttctttggactgtgtaaagcttctcctgcgttctggggctagcaccaaagtacagaacctaaggtggtaatatttggatttaagaagaatattgcttctgtttgatggcttgatgcacttaccatcctgtgatcctttgacattgaacagaaagcaaagaccaatagatgtggcaacgtcccaagatatgcgtttcattcttacctctgcaaatgtggctccatgtaagatattttctgacatttaaagatatttatcaactgaaatcacaaaaatgtttgtagtagtgcatacaattagcagtgttcgattcaatgaaaaagatttgaagattggtttcctgttggttttactgcataatgatcaatacgcagcaaataccttttcaacggaaatatattctgtttgtagggaaccgtagctcacatccggaaaaaagtgtgatgagcaaggaatttctagatgacaattttgttgattatgacagcaatgatttaaatgaaaggtttgtctggtgaatggtgcatgatttatatcagatcttccattcttttgaatactagaagcattgcttctcaccctatgtttcaaactaataatatatttattttgataatgtggcagctttactgggcttaaaacatcagcaagccatcgggatttccggtctagtaatggttctgcccagggggggcaagagtaagagccattgtgctcccaagcaaggttccaagtttgtgcctcgggtaaacaaacatgctctgcctatattaaccaattccctttttcttcacatggtctgcctcttataagattttcttttagcctaatcattggctgaagcacgactacactcggaaaatttttgttgggggcctcccaccttctgtgggcgctggtaaacttcagaatcctgaactacttgtacttaataaagttagaactaatgtgtttcgaagttttaacacttgccttgttttgttcttcctggcagagtacctcactgagttcttcactgctgaatttggacctatggaggaagcagtagtcattgggataaggatgggtgatcgggtgcaatccagaggattcggttttgtaaagttcaaaagagaagaggatgtgataagtgcaaaggaaactcatcatgtgtacatgcttgggaagagagtggaggtaaaggatgctgttgctagaggatccttgccttcagaaatccagaaaacttcttcattcaggcaccacaaccaggaggttccaaaggtaactcatcatctgttgggtggtgagctaaaggaggaacattacattaggaagcggaggcccttgccagagaagtgtcttccatcttggttctttatattcaggaagtggctgccaggatttcttgcagatgctactgaacgacttggagataggtacccattgagctccctgaagggtgatttcagagcaatttgcagaatggagcttgatcatagcacacttggttatcctaagctcagtgatttcatgcgctcccttcctggtatctgcagaatgtgtgtagtccctgtaggaagcggtcctgcaacacacaaggtcctccttccaccggtctcgcgaccgaagtatgtacccttgctagtaccattctcctttgatcatgatgagctcccagaatcagtgtcagatcatcagttcccgatgtctccacttaccactaatatcaccgaggactcccctcgtaacacagacagtcagcacggtgatacttgcagcgagagcaatgcggagagccagcaggatagtgcttccactgacaatggtagccaattgtacacttcaattgagcctgtatctacaagaaagcttgatgtagttgagcctctacctgcaagaacacctgatcgagttgaacctcagaagattggttctgatcctgcgagaaagactatttcccttgaatctggacttggtgtgcagattttcataggcaatggtagtgcaaatttgtcactacaggtcgacgtcaagaaagacgttgaatacatgctgatgttatatcaaaagagaactggaatcagcagtagaaatatctattttgtatacagagggaagaggctcaggttaaaccgcagcttactatcatatggtgtacagaaagacagtactgtgaatgttcgcagtagaattctggggggtgctggtacatcactggaggaatatttacacaagcacaagaatagtcttgtgaaaaaaaccgccttgtatgatggaagattcttcccagagttgacacccagaagcagtattcttttgagaacatgggtcttatgttttacaaaggcattcaaggagcgacattgctgggagcccaaatgtgaactctctcatttcaaggttatcaatggtcatgtcaaggttagcacaccagcaaaagggaacctcacaacgcattttctgcaagaaaatttatcttttctggcaaagacattaaaggatttcttcagaacaattggaacaaatcttgtctcagaatacccaccgtactttgaatattttatgaagtttatattgaaaatagatctaccatgcgtaccacatttgcagaaagttataattgaattgaacctatgctttatggattcatacatgagaggggtgctgacagtgagattgaagcaaaaatttgatagcctacctccaaaacaaagagccactttgatagataagatcaatcatatcacatgggatacatctcgaatgccaaatctttctacaattcctgtctttgataaaatcatcaaaaaagcaaaggatgatggagagccttacttcattgagaattcagtgaacttcgagtttaaggcgttcaatggatttaggttgagccgtgatgctcctatacatgctcctcaacacagatttgtaagtatctaacttgcttcagttttatttaattgtgaattgtttttattatgcttaatataatcatatccttgtcttattgcttttgtttgcttatccactaagtatcagtagtagtttagttgctcttttcttgttagtttactataaatatatgccatatgcttcgaataaaagatatagcttcaaaaaaaaatcaatcctctgttctgcttgctctctcaccctctactcacctccttcagttcattctcaacatattataggtatcacagtgctatttgtacttttcaggacaaaacatcggtaccttggaaggaaaattttccagataatacaatagaattgatgacacctgcttatctgggtgatttgcttcccgaaattatctggtgctttattctaaataaggtggacatcacagaggagtaagtatactgaactttttgtgagcttcttttacataatactttaattctaatccttatttgttgctactaatagattatcacaaagtcagactccatgctgtactatgtgccatcctataaaaacaggtaatatttacatcttgtctcatttatcttgatgttgcactctttgtaactgtgtaatagtttttgtgttagatgtgggtgaatatcccacgacacagcaaactactgtgcaggataaacagcctacaatggaagatgttggatcctcctcatcaatgcagcaaaatgtatggaagaaaatctggtaaggcgaatgagctgaagcttcacaacaaccaccaccgatcgagcaggagccggatgaagggtggaaaacagtagggaggaatggaaaaagtacatgttagctgcctcttccagctgatgaaaaacaggaaaagcttacaatgatcgtccatatgatttgaaaaaggggactgcagttgatcattgtgtactctttgtgcgggagttttgtaatagtagtgcttttgtattagaaacaccatgcttgcaaatagcttaaccatccaaactcatcagagggtactaaatgttctctctctttccaatcgcctacaacagactattaatgtgatgaaccttcaagttaagaaccgatattaactagatatgatgttgcttcctggccagtttgggtgtgaattatatttgctttagtttgttctgaattctgactattttcaagaatggcaaaaagaagaggatattttggtattacttttggagttcataatcacctattatttattactcttaggttatttacctgaccaattcgctatgcagctgaggttcctggactcatatagtggtaattgtgcaatttaatctggcactttactctaatcagttcaacatgtttatgtcttttagaagtagaatggccagttggatttgaatttttttttctttcaattatcatttatttttttcttttgtgtaaacacaatgttgtatagtctcagtgtgagtaatattgtcacctgaaaaatgaaatttttgtgccttcaaaaactttcatctgaagaagcattatcacattgtttctcctgctctggacatctttatttctcttttttttgatgtattccttgaaatctctacctgttctaccttttttcaagataatgttcatgtcctagcattggtccataacacactttgtggtggtcttttctggattggaggttttaacttttaacatggatgtcctgtttaattattagtgctcctttgtgccaccaaatcacaattaggaatctagcaagaggggtgaaaaccgtacggaaacggacgaaaaccacctttatcgttttcgttttcatacgtttttcagaatcggaaaccccggatacgaaaacggaattgaatattatcgaaaccgaaaatgaagcgaaaacgaaccattgcgaatacggtaacgaaaatttatcggaatacaaaaacccctcaaactgataaatccaattctcaagtctcaacggtcaacaattcatcataaaacataattatacaagtccaattgttaagtctcaacagtatatcacaaagcacaatctatggaataaattatctatgtttaagagagaaatgtcattgataaatcccaatgcaggaaataaatattcttatgtaacttcagatttgaataacaaatattttttaaaaaataacagccaaacaccatggtattcactgttcagtgcttaaaaaagaatccagggtatttcaatcacaaaatttctggaaagttttcggccgattccgagttcagacgaaaactgcccttatcattttcgattccgttttcgagaaaatatttccgaattcgtttccgtttccaaaaaattccgaccgacagattctgttttcgaaaataggttcggaatccggaaagttttcgtaccattttcaccccctacctagcaatgatttatttggtgcatgccttttagagcccacatatcctaatttactgtgtgtatagggttaatttgatctatgccattgcaaatatgtctattcaaataaatgatgtaattcgtctgtttatagctgtgccactcaaatattaaccaactgggccttacatacttcatacttcattcatgaaatccaacggacgaaaatcatctaatctaacgcctcagatcgtcccacatacccccttcaacctccgcacgtattccctcgccgaaaatcatgccgctcacatcgctcctcctcccccacgcgctccgcaacctgcgccatcacctcccatgccaccactagcgccgccccactccccggggcaaacctaatcgccgccgccacctactcctctctcccctgccgtctcaagctccacccccttgctcctcttgcgccaccactggatcactctccaccccggaggcaccgcgggtgatggcgacgcggcggcggtgccagaccgccgtggctcctctctgctctgccccttccttgtgcctcaccaccttgctgttgaaaggaagaaggaagttgcaaccactggtgtcagcgacgtcgactaaaccctagaaccaagctccagaatcgatctccttttgcttaccggtaatgggtgagccaattccgagcctacaggtacggactacttcctccctctctccccgacaatcacgacatcgattgatttatcccattgctcctgtgaacttggtgcattgtttgattcccaatttcagaatggcgtgtgaaattgcaagtacagagcgagcccagtcagtcatctcctcaccagcacggcggtacgagaagtttgggcacaacaagcaagcaggaggctagcaaaggtttgtcagctctaatccaaaaaacaacaccttattgcacatatgttccatgtatgtgaaagaccatatctactgtgcagacaacatgtgttattatcctatcgtcaaatctgatatacaaactatattgatatttcgagtgactgaataatcatattatcggtataggttagttcttttactcttctttcctggtcatattatcggtaggatgagggtatattggttggagttgctggcattttcaatggcttaaaaagtgatgttcagggttttttttccttggcagaagaatttgctaagaggctttgatgaggtgagctatccactataaaaataattttgtttcttttttgtactgaaagtgcctcattccttgtgttttctcatttcctgtggatctgcaggtcagggattttgttgcagatcagatgtctttgagggtatcacatttcatgctgaccgactgcatgagcagtacatcaattttcagctacagtgccactctacatatatactccctccgtccctaaatataagggattttaattattacaacaaatctggacaagcttcccatccagattcgttgtactagaatgtgtcatatccaaccaaaatccgttatatttagggacggaaggagtattctttactattggttatgacactcataggcttttatttctatagaagttgatgagtgtgaaattcttctgatatggcaggaaaaactgcaatttgttggccatgtagttcttgcttaagtacttactaaacaacttctgcaaagacatcttttttttatggcagactaggagacttgtctattctcaatcaattatataggttcacatacacttgtactcaaattcgtggcattccaaggttaaaggtgctgattagtggtcgtatcatgaggtcgagaaacatgtagttattgcgatgtatagatacatcataaatctgagtaaatcgttaagcaatatacattctccattatttaattattgcaattgttaattatgcttaaaaacataatgttaatcatgctcaaccgtaatgctggcaactaaaaatattacctagattgacagtagtacagttgaacatttgaacaatacctagactgacagtagtacagtttgggtggtgaaggtctcattgctcactgatggctttctaaatcccctatgccgccgtaagcctgattatcgtagtatattatttctttgaggtgttataggtgatatgaatgggcatgtacactgttatggccggaataaaacctaggtttgatgcccatttacatatgaagaacacacgaattaatttgatcagttattatgctttattctgcttgtttctatgcactacaatgccaatttgagtgcctatcttgtcatgctattcagtgtaatgtcttggcaggctatgaatctgttcatgcgtctatatgcagccttcatataagtaaggattaaccagattacttgctttgtctaatgcagcctcaccatttcatttgtggtgagcaccttaattccatcttgacattgtcgagggagtatatcatctacatctaattctgtatattgagtatatattgactaggatcttggaatttttatattaagtttcttagtttgatgatttgattagtttttcaactaatcaccattgatcacaagtaaacaccactaatagaagtttaatggctatttatctaaaaaggaaaaaactaagtttaatgattgaaactgcagtggtactatgatctataaacaaataaatctgctgagtttcctagcagctgctgggtgcactttcctcttgttgtgtcttccattaaatttcaaaactgcaaattctttgtataggtattacggggactcaaatgtacacctttcagttcacactcaattctgtataacagtaaaagcgtgaaaatataggaaagataattgatttgttcagaaaattattcaaatgctaaggtaatcactttctcaacatatgtatatgtacaacaatgcataccgtttctacttttcacagttggaacctgaaatatcaagattctaaaactaatgtgtgtctgctgcacagttcttaaaacaatgctatggagtattctatgactaatatgtgtgtactgtacagttctgaagattgttcaaagtgtggggaacttccgagggaaagttcgtcaaaaaactgcaggttaccagtgttttggtggacattcacatatttatgcaatttgatatgctaaatgaatttactactaatacattacatcaatcttctggttgtaactggttcagtggaccattagagctttctgttgacaaattaaatgagctttgttcatttatccaacaacttgttttctttttctgaatcttgctccaaattttgtgtcatattattgactattattttttaaaaccatacaaataatttggtagattttttcccttttcgctggacaaccagaactgcattcaattgtatgatttgtatcttagtcctttgcaggtaaggtatcgagaaaatatcataatggaaacagaggaagtgatgtaattctggaccttaattgtgaaccttaatatatacataactagttgattccccgcgcgttgctgcggaaattggttggaggcaacaaaatacaaaggttatatttgaaaagaaaataaaagaggcttgtacaaagattatcaaacttttagagtggaccaataggccaatattttgtttacatgacattgtttctttacatagggcaatatttggagtaccagtgatgagaaaatacgaattaattaaatcaagaaaattatggtgatctataaagatagtcccaaaaactttgtatgaaggaaaaaacaatttcatttttataaaaaaggaaacatagattataatgcacccgatacagaaagtctactccaatattaatgtaagtaagacaaacaaagttgtgcatgtacgcacatctttattgaatgaatgtcggtcagcaaaaaaagtgaattttatttctcaagatgataatttctttgtaagcctaatactttagtgcattatatctgtgtaattatgctacatccctaaattctgcataccaaccttgattgcatatatcttgaattgacaacagaattgtttgcatacctgtgtacatgtcaagtcttggcatctcagtgagcagtgcttgaaaataaattatgactaacagcaaaacactacttgattaggttccaaagtaaaccaaatcatcggtacatatgtagaatgcaagtaaagcatacctgggagtcaaatctggtatgccttgaaataggcaaatagcacaaaattcctgggtatcaaatcccgcttgaagttcgtttacagataaatatggcaaattgtaagtaaaagaatatttttatctggttcttggaattattgtcaggcctttggatttctgatataagtataaaaattttcaatacagaatgccttactggagtagcaggtcaggactaactttgaacccatcatgattcatgattcatgaactgaatgatggatttatacatcactcaatagtttgcaatattgaacacacacctgtgtacatttgtatcaggtaaatatgaaatagaagtgaatatccacttacagaagagagattagaagtatgtattagcggcagtttgctctaaaaggttataaaaataaatggggacattggaataggaatagtcatatacttgtattcctgtacacggctatacgatgaatcactgaatataatcgatagccactaaaaaaattgaacaccagaccatttgagcaaggccattcaaattccataccagcagcaaaactatagcgtagaaagtctcacatgaaagatcttgtccaacatttcattcaacaacataagtacctataacttggcagagatagttatatcctgttaaagaagcagagaattgctcctaggaaaagaagcaggagaagagaataatcaggaaacaggaaaacatcaaaattaacagaagtgcattacctaatgtattgctgccggttagaaggattggataacaaaggaaaaatgaatccgcagaaaaaataaattgggattaggctgacataaaaacgaaataggtgcggcaaaaaggtatgcaaaatagcaacaggcagatgagctgattgcctgaatcaaatagagaaaaaaaaaagaaagagtaaatcagcaagtgctccttgcgtgctatagggccatggatgctgaagcttggttctggctatggatgttgaatagtggttcgtaggcaactggcgatttggatcttatagatgggaagagagacggcaatgtgcagtaaagatgagaagcgagaaggatgataccaaaggacgtaagaagggaatatgaggcatcacgggagagacgggacggtgcagtgacaaggaaggcgatgcggccaggggccagtgctggaagggggaaggcgaagcgtgaagcggaggccacgcagcgtggctggtgcatgggggatgggggaggcagtgcgatgcggggaggggaagcgaccgcatctgtggccggcgcacgggggtggagaagagagcgcggggtgaaggagaagggaggggaagcgatggcaggcccgcggtgcagctcgcgcgcgcgcgtgcacgggggcggagaagcgagcgcgggccgcaggggcgaaggagaaggtaggggaagcgccgcatccggtgcggcatagcctgtgagcgatgcggatggggtaggagaaacctggaaagagaagcgcattgggcttcacgcatctgcgaccgttcagattagatctaacggctgataattaaatggtgatgtggcttaaccacagatcagctttgggtcttaactatatagaaagaagggatacttatttcaggaagacagacagaatacatatttcttaattccgaaggcattcagaatgtttattaaagatcattactgctgtttttaggaaacatattacatcagcgttgtcacgtttatgagctgacatagagtgatggtgttcatggtttcaaacgataatatatatatatatatatatatatatatatatatatatatatatatatatatatatatatataggagcatgtaaggcaaataacagggattttggccaaactgacaaaccaaggaaagagataaaggtttcttgaatattataaaaatacaataacaccgtagcattagcacgggcatattactagttttataaaattgtaaccatgccatcgccgtcacgttttccatcttcttccccatctgcacgtggggcccacccgtcagattcatcttcttcctccatcctctcctcttttctttttttcccacttctctccaccatgttcatgatgttcgccgtcgcgccggggaacgggttgccggcacggaggttgttgtcggcgtccgtcaccctgtgcaccaccttgtgcgtcggcttgccgtgctcgtccacgccattctctgcaaagatttcacatttctcactgtcaatttgacaaatgaactcatccaatctagggacaacatctgtttggatttaacaagaatggaccaaccaagatcgaagtagtcggcggctcgacgccacgggggagggcctcacggccgaggcaatgcggaggccgtcacgccacatgtcggggtccctgaccgccgacacgttgccgccgccattcgtcttgagtctcttgacaaactgcgccaccgagtagcacgagatggcgaggacttgacagactgcaccaccgagtagcaggaggccgaggagagaagtggtgtccgccacaggcccacgtgcatgggatgaggccaagaagtggtggagagagatggaaaaaaaaagagaaaagggaaaggatgaaggatgatgatgaatctgacgggtaggctccacatgtagatgaggaagaagatgaaaaatgtggcggtgatggcatggtttcaattttataaaatttgagtggcacaactaaaaatagacgaattgtaatggcatttatttgaatagacatatttgcaatgatatagatcaaattaaccctatttttttttatgttacccaatcactaatactgtaaatctaggaaatccgtggtagcgtgaaatacttcctccgatttttaatatatgctgttaatatatgaaaacgttgacttttatacatatatttaaccatttgtcttattcaattttttcatacaaaatataggtcatgcttaaattttttaatgataaatcaagtcaaaagaaaataaattatatttattttttttcaatattatgacgaaatatcttaagaagtcaataacatcatatattaaaaagctgagggattaccatttttggtccaggacaacacagtgccatggcatcttcctatctgtgctggtaaactaaaattacgaactcaattagaaatcacaatcctatctgtggaatgtgctgtcactgttcaattagcaaaagtttccttggtgattcttcagtaatgatgtagggtatcaatgatacagaacagaaggcatataaagtcatgcacttatgtaacttgatgaatgatctgaagataattgactagagattgagctgaatgaagcaaacttttggttacacaatgtcaggattcctattagttagattctcagcccaaaactctgaatattttttaggagtctgggtgaatttggcccccggatcctgacaaaaggtatcagagctactcggttcttggccagatccatcgaatttggaggtccttcgttggtgagggtttgaggacgagttcctctgtaaaattccatagccagatccttgagtccgattcggggatcaactactttaagtggtagcagggagggttggaagaagccgtaggtagttttcttctgtaaaatctctgtacctgttgttgctgctcatggcgaggggtggccgtcagatggaaatcgcggtagaggaattgagagtgaattttgaggagtttcagaagaaggttggggaagagaataagatgctgcaagagcagattcagaatcaggcagtgcaggctaagaatcacaaggacgaagtgatgcaaaatctggaggtgatacaagatattttgggatctatcatcggttgtcaagggcaagatggtcgaggtacactctgtcgcccgggaaatgctcagtcggtggcccctgcaagaagagcaaaatgtaaagctagactcccccaaattcttcagcttttgatttcataggagttccctgcccgatgcctaattttgaaatgggagaaacatatgccatacacgctcacaaaaccattccaactcaatcaccaccaccccccacaattcatgtatgtactcagaatacctacccaaatctggagtggaacacttcagtttactttggaacaccacctatacctccacctccacctccacagtatagaactggccaattgatgaccaatggacaaaaccctaccttaccaccatatttctaccctccctatcaatctccttggggttatcaaccaagtccaccacctccacccccaccctcctttgatttccaccgacctcttgatcgtggaccaccattctggcacagacaggaggagactcgttatgattctgttgatcacagttacagaaaaagacctcaatatggtgacccttttaatcgtaatcataagcatgtggattttccggtgtttgatggggatcaccctgagtcttggatctgaaaggccaacaaatacttttctctggcccgtacccctgaagaagatgaagtgcctttggctaaagtgtacatcattggcaaagcagatcagtggatctcaagttatgatattcctaccgatactctttcttggcctgaattttgcaccatgttgtgccagcggtttgcagttaagtcagtatggctcagtagacaattacattgacaagtttgaagaaattatgcctcttgtcaaacacaataaaccccatctcaatgaagaatacttcttggaatacttcatcttaggactgaaggatcatatcaaaagacctctcaagtctttgaagatgcaagcttatgaacatgctcacaattatgacagccccaccttctcttctatacagccagctggcactgctcattcttaccctaaagtggctcttaaggattcccctatgcaacctgtcaagaaggaaccaatgcaaacagacgcaaatctcttcctgttgtccaaaccagaggagggggcaaatgcttcaaatgccaggagccgtgggtccctggtcatggaagagtgtgtaaagtaaactaacaactttacttggttaccatggaggaggatgacctaccagttgaatattcaggtgatgttatttacactactcctgacagtcctactgaacctcaaccttctcctgaagtgtcgctgcatgctttgaatggtctaaatgctggtataactaccttcaccttgcaagttaaaattggctctctccttgctactgcactggttgatagtggcagtactacgatattcatgtctcccaaagtgaaggtaagagttgcttgtgtaaaagcaatttcttctatttgacttatctagccgtgtcttgtcttgcacatactcggctcagtgaatggttcatcggtgcacaaggcaaatttggaaatctccaaccatcctccaatttcagtaacaatggctaatggaggcacattgtccactggagtctgtagctcagtgtgtccttcaaccatatgaaattcaaggaactgtttctgtcacatcttttcgcattttggatatcaagggttatgccattattttttgttgtgattggatttatcaagggttaattggatccatgccattacatatttaccaattttgaaaaataccattactatttatctatttgaagccatgccattgtaattcaatagttatttgataatatatgccactacttaccccttcaatacattttctgttttttcttgaccaaattacccctatcttcttcattcatccccttcccactctctcatgtcatcctcttcaccattggggggaat

SEQ ID NO: 72904 - DNA, 1239 bp, Oryza sativa
cgtcagcgcttatcatttcctttggaaaaatatttaataattgctcaataaattggtattaattatagaaattcattaaaatggctcaaaacttctaaaattcatatctaattcattcgaactccgaattgggccattcaacttgcaaaattcatctaaaattgagctctacatgtttgtttactttttatgtactctttgcttggtgtttattagagttttttttctcgttttgtgtgccagcgagtagattctgttgtttcagaagttcgcagtcacaaggatcagagttcagaagattgttgtgaagaagcaaggcaagtcacacattccccttgagcatgttgatcccaatttataaattttttatcgtttgcaaataaacatgcatgttttgctaattacatgggatcatggttttacctatctgcttggttgtgccatgtttacttgatatctgtcctttgtcaacattgggtaataaatcaactagctcatgttacttatgtgacatagctagaactatatgcttagccatgcttaattaccactagctcagttgatgggatgattgcagtattagacctttttagcaatagaacgagctgcgtgctcgagacacctggccatgtttcagtggtcgtaattatacaactaaaatgcgactgaatagtgggctgtgggtgcatggttttgctagtcgcaccctggaagaatttctcgtacttaccacaagccagcgtgggcaacgactgggcctgtagtgtagctttcctctagctgacgcatccaggcaagggtgggcatgatggagcggggcgggccctgcgacggcctctatcgcttccggattcacctaggcatgacaggggactgcccgttgcccgctggggacgggggtcaaacctgaggtgtggtgtgcttggctagagggggttatgcgaagggtcctgtcacggcctctttccggtatgtcgtggtggcatgtcggcgcatggaaacgtgtgatgtggctgtgtcttgtggttacagttgtacacctctgatcagagtaaaactattcgaatagtcgtgcccgcggttatgggcggtcgaccagattcaccgtgattagtctcacacttaataaatcgacgcaatgcactgtagttcaggtgggttggttgggcctgttcaacgtggtgtagcgttgatcagtggagatttaatgttactttaattacttaactgggctgcagg

SEQ ID NO: 72905 - DNA, 1060 bp, Oryza sativa
  unsure (1)..(1060): unsure at all n locations
ccgcgttgatgaattgaccaccnagatggnacagnacntcatcattctagatcgatccagatccggcgcccactctcactcactcactctctcgaccgccgcctcgcctctctcgacctctctgccgccctctacgccctcctctgcaccgacggctcgacctctccaccgacgccggcctgcaccaccgccgccgcactcactctctcgaccgccgccatccatatccaccgccatctccgctgccatccagaccctcctcgccgccgccctctctgccgccatctccgccctatccgccgccctcgccgcctccttcttcaccgccgcctcctcactcactctctcgaccgccgccgtcctctccaccgccatctccaccgtcgccgcctcaacccctcctccgccctctccgccgccatctctgccgtcctctccaccgccatctccgccgccgcctccaccgccgccctcgccgccggtcgtcctctccgccgtccgtccatcgacttccccgacctccccgaccctgacctccccgacgccgggatccccgaccaccgccgaccgcctcgacctcttcgccactgcctctccgccgccgccaccaggatccaggacgactacggcctgcgccgccgtctccaagtacgccgcttctccaagtatgccgccaccctcccccattcctccttttttccgatggatgaattgcattgtttagatgaatgaaatgtgatttgttgtttcgattattggtgctgctgtatagatgaattaaatgtgatttgttgtctgtgaatgttttggatgaatgtaggggctagattttatatacatgattttggtgcagtgaatcttagcatcaatagaggatcttagcatgaatttttaatgcattttgttttctataattctttgataattaaggacctttattaggtgtagggtttgaaatctagttacaagggaagaattgatagattggccgcagatttaatgtagttccgaggttatcaaacctgatgaactacttgcagaagaagagcctatcaccgtc

SEQ ID NO: 72906 - DNA, 11839 bp, Oryza sativa
agggcaagcatatatgaagtaaatatgatagtcaactggttaacaaacgctaaatataagtacaatactaaacatgaatggaagcaaaccggtacaaaatgaaagatcagcggagcttcacgatccactaaacagccctcaacggtaatatcgttcgttttttgatctctagtgaacaaataaacctcacagggaaggaatgggtttataattgtaaggcaaaaatcgccctcccccagggcgtcagggggaccgcttgctaaattccatgccccctaacagcccatttgctggcggccccccgcccagtgcaaaatcgccctagcgaaggccgccaaggggaccgcctgcaaaattccatgccccccctcgccgcccatttgcaggcggccccccgcacagtagaaaatcgccctcgcgaagggcggcaagggggccgcctgcaaatttcgttgacggccgtcgcccgagagcgaacggccgtctgccacgtcatatttgccgccctctgagagggcgatttttaggcggtaggcgactacttccgtcaattttcaaaatggaaaattatttttgtaaaacttttaataaaaaaaattataaataaaaaaaattccacccccaactatgcatgagttcatttaaaaataatctattattgttatttgaataagagctagcttttcaaaagtcaatttgaaacttcaatttctttaggctagtgttccagttagttatgttttgtactatacgatcgttttgaaatgcaatttttttttaataattggcagtcgattctttaaaacaacggccaaaacaaattccattatctccaaaagaaaattcagttctttattttctgaggtatcctttaatggttttcagtaccaatgctcaatagttctcgcgaaaagaaaatataagagcaaggtgtataggagatatcaggagtagcgcctgaagggtgattagttatggcttttgtttgtgagatatgcgcaatgtatggtggttgggaatgtatagtaaaaggcttaatccagccatagttcaaaccgaaggttcaaaatttcgaagtgaaatatctgaaatcccctaaagttggatatacaaatgggctaaacaaggatttgttcgtaagaaaaatttgtgactaccactacttcaatgaaatatattttgtgtttagtcaactttttgtcgtggacgtcttattgggcttgaagcggacataaaaggctagagtcttgggttgaatttatcctggcccaaagatagataggccatcgatctatacaataaatagaataagtttattttaggccctttttcttaacatcgagtttggatcacatcctcaaaccacaataccagatatcactggcagcgtgatgatgaagatatctctggctcggatataaccatgcttcacttcaacaagctgacagtgcaaatgttatatattagttttacttataatatgttttaataaatgtcactgtaccatgagttttctatattttcgtttgcagaaatacttgtataagtgaaagaaaggagagcgagcttacgaagtacttcgatgatcaaaaaggttgattggagattaaaccaagatatttcccaagtctatctttatatcaccatgtcacttttgttccatacaagacaagagatgaagttctacacgtttcggatctagagtcgggtctccttaacttcaaacggacctaggcgtcgattcagaaggactctcggggcccatgagtacttgttggaaaacttatggcgtatacttcatatggttattgttccacgttaaaattcctcctgaacagtcgggaatctacaaaacaagccacacacctcatccagtctaagtctggtttggaccttgggccttgtaattgtgtcatgagctaagtccaaggggtgaacgccctagagctaaccctaggacatccctaatcatatttattcagtagtcatcatcgtttagatttggggttttgcttagattattttgtcatcgtaattccgccactagttcggtttgtggaaccctaatttgtaatattcatcttatattcgtaatatattcatattgcatcttctactctcttgtttgtgttctcgattcgcttgcaggagatattattattggtgaggccaaccatgtttcggtttaggtgataaccaacgaaggggttgtgtagtgattgtgaggggttcagtcatcttgatcagagccttcggatcgtcaatgtcgagtctctataattgactagtcagtatctaacggaagatcgggatcctagtccgcatcacatgaggaccaaccgtgccacggcgagcggctactggaaggccactgacaaggacaaggaaatcttccgcagccgcagtgtccagctcctgtccagtggccacgtgctgcccttctcccttcatccgtggccctgaagatggggaagagagaggaagagaggtggagataggattacgaaacaattgctcactgacatgtagggctcgtgtggtcccagcaaactcagctctccatgtcagctaaaaccaaacatgatagtgctctagaatctcaattaatcaggttttataagttggtgaacgcattatatctggtattgtggtttgaggatgtgatccaaactcgatatcaagatgagagatatgaagtgaacttatttctgctccaaatccagtaggcagcgcaaaggccatatgaaagtgatatgaagaatacagaaggaggcaatagaaacaggagtaacacaccatagcaggcagcagcatttagcttcagctagcagccaacacttgttcagtgggactgtccgttacccgtaaaccgaaggatttatattcttcaagtctctagatagtagcgtgtgttggatgtgcatgcatgtgtgggtgcgtgggtagtggcagtgggtataaccgtgcagtgtggagtgtgttcgtatacgtcctggctttgtacccttgtaagaaggcagccaacacgctggtaccagccaatcctcaacttgagtgaagtacatgggcggtacttaaacttgagccgatatatcatctaagtctctaaactcctaaaatatatttttaggttcctaaacttaccaagtgtgtcatataaatccaaacgggttctaacccgctccatgcgttgacctggcagtgccatggtgacacctacatatatatcaatggaatccacatgtcaagcatatataaaaattaaaattaaaaaccatattttctcctcttaggtagacagaaaaaaagataaaaattatagatagagaggacaaaatatgtctttctaattatattttttctatgtgactgacacgtgggtccaactaacacgtatacactatcgtggcatgccacgtcagtgcacggaaggggttggagcttgtttggacctatatgacacctaaaacaagtttgaggacccgaaaatgcattttgagagtttagggacttagatgatacatccacacaagttttagagaccgctcgtgcacttcactcttttcagaatatcgaaaaaatcaccgtagagcaaattccacttttgaaaatttcgaaaaacactttcaaaaaatccaaaaatcaccaaagagcatttttgcttgccaccactattacaaaaattttgaaaatcacttttagaaattccaaaaatcaccagcatttttgctagcgcggccttttcgaataaatccgaaaatcacctgacaacaattttcaagaatgagaaacactttaacaaagattttgagcaccaaacttattcctagacatcaaggcaacatcgtccttaatagtacggtttttctatcgacacattcaaagtaaaaaaaaatcacattttaccgtttgaactttcgccgcactttttctttttatttttgttaacacgaatggttattgccttgaatataaactcatacaggactaatattctttcacatgttctcaaatcagctgttagtcctcactactcatattgttattaactaacacaataattagggacctagttgtactttccgttggttaaaaagtgagataacaacgtcgtacataaacggaaggagagagagtaggtattggtggtaacaataataaataaagaagaaacagtagtagagcaataatgcctgaaatcttagtggcaattatttaaatgtcacttattatatgtaaaaagacaaacatatggtccaagtatgcaggtgcttgtctccatgtggtatctgagattgaaacgatggatcatgcaacttaatttggattttggaagttgcacacctgcagcacggaatgcagattttttttttatttagtagatcttactccctccgtctctaatataaaggattttgacattttactttatgtttgacttttcgtcttatttaaaaaaaataaaattattatttattttatttgtgacttactttattatctaaagtattttaaacacaactttttgttttttatatttgcacaatttttttaataagacgagtggtcaaaacagtgcaagtaaaatgtcaaatcatattagggatgaagggagtagaagtttagtaggttacacgcagattctttcagccccaattggagcattcttatttttccggatcaccatggaatcgaatcgttgctccaaacaaggactcaactgattatcatgggatcaagcgagtacttatatattattgtaaggttaattacatggagattcttcaagccccagttggatggaacatgtggcatttctccagatgccacaaatcttttgagcaaaagttccagtgaacaggtctaaaattgaagtaaaccaaagcagataattgtacagtatccagcattgatcagtactaatttgctggagaaaatcactgatgaatcatcattatcgatcacgggatgccatatcaagaagctttgatcctgcaacggcaccaaaaaagaacgaagaacacatcagtgtataacgtcactaacattaatatcatcgatcgtgttcgaattaatcactctgcagctgctaaatagctcaccagttcatcttgggcaggatcctgtcgagatggaacagatgcttcctcacccggtacacatgcatcgtgtacattgccgccgcgcaggtcacgagaaagaaggacagcacgatcagctcgccgaaatcctgttgaaaaaaaaatcgacgggaaagattatacccgattccttagaaccacgtgaacgacgacttcaatgcaatgttctttccaatatcgcaataagccgtgtatatatcctcgttggatgtagaggtcgggtttttatgtaaaaaatttttattgtggcaattaatttccatgtgcagcatgggggatatggtgttggtaccctggggtcggagacgatgatgcccatgacgtaggtgagcaggtcgaacatggactgcagcgagttctgcacgccgccgacgacgcaccggtcgctctccgggacgccgtcctgcatcagctgcatcacggctaggtcgaacatccacagccccagccgcgacgccgccacgccgcccatcagcatccacgccgacgccaatggcgcggcgccgccggcccagacggaggcgacgcagacgaggaggcagcaccactgcgcccagatggaccagaggcccgcgcggagcgtggacacgcgggcgtgcgccgccgggtacacccacgtcgcggcgatgccgacggcggcgctgacgccgcgggcgaggctgatcacgtatgccgggatcccctcccagtccagcgtcgccgtcatcagcgtcccgaagctcagcacggtgaagtagaggaacgcgagcgccacgccggggagcaccacctcctgccgcgcgtacaccgcccacgactcccagcacggcagcatcgtcatccacagccgctccaccttctgcggctgcgccgccgccgctgcctcgtcatcgtcggcgcgccgtcttgagatctggctggtctcgctgagcgccgggaagccggcgtagacggagacgaagagccagtactggacccacacggcggcgaggttccacgccgccagcgccgccgcggaggcctccatggacacgaagctgatgaagaacccggacagcaccggcgccagcagcttgcagctcaggtcgatccgccggatcaccgagttgatccccgtcagcaccgccgccggttgcccgccggcgatcaccaccaccctgcacgcagcaaattctcagcaattttctcgatctatcaatcgatagatgcgaacaccgaacactaccattctctctcgatcagtatggtgccagcgagggtggagagcgcggcgagcgcgccgaaaacgttggtgacgacgacgagcgccacgaacgccgggaaccccgcggcggcgagccgggcgccgtagacgagcagcgccgtgacggagacgccggcggcgacgaaagacgcgccctgcagcagcagccacagcctgagcacctgcaggtatgcgagcctgtcgacgacggcgccgacgatggggcccagcgccgccacggcggaggcctccacgacgccgtacaccgccgtgagcaacagcgagcccggccagattcggatcatgtagagccccaccgagaactcccacatcctcgcgccccacctcgccaggaagtgccccacgtagagccgccggagaagcgccgcgtcgtccaccccgccgccgccgtcgaggagcggcgccgcgaggtggccatcactcgccatacttactcaccttgcaatcttgaatgattcttgatcgatcacacaagaagatgtacggatcagaggccaatcgatcgaaccgcgacgagactgatcgatcactccgatattgatgtgaagaagagattgattcttagccaggagagatgagtggatcgagggattgaaaaagagaggatcatgcaggtgaagggtgagacaagaacacgtctgcatctgagcagtcagggagacgctgctcttgtgctacctccggtttactacctgacagaggcagcagctaacctactctgtctctcaaatagtagtaaatatcgagagagaattttaaactctggagggatgtcctcttttattatttgcatgtcacctaaatagttataaaaaaaataagaagatgtactaacatgtgatatatcactccataagtatacaagttaaaaattcaacttctacatgttagaacgaaaaaaataaatttaactgtgagtatacgttaactagctgtagtttaatgtgtttgtttttttttttgcgatatgtataagttgaattttaacttgcttagactttttgtttgtaatttttttatcattcgttttattaaaaaaatttgaaattattatttattttgtttgtgatttgctttattatcaaaagtactttaagtgtgacttatcctttttatatttacattaatttttcaaataaaacgaatggtcaaatattgtaagcagaaagtcaaagcaacatctattatgggactgaagtagtatattaatgcatctttttaaattttttatagttatttaattaatatgcaaataacaagaagatatgcccttgagaattagaatagttttacagtaaatactctatatactattatgaaaatgtctttctcctctgcctccacatggaaacttcatttctctcctaaaaaccgtacacctaaaaaattgttttcttttaataaccaaccattttttttaaaaaaaaaacaaactgcttgttgggttaaaatcctcaaactaaactgaataaaaacctgttacaacactagtagaattaaatatgtaacttaactcagatttgggggataattaagtaattaagcctcggtcaactacacacttgcgtgataaactacacgggagctgtcaaatcttgtctgatagatatatgagctcccattggaggtacttagctagataagtcgcggttaataatttggtgtaatatactacaaggctgtcaattcttgtattgtgtacttatgtggcagagtctatagtatgatgttatctctgtcagaccaagttgatttgtattactgtgggcagctccatcgggtttattgtatgatcaacctattgcagggaagacgtttagtatgatcaattgggcctaccttaattctttcactgaatcaaattgagagttgtatagggattaacatttgctctacggtttattaaaaaaatgtggttccttaaaataattttttttctactgcattatatagaccatttatttaacttatctctgtgacaagtagataattggtgataataatttgttcagtaatttaaatcaaatgggacagagagagaaagagagaagacacatttttccgatctgtcgattgttgtaagcgttccaccaaaatcttatttactgatcagggagagttggttctgctaatcacgaaatcttatttagtgataaactcatatatattttttcccgctagtctcaaaaaggattattttctataaccaatgaaaaattgctcaagtctgattcgtacttctagggtagccttacgaaggtcaaacataattttctttcgtatatggatcattgacgattaagaatgacccttgaattaaatttgaaaataataaatggttggaaaacacaagcttacaggaacaatatccttaccaatacaatattgttaggcatatacagacactacgccagatcctcacacctctgacgggatacctgtgacgggcaaacgaattggtcagtagtgaccattacctttgacgggttatacgggatgccgtcaccggtgaggcatctggccgcggcccgtcacaggtatcccctcacctgtgacgggccgaaaggaaaacccgtcagaggtataccagtgacgagtttttcttccaacccgtcactggtatcccctcacctgtgacgggccgatacattagaagccgtcagaggtgatgggccgccacctgtgacggctttcatttctggcccgtcacaggtgagaggataccagtgacgggccgttgaatagaagcccgtcaaaggtatgagcaatacctttgacgggctttttttatctaacccgtttgaggtgtgttgggtctataaatacccccaaactgccaactgctttccatcccgaccattgtactgttcacaaatcggttgggagggcaaggggggcgattttttgctaaaattcaaggtaaaaaacacattattctccattcattctcaacatatcgatcatcatttatttttcttcgtatgttgttgatttcagatggatcgtagatggatgtactatgcgcatcgttcgtctaccgagtatagagagggggtcactgaatttgtcacatttgcggataatgacagaaaaagtaggatgagcatgcacatgttgtgcccatgtagggactgtaagaatgaacagatgatcgaagacaaggatgaagtgcatgctcatttgataatgaatggattcatgaagaaatatacctgctggaccaagcatggagagcaagaggcgcctgatgtcgcagctgaagaagtgttggatcaggatgtagagaacaccgccgcagctcgagaaggcatgttcgtaccttctactttaggtggagagaccatagatttggacactcaatgtctatctacaatgttgcatgacattgaagacgcagaggacaacgacagagattatgagaagtttagtaagttggtggaagattgccagatgccgttgtatgatggatgcaagtcgaagcacagcaagttgtcatgcgtgttggaactcatgaagcttaaggctagtaatggctggtcggacaagagttttacagaactccttgagctgttaaaggatctgttgccagaggggaacaatttacctcagacgacatatgaagcgaagcaagtattatgtccgttgggcctggaggtcagaagaattcatgcatgtccgaacgactgcattttgtattacaaggaatacgctgacttggatgtctgccctatctgtggggcatcaagatacaaacgagcaaagagtgaaggtgaagaaagtaagtcaaagaggggaggcccagcaaaggtggtgtggtatctcccaattgcggagcgcatgaagagaatgtttgcgaacaaggaacaagctaagcttgtgcgctggcatgccgaagaacggaaagtcgatactatgctgaggcacccagcagattcagtacagtggaggacaatcgataggatttaccaggaattctcaaatgacccaagaaacatgcgtttcgcaatgtgtacggacggcattaatccttttggtgatttgagcagtcgtcacagtacatggccagttctgcttgttaactataaccttcctccctggttgtgtttcaaaagaaagtacattatgcttgccatgctcattcaaggaccgagacaacctggcaacgatatcgatgtgttccttgaaccgataatcgatgacttcgaaaggctatggaatgagggcacacgaacatgggacgcatatgcacaagagtatttcaacctccatgcgatgctgttttgtaccatcaacgattatccggcccttggcaacctttctggccaaactgtgaaagggaaatgggcgtgttcggagtgtatggaggaaacaagaagcaaatggttgaagcattcacacaagacggtctacatgggtcacaggagatttctcccaaggtatcacccgtataggaatatgagaaagaatttcaatggacacagagatacagccggacccccgacagagctaacagggacagaggtgcacaacttagtgatgggaataaccaacgagtttggaaaaaagaggaaagttggaaagcgaaaagagaagagcacatcgaaggaaaaaatagaggagcatgtggaaaaacaaaagacaaaagagaggagcatgtggaaaaagaagtcaatattctggagactaccatactggaaggatcttgaagttcgccactgcatagatttgatgcatgtcgagaagaatgtatgcgagagtttaatgggattactacttaacccaggtactacaaaggatggtctcaacgcccgacgagatctggaagatatgggtgttcggtcggagctacatcccataaccacggaatccggcagggtttaccttcctccagcctgctacactctctcgaaagaagagaagattgatttgctaacatgtttgagtggtataaaggttccatctggttactcatcaagaatcagtaggctcgtttcactgcaagatcttaagttggttggaatgaagtcgcatgattgccacgttcttatcacacagctgttgcccgttgcaataaggaatattttgcctcctaaggtgcgacacacgatccagcggttgtgttccttcttccatgcaatcggccagaagatcattgatcccgagggactagatgaactacaggcagaacttgtgagaaccctatgtcatcttgagatgtactttcctccaactttctttgacataatggaacatcttccggtgcaccttgtgaggcaaacaaagtgctgtggtccagcattcatgacgcagatgtatccttgcgaaaggtacctcacctgtgacggcccagagtgctgggcccgtcacaggtggtcttacctgtgacggctccacggttggcgcccgtcacaggtgaggccacctgtgacggccacatagtttgagcccgtcacag

SEQ ID NO: 72907 - DNA, 51815 bp, Oryza sativa
aacccaaaagactagtctgatgggtgaggaccgcccccaccttttaagtcgtgctcccccaccatcaattaccgatgtgggactaaacccaacaatctcccccgtcacacatcgggcccaataatctcccccgtcacatcaacccatgtgaccccgaagacttcttacctggcctctccaccatgtgacccatggaaattattccgggtttcaaaccttgggctctgataccacatgttataaaatttagtcgatatagcggaacgacgactaaccttcccgatcgcttcagtcgttgatcacccaagacatgccagatgacgacacaggaacacacgatatttgttaacgaggttcagccgaagcctacatccccggggctctgattatggacgctcctccccaaccaacatagcacctagccgctacgagtccatggccacgccgccatcctctcactgcgtgtctacgctacattgtagtcgtcatggttacatcgtggtgcccccctctctatttaagatagttgccgggttacagagtccgactctaactccacccctaacacctattacaactccaagtccaactataaccaaataggactagtatattcgacacctattctaacagagctggcgtggtcaaggtggggcgagcgcgtcagagcggcgacgtcatcggcgtgcctgcctccgcgtctccccgagctagaggacaaggtagaggcaaggaggaaaaaggaaaagcgcgaggcgaaaaagcgaggcctccctctgcttgactgcttctggtggcgcgactggcaaggcggactgaccggcgtcgacgccttggacactagcggcggggccatggtgagacgccggctgtgacggtaaaggcaggcatggtagcttggcgcctggcggcgagcggaggcaaggcggcggccagagcggtgactcgcacgcgagggcgggaaacggcgaggttgcatggctggccgcgctggcgagcgagcgaggttgcctactctcctgcatgtgcgcggcagcacgtgatgagcagccgtggcgagtcgggctcgggcagaccggagcttcggcacgcgagcgtaagggagagggatctgctgggctgtcctgcttagataaagaagggagaaagcggcctgattggagaaataggcatgagagggatttatttggatgaagtttgagggtgatttgatttggatttgaaattggacgttacggagatttgattcaagtttgatatttgaatgtagggactactcaaggaagggaaacacggtgggactcaaatattttggagttgtaagattacttgaaacgaggattggatttgaatagttgaaaggatttactgatagacttaaggagggaggttcaaacaagcaaatttaaactccgagtctatttcgaaacggtaattttgaggagtcaattttggttttgaaggaaaggagataaatagagcactcagaatacgagattttcacggataggtatttcatcagttttgaacgccacgtaaaaaacggggcattacactagctataatctcaaaagaattgtaatttagtaacgtttggtttggctttaaatccactattcacaggatgagaatccagagctgaagctttgtcgtaaaggacagtaatcgtgccctctggtaggcagtgcacctatttgctcgaaaacttccgtaagtttttttttttccttcaaaactattagatttttaaccattggattacctcgagatttgcgcatgaaagaattttttttctagaaataattttttacacatatcacgcgtaagaacatgatgctaactaatcaaaccatacttgaatacaagttttatataagttactatatcgtagttaccatgtaattacagtacagttacaatgtaattgtgtctcaattatatactactattgttatatgtgaaagtttttcattaaaagaattgagacatttttttagatactcccgtaccaaagttactaccactatataaggaaacatgcaatttatcaaaattgtagtaaaaactttatattagactgaaatcgtcttatatccgtgtgcatgggccataactttactcagtttaaactagtttagcggccgtccatgaaatgggcctggatttagcctatataaaataggccgtacatgggccgataattggatctgaacgatactctgaatattaaattctcgcggagatgcgtcccgcccgcccgtgacgcgtacagccgtacacccattcctccacgctgtttgctccccgcgcgccacgaagtagagtactccatctcccaacgattaatgccaagtcaacaagcaacaattctttttgtcgaacaccagcaagcaacaaatcatccagtcagcccgaacacagataatgcagccgtcgcaacgatcccgccggccaccgaggttgagccgccgcaatgccatccggcagtcggcgtacgtggcccggccggcgtcacagctctcgccgccgtcggagtcggaccaacccgccttctggtattcgacggaggaatccgttctggaggaaagggttgtggaagatgaggtcggagatcatgcagaggcaggtggagccgaggcggccgcattggtggtggaggaggcgtcgacttcgagctcgtctgcggtctctgtccacgcggctatggtgatcaggaggagcatcttgaattggagtaagctggatcttatcggggccggatcgtccggcagggtgtacaaagcggtggctgagtaagtccgcttgcgatttaccgtttgccttgctcatgaactgttcgatgcaatgcttcattgtacttcgtgtctggttgtgtgttctattctttcagcagaccggcaatttcggatgagttatctctgtatttctcaatgcttcttcgtattattgccttgtcagggatgggtttgtatttgctgtcaaagaggcttcgttgattggtcccgaaagctatacgaagcaaaccgcatgtcagctaaagcaggtagttttatctcttatcaattaattaggtgaaaaattatcttgtaagtgtttaattaagcaaattgcaatttttgtcaggggtaaaatttcagagtattgatgttctccaattctaaatgattccaagtataagctaattcagtattagtaacaacatttcaggaaatcttgcttcttagtcggttggagcacaagaacatagtgcagtattttggtgccaaaatggtatgccagttctcatatgctagttgaacaagtgtcttcattatgttgctgatcgcctctgcaaactgttgcctcccaaacaccttcattttaggttatttttcttcggtttgagcttactatccctgtttggatttgcttgcagggagaaaccgtgctatgtattttccttgaatttgtgagtgaaggttctttggtatctgtatatgagaagcaacagctggaggaatcaactatatcatctttatacaagacagatcctcaatggattggcttatctgcatcatcataatgtaatgcataggtgataacacattatctccacaaaaaaattcttgctgctggcccggtcatttgaaaatgtacttgttatagtagtgatcaagttaagtacagatgtacaactctcgatcaaatgactaaatgagtgaagtacttctttgtcatattatggtaaatctgcactgtccttcccttttcaatgcagagatattaagtgtgcaaatattttggttgataaaaatggagcagtgaaggttggagattttggactggcaaaggaggttacttcatttttggtttcagtgtccttttttcccctggtttgactgacagattatgaaatgattttgtttgatattgacgatgtgaattctcaacccttttaattgatgtaatgccagataaaagtctggaagcagaaaagatcttgtaccggaagtgtatattggatggctccagaggtaattgtttgacttagtatttatacatagagttttgctcccatccagcaggtaccatcgggactgtccggtaccaaatctcagccatttaatcagcgaaatcggacggtggaaaataagtggtacctccaggtacaaatttgcccatgaggaggtgctaaaaaatttcgagtggtggaagggtaaatttgttttttcgcgtaggagtgtccagggaggcagtggcgagttgcttcgtgcttcgtcggcggcggcgagttgcttcgtcggtgacgacttgcttcgtgggaggaggcggcgtggcggcggctgatccgtttgaggctgcggcgtctgatccgtttgaggcggaggtggcggcgacggcggtggcggcaggtggttcgttgcggcgaggttgtgttgggcgcagtggtggcgggcgcggcagtggcctggtgctgctggtggcgggcgcggcggtggcctggtggtggccacggtcacgaggtagcggcggcggctggtgtgtgggcagccttggctgcgaggtggcgacgggcgcgatggtgccggccgtggtgatgaggtggtcgtcggagccggtgttgtggcggctgcagcgacgagatggtcatggagtcgtcttagcaggcgatgtggcagtgtatacatcgatttcttttcatccgatctaaatcattaggttcggttggttgcagcagtagatactttcattttctgggctgcatatactcttcttcttcattgcttataggatttgtattgtacgatttattggatgttttgatgagctcaaccattacttgttctttgtgaatgttcaaatggccaataccctcccatatcatttactgattactgcaattcgagtaagggcgtgaatgaagccgctggtgaaggagctcgctggttccgccgccgcggatggcagatgcggggcgagcaagcgagcgcacaggcgggggcatggatgcggggtgagcatgcgcgcggctcaggtgggcttcgcacgggtggggctgcgctcggagggaggaaaaaaaaggagattagatgagaaagcagcgccacacggagggaggaaacagagaaagagcgaaaaagagaaagcgagggtgcgactcctttctctgtttcccgatcgtacccttctaacatggacggatggatttatctctgtacctgccggtaccagtacctgccggtacaagttgctggatgggagcaaccctcttagacatattagtatgaagtatctagataaacgttactctgaagaatttattgcacttttactttacgatagtcgtccaactttccggaccagcagaatctatattggttatctgaatatctgatgatgatcaggttgttcgtggcaatccgtatgggtattctgctgatatttggagccttggatgcactgtcttggagatgcttacccaaagaattccttatcctgatgataactgggtcagtaaatcctacagtactcatttagacttcttacagtctcttcaaattcgatactgattcagttctatcaggtatcagtcttctaccaaattggccgtggtcaacttcctccagttccaggctccatatcaccggtgtcacgcgatttcatccacaaatgcttgcaggtgaatcctgatgatcggccttctgcagatgaactgctgaatcatcccttcgtggctgttccagaaccagactagtatgctgcatgtttgcttaacattgctaggcgaagaacattcagtagctccttgtttccttcctgtaagttcagggtcagaaagtcagaatgcttgtggttggaaattcatagtcctatggctaatttcacgagtacttgtttgtacgacatctgttccttataaaaatatcccactatccaactttgcgactttgaccattagttgggagagcaatcaaccaatcatgtattttatggttgagacttacgacgacttgctactccgcgtctgcatgtctgagtctgaagtctgaaccgacggcgctgacgttcccggtgacgaaaccaaacagccacacactctgaatcttacaagcaaagccaattccgcaattcccacgacttggtactcggagatagcggttggtcgtaacgggagcagttagccagttaccgatgacgtcgtctcgatcgacgctcgggtcgctctcggggtacggggagggtagtcggctccacgccgttataaaaggccctcatccgcaacgcgggtctctttccggcgtcgccttgtcactcgctcgccaccacccctcggcgccacggcgagcagcgcaccgggtccaggtcaaaagcgcacgcacccacatcgcacggccgcgtcgccgtcgtcgcgcgtgagccccccgtgcctagtcaaaccccaccacgagcagaatcccccaatcttctcgcgatccgctcgctctgctgctgcgccgcgggagcgcgggggaggaggaggaggaagagggaggggcactggccatggcggcgcgccagcggccgcaggcgcagctcgcgcggatcaacgccatgaggcactcctacaccgccgcgggggacgatggctccggggacgacgtgtgtggggagctcgacgacggcgggggcgagtacgcgtcgcagaccagcttccgcatccgcggggggcgcggggccgcggaggtcaccgccatcttccgcaagctggggctctccgggcccgaggacttcaccatcccgcccgcggtctacgccgccgccatgtcccacctctccagctccgcccgccgccgcgcgtcgctcgaggtggcttccccgccggagcttctagaagcttctccagccgaagccgcggttccgatgaatcgggaagcagtcgagaagggggaggaagctggtccggcccccaaattggttcaatcagaggttacagaagtttccacacgagcttatgcaaatgcaacgcctgcagcagaatcgagcatcagagtagtagctccatcggccaccaaatttgttcaagcagaagctatagaagtttccacacgatcatatgcaaggcctgcagcgagcgtcagatcagtagcttctaaacgagctctgctgaagcaggatagtgcagacgaggacaaggagaaaggtaaattggtcagattggataaatcacgagaggaaattagaggagaggtggttgtggaggcgacaagggagaccaccggtgcctcggctctggtcgtggaggcgacaagggagtccacttcacgtgacatcgagcatttgatttcaccctctcctcacaggcggtttaggagaaccatcacgtcctggcttaagggagagcatctcgggagtggatcgttcgggtcagtgtatgaggctatcagtgagtaagtatcgatctgcctactctgtcttgacgattgcataattcgttttcattatgtttgttgttaatatgtttgcatttgctactgttttatgagaggaatacaacgaagaaagaatatcaatggttttggactatgcagagaaatcagaatatgtcatctgtctagttcacttaattgttggtatatcagaatgagtattagcttcatgtgtccaccgaactgagatttcacaaattggctgcatccatttcaacttgttgggctatttattttatgccgggttgaatgaaatacttgaacatactgatgcaacatattatctgaatcatgcggctagctaaatttcttactcagtgcttttacacttcatttggcaaatttaattatttaggtgaacccttgtgtagttcttttgtagcactgcgtggattccatctaaaccactcttggaaaatataacttctgtcaacagttactatatagccgtgcctcgttttgttaataaaaagcttcataatcgacttttaacatttattttacagtgatggttttttcttcgctgtcaaggaggtgtcattgattgatcaagggatcaatgcaaaacaacgcattgtccaacttgagcatgtgagttaccctgtttcaaacattatgtttgttattgaactatttaatatccaagcaacaattgttttgtttcaatccactgagaatactggtgaatcatttggttccaggagatctctctgttgagtcgtttggagcatgaaaacattgttcagtattttggaacagacaaggtaatcctcctttcttatagatgttaattccattaagattacagttgtgaatgtattcttttcgtttgattttaatattatgttgcttttactctgctagttatcttcatgtaaacaacagttgtctgacttgagttgctgatttcgacgtttacgtttactttgttggataaacattttacaggaagatggaaaactgtatattttccttgaactagtaactcaaggctctttggcagctctatatcaaaaataccgtttacaggactcacaagtctcagcgtacacaaggcagattttgataggtttgaactatctacaccagcggaacgtgttacacaggtgcattactataatgctctatcaatgtgatagtgtactctagcttagatgtttttattgtttaggatttgctcaactgtattcttgctggcctattgataccccgttctttcctatgttaccagagatattaaatgtgcaaatatcctagtggattcaaatggattagttaaactggcagattttgggcttgcaaaagaggtatttgctctatcaaatatctgatgtaatcaatttgtcactagactacatgttgccctcactctttctaatttggcatgtcccagatgtcaattttgagtcaggcaagatctagcaagggaactgtttactggatggcccctgaggttagtctcacagttatgctttggtcctttttgtacaacccatttaccttacgctcctattcagaagagtgtaggtgctttaccattttatgttttaagcatatttctatgcctgatctattatgttcatattgttcacctctttatacttgtaagatgttgcatggacacataattgtatctctgtggtcaaaaagtcacggtcttgcaagttcaagcaatattttgcataaagtggtatgtgtctccatattgtaccgagcgtgtaaattttctgatagcatgttctcattcaggttgctaaggctaagcctcatggacctccagcagatatatggagtcttggctgcacagttttagaaatgctgactggcaaagttccataccctgatatggaatgggtgagtatatctcttgtcttactttccagtaacagcatcccatttttaaataccaaatgcactgatatacgcgggctgcacgctatttaattaaaggagcaaaaacattgatgacaacttcttcatgttgatgacttgtttgcttacatcagtacgtatgaagtatatctttttgggaaaatcaaacattagtttcatcaggaaaatttgggtagtattggatttaaaaatgtcagtaggaaaattaaacatttctattcagaactgcaaacagcaaatccactgtatgttgctgtgttaattttcttattatccgggaatttgtattattactgtccgtgatgcagtcttttcttctgctatgtagacgcatgctttgcttaaaattggtagaggaataccaccagaaattccagctacactgtcagaagatgctcgtgatttcataattaagtgtgtaaaagtaaatccaaatgatcggccatctgctgctcagctgttggaccatccatttgtccagagatcactgcaacataaaggcgcctaatcactcttgtgttgctaacaaacttgcttgtacataagctggtcagtattccattctttctcatacaaaaatttcaagaaatagggcgctatgactatgatcctgtattgcaaacattaatggatttctctctgttgcatttcatagattttaattttacctgtggaaacaggaaagctgttgatgctgaggatgatcccaaatcccttgccatgatacagcggtagtttgtaggaagtcgagcttacagcatgtgcaagctatattcaactgaagatacctttcaggctgctggatcatgtgaacagaagataccttgtcaggtgtttactccgtgccttcacaaccatcagggtgaacagttggttgtccaaagtttttagtgctgattgtcagggattatgagttccagtgcgaaccatcgaactacgtttcatgacttggataaaaactgggaaaggttcaaaaggaggattagtggtatctcgcctagtggcctatggaagcagccaagcaggggacgtagaaagctcagtgctcacggcacagttaacttttctgaccgcgtttctgtacagcgtttttgtacctgtaaagtggcttccttgtgtatgtcattgactgttgacgagaaaatccaatttgttttatagccataccgtgaaattgtccagaaaaatcagtgtgttttgcgataattcaattcatgttggacttcactcctgtgactacacagatgagggggaatcatagtggcaggacagctaaatgtactgaactactgatatacaacagttctctaatctaacgtcggctatcttttgacttcagaatatcagtcttctgcattctccagtctccagggtctgaattcatcccccatccaagcaatcgattacatggtcataatcatgccctgccatctcatgcatgagcaacccaagcatctgagatatctcctccgcctgtggatgcgaccgatcgccggagacgaactcgtgcacgtcgccgtcgatctccacggcgctgtagcccggcctcttcctcagcccccgcgccttcatcaggctccggaccttcccggcgccgtcccacttgccgacggcggcgtagatgttcgacagcagcacgtagttggcgtcgccgccggggtccagctcgagcaggtgctgcatcagctgctcggccatgccgacgtccccgtgcatccggcagccggcgaggagggcgccgagcaccacctcgtttggccgcatcggcatggtggtcaccacccgcatcgcctcctcgagctgccccgaccggccgagcaggtcgaccacgcagccgtagtgctccatccgcgccgcgatgccgtactccgccctcatcaggtcgtagtatcttagcccctcgtcggtgaggccgccgtggctgcacgccgtgagcacgccggtgaacgtcacggcgtccggcttgaacccctccctccgcatcgcctcgaagtgctcgacggcgtccgcgcaccggccgttggcggcgaacccaacgatcatcgagttccaggagaccaccgtccgcttcctcattccgctgaacacctgccgcgcgagctccacctgcccgcaccgcgcgtacatgtcgatgagcgagttggctatcctgacgttgcgctccagcccctgccggaccacgagccggtgcacccacatcccgagccccagcgcgccgacctcggcgcacgcggagatgacggctatcagcgtgacgtagtccggctcgacaccgtccagaagcatggcgcggaagcagtcgatggcctcgtcgtggcgcccgttcttgacgcacccgtcgatgagagccgtccaggagaccttatccggcgccggcattccgtcgaacacctcgaacgcggcggcgacgaggccgttccgcatgaggccggagatcaccgtgttgtaggtgacggcggacctcacgggcatggcgtcgaacagctggagggcgaggtggggcaagcgggacgcgaagtagaagcgcacgaggcaggtggagaggaggaggtgggaggggaagagcttgagcacgcgggcgtggacggagagcgcgaggcggcgggcgagcggggaggacggggagtcggcgcaggcggagaggacggtgagaagggtgacgtcgttggggacgggcgccgcgggggaggagagcatggcggagagcgcagcggccgccgcggggaggtcgccctgcttcgccgggcgcgcgatggcggacgtccatgaggcgacgtctcgcggcggccggcggcgaggtttaggggttgggttctgaggaggttggggaagggcaagggaaggaggggctacgacggccatgaggtaaggtctatggctgagggctgaggcatttccccgcgggcacgttggcacggagcctttgctctcccctggtttcttcaggttttcttcagaattcatccccttttatcctggtttcattagcatcccaatgatatgttggcgatacaattcacaacatatatagatcctgttcatttctccaacaagagttggataaagataaagattttcatggcacggtttttaaactgataaacagtatgtgtcatgcgaaaactttctatatgaaagttgctctgaaatatcatattgatctatttttcaagtttgtaataattaaaacttaaccaatcatacgttagtatcacctcgttttacgtaaaaaaacttaaatcttcatctacacctttatcttctaactatgcctgaataaacacaacagtctggttttcagttgaagactataaggtacgacgtgcatatggagccacaaaatgaaaatatgcagaaaagagaaagcaacatactgccaatacgagggggcaagccatatgcatcaaaaccacaaaaggaggcaaatcaaagtctaaatgatatttttgaacttccttaacgaaaagaaattacatacagcacaagaagcatcttgcactagataattgcgcacagctgaacataattctgcagtccagttcttcagtaaatctagtgaaagtcagatacagaagaaagttgcttaagggaggtgtatggctggagggcagattcattggaccatcggatcagggttcccagctgcaagtatgtccagcaacgagttctggggctccagctcttcatgccacagttgtagtttgtctccagggtgaaatttcctcgaaacaccatctgcgtttatctgcaagattatcatatccataagttcaagaatcattggtctttcagaaaagtaatagcattttaagcaaagataacaagacatgcctcaacttaaaatttactttgccacatgctacacattttcagaaaaaggaagagctacaagaaaatgcaatcaaagcaaatagatgcccaacaaggacataagaaaatttgttactaatgcttccaatcatccaatgtcttgtctacaataccctaacacattttagtaaaagagtaaaacaggtctgaatgaagtataagggatatatcacactgaaatattatccatttttggcaagaaaaccagtccatggaagttaaaaaaggccaactttttcattttaagtttcatctgatactatattctatggccatcacagcaaacagcatgacaaatatagcatagaaatttacatgtttgtatgaagtcaactaaagcaatcagttccggtatctgatgtttcaaaatatctacaacaagggaacagacaatgacaataaggacgaaaaaagggagcacttacagtgacggtacgaacaacccctccactagcaccatcacgggctatagcaagggaaactaccttaaccacaaacttctgtaaagatgaagaggaaaattaagtaataagagatgtgatgcagccagcaatattatacagggaacactgaagtgatggaaaatgatctttgcactctatgaatctggacatataaataatttgtgatattttcattaaatcatggcaaaaatgctgacaaactatctcttattactcatggattacgactgtttgatatttagatgatgtacctcagcttcttcctgggacatgccctccttccattcgtggtcaagcaatccatagaggtaactagagcctgaacctgcaaaactcagaaatagcatctggtgtcaggcaaacagcaaacaggggcttgggaaaattttatagtcaatgattataacagggcagggttgcacaggacagtgttggtaaacaaaaaagaatgaggcaagctaattcaagacatcaacaaataaagaaagaaatgaatcttgctaactgcaaaagattgcttctgctttgcttgaaaaaattaaactgctcaggtaagtttgaaaaaaaatatctcataactaattggcttatactattgaactgacaaattattcttgtacgatatgtagatatgttatatatagacacaaatgttggtgggaaatatgtttcccattagattactctgagcccaatgaagagacatttgccataatatatatacctccgattgcaaatggttgcctcagaattgttccaccaagggggactgagaaaatttggcctccctcatatttatcccatccaccaacaatcatgccagcttgcaacatgttctgaaaaataaaaaaaatggtaaaaaaaaaaccattgcgacaataaaacaacaacttaaaatcgtgtatcagagaaaccattgcgacaataaaacaataacttaaaaaatcgtgtatcagagaaagaatttcatctcatgtagtcatggagttattggatcgcagaatgctatagaaaatataccttgttctgataagccaacaacctaattaagttggctgcaactttcacggtagctggctgcccaagctgaattctgaaaatggagggaaaatttagcatgaactgtcttgcacatcaaatgtttccagtaactagtagaacaatatatatgaagagttcattcaacttcttcctattcgcttcaaggggacaacttacgtgtgttggtggagaaaatagcgtacataatcggaaattacttgtgtatcagcagcctgtgagacagagagaaacaaatatttacatgtgaatactactggactcttggaaatgccttagctgataataattagaagccgactactaacaactacagaataaatgaatcaaagtaaaatattgacaatgagagtgtaacttatgagagggcaatgaatgactgggaaaaccgatcaagatgacatgacacagtataacaaaagaacatatataacttgatgaataggaagctcgtgatttcccaatatcttatggccacagtacaatgagacaacatgaaaaaggagtaaagtccctaatatagatacttacagatccagagcggcagatgtacacattgtcagttagctgagtaatcttgtccgacgcacggtttgccacatacattcctaagaattaataccagacaacaaagggtatattaaaggaaagtaacaaaaaccaacatagtacgtcaacataacatcgatttcagttggttcagaacatgcacatctaagataacaagtcagaacatcaaaatcatctaagaaagcttgttaatcatgtagacacgagacccaatgttctaaatttccaaaacagcaacatcacgctaaacaccaatcgtgtacacttttctgactcttcactcttcagggccaaacgagaactatatggacagaaaaatacaactggaacaattggtgttgtttctagtttcctctaatgctacagtcacgattttttcacatatctgccatacaagttttagcacgcattctactcgtcacatacagatttaagcaggataaattagtggtaagaagcaattttccatcaacactacattacgtgatccactgtggacgctatatatatattacaactaataatctcataagtcacaaacctaaaacagtaaaacttgaatcaggatcgcagaggctaacaatcactactcctattccccccatcccccgcgattttgcatcaaaattgggcccgcgacgccaccggctccacgttaaaccccaaccacatcaatggaagagatctcccgcatcgggaggtgtcgaggcataccggtgctggttctggaatcggcggcgaggacgacgccgccgtcgtagcagacgccgacgatggtggtccccatccggtgctccccggaggtgggattgtctcccgctgcggcggagggggcgcccatgagagaggcgtccatggctggccgggggcgggggcgagatcggcggtggcggaaaaccctagcttagctgcgcggcggcgagatgcgagtcgaggcgctcctttcagtcgcgcgagcgagaagagaccagacggcgagagagctgtgtatgttacggttttgggctctggtctggcctcccccgcaagaaagaacacgaaacggagacgagacgaggacgtgactgggtcggagttgtcgcgtgctggtgcggttcgacccgatggcaccacgagccggtgcaaccacataccgacttcccgagcccgaccgaggtcgggtcggagatgacgtcagcttgacgtagtccgcatcgacgatatcccacagcataactcagattcaacactacttacttccaaaaaaaataatttacatagtatatgatgtaacatatactacgaatcttaacaacttgtattccctccattctaaaatataagaacttatttgatatgtagggaaaaacaacaattttagaggattttaatcatataagaatatttcatatggatgcctttgaaataaaggattgaattcctatcattttaaaattcctatgaaatggacaatcctatatagattttgaaggaaacttgaaaagagctctaatctattgaagattttcccttgagcctatccctctcatctgactcatatgttttcatgcattttgcaatcctttattttgtagttgaattcatttttgttttttccatgcctgcgatccaaagagtccctaaaggattttgatcgaatgggacacatctaacactataaatttggttagaacatcctagttctactaattttgatagaacatcttagcactacgaaattggacaaagctattcataataatatgatgtgtcccatctaactaaaatcacttatattttgggatatagaaagtatattacatctcatattatgttaacttattttgggatgaagggagcagagaaaaaaaaagttgcaatgtactctacaaaaacagcattggaggaaactgcaagcactaaacagatatcacaaccaccttactgtaaacaactgaggaggaaagcaatacacagaaatcaaatgcattgattaaaatcgatatacatatttcaccggttgatccatacagcaaaactggaaaaaataactcttcaatttagtatttacaaaccaagactctgtacatcacctgctgaatgttttacagccatttacatgtacatacatcagacgacccatactgtacattggcaagaaaatacgaaattaataaatcgaacatgttggcattacaatttacaactttacatagaccgatcaactatgcctgaataagtacaccaatctggttgtcagttgaagtcttgaagccgcagagaaaactcaaatatgcagaaaagaataactaacatacccccaatatgaaggacaagccccatatgcatcagagccacaaaaaagaggcaattaaagtataaacgatattctttttgaacttccttgatgaaaagaaattacatatcggaaatgaagcatcttgcacttgataatggtgcgcaaatgaacacaaccaaaaacctgcttggctgcttcatctgacgtttcaacaatcaagttctgctcatgccaacaacctacaaagctgagcaacctaagaaaaacacagcccttcttacaacagtcaaatctgatccatatctgacaacaacgttggaagtgttattgtccaacctgaaaacatatcaaggcttttctgtcgtgctggtagacagatccaatctctcaaacctcagtattaattctaatgaatttggacttcatatattctaccacaagctcattccagtctgacagggaagcaaatggcagcaaaccagccaagcatgggagaataaccgacaggacagtataaaatgtgtatcggcaaacccgatatggtaaatcagacgccttcgttctgtcagtcactgaaataggaccataaagcatgcggtataaaagagatggcctgctgttcccaaataaatggatgaagcagagaatctcccagaaaaagagccagacatttccatccccgcctagtgtgtcaacgcagaaccttccgacagaaccacagagaactcccaataacataacattgaacgttattggcatgtttggtccagtcattgcagaacgctggaatatcaaccaagcaatcaagagaatcattaacatgccaaatgacatccttgttgctgctattaaatgacacctgaaaaacagcaaacccgaattgaaagctgatactgaatttggcatccaccaagatttaggttcctgccaaaaaaaaagtgggttaaagagattagttcatagcacaaatatttactagcagttagtagcgaaaaatgatgggacatacccttgaagccgctgcacaagctgcagtaacagcagttatccgcttgtacgaataaatataggttccataaccaaaacagacagacataaataccactgcggtaaggagcaaatctataagcctcctgaggagttcagcatgtcttgtgtcctccatttgcgtcctaaatttttcctctctgaaagaagctttctgaaatcccatagaaattttgatcttctctagcatgtgtgagtatgagctgagagctatctgagattgcttcaattgcaatttcctcatgtttagtcctatttcaagttccttgagctcatttgaacgagtctgctcattcagagatctctcaaatacattaagaatgtgcctatcaaattctggactagctttattatgaggtagtttaaccaactgctgatcggtgcccgcatgaagaatgatttgattatccattgaacttaacgatgtactctcctggatatcatgtaccggcctttttgaatcagcaccactcaatttgatttcagcagcagaagtaccatcttcgtgagaaaaccgagagttatcttgctcatagacaggtgtctcattaattaaatgaagtgtcctcaatgtacttccaaatgatttctcaaagtttttcgtgaagttgtcgaatctatcaccatatatctgcagaataacgtaagtcagatatgtaaaaaaacctgtctaagtgtaatcacagacaaggaaatgaaccattcatacatttgtcaaggactctttcactgctgacgtgcacatctgcatcaagattcagagttagcatacctgaagttctgttatagtccatggccatcatttgtagaaaggctaattacatgaactgtgtacctttgaaaggaaatcaggttgtaatcttccttcagagcaactgcttctattaaggacctgaaacaggataaggtcagttcttgttaattacgagtaagaaaaggttaaaccatacaagctgaatccatgcttcagaaccacagttctctactggagagcccaagaaattcatttgattcatttttgtaaataaacaacttcattttaatttggcttggatgtatttcatcatcctaatggcgagacgatcatccagagaacagaaggattacatatctgagcctacgcttcaaaacacacgcttctgttcattagtgccgtcccatgtaaatttgcttaattcaatttggttatataaacgactttagttgaatttagatgcaatgtgaaaagacgcccaaaatgagttccggagcaaaagaatatctctacttctccatcctaaattcataatccaatgaccgtcccagcaaggcaagaattgggtgaaccacatgaggagggtaaaaaccgaacctttccgccgcgactaaacaagaaaccagtcaagaatcgaagcgaacgcgcacctgggcaagaaccgccgcgaaggacatcccgagaggcagcgcgaggtcctgcgcgccgtcggcggcgcccctcccatcccctccagtcgcaagcagcggtctccggagcctctgccgccgccgccgcaggcgcacccccttctgcagccgggacgcggagccgtacgacgacgccgacgaggacgccccgccggactccggcgagccaccgccgtcgcagcaggccccgtccataataagggagcgtggcggcgaggcagaggcggtagggtttagttgccgcgccgcaatttcttcgcctcgaccggtgcgcgacccgctctccggtgggcttctcataacgggggagagagagagtctaggaaaggcaagtcaaaatgggaacgcgacgcggaacggcttcggggtcgcgtcgcgtcacggtgcggtttacgttagccgttaagcaaactcggaaattctgagcaaactttgtgccgttttgtgcgtgtatattaggcttttggcctggtttccattaaggaaaaatgttgtaaggaaggaaagcagtgttaaattattataggaatattatttaaactactggtgttgtagtatccacgaagtttaccgtgtcatttgaaatttctaagaaggtttcacaaactttttccgaaatatttgcccgtcaaaaaacatgcactgaaagatcaaaaaactttcttcaagttttcgagagaagttggtcagtagctttgggccctgcactgccactcggtctttgcaggccggtgcacatcaagattgggctggatactccgctatcaacgggttccgcacccacaaggcccgttacgctgctgattttgcttgcgcgcgaaccggattcgatggcacgaaatctcgttcaatcctcccttgattaacctgacgattaccttaacatatctgccacttatttataaccacctcatcccataatcccatcctcatccaagagaagatagatatccatcaatcaaataaccatggatgatgcggcgggtagaccaccgcgcccggcggcgaggtgcccacaggctggccggcggccgacctgccgccgatcaccaaccgcgacggcctcattgtatcccgatccagctgaagcggcggcggacgtggctgatgattgctcggtctcccgccgcacatcatggccgacgaggaggccatcgaggatgtcgatcatgaagacgttcgccgggctggtccgcatcatatcgaccggtggctcgacctgacggatgggaagacgacgcacgcggctcgtctgcgaggtggacgtacgtcgtcgccgaaccatgcgaggtgccgcgcgtcctcgcgctccacctcgtgcccaagtggctcgtcaccgtcgtgctgcggagacgcgacgacgacgcctccgatgacggctgtgacggcgagtcggctaaggccttgttcggcacgcatgtttccaatccaggccaggaattgatcaaggccaggtttcagtggatccgggtggattcactggaaccacctgtggattgaatccattccttttttcaatccacctcttcaaaaatctgtgttcggtttgacctggaatggaatgaagccattcaagctgccgtggattgtcgatcgatcagatccagtgattcagaactcaaaacattcagttaatgtcatcactcattagaattcagaatcatgcacatttctaatttctaacagtaatagtatattgcaggagttaattaaccaaaattcccaaatagaaagacagggaacaccctgaatagcatcaggacaattcttcaccatattcagttgctgtcatcattcatcagaattcagaacatcatgcatatttctatctagttaagcatgaacagtaatatatttcaggattaagcacattcttttcaggactatatcactaatcaatctggcttcgccttcctccggtccctctggtagcaatccatcggcatttgggaatatcaattgattatccgctgcagccatagcaaagaaatcttgcggttaagacttagacagtgtgatatagaagcagtacaactcttgcaagtaaaaacagagcaagtaaaaatacaatagagctgttgaacttcacacttattatccattttacaagtttgtttgcatgcattcaaacaaacttgggggatctgcatttgtgttatcatcataaaagggctatcctatgtggacacaacatttgatatcttcagattcgaaaaaaccaaacttgtcggcttatataataagtagatatgtgaagtctaatacaacataatatcaagtaaattcaaaagaaaatttggtaatgaacagagaatttccatttattcacatgtttgagttttttaattagcctaaactacccagagcttagaaagaaaatggtcctattccaggacttagatgtaattgaaaaatatgagcctatttgttgttgtcatttattacagactacataagaggcaatttagctgaaaaaaatgttaagatactgcactgtagttgccagaatgaggcagccaaaaaagaggcaacaaaatcatcttcctactgcagttcaatttatatttcagcatcgatgcgcaaagctttcttctccaaataaagcagaaaaatatgcttgttaatgatgtttgctgataacaggggctggtttgttaatggatcactagcaggattgcagtttccaccaccctcaacaatagttgtcagtaatgccaggccttcatgtctgttgaaaacgcctgaagcttcctgcaaattctggttatgaggtgcaaattgtcatgcatgatgatcctcagagaaagaggatggccccatcggaacaaggacaatctacaatgatatatgcagagaaagggagaagggaccaaagcatctgatggaaaatggctaagatttaatgaatcataaacagaaagatggaaatagaaaaggtttataattagcatagtagtttgttgaggcagccagtgctggctaaaattaagtatccaagctaaaaagcagctaatccatgaggacatgtggttatcaaaatctgaataatgaacagaaatgccatcaagaactgacaaaaactggttatcaaaggatcttttcttatgcaacactgaatttaataacaatcttgacttagcctggcttgggtgagtacaaaaacagagatggagcaccagtccagttacagtgacatgtttttttttcagcataatttcctggttcattcgagaagaagacaaactgaaagggaagctggttgacagatccatggctatgcaacacatcgatccttcagccaagatctagggcaagaaacagaaccaagaacctagggctcttccaccaagaatcccccgcaacactgcaagaacctaaaccacagaccaaatctccaagaacccatcacgattcccccatccccaccccctacgcggatcggaatccccaacaaacaccagcccttggaaagccctcatttgggcggaagaagagcagcagcagcacaagaaccctagcaagcaaaaaccaaggaggcggcggtggcgtgctacagcggcaggggaggaggcggtggccaagaaccctagcaagcaacaaccctagcgccggggagagaaaggaacaaggaagacgacggtgatgcgttactggcgagaaggcggcggagagcgtggacgtcggatgggaagcgggtcgtcgtcgccgtcgcctctcgcgtcgccagccgcatgccgtcgcctcttcgcttctcctctcgcgtcgcctcgcgtccggattggaaccggagggtcagaggtggggaatggatccgggccaggaacagggggaggcaggccaaaccgggcccgtttccaatccgggccggccgaaacgaacgacgcttccgggccagaccagatttggaaacgggccgcttcgttccggccggaactgaggccgttccgggccgttcctggcgctgccgaacgaggcctaagatggagatgctgccgtggttggatcgtctggccgtccaatgcagccacgattttttttatggcggtgagaataaaaccatccgttgttcttggtgattatggaaattaaccggaacaggttctgataactctccgcgaggagagcgccgcggcgtcggtagcgggcggcacggcgagttcccgtggcgatcgacgaaatgggccggaacggtaatgcggcctacgtgcggaaatattggtcggaactggattcccacgtcgcgaatgttgggctgatatcgcgctatggacagaccacaaactaccagcccagtaacgacgatctgggcctgagccagattcccgtgaactgtgccgatatgttgggccggcctcagcaattgtgggctgaccaatttgtgggttccagctccacatgtcctggagctgaaccaaccaaacatttgtagctctagctaaaacaagagcggagctcgcgaagctcggtggagcatttttataaaatgaactagagaggcaaagttaggtttagactactcaacaattacactccagattcaactcctggatccattgtaactggcttttttttcaaaatcaaaaatcagaccaagcgaaaaattaagagacctaaagtgaacttattccacccagatggtgctctggaatgggataccgacgccgcgtcgccttcagttgtccacggtctagctattttttttttcaaaatcgaaaatcagaccaagcgaaaaattaagagacctaaagtgaacttattccacctagatggtggtctggaatgggataccgacgccgcgtcgccttcggttgtccacggtctagctactacaaaatcaaggccaaaatgcagtcttctgcttctttttttagaagggtattttttacccggcctctatatccaaccgaatatatgcatccattgaaatagggaatttagttctgcaaacaataaattcgctccatagaaaatttgaactcagaaccttggggtactactcaggtcactgtagccactaggctatatgcaatcttctgcttaattattattgtcaaaatcaagggtcattttccgcttagataatccgcacgacttcaatgttcgatcgtatcagcatggaatttgtttcaccattcaccaaatatgaaatcagccctaggcctatatatctagggcactattacttcactttatagagccttgatgcttgtcgcttcagccacagcggacagcgtccgtccgtgcgtgcgtgcgtgcacggtctccgtgacgccgaaacaactggccaacaacaacgatctgtgggtgcagtttactgtagtgccaaacttctctctcttcgtgtcctaggatttgtttggatgagcttaagttttgagaagttgtccttggtagttaacttatgagattcttgagaagctgaatttctcggtttctgacttttatttattttattttggaatctgaataaaaagctaaactatttataaaagttttaattcttggagctcgatcatacatcccctccgtcccaaaaaaaaactcaacctaatataatgaatatagacatactagattatgtcacatttcaatcctagattgttttttttcagatttattgtactagattatattagtattatattatagttctatgttaagtttctttggaatagagggagtatgtcacagctgtcacctatcccagagcccgaaatgtttgacatattccctcgtctggtgctttctggtaggctatcacatgatcatctctaccagtcagttcttgccgctcgacctgattggtcacctaagccattaggtccacgacgatctctcaccttgcacacgccatggctactgtggtaacagtgttataaatggagtgcacgcaataggtgaaactaccctatgggtagctgctgctagtagctttgagagcgtgcaacttgtcacgtccagctagagcgagtcactgactcgtgggcccggacaccgtgcgtttattagatggcgaattgtttaattagaggctaatttggcctcgacctgggacggggttgataggctaaacaagggtcaaaccgacccctatcccgactcgtacttggcccaaattaaacctgtgtgcatcgatcggaccgagccggtttaccccagcacgaatcgtgatgtatcgctgatcacttggtgactcggaaaccgagagccctaggtagctactaatccatttgcacaaatttaaatactacctccgtctcaaaataagtgcagccatggatatccgtgcccaacgtttgaccgtccgtcttatttgaaaaatttgcgaaaaatttaaaaaaatttagtcacacataaagtagtatttatgttttatcatctaatagcaataaaaatactaataataaaaaaatttcaaataaaacgaacattcaacctcaaacgttaaacgtgaatagtacaaaactgcacttgggacggggggtataacgtaccgaattgaacccgatccaaatctgcactcaaacccatggcataactaaccacaacgtcgtcataaatggatcacaagggagcaaaaaccacttgtgaataaatttttactaatcccagaaaggtaaactctaatgatctgcaacatggccaatcagatcgtttcaaatatcatggccaatcaggggccgtacacgttcatgcgaaggatcgatgcagcttgcagagtagctagcagtagaacttctggtagatttgcacgtgattggtcgttccgatccattttgctttgggctacgacgactatgagcagagttcaagttgaaccttgttttgtttacatgcaacggttgccgtgctaattaagcagtttattaccaagggagttagttactactggtcttgtactattggagtacaatattttgttgaaggcatgtgggaagagaattaattttattcgggaagtgaatattaaactcttaagaacatatcctcatgttgtctatataccatctaaatatttatgaaaaaaattaaaaagataaattaatatgtgatatattactccgtaaatatacaagctataattcaactctcacaagttacaacaaaaataactaatcaaactaatgtatattcacaattaaatttgtattttttaacttataaaagttgaatctatcattgcacatgtttgtggagtaatctatcacatattaatccatcttattgatcttctaaaaatatttcataactatttaaatgaaattctaacaacgagatgacgtccctcgagatagtttagaattatcttttatctattcgcgatcgaactcactgataatagggagcaaattctcttacgtgtaagatcgaatcacaagaactaagccaaccagagggggggtgaatggttgatataccccaaaacccaaacttttagcgcaaataaaagttaccctcaaattcgatgtaaaccggtctgaccgaggttgatccgccggtctgaccgagctcgtgccaccggtctgaccggtgttgatccgccggtccaaccgcctgaagattgcctgccgcgtgtgaagtcgccgccggtctgaccgccgcctgccaccggtctgaccgccggtatgtcgttggttagaccgccgaaacccgatgaaacacaaatcgaagaactctcaaaatagatgacaactttattacttctctctgtgtttacaaagtgcaccaacatcactccttacaaaaatcttgactaaactcgaaaccctaactaaactagcaactcaatagctctcaaaagcgataccgggaagcctcacgctccccctctatttatacatgatgtaggcagcctaaagccacgaaccaaactcatactaagagtcctaaacaccttaggaaaccctctagtacaagacacaaactttacataaccaactgtaccaaatttggactccttccaaattcgacttcgcatcccatacgcacactatacctccatcgtatgccatatggaatcttcaccaaccacgtgcatcaactctagccttagtatcccgcatgatatctgaccaccacggacatcgtcttaccatcaagccgactcccagtccatcaccgcaaatactcttccgaggcatcgagtcacctacacacgaaataaacaaagaaaccatattccgataccaagctatccccaacttgactcattgttagcaaacaacagtattacatacgtatagtatccatctagaagccataaccatgaaacaatcacggatatccaaagaaacaacccaaaaccgaaaccgacacaacatcggccggtcagaccgcgggccggccggtctgaccgctcgatcaccaccggtctgaccggcatacaccacccggtcggaccggtaagataaaataacagtgaatctgatcatcacctgaaaattgattatctccaaaaccacttcgacgataatctccaaatatcaaaaccaataatcacagatacctattgttcatcacagaataagaatcaaaacacactttgatcttacaatctcccccttgatgaacacattggcaaacctcataaaaaaatgttttggtgtttggaaaaataaaaacaaaagtggtaaaaaacacacttcgtacaaatgtacacatcgtgctcaaaaatccaaaagaaaacttctccccctttttaaaagaaagaaattctcaattatacacactgtgctcaaaaatccaaaagaaagaaattcccccaattgaaccaaaaacatgctcttctcaacaactctcaaaattcaccttgcttctccaaaaatccaccttgcttctcaaaaaatccaaaaattttcacattacttctcccccttttgacaatgatttcatcaagcataggaattatgttcattaatgttcaagagcttagtatacatatagcatatcaagtcatgtattgcaataaaaagaagatgaacccatctataacagaacaagcatgcattaaagtataaccatgaaccaaagattttacaattaagcttgaatcaacaatcaaaattcatgatttcatatgatttataatgcaacatttttacaagcacataggttgaagaataaacactaaacacatatacctattgcatttatcactctttctcaaataacctttagcacaaaacaaccaagagaatttttaactttttctttttcttgagcatttttgctcatatttttctctttttattccgggtacgtccctgtcatcaagactgtttctagggattcggcacccattattttgctcacatcgaatacgtccttgtcgtcaagactgtttccaaggattcggtatttatttttttctcatatttttattctgtttttcacaatgagcaattaaagctatttgaggaataacaagtcaataaagcatatatataaagcatttataaatcaaaccatatgctagcatcaacattgcatatttgcttaattcaagtatagaatttaagtgtcatgcattatctcccttgaaagcaaaatctaaatcacatgaaaagactagaatacatacaagctttgctagagacaaataaaccttcaaagtattgctagcatgcacaagaaaataccatatgtataaaacaaagttctcttttctcaattttttcattgtcatattattgcttgataaaaccatgaggtacaaactccccctcaaaacatgccaaaaggattcacgaataagcactaactccccctcaaaataacctccaattctccccaaacaaaaatcaagaagaaatcaaagattttgaaaaagacatccaattgccaatgatatcaccaagattatcatgaattgacatgtatacacttgtattaacaaaaactactacctcaaacacaagcatatgaaaagctaataattaagaaagtagaacaaaaaatatgtcaatccaaaattaaattgatgttaccttgtgaagcaatcgtcatctcaaaattgaacactcatagggagtatgctgccaaaatacctacgaacgagaagatgtcgaggccttcgtgttggggttagaaataagaaattttggaatccaacactgagttacacgacctgtagaaccagtaggtacaaatgcactgacaaaatcagaatcagacttacctgaaaaattacctttttccttcacaaaagtctgagttaaatttcgtacaaaattgccccgaggtcggtctgaccaccgctgtgcctacggtctgaccgggcctgacagccggtctgaccgccggttcaactgcggtctgaccgctggacggtctgactgactggtcagtgtcggtctaaccgtggtcctcgaattaaaacccgatttttgccaacgtcgttttgcaaaagcaatttctctttccttttttctgtttatgggcaagtttaaaacaaaaaccaaccaaatgtccatcttttccacaaaaagaacaagtgtacttctcacgacaagtttgtgaagtggatggttttgaaattgatggttttgcaacaacagaaggttttgcattcacaacatttgatttcgaagaagatgcattcaaagaagacatgatgccagcagatttatacacagtgttcttaggctcagtttcaatcaaaatttcacctctcccagcaacacccaaaaccgtaggaggatgtctagtatgatgagcataagaatcaaaacctaaaccacgattgtgtgtgctaactttagattgatcaagaatcatgttgaggttctttttaccatcagaaaatctttgcaaagaacttttcaaataagaaacctcctgagtaagaatagcacaatttttgcaagcatccaaaagacctttttgttttctacaagttgagcaagaaaacacctcatcttgtttaacaatttcttccatgtgtttaacacgctctaaagcatctttcaacttcaactcattcaaaacacactttgaacaatcttgagaaatcaaaacaccattgttttgttttgccttatttgcacatgaagcattgaccaaagaacttgcacaaaaagcaactttgtatttttttcaaaacgttctttgtcaaaatcaactcatcaacaacacgagcatgtaaagcaaatccaagagcaaaagaagactccaactttttagatttttcaatctcaaattccatttttttgcaattaacagaattgacatatcgcaaagcattaatttcagaaaataaaacttcacaagattgacaattatcatctttaggaatcaaagattttaatctagcaatttcagcattaagaatctcaatcgtacgatccttctcatcaagcacaatagaacatgtttgaagtttcttagcaaatttgtaagcatcatattctaattgatcataactaagcttttcttcattatcatcatcagattcatcaacatcagaacttgcattacgagcaataaaagctagatcaacaacttgcttacctttgccctcatcttcatcttcagatccatcaaaaatttttatgagttcttgaattaaccactgcatgcaatgtttcttcttctccttctccttcatgttcttcttcttgttcacgtcatcctctttgactctaccatcatcttccttcttgactctcccaagcttagggcaatgcgagcgaagatgatcaagtgcaccacactcaaaacaacgattcggttatcctcttttcctgttcctaacatttttcatagctcgagaaaatttgttaaatagcaaaaccaagtcctcctcctcgaactgttcgagttgatcatcagacatggcattaaataaagtaagaacataagacttcgatgaagaagcaccaacatccaaagaagttgaagacgaaaccaaagcactagaattagaatcacctttacgagaaagaatattcatctcatgagttttcagttttgtgtaaagcgaatccaaagtcaaagtagacatgttcacagactcctgaatagatgtaattttcatctcccaaatagacatgtcaagaccattcaaaaagtgacgagaaatctcaaattgtagataattagcatcataagaagaatcaacagatctaagatcacccaaaattttattaaacctaaaaaagatagtcatccaaagcttctccaggtttcatctcaaatttaatgtactcctttttgaaaagatcacaacgaagttctttaatgttattagtaccttaatgaaaattattcaaagcaacccaaatctcatgagcagtttgaagatgagcaacacaatcataatccgaacgagaaatcccactcaaaaaaatattgcgagctttgcaattcagttcaaaagcagttttttcagcagcagtattaataacttcaggaatcacataaggaagagaaacttttctccaaatatcataattctcagccataatgtaagattgcatcctactacaccaatgagaaaaatccattccatcgaaaacatgaggcttagttgaaaacttattagaagcagccatggcaaaaactttggatcggttaaaatccaaagaagcaaacaaagctctgatactacttgtaggatcgaatcacaagaactaagccaaccagagggggggtgaatggttgatataccccaaaacccaaacttttagcggaaataaaagttaccctcaaattcgatgtagatcggtctgaccgaggttgatccgccggtctgaccgagctcgtgccgctggtctgaccagtgttgatccgccggtccaactgcctgaagattgcctgtcgcgtgtgaagtcgccgccggtctgaccgccggtatgtcgccggttagaccgccgaaacccgatgaaacacaaatcgaagaactctcaaagtagatgataactttattacttctctctatgtttacaaagtgcaccaacaacactccttacaaaaatctcgactaaactcgaaaccctaactaaactagcaactcaattactctcaaaagtgatactgggaagactcacgctccccctctatttattcatgaggtaggcagcctaaagccacgaaccaaactcatactaagagtcctaaacaccttaggaaaccctctagtacaagacacaaactttacataaccaattgtaccaaatttggactccttccaaattcgactccgcatcccatacgcacacaatacctccatcgtatgccatatggaatcttcaccaaccacgtgcatcaactctagccttagtatcccgcatgatatctgaccaccacggacatcgtcttaccatcaagccgactctcagtccatcaccgcaaatactcttccgaggcatcgagtcacctacacacgaaataaacaaagaaaccatattccgataccaagctatccccaacttgactcattgttagcaaacaacagtattacatacgtatattatctatctagaagtcataaccatgaaacaatcatggatatccaaagaaacaacccgaaaccgaaaccgacatagcgtcggccggtcagaccgcgggctggccggtctgaccgctcgatcaccaccggtctgaccggcatacaccacctagtcggaccggtcacataaaataatagtgaatccgatcatcacctgaaaattgattatctccaaaaccacttcgacgataatctccaaatatcaaaaccaataatcacagatgtcaattgttcatcacagaataagaatcaaaacacactttaatcttacattacgttattatacgttcaccgtgaataacatttagacccatcactctcgagttcatatatcagccaccacatcggaggaaagttatgtgagagaatttcaatcggtgataatataggcacgtacgtgtcgcctctcgacgacatgtaagacctgatgactgaaaaaccttagcgcagtactactctgggccccggcgttagtggctacaaagcagtacaccagttggtgtgaactaatttgacagcttaattactttgcagtcgtgttatgttagagtaccgaaacgtgtgcatgactagtgtaggtgacaattacatttgggatcgagttaatggtgacaataacattggcatcgagttaaacacgccgtacattgaaacttactctacggatatattctccttgtctcgaatgaaaaagaaagaaagaaaataattaatgatgaggtcaagaaaatatcacatcgttgatctagctggagaaaaccaacaagctaagactgctagctactgaagaatatcaaccatggtcgctataatggaacgatcaaattagaccactcgacaagatgttgaaagattccatacctttgactatgctagagcattttcaccggtacgttaattaccgcgtgttaattcgacgtacgtcaaaactaaacacctggtagtacgtgttcgaactctcctgttgcatgcacacgtaagtgacacgcataagaatccagaccgatcacacgtaatacacatggaaatcaaatcgcacagagactaatgctgcaattaaaattccatctggaatttaacacgatcagtacgtctgaacatgcctacatctacctgaaacggacccgtggaaaaccggaaaacgccatggccgacacacatctacactactctcaggctagtccaatgagcactccggtcgtcgccggccgtgcaaccgccgaaataaacgacgacgacggtgacgactgatgagacgttacaagctaggcaagaccataaaattaaattaaaaacaagcacacacgcactagaattccaagaaaactacgtcttgttacgactctttgcttgtagcagtacatgtgtcttgttgtgaaatgttgattaattctagcccttgtaagtgttatccatatcgatgcaatgcctgatcccgaagccacgtcttgggatttcgtacggggctcctcctctcacgaggagctgagttttctaaccaaaaaaaactgttacttattgtgcatagtcagatcgatagataggttgtttcaaaaaagaaaacgatataagatagatgttgcatgcatatacattacattagcagtgagattaattaatagtaagaacattaattatccataatatgtaattaacattcataatatatatatgtctgttgcattgctggtggtaatgagaatcttgagatctattccaagtccaacgtccaattaaaggagaacagcttatatattagccagtttttggttccaacaaccagttgacctcaatcatcatgacgatcgaagagctagagaaaaaaattatcaggatcaaaggtgtattataatacagaagagaggatagttggcgtaaaataataactatacattgttactgaaattctgtgtggcccaaacaagttgactcgagattttatacggagacgcaactgctagtccggccttagttttccattatactgtataaatcttcggtcatcggtgagctatagaaggagatcagattaaggcactgaaatggctatcaccttacaggatgcagacgatggcatgccatgagtcaacattgcagaggtccgacttaagacatcgaagcatatatatacactaagtgttgtgaatcacaattaatgcatgcgtttagaaaacaaaatggtaacaccttaggtttttttttctaactaatttttgggttttgctaggtttgcatacaagctagctagcaacctcaatcaagggcactccttaattacataagaattatataaaggtcatgaacgaattatattgtctaacacatatatatcatcaaaaaaaaatttgcatgttgttttactcaattcctaaggtgctgtagacagctatattctccatgaaatgaagtgcttgcgagccacttgatactaaattatagtcacatacacaagtcaacagttcaatttatagcgcgagcgagttctataaaagtactaaacatggcattgaaagttgacattgtgcaactagaatgctagatttatacatatgaaaagaaaatattaatgtatatatagctcacattttaatctgtcattttggtaatggggaaactaaggtgcgtgatgatagcggccctgaagaaattccaagagttgacctgggctccatacaatactaatccccttagcgttagaagcgctctctcccatcatgcacatgaccaagcccccacttgacttcggtatcccttgtcatttggatcacaccaccgtgcacttcacaattcacactactccttcagattaatccatctcgttgatatttcatctcgagtcgtaaaaaccctcatattgtattcatcactgacatgtgtgcccccaaaaaatatcaataggtgtagaaggtcgtgtatatatacgcattcatgtgtgtcaaggcaatatattttgttgaatatgagatgacatgggataataggattaaggaggagtcttccctcctcattgcccttttaatacgtcttagacacccagacattgacttagatgcctcgggagaagtagcattaggatttaagaccgttccccattttagctgtaccaagagagacaaaggtacacaagattaccagaaagaggccaggagcatgtcatccaagaagaagagagctgccatagatctctccctggaggcagagagaagacggccagaagaacgcggcggcggcagcgatcgcgaagccagcgatggcgccgctgctgcagctgaggaagatggtgatgtcaagcaacgagagggccctaaagaggaaaccggcggcgaggaggagaaggtagttgaagtggttgtggaccaaggagaagacggctccaatgaggagatcaaatataggactcaacaagcagagatgatcgaggaggacaagcaaccagctgcagcagcaaacgtcgacgacgatggcggcgacagcgacggagtcggagctagcgcggaagagaagcacatggtaacagaggccaccggcggcgaaggcgacgacggaggcgatagccgtacccccatggcgcaagatgaggtactatacacagtactacaattaaacttaccgacgattataaaaactcctaattatactattagctggtgatgtgatgcaagtagatagaattaatatcgatggagatttctcttgtcctttgctcccatttggagttgacatatatatgtgtgcttcttcagctcagcgagatgcaggaggagatggagaggatgaaggaggagaaccggatgctccggcgagtcgtcgacaagacggtgcgcgactactacgagctgcagatgaagctagccgcctaccagcagcaaccggcagcagcagatgagcctaaggtgatttaatttcttaattagctgagctagcttaaccaagctgatttagctagctattatagctaggctaaatatccaattgagcctacccatgttgaaactaagcttagctctagctcgcgcgctcatctcgtgcatgactttaattattcttccacgtgacacaccataattaccatattactcaattaagtcacgccttgttgtttgcgaactcgtgattgattcgatcgatttccgtgtaggagaccgaggtgttcctctccctcggcgcaacggccgccgcctccgccggctgcggcggcggcttcccggaggcgaagagcaaggagcaggccgcgtggcggcggcgctctgtcggaagcgacgacagcgactgcggcaaggaggatctagggctgtcccttagcctgggagcgtcgtcgtcgtacgacgacgaccagaaggcggtggaagcaaggccgcacgacgtcgacggcgcggcggctgcggccatgatcggcggcgacggcagcaggccggcgccgagggggtacgcgctgctggagagcagcaaggtgcagggtggcgcggcgccggccgccggcgagctcgccgcggccggcggcatcacgagccagagcgtcaacccggccaaccgcaaaactagggtttcagttcgagtccggtgccaaggccccaccgtaagacacaatgcatgcaacatctgtgcgtgcatgcgtgcagtacatgatacgagtactaattactaatattgatcttgtgatgttgtcgcaccggtgcagatgaacgatgggtgccaatggcggaaatacgggcagaaggtcgccaagggcaacccgtgcccgcgagcttactaccggtgcaccgtcgcgccgggctgcccggtgcggaagcaggtgacgatcgaaactgacaagaattcagattgattagcattggttgcatgcatgatcatgtgtgttcgtgcatggattgatcgatctcgtttgattgtgtgcaggtgcagagatgcctcgaggacatgtcgatcctggtgacgacgtacgagggcacgcacaaccacccgctccccgtcggcgccaccgccatggcgtccaccacctccgccgcggccaccttcatgcttctctccagcaccacctcctcctcctccgtctccgacgcctccgccgcgccgtcgtcgtcctacctcagcccgtacctgctcaactccgcctcgccgttgctaatgccgggcgccaccggcggcggcggcggcatgcagcatctcaacctgttcgggaattcgccgtcgtcgtcgtctctgctagctccgcaagcgccaggctccagcaagtacccgtggtctccgaaccaccctccgctcgccggcgccggaggtaataagagaccgttctggagcgccggcggcgacggggacaagccggcgccggcggcattggccgagaacgtcggcgcggtgatgtcggacccgaacaagttctcggcggcgatcgccgcggcgatcaacaacttcatggggaaagacggcgagagtagcagcggcaagagtagtagtaagtggggcgtggttgaatcacttccaccccatgagtagtagtgagaattatattactagttactagctaatcaaatgtgacaagattgattcaatgattgggaaatcagttaggattattgcgtgtaaacaaatcaaactaggggaaatcacacattggaaacatttttttcggggagatttcgttgtaatttttcagtttttttttgtttggaacagatcgaattgttgttaaccgtaaattacagtatctgttcatcgtctttattaattaacaaggttgtacgatcatattcagatcatacaaagtagtatcctatattagtagggccgtgggggttcagttctgtgtgctataacagttttttatttactacatttataagcatttttatggttattttaccatacttaaggagttatcgggagttaccatattttctatattgaaaatattttctagtataaaatttgatgcatatggtggtattagttatcaaaatttttagtgtaaaatgtaggtacctgctctattaagaaccataaaatttctcattttcttatgggcagtcgatttcacacttgcccttggtttattcaagaatgtttgccggcattttaaattttggagaaaaaaaactaaccggtggatatatcagtgcatttaatagtggtttcaatttggtccctatgtctaaattgatcggttgttttgctctctccttttatttatttttatttttttaacacgcaaaacaattgcacatcaatgtattagaataaaaaaatgttacacaacgtaagtggctagacatgtaattaatgaaaaagagttttcattatttggtctattaattatacacatgatctggttgtaactatatatattgtgacaattattttttctgtttgagaaaacaaatgtccacagaggttcgcttaaatagtaagggttacatcatgacaggatcgcatcatttatgaaacactgtatgggctactgtgccagggtcacacctgtagctgatcaagcattatcagttggcttccagaacaacaatactgaattaggcctaataacaaaaccacactttgaaatcttgtggctagtactatatatatatatatatatatatatatatatatatatatatatatataaatatatagcttgatgactacttcatccgtttcataatgtaagactttctagtattacccacatttatttagatgttaatagatgtagacatatgtatgcgtttaaatttattaacatatatatatatatatatatatatatatatatatatatatgtggataatgctaaaaagtcttacattctgaaatgaagggagtattaattaagacagatcatacgaattcagcaagtattgttttgtgctgtactgctagcagtgcaagagttgttccgcgaataactcatttttccttttgatttttcggtttgagaacgtcgtctagcaccattcaaattaaggaagcctgcagtgcactgtgcactctgcatggtctcctgactaattagcaatctggcgccgtcagctcagctttctcttgtaaaacatactccctccgtaaaaaaaaaaagacaaaccctgggttttcgtattcaatgtttaaccgtctatcttatttgaaaaaattatgaaaaaaattaaaaagacaagtcacgcataaagtattaatcatgttttatcatctaacaacaatgaaaataataattataaaaaaatttcatataagacggacggtcaaacgtttgacataaaaatctagtgtttgtctttttttttttaaggcagagggagtacgtagagattggcgcggccggggatgcaatatgcaagtcaaggccgttgcagcgaaccagcttgttggtagcggccatcaggatgcaggccggatcgatgcctgcaaactattgttgcgcatgaagcgactgttgtagcacattagaagccagtatggtggacaggatcttccggcaggcctctgtaaggccccagaggaatttcacagagagaacgctaagccgctaactcttcagttcagtaagatatcttatatatggggtatatagggcaaagttgtctcggtacccaaaaagaaaggggaaatgttatcactaaacaaggaagaacagagatcgcatattacattcgtatagaggaaaacaatcactgtacgctccggacaagcttctccagactctagagtggtgtactacgttccaacttccaaccccttgtttccattgatcattctaacacctctggtcacatggttctgaccatttctggaacatgcctatgctctcttgcagtagtgtccttcgcgtaactaagcctattttccgttaagctcagtcattgcttgtacttacacgagtgttaaatcccctcctggcatgtactttcatcagcactaaagtctgaaatttcttgtagtattagggtgtgtttgagaagaaggggattggggagattgggaagatacgcaaaacgatgtgggccattagcatatgattaattgagtattaactattttaaattgcaaaaatggattaatatgattttttagagcaactttcctatagaaattttttgcaaaaaacgcaccgtttagtagtttgggaagcgtgcgcacgaaaaacgatgagctttctcacccaatgtcactagaacgaacacagccttagtacaaaaccccaaaatccacactgaacttctctgaacttttatcacagggccattagcctgaagcctcgagcaggaggtaggagagagagagaggctggggaccaatacgccagcaaaagccacagtcccacggatcatgtgatcagccaccgcccacgccccaccaccaccaccaaagccaccaaactcttctctgaagaaatttcagtactcagtgttgaagcctgaaccacccatccagaatcgcaggagcagcgagcgatctcggtttgatctcgtgcgagccgcgcttctcggtccatccgaaaaacgccaagcccaatccaattatccaaccctatcccagatcagaatatatcggatatggttgatttaatcccaactcattactgctatttcttcgcttgtttctcatgcgtgtttacaagaatcttccaacctaatccccccgtcttccaccacaatcacgcagtgacagcgaggaaattatagttgcctggtcaagtaaaactctgcttagtgagacattcctacttttccaagttataaaacaaacattctgaattttatccatggggttaatttcagctgttccaattgtaatctcactagctttattaatgaattttagctgttccaattatgaactcactaactttacatagaggttgatgaccaccggcgggaaggaatctgttcccgtttaatacgggttaacacgccgaaatttactcgaccctacgataaaagtacaaacgataagaggaatattcctttttatattttattttctctctctctctctcaacgtgctacagttcaacggtgtacggcaaatcgcaacacgtcccgtagaaggcaccccccgtctccgccggtttcgtcaccccagcttttgcgtggacgcggtccatggactgcaccgcgaccccggcttccgtcccggctcccgcccgcccgaggagggagccggtgcatggaccgggtccacgcaggggtgaacaggcggcgaaactgtaattgcaacgcgaactcgcaccaaaaaacgtggggcccacccgcccaaaatctttgcgtctcctcccctttctaatccactttttattttttgcgccattttttctttttctttttcgttttgttttttttttcgttaatttggcttaactaggggtgtccttgtctttcgccattttctctctcgctcggtttgctgctctcctcctcctcgtcgtcgtctccaactccgtcgcggcctcgcgctcaccgccgccggaatccggctgacctcctccgctcccgcatcgggcgctcgccccccgggtctaggtacttgcccttgcccccctgcccatgcccttcgtcccgattcgaacatgtcagatttggttggttgggtatcttggtggtgggttggttcgccaggcgccgaggcccaagttctttgtcctggaatggtggctagggagctttgtttcggggttctatctctgtgatttgggtgcggatgggaggaattcttcttggtttgggggaatttggggggttccggtgctgatttgagtgttttctggctggttcttggcgctccttcgggagaattttgtggagctctctgatgggagtggtctaggtcgggatctcagactggatggcctaatttgatcttatcaaggtgaattatgccttctcagtgaggatttaggtgactgtggttacaattgctggggtatttgacctaaaaacgaagatgggcgagcaaaaggggcctcctattgtcaaaattttagtcattgaaccagtagcacgagagcggtgttctcggtgtattctttgcgtgtagattggaggattggccgcaatggcgtagcaaaataccctttaatgtatcttttgagcttctgttgatgcttttaagctttttgattgttgtagtagtgattaacaattttgtaggaaatgatctactgcgagaaggtactgtagtaaggaaatttaattggcagtaaagcttcattttctgaactgtccttgtgcccattgataatgccattaacgtagaaaaaatagcatttcggatagcattttagttaaatcgtgagcacttatctagtcttgggccgtggccctttcatttctttgcttaaagttaacgaagaaagatgcttctcgggtaatatttaataatgcactattcagtggataaggtgcactttttagatggagaagaaagtgtttttgtcactgatttgagttgaaaatggtgaattttgaaccaatttgtggcataagaaaacccttttgccaacctccatccatgtgttagcaatcatggtaggaggatcaagattgaagtaaaacttaaagaagccctttgcttcaaatacctttcttgtgctggttacttagcatgttcttaaaggatggaatccttggcccaattgcagtatcaattgattctctctaattaaaaagttatgtgttgttccttgtttctctttaattctggtagatctgggaggggtcctgacatgctccatgtgggccactggttttccctttatctcttatctggctcttaggtgtgacttttttaatgggtattgtagatcacatctaatgtgcttcattgatttgattatttaaaagcctttggttgttgctattcgtttgtttatgttcctacccttctgtggttggatcccataaagtctacctgtgacttctgctgccttggttgcttgttagtcattgttgtggatcttaagtttgctgacttggtttaaggaggaaggctgctgcaagagtaaagctgcaattggttggtaatgttgctcatgagtttttcttgtataattgcaacaaccaaggaggatctttttgtttgttttccattttgacattgtacaatgccagtttgctacttcttgcttcttttttataagtttgcagccttagtttagtaagtttgcttggtttcatatgcttgatttgactcacaaaaatgataactgtgtggatgcctcttttccttgtttgattatgtgattatatcagggtctacattcactgcctctgtggcggggttcatccctatcatcatgttaaatattaaactttcctccttatgccaattcaatggagcagcaaatggtgattccaatgccaacagaaattgctgcctttggaagttggacagttgtgatttgtgttttttgtttcatgattttagttgcgcccttcaactatccatccataaagctgtgttcatttttacgttgccttgtgtgttctgtttgacaaatgatgaaaatgaccagataaggaatcaggaaatgttttgacttggccaaggaagatccatctgtgcagctcctactgacccccacccccaccccccaaaaaaaagtcctcaacacattcttgacaaagttgattaatctttttcccttttgttttgctaaattgtaatataaagaattaaccttgtacatattttctctctttaatgaaattacactactaggcaaagcccttgtagttttcccagtcaaaaaaaaattgtaatctaaagaaggttaatttctgtgtttatcttgtattttaatatccttgcagatccctggcctgtttttgtttataagaaaacaactgtatcaacaattcatgcaaatcacgttatggtttctttctggacaggtttccgaagaaatggcaagaagtgcaagggcaaggaggcatgtggctcgtcagcttagatccgcaccgtatcccatcccttcgtaccgctggaaagcaatgaaagaatcaaaccgaaagaaaactctgccagctgcacagaagatggactgggaagatgccaactgctctgtgtgcatggaatacccgcataatgctgttctcctcctttgttcttcgcatgataaaggttgtcgcccttacatgtgtggaactagccaccgccactcaaattgccttgatcaattcaagaaggcttacaccaagggtgcattgctagaggaacttcctgccaacactgttggcacgaacttggactcgacgccattgattgcaggtgaaaaaaatgagtctgttgatcttgcatgtccactgtgtcgtggcaaggtgaagggatggactatagtagaaccagctcgaagttatctcaatgggaaaaggaggacatgcatgcaggatggttgctcatttgtaggaacctacaaggaactccgcaagcatgtgaagtcagagcaccctcttgcaaagccaagggaagtcgatcccatccttgaacagaagtggagattgctagagattgaaagagagaggcaagatgcactcagtacgataacagcaactatggggagggcgattgttttcggtgattatgtgctagacttggaagatgaagatgatttagatgatgtagaaagtgatgaggatgacaatgccaacggacacgggacagataacactagacgaatgttaatgtttctaatgcgccaagttgctcggcatcatcaaaaccaaaggcttcagaatgcaattggtacaactggcggtgccgaggacaattatgcggtgagcagtggtgcaaatgcaaccacgccttaccattaccccttggaaggcgacgatgaggatgatttggttatggccggaggcggaagcaccggtatggttagaccagagaggcggcgtcggcgccgccgtagaaaccgcgagaggttgttcttaggtgctaattgagacaacaggggctttaccactggaggagtacattgcacaattggttctctggtgcatagcattcatcaatttcaacctcaatttacttgttcatgatcatgtaccaaagtagttgtcttaaccttttagctcattgtttcacttcaatgtatgccatctcacattcattgttgaaaaggaaaataccgcacccatcttgtgcggtttgtgtagcctttatttccagtttttcagaagctctgctaaatattaatccagtggggatcgattttagatctcaccagcttcagatattcagttgtgcttagtgctgactaaacatagatttgaacatttgctaaaccggaggtgttgactgacgatattacaacataagaagcagtaagatcttacaatgacctgagctcatgtttcaaccaaacatagaaactgtagaatacattatcattgagttcgacacttcatcgttgaagtgccctacactttatgacatcaacatacatgctctaaatgatttcccgtaacataacattacaattttgttcataactacattctacagagcatatattaatataatcatttacttgtatatacttgcaagaagaaagatttgtatctcttcacgacggtcgatgagcatttccacagcagatcttctagtaaaccgtcgatcgaaggcatctgccaattcacaccatcttgcctgatctacattcccagatggcgaatgaatatcacaaacatcacaagcacatgcgagctcgtgcaatgcggtgccaagaatgctcacttctgtcaaacgccatacaccatcatgtcatcgattgctcaatgcccagaaccaggaggcgcattggacacccaaaatctcccacttgagcacagggcagttactttttcctaatgatggtaggcacaccgtagcaaacgggagatccaccgatcataagaggaagcctgcaagcacgcctagcttcacttaaatatgaagctactcgcctgttgccacaagtgcaacgcttactacagttattcattcgttcggacttcttccctcgtgtgcctcttcgcctcggcctgccattaccctccacagcaatggtcatggattcaaattctcgtgttagctggcaacacttcgagcaatttttggccgctacaaaattctcttgcaaccatgaaccgagcaatgctttgctgaatcgatcaatatccttatctgacacatcccagagatttgcgataacagctggagaaccagcagataaatatgataaaggggctccttgaggagcataacaccctttgcaacgcaatgttccactactgcaacccataagaagagcagctgcgcaattatctaatttctcaatttcctttccagagacatactgagttcctgcaacatttcaagaccagttagaaaataactgtttagttctaataaatgaaaatggctgttctctgtattagtcaaaggctaccagaacagtgcccagtaagaacaaagatactcatgatcactaggttagttcttattcctaacagtccaatcaataggtaataaatacaattgaaaacttgaaagcatccattggcactgggccccctagaagcagttgttcttgttccaattgacacataacccactctgctatcacatgtggccggtttgtgtagttgactcaagggcaccatctaatgaattagcggttcaagctttagttatttttatataaaagctgggtttgagtattcatctaaagaaatttcacccaggtggccataatagaccaatcaacaatttaggtcatgttatcacccgttgaaaatagcaatccttaatgtatcgctgttgcagcaatcagtaaaaagaaaacaggttcagcaaataacttaactatggtactccctccatcccaaaatataacttctagtgttcaaaattttatcccgaaatgcaaaaacttctccacctactttcttatctcaatcaatcacaaccatctttcatttaatttctctacatattttctcatcttaatcgatgacaaccatccctcatttaatttcacctcttcttaattcccgtgaaaaactctagaagtgcttatattttgaaatggatggagtattaccctactagacttaattctgaggaccgaaggcatcagggtttaacatgaatgggagaaaacgttaatatgtagatccagcaaaatgatgactacaatctttatatctatagggcttaccacttccatgaccaaaataaaggaaaagatcatgattcctcaaggccaacaccagctcttcagctgttggagcatacccagcctttccctgcatacaatcgttgcaacattcacaaatcacaaccgtttgttggtgcactatataggcatccaaattcatgctttaacatgcaacataaatgctccagcaagcctgcaaaagccctaagggttcatgtcctgttatctctatgacatatgttagacgctgtagttgattgatgcaatttattaaatttagttgcaaccaacagtagcaataagcagacaagctgagctagaggtatctagtgctagcctacaggtagacaagattttgcagccatttatatttctaaagtgaaaggagcagtaaatataaccacttttggtatggcaagcacatgtttacaagcacattgagatgccagaatataaccatttctcatctcccaacaagagcatttccacagttggtggaagcaattatttttcacaaatttagcactgagaaatggttgttagaacaaggactgttgttttatcatttctaaattgttgtcaaatcaatgttaccttccattcgtagttcttaaacatctgatcaaattcttcttgtgtactgctcaggtctccactaggattcaacagataaaatgcgttgaaagggtcaatgacaggaaaaggaggagctataacacgggcatctttccaataattattacttctagtcaaagctagaaagacacttccaattgatggcatgcgataaatttcttgattccttagtgcaggcaagttttcccaaggaagcatctgcatttaatcattttaaacaaaagaggttaatgaagatatcataaatgataggaacatacatcacagcctcacagagtcacagggactgctgattgaaattgaaaaaaaaagcagaggcaattatttttttagagtaaatttcagagaatgccatgttttatagttaaagctgcagaaaaccacacgtattatgactcacataaccacagttttttgtctaaaggtttcataaatccccaacttcattcaaatctctattaattttagcatatctgaaaaaatattattcaaattagtgaagagttaaaccaatcaccttaatcaagaagtcaataattaaaaaaaagcatagacactccatattttttaaaaaataagtaaatatatgctctgcatgtataggggtgggattttgtgaaactttaggaccataatatccagggctatggagctatgctagtaatagttcctaaggttttgtacaactccaaccataaagcatggcgttttctgaaatttattctttttttaatcaacaaaggatgcagtaaattcaacaactgtaagtgccaagctgttgcgacagttttaagatatttgtggttatgtttaatattcatattcatattaaatacaaccacagacctggaccaacacaggcttgagacaaatgatatcgaatccacagtatctattcctaccattagaccgaacagtcaaggaaaacatccataacactatctcaaggactcgaagaaatatctacgcacatgtactaacccacacagtaaacatagttcacaatctggccatcttattgctcacctgcacattagtgtccagaacaaaaatgactggatctctatcaactggttcaatcagctcattcactgtactttttattaagcattcgactgtctccagagcttcagactcaatacagcaagaagataaggctctaagtctgtctttcccacaacaccctcctcggccaaaatatcctttatacgatataagttgggaaacacagtcctgcacttcatccactgacatagcaccaccaaggatgaccttgatgagcactggatttacttcaaatttgaattctgattccagaccagcaatcaggtttgtcagagcttcctcaatgtgttggtcagttaaatcataccccaagagaaggcatttccatggccccagccatgattcctccatgtctctgttcaaaaaagaacataacataccagaaccaaaaagttattaaaaatatgatccatctcaacaacagaaaattcaaacatttttttaggaatacatcttgtggaatcaattttcaagttttgccataacataagaaatcttacttcagcatcttatcaaggtggttgttgagcttcattctatgtgaccaccactttacatggtttgcttgtccatcattcagagtgagggttgcactagagagggaaataaagttctcctcaagtatctttctaaaagtaggagccacgtagtctattatagtgtagccccaagggcactgccaattcttatctgtggctctcattagattgtccagttctttggtacaggaatcttcatgttgggtttctgccaagcaacagccatgtgagaaaaaaaaaacacaaaagaaatactaagagtaagctatgcaattttaatatggaatcaacaaacctttagaaatagcatccactggcaaaagcattgtaataggtttgtttgttgaatcaaacctcgaaagcatcatccaagcaggaaaataagaagggagaagaagaatttccccaagaacattcacaaaatcaccttcaagcatgctaatgcacacaattggtacatcaggaagcttatggaagaattcttttatatgtatctcaagatgtcctatgtctgctgatgaaaacctgagagaaatttaaatatgaccatggaggacaaatccggtaaaaatgagctaagtgttaaactcttgaaaatcatacctaaaagttttgtaaattcatgaaaaattactagagataggtgtagatatgaaatacattctcaccaaatctcaagttcaaactcaactttatttgggagtaaaaaaagaacaaatttcgggtgaatagtaacaggacactattcaactgaaatttgttatttttgtttctctcgaatgaagttgagtttggacttgaatttggtgagtgt

SEQ ID NO: 72908 - DNA, 49489 bp, Oryza sativa
aacatgtctggtctgagatcaaagcgtttcaagaattactcaagcaacgcccggtacagagagatattatacttaaagagataagcatcaacctggatctgtggagtaacttcttctcaaagccacctcctgaaataattaggctaatggaagggttacgcgtgcttaagggagcgctatcggaggaagcgccactgccaactactaatcttgttctcgcacaacaggaccagattaaccaacacgtcgatctgctccgcactgctcaagacaaggtggagtcatcatgcgtcgctttggaggcactgacgagtcaatataatgtagagcaagcagtagaggagggcaacaagagagagtgctcacgacaagcacggaaaattagagcagagatagcagtgttgcaagcaagacttcaacaagtggaagatgcccactccagtgcacaacactgacaagatgttgtaacagagaacttgaactcccatctcgagcgacatcgtcaagctaaagatcgaaaatctgagattgcggcgcacttaaagcaggcgagcgtgcaccaaaagtctctccaagatattatagactttactaagccagacgagtttgatctatctcaatatagatatgtctacaatttatttgattttttcatgggctgctcattagatgagtagatgctagtttcaaaatcttgtttcaggtttgaaatagctcttcagatattttatttgtttccaatatagcggagtgaactcctttattgttttttctatatattttgatttgcaccagaaaagcacagtgaactccttcaaatttaataggagcgttgcattgttaccaacaatatttgtgcactggcttcttccttttttctttatgtatatacatttcctcacataaaggatgctcacgttcaattttttttagtggctttactactgtagcagtaacagtaacgccactaattcttcacgattctggcttagccatggatttcaattttttttttggcttttaaaagaccagcctccccgctttagaaattatagcgaaatccatgcaacagtgtaaatgtcgataaatataccatagcgaagattcatcttattaataagatcactgtaggaaattcgttacagtgcaaaattattgggattaatcgtcgtccgaaaatcttggacacgggtgtaacccaattaaataataaaatcactgtagaaagcacattgcagtgtacaatttatagcattaattgtcgtccgaaaatcatggacattggcatgatccaaccatatattaagtaagggaagtgcttctatgcttctttaaaaaaaacctgcacgaaaattaaagcacatcaacagtgaggattaaaagttgattaacagagtaatcccctttaacgaggggtaattttgtcctaagaaaaagctgaccatatctagcccaccctgtccgcatatcagaatcgactggttcctccttgacttgcacctttgacggaggcgccatcttcgccgccgccgccggcaccgccatcccaccgggtcgaacgaacccatcttgcccgacgccggcacgcttgccggcggcattcgacgacagccttgtggcgtccatgctcgcgcatgccggcgcctccgcgggctcctctccttgacctgcagcaccgtaaacggaggcaccatcttcgctgccgccgctgccatcacttcgtcctctccctgttcctggacgtcctcgccatggctcccggcggcggcgggggccgcggggcgggaagcctggagggcctgcagctagctgaagcgggcgtggatagaggactggagggaggagaggtgggagtcgaggtcggaccagcggaaggggaggaggatgggcgagtggaggacgaggctgtcgcaggcctcgcggaggcgttgcttcttgccatgcagcgtcgcgatggcggcctccatctgcgccggccgtcgtcatcgccatcagagatggttcagggcacagggccgttgccgtggcggcggcggcgagctgttgcataatctccatcgccatcgattcttcgtgcggccggtaagaagccgacgcagtttatatataggcacgcggccgcgaacagtacgagacggataggatcagcgcatacaaccaattctatgtaaattcaaaagattgtgatcagccttgtgttaagttcagttcaattctgaatgcatatcaggtatcaccatatactgaggaataaaatggacatggaagctttggcaatctctgccgagaatcatgaagaagcagaataaggtgttgataatggtgagtgagggtgttgtgctcaatgaatcagccaaccagccatgtttcctgaaccacgagactattgacgaacctgaaagcacgacgacgagcaccacctacacaacacgtcaacacgcagctccccgaaggagagagctcgccggtgaaggaagcagcgacggcgtggttagtagcggaaggggaaaacactcttacagttacagggggtagaggacgcttctcggcgaaggaaagggtgcgggcgtgcggcgctgttcaccggaatgcgtcgtgagaactgccgcgcgctggccgcgaatcaatccatgagaagggatgtggatacggatatgggcttttacttctggacgaaattgccccttgctaatggtgattactcggttaatcaacttttaatcctcaccattgacgtgctttaactttcgtgcagtttttttttaagaagcatagaagcacatcccattaagtaatcatatcactgtaataaataagaacaccacagtaaacttagtaggaataattcccgtctgaaaatcatagacgtcatcatcctctcttttttttgccacgtgttttttttttgccacacgtcataaaggccttcttcacacacatcttgtaaattcaggcttcaaatattattagcatatgagatagatgtcccccgccgagtagagttcatgtgcgaagcaacagggactcgacttggcaaaacaatcaaactgagtcgacccatttctaaatcaatttggtgtcgccctctctgtttttttttcttaaacacggtcatcacttagaaactatggataatttatcgctatgatagcaaagctgtccattttaatttgtttgtgactcaatctgaagattagtattttgagtacagaccaaggtttaatatctgcgttcaaagcaccagaccctaacaaggatagggcagcaaaacttatttgtcactgtagcaagatttgtgctacagtctccatctcgagtaggtacagcataaacacatgcaccatatacaggaatggcatcgaagaaagaaactatagcgagaatccataccacagtgtaaaatactgtcataaaatttgtatggtagcgaaaatcgtgccacagtgtaaaactataggccataagtaaagaaatgtagcgaaaattcatgctatggttatgatgattgtattagcacatgtatataggatgtggcgaaataatcgtgccatcctattattttgctccatagcgaccaaaactgtttggtgcggaaaaaaacattagtcaagtttgatgtgaccaattaacatgatttattgactctattgtgaccactttataactgcggtgacaaccaatacaggagccagtagtgaagagatgcttctcctcacaacatgtagaattttattaattctactacgactgtttcactagtaagaagccagccagtcgagctcaatgattggagggtgtagaattgcccccatggtattgagatatagcgcaagatcataccacacctcaatataagtttatcaactctattgcgattgttttactgtcacgatgcccgccaatgaagttaaagggtttcacagctccatgcatgccgcactggtgcacttcactgctcccgttgtagcgaaaaaaatcataccgcacctcaaaagaatttgatcaactctactgcgatcgttttcaatgtaacgatgccagccagtggagtcaaaaattgacagcttcatgctatacacgctggtgcacgtcacttccccatctaataattgagatttgtccgaataatcatggacttgaataaaaactggtttgatccaatatcatgattagagcaggttattgtcaaaaatgtcatgaaaatgtagaggttcaaccatattacacggctgactcgctcaggaaatacattttacccaagtagtggaacaatgccaattatgagagtaatgtttatgtggcagaataagagattgtaatgatctggaaggagatccaaggagaaacagatctctcttttttattaccttctttaaatcaacgcaatagtcgatggtggtactactagagacggtattccctagtacaagtattcgccaccatgattttcacttgcgattcagcttactcgtgagttttgtgtaagggcatcacactttgtcaggatctctgatgggccgaagaactctctccaagcctcccttcagttatgtgcctcatgtcttccacctttgtcccagtaggggtatgggatatggctaatcattgagatggtttatgggtgataggctttggaaattgtgccattacttttgctgaggatgggaagtgactacattccgccttcagatcagggaagagtgacccattgattcaagagccttcctttatttttttctcttcttctctttcttccagattgtttttttttgcacacatattttgatcatacatttcatcggcttgatcactctccccctttagaacttggaaagtagtcaccacacctttagtgtaaactaagaattcctcactggcatttagtattttcttctttttttttatttgcccttgttaatacttcatggggtggcatgtggctccacactagaacttgacttttgtcagaataggtagccctttcaagctctttttcctatagttttccccagaagcttgcccccttaacctgggcaaaagcgaaagacatgataaaaacccaccacatcagggtttaacttggatcaagattcaaccgccctcttcatccattgttggtgtgagccaagtgctaagtgttgacttcgcttcatcgcgagatcaatcagttggagcatagtctgtactaggtacacatccactagtgacaacccaccaaaggtaatgcttccttcttatttggactctatgatccatgaaggagattgtttttagagaggaatgtactctttaaagataacaggggagatgtttgcacatacatattaaaataacatttttcatttattccaatgaggaatctcatggtgagatttcaactccaatatgtgtttgaattggcattgttctactcttggtaatcgactaggattccattgaaagagagggagagaacagaaagggaaggtagccaacataattaggctaaccatagtatttaaatggctaaatctttgatagataagcgttgggcatgatacttggtagtaccacacatagttcggttaacaccatgcatggtggtaaggtattgaaagatagaggagggaaaaaatatcgtttatttgatattggatcaagacaatgttactcccagtgttgaccaccttggccatgtgggacactcgctgcaaacgtgtgaaagcgagagtagaactacatcaagtagaataactcgtcattggagaatataatattttgaagatattttagtcaccctcataacattttatcaccaatgtcatatgaggagacatagtggaagcaatgcacatctaatttactgccccagccattttgcatagcactctaacttagagctgttgatcggtgttcctgcatagtccgtgataagtgatctattcaactcaagctcagcaatggcagagatgttgtgtaggaaattatgcatctggatttgcagagtggtgcttcaagggattgaatttgttgcacaataaattttggaacaaatctcttgcagatttaaaacacacgttgacatcgtgtttgccgctgtcgagctcaagttgtcaattggcattgttttgtaggctcactgaaggcaatcgagcctatggaatcagcttcggaatttatcattgaggggtcaaaaaattgccccctgcgcttgcttgtggtggaacacttgatgatttattttggtgactatcatcatgttggttagttaattgagtcttattgcttagattagcaagctctcatcttggtttgagaaattttgacgcattagcccaagggcttacacatgagaaacaagacccctgctgtctcatggagtatgattaacaataatagaggtagtcccaacctctatatgtatatttctataggacatcagggctgtccaagaaaatattattagagcgaaccggtattaaatgttgatatgcccctggcattcgacggcctctggatttgtcacctcaacttgaggtttgacagcgttgaagataatcgtttgacgaaacagcatgttgttcagcaaactaggagaacatataaataaacaaagatctgaagtgtttgttccctcactagggtgaccggtgctgaatttaaaatgtttttttattgcatagtcacatttggaaactttctatgtaactggcatgtgcagctcacatttttttaggccaatgttcaagcatcaggagagatgacccgaaccgtatgataaataaacaagagatataacgaatatctctcttaaaagtaatgagaatcatgtgaaaagaactcacacgcatagtagtcctttgattaatattttgttatctgagaagagtttttgcagcctcgactattttcaatcagatttcttcttcaaaggcatgcaagcagcgcatgagcgacactgcctggcttgctcaattgcaaggcttagctttgtatttgatgttaactcatgaatgagtctggaattactccgttgatatcttagttagccagtctcaccgcagaacatagccggtagaggagaaaagtgtagggatactcatgaatggtacaatgagtaccaagtagatttggatcagtagatcgacacatcacttgaaacaggttgcattgcttcattacataacttactgaagccaagtcgaataaccttgcatatatttaatttgatgccacagataaaaaaaatcttttgaatgtttaatttgagaaagagaggaataggatgtgcttgactgcataggatatatatgcagcagccacatataaaaattaatagaaaagcaatgcttacaaaagcatcgttcccatatatgcatactgcacggcaggcttttgtgagcctcttgttatttttaaagaaattaattaatttttttatagatcactggattatttttgtttttacaggaaatagatcgatacctcctgaaaactgccgcatatagacgttcccaataatttgttttcagaacagcctgaattaatgtctgtgaggtgactctctctctcaagcaagtgcgacagcaaagcagtgcacagttactatacttttatagaaaatgtcattcaataaactgaattggaaatacttgaacaacagccatataagtgcatatatcttgcacttttcaaactttttttttaaccagcgacatttgtcagtagccagtttcaaaagtatatatattagtatatgatagctaactcttcttgatgcagagaattacggatcagcaggaaagggaagacggcagcaatgcccggcgtggagcagtcaaataaataaaaactaggaggatgcaattgcccccggtatttcagtatttggaaatgtgtatatggatgtttgatccttgggtgctgccactacgccagatcctcacacctctgacgggatacctgtgacgggcaaacgaattggtcagtattgaccattacctttgacgggttatacgggatgccgtcaccggtgaggcatctggccgcggcccgtcacaggtatcccctcacctgtgacgggccgaaaggaaaacccgtcagaggtataccagtgacgagtttttcttccaacccgtcactggtatcccctcacctgtgacgggccgatacattagaagccgtcagaggtgatgggccgccacctgtgacggctttcatttctggcccgtcacaggtgagcggataccagtgacgggccgttgaatagaagcccgtcaaaggtatgagcaatacctttgacgggcttttttttatctaacccgtttgaggtgtgttgggtctataaatacccccaaactgccaactgctttccatcccgaccattgtactgttcacaaatcggttgggagggcaaggggggcgattttttactaaaattcaaggtaaaaaacacattattctccattcattctcaacatatcgatcatcatttatttttcctcgtatgttgttgatttcagatggatcgtagatggatgtactatgcgcatcgttcgtctaccgagtatagagagggggtcactgaatttgtcacatttgcggataatgacagaaaaagtaggatgagcatgcacatgttgtgcccatgtagggactgtaagaatgaacagatgatcgaagacaaggatgaagtgcatgctcatttgataatgaatggattcatgaagaaatatacctgctggaccaagcatggagagcaagaggcgcctgatgtcgcagctgaagaagtgttggatcagggtgtagagaacaccgccgcagctcgagaaggcatgttcgtaccttctcctttaggtggagagaccatagatttggacactcaatgtctatctacaatgttgcatgacattgaagacgcagaggacaacgacagagattatgagaagtttagtaagttggtggaagattgccagatgccgttgtatgatggatgcaagtcgaagcacagcaagttgtcatgcgtgttggaactgatgaagcttaaggctattaatggctggtcggacaagagttttacagaactccttgagctgttaaaggatatgttgccagaggggaacaatttacctcagacgacatatgaagcgaagcaagtattatgtccgttgggcctggaggtcagaagaattcatgcatgtccgaacgactgcattttgtattacaaggaatacgctgacttggatgtctaccctatctgtgggggatcaagatacaaacgagcaaagagtgaaggtgaaggaagtaagtcaaagaggggaggcccagcaaaggtggtgtggtatctcccaattgcggagcgcatgaagagaatgtttgcgaacaaggaacaagctaagcttgtgcgctggcatgccgaagaacggaaagtcgatactatgctgaggcacccagcagattcagtgcagtggaggacaatcgataggatttaccaggaattctcaaatgacccaagaaacatgcgtttcgcaatgtgtacggacggcattaatcctttcggtgatttgagcagtcgtcacagtacatggccagttctgcttgttaactataaccttcctccctggttgtgtttcaaaagaaagtacattatgcttgccatgctcattcaaggaccgagacaacctggcaacgatatcgatgtattccttgaaccgataatcgatgacttcgaaaggctatggaatgagggcacacgaacatgggacgcatatgcacaagagtatttcaacctccatgcgatgctgttttgtaccatcaacgattatccggcccttggcaacctttctggccaaactgtgaaaggaaaatgggcgtgttcggagtgtatgaaggaaccaagaagcaaatggttgaagcattcacacaagacggtctacatgggtcacaggagatttctgacaaggtatcacccgtataggaatatgagaaagaatttcaatggacacagagatacagccggacccccgacagagctaacagggacagaggtgcacaacttagtgatgggaataaccaacgaatttggaaaaaagaggaaagttcgaaagcgaaaagagaagagcacatcgaaggaaaaaacagaggagcatgtggaaaaacaaaagacaaaagagaggagcatgtggaaaaagaagtcaatattctggagactaccatactggaaggatcttgaagttcgccactgcatagatttgatgcatgtcgagaagaatgtatgcgagagtttaatgggattactgcttaacccaggtactacaaaggatggtctcaacgcccgacgagatctggaagatatgggtgttcggtcggagctacatcccataaccacggaatccggcagggtttaccttcctccagcctgctacactctctcgaaagaagagaagattgatttgctaacatgtttgagtggtataaaggttccatctggttactcatcaagaatcagtaggctcgtttcactgcaagatcttaagttggttggaatgaagtcgcatgattgccacgttcttatcacacagctgttgcccgttgcaataaggaatattttgcctcctaaggtgcgacacccgatccagcggttgtgttccttcttccatgcaatcggccagaagatcattgatcccgagggactagataaactacaggcagaacttgtgagaaccctatgtcatcttgagatgtactttcctccaactttctttgacataatggaacatcttccggtgcaccttgtgaggcaaacaaagtgctgtggtccagcattcatgacgcagatgtatccttgcgaaaggtacctggggatccttaagggttatgtacggaaccgttcacaccccgaggggagtatcatcgagagttacaccaccgaagaggccatcgaattttgtgtggactacatgtcagaaacatcttcaattggattaccacgatctcatcacgaaggaggcttgacggtgttggtactgttggaagaaagactattaggttggatcggaaggtgtacgataaagctcatttcacggtactacagcatatgactgaggtggtgccgtacgttgacgaacaccttgcagttatccgacaagagaacccaggccgatcagagagttgggtcaggaataagcacatgtcttctttcaacgagtggctgaagaaccgaattgccaggttgcagaacttgcctagtgaaacacttcagtggttgtcacagggtcctgaatggagtgccaccacctggcaaggatatgacataaatggatacacctttcacacggtcaagcaagacagcaaatgcacagtgcagaacagtgggttacgcatcgaggctgctagtgacggtggtcgtcgtgatcaatactatggtagagttgagcaaatattggagctagattacttgaagttcaaagtcccgttgtttcgttgtcgatgggtcgatcttcgcaatataaaagttgacaatgaaggtttcaccactgtcaacttggctaacaacgcgtacaaggatgaaccgttcgttctcgccaaacaagttgttcaagtgttctacatagttgacccgtgtaacaagaaagtacatgttgttcgtgaagggaaaaggagaattgttggattggacaatattgcagacgaggatgattacaaccagcacgtccacggcataggtcaagaaatacctctagaagaggaggaggaagaagatgaagttcaatatgcacgtgtcaaccatgaggaaggattatttttgtaatttatgtacgtagtttatgtctacatgtctgttatctgtatgactctaatatgttcgcaatgatcaatagtatattgcttatgaaatagtcaaataaaataattaagtgaagcacccactagaagtgaaataaaataattaagcaagtataagcattggaaataatataattaaagtagtataataatgaagtgcaattactactgttagtgaaataaaataattaagtataaaaaaatatgtagtgtatgtgaaaatatgttaaggaaaataaaagaactaagtgaaataaaataaaataaaattgctctaggcaaactcacctgtgacgggctctatctgtagggccgtcacaggtgacctcacctgtgacggcccagagtgttgggcccgtcacaggtggtcttacctgtgacggctccacggttggcgcccgtcacaggtgaggccacctgtgacggccacatagttggagcccgtcacaggtgagtttgactagggttgacctagggttggacatcttctagatcgatccagatccggcgcccactctcactcactcactctctcgaccgccgcctcgcctctctcgacctctctgccgccctctacgccctcctctccaccgccgcctcgacctctccaccgccgtcctcgccgccgccaaatccgccgccctctccgccaccctctacgccctcctctccactgcctcgacctcgacctctccgccaccatctctgccgccgccctctacgccgccctccccaccgccgcctcgacctctctgccgccctctccaccgccgccgcctctcgaccgccgccgtccatctccatcgacctctccgccgccatctccgccgccctctctaccgccatctccgccctctacgccgccctccccaccgccgcctcgacctctccaccgctgccgcctcactcactctctcgacggccgccgggacctcctctcagtcgccacgccaggaccgtcgtcaccgccaccgggatctcctctccgccgcctcctcctctcgaccgggactcgtcgtcgccgtgtgccgcctcctctgctcgtcgtctcctctccaggtacccctctctctctgatgcccatgaatggaagaattgattctttgataattaaggaactttattaggtttagggtttgaaatttagttcaaatggaagaattgattgattggccgcagatttaatgttgttccgaggttatcaaaccatcacagaatacaaaatgcatgggaaattttggtggattggtcagtgtagtccatggacggaaccgacctagacaccaaaattctccatgcattttgttttctgtcattctttgatgattaaggaactttgcagattatctaaacttgtggatttatataccctttttgtctatgaataggtgaattgcatgaattgttgtttatatacatgatttatatacccttgctgctgctgccacataaatgattgtgggctgttttattatctacacttgattgaattgaatggatgaattgctgtttacatgaagttagtagtactgtctcctttttttgatgaaatatatgcatatttgagatgtgaaatatatgaggtgatgaatttggactatttgtggatgaaatatatgcagtattagatgaattagtctttttgtattagatgattttaggattaattttgctgcattggttgaattttgcatgattttaactagataaatggccagtgatgttttatgttaatacacccctgccactgctgttattgtgggctacttgttaatacacccctattgttgctgcccctgtggagtatctttgcccctgttgctgctgcccaatgtgttccttgttaaatggccagtgatgaattgctcaataagaacaaattatctacacttgttctttttttatgcataagaacagattttctgtacttgctcttttttctggattgataagaggagactatatacacttgttttctgtcattctttgatgatttatatacccttgctgctgctgcccaatgtgttccttattaaatggccagtgatgaattgctcaataagaacatattatctacacttgttcatttttttgcccctacacttgttcatttatatacccatgctgttgatacccctgtggcatatatactcctcctgctgctgttttatgtcaatcatgcaaattctgtacccttgctgctgctgttttttaaatttgcatgattgattcagtggttatatacctctacacttgttctttttttatgcataagaacagattttctgcacttgctctttttttatgcataagaacagattttctgcacttgctcttttcttctggattgataagaggagtatatctagacatgttgttttagttaatttgcccctgctgttgctacccctgtggcatatatactcctcctgctgctgttttatgtcaatcatgcaaattctgtacccttgctgctgctgttttttaaatttgcatgattgattcagtggttatatacctctacacttgttctttttttatgcataagaacagattttctgcacttgctcttttgatgttatgatttcctctttttatcccttcatgcaaatgattgtaattgatgcatatttctcagcaaaactgaggccatatctttcatagtataccccgtattacattggatctaatgctatttagtctaatggtaggaaatttataatctttttcgcaaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcaaaattgccgcatgaacaacatacgtcgatgtcgggcgggacaagtgcaagtaggtctagtagaaatccgcggtcacaaaatatatggccgaccacagtgcaagttataagagaggttgacgctagtggtaggcccacggcgcccaggactgtcattggaagatggtctaactgctgcgggatagcggcacgtgagaacttcgggatcctccataaagatatcgggaagatcacagaagccgagaaagagcgagcttggacggcaatggagaaatggttcacatttccagccgaagcaaaggataggctcaagcggaaggcattccaaaagatgggcaaagcttggaagaattggaagtcgaagctcttcaccgagtttgtcaacccgcccggcaatcatacgccgttcgatgaataccctcaaataaccgaagcggtttgggaggaattctgctctctcaagaccacccaagagtttagggaatcaagcgaggcacatcgcctactgcaacagcggaatgagcacccgcatcggctaggcaccgcagggtacatcggcaaggaggcaatatgggcccaagaagatgcagccgctgcagcagcgaatgtccctaccccgttttcagacatccctgaacaaagagctcgcaactgggcgcgggcaaggggtaaggtcaacccggacggctctgtcacatttgagaacaaaagtgatgccgtcgtctatcaggaactggtgagttcactacttaacctaactaattttcgttcgtataaagtacaagttcgtataaacgactatcttcttttctagttgggcttggttactgaacaagcttcacaaagcgaggttgagtccgcgccgaagaggcgcaaagatgacatcctcacaaaggcgctcggaaccaaagaacatcctggccgaacttggggaattggtagcgatgtgccctggaagcatggactccctcagtacagatcccaatacaggaaacggaaagtctccaaggaagagagggacgctcgtttgaaggacgaacttaaggttgaggtcattcaagaactagaagctagcatgaatgcaagggtggaagaaagggttaacaaggtcctcgccgacatgaatataccccgagtcacaacacctgctgtgcaaccaactcctcgtgtacaacacgacgcgagtccgtcacagcataggagtagttgtgcatccacagaggtgccggcccctggtctcccgatcgcaccactagctgcagtggaccacatcgaggtaattgttgttatccgatccatatctaataaaagacatgtacacattccaatattaaattcaaactttcaccttatgcagggcgcagcacagtgtgtcctactagcgagagtccacccaactttcgctcctgaagtcgctgagggcatggctttcaagccctcggttacagacaaggtccacggcgtagacctgctagctgggtatgccaaggtgtccatcgatacagtaaaggacacctggtcaggctatccgctgcccgtgcccccaaatgatgaaatcatgactttgggcgatgcacgcaagacgttcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggctgatagctccccaccacttgtcaagggccagaagcgtgaacgcggcaaggggaaggtcggggagttggcgccggagccaaaaaggggcaaggctgcgacgtcgatgccggtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatccggaagttggacactggtcttctaaaatgctactccttgtaagtgcataccttctatacttgtgatatgactggactatatctcctaattaaattagttctaatacgtacatattttaaggttgtgttggatcgagagtcgtcgccatggtaatcaggttggattccttgatccatccatggtgaatgaggttaatttacgacagagcttcactgaggtggttgactatgtcaaccggtgtttatgggcccatcaagacaaggagtacatcatgtgcgcacagaaccaagaataagaggacaatacccttcgtgtatattgtttttgaagttaaggttcttagtactaacgctacataaccactgcgcaggcgacattggattctcctagtcatcgtacctaagtggagtcgggttacctaccttaactccaataagtccaaagattatgatttcagtgaaatcaccaaggccttaaatatggcttggggcccatatgtggaaaagggtggtaggcacaaggagggcaagaatgaactttatcatgacaccaagtttgcatgcgcacaacagatcggagaccaatgtggttttcacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaacccccccgctatcagaggcgaattgtgcgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtactattcatctgttttctcctttttttttccttattgacaggttgtgcaggtcgatgacattatggctttaatccatttggtaagtatatatgtggttctatgagcaacgaccgaaattgtggctttcaaggggtgtgaatttgctgtgcaaaattgtggcatttgaactgcatatatgtgttgttggggatctgtgatgttatattgggggggtgatgtatctgtgatggatctgtgactagaatatatctgtgatgtttctatttttcagagggcatggctagcaaatcctgaggctagccaatatttagcatttatttttttctggaattaactcatcagtgacgggtcggaacaaaaatccgtcaaaggtaacataacctgtgacggactagcaaataaaggcccgtcagaggtgacctacctgtgacgggcctttacttttgggaccgtcacaggtagatcacctgtgacagcttctaactacggagacctcaacctctgacggcctttatttcaagggccgtcagagatgagtcacctgtgacgggtcctaacttgctcaaggctagcggagaccaacacctctgacggccttctagtaacttgcccgtcagaggtgggtgtcacctgtgacggccggccacccgtcaaaggtgactggactcaccagtgaccactgatcactgaccatgcgcgaagccgtcaaagatgagggtttgggcccgtcacaggtgaccttggccagtgtagtgtgcgtagcatagatgagagaagagcattaggagacaacacattggcagccatgatcatgccatgctgggatgtgctaggtgcattcctccctcgattaattaatgtctcagaaccaagccgaatggctctgatggactgcagtgcgcatgcatctgagttgagcccaacaattcactaacagtctttgtgcatttgaacggcagaaggaggaagtaatataagcacggctgcacatcaagcacatgctgcagtgcttattacggagtaaaaattaacagagaacgatgcatacaaaagcatcggttttatcgcatattgcatggtaggctctatgatcatggccatcttccatcgttaattaggtgtccggaaattaatattattactgccagccgccagcgtgttaattgcacaaactacatggtgcctgcgcgcaagcacaacgagcccacatatgtgtatatatattgaaccggccatccatacattgatgccatttcatgattttaatgagcaccatccaattagtgagcaaatttgaataatttaacgacgaccatcgtagcgtagcatagatgggaggagaatcaggtccgctgggcgtgccattttgtttgatgaaaacaaaataacgaacacacaaaaaatagggaaaccttgtattttattaatcacgattcattaatatgaatgtttacaaatacatcagggctcccacaggagttcgtcttttgccttcgcgaggaatacttaatggaaatgtatgctgactggagattgcatgcagtccgctgattccccgcgcctagcaatgaggctaccggttaattatatccataggacgagcctatggaacacctccgattaagatgcgctttgtgatcgtcgtcttcaaaattaattgctcgccgaaggttgaggttggtgcagaaatttaatgataactgtgatataggtggctttgttttgccgaaacctggtcacaatatattatcaccacgtccatacatgaatcaggtatcataataaaggggatgacttttgcctcgtcggtgcccagtcatatatgccggcctttattagatatagatatatcgttacttttgcctcgttggaacctagtaacgtgtatccgttcctatatgtttggacatgttaataatatcgtgactccggcctcgtaaatgctcggccataatttttatcttccaaagatcatgaatagctcccatgcgtgtgcatggtagcaaaatatattttgtaaaacaccgcttagattgttcaatcaccaatgaaagttggacatatctagcaccgttgttattggcatcatagtaacaaatagatgatccaatctccaataagggtcggacatctaattttgagcatagaaaatatcaaatagtattcggataatccgatcgccaatgaggaccggaccagccttataccattgattgtataaatggagtttgatgataaacgtgtttcggctctcattgatctggctttaatcatcaagatcaagatagattaagaacacgcagatgttccgatcgccaataaggaccgaacatctattgtgtttaatctagaaaattaatatttattcaatgtgctcaccatccagcgcaaatatcttgaatggcggcatgttgtcgataaatgactcgacttgacgaaggacgccggctgcggtgtttaattttctccgcagtggcagcggcaccggtttgctatcaccaggcgacttcaatctcctctcctgattttcctaatctactaagaagaatgggatgaatgaaaatgggcagatgggtgtctcctgtggcgtcctcggcgtcccccgctctagatgggttctgctccttatataggcagcggtgacggaaacagcctccgaatttccagcgccccgtgctaatcctcctgataaaccgatgcagggacgagccaatgcgtcgccgtgtactggagataattatgtgattaacatgcctaatgacggtgggcccatgtgtttaatcgcctgtcaatttccaaattggagataatgatcctcacgtagcaaagcaagtaacgatagcacttgcttatttcttttcttttaatagctccaatcttttgaatcgtacatcggatttaaaattcatttgaaccattactttctattcgaattatacatcaaaacgagtccaatatcgaatatattcggacaccgtgatatttaaaatttctgggcccatatgtcatatagacacgtctcgtatatatttaataaaattgggtggcagataatattttcgtacaaaattaaatgcccaataatttattatatcttatatgaatttttttgcacaaaaactcatcaaagaaatgccccccaccgagtatagtctgtacgcgaagtaggacaggctaatactcggtgaacaaatcatctattcagataaacctctccataaacgattaattttgctggtaactatcaccagtatatctccaacaagtccgagacgtatcaaaactgattagtgattaatccggcatggactccatatcgccgggcatatatattctcagcagccacgcctgcctagggtttcgaatttgtcgtccttctattctgaagtaattttctctaatctttgttcgtctcactagtcgggacaaacgaaccgatctacgtgataaagaccaggtttgctctacttgactatttcttgctttacatatcttgctaataccttgaaaccctcacgatcaggcatgtacttttcaataatcttgtcagctatttttgcctcccacttttgatagtactttaagatggggagagagagcaaagaaaacgttcaaatccgtttcagggcgagcgagccaaaaagaaacaaatcaccggagatcaacacgatcgtgatcctgaattgattaatacggaggagcaatgcgcccctactgatcaccagcgaaactccatggaatctggcagttcagaaggttctcgtgacatgcgcacaggataccttaaaacaactgctcacaatgtatgatcaaccttgaaccactttattgttttaaaacataagcgtgaccatactacttgcttgatgagcttcctgaacttcctttattatttctcttttattcttacagaaaatgccaatctcaatgtacatattatttagcgggtatgaaagagaagcaccgccgcaagaagaaaacggagaagcgttattgtggtgagaggattttgatttttttaaggatgcagagccaaccggtaatttacccgaggatgcacaatcaaccaacaatggtgaagcaaagaaaacagatgatttcatgagtcaggttgcttcatgtttgaatattaagtggggtcaacaacttatacgtgaagcagagtggatgtcgctcacgcagagtcgtgactgggcagcattccgtgtcccgacaccatttcaaaaattacttgccaattgcaaggatgtccttgtaggtcatcaagatcaaccagggacacagccaagagggaggcctggcagcatgtgtctcttgaagccggttttatttaatgactccgggacttttgatgtgccacgtcatactgctacattggcacaaaagttcattacctcaagaaccaagcgatggttggaagatcagccaatgcagttaaggctagaaatttctcccaatgacaagctaatgctatgggctcgtatgctaatggtgaatccgtacgaccgtacatatctcaagaaggccggcgtactccgaggcataatggcgtctatttataaatgcaagatagatccttcattagtggccgcctttttaacttattggaatgtggatggacacactttagtcaccagccagggagagatgggttatcctctccatacaatgtacgatgccatgggcataccaatttcagggcgcctttatgaagaatttatccctttaccatccacagctcgtgggcatgtgcagactctgcacaatatatatgttgaggagtgtcccctacaactaaatgagggtcctggaatagtaaccatcgcgacatgggtcaatcacttcttcggcgaccaccctgtgccttttcagtcatttttacccaatggttttgctgatccaaaaaaacctttatatgagggcccaaattttcgtgttgagattcggaatggccgacccactgctatcatgtgtggtctcgaaatgacttacgtacacacctacccattggtggtgtaccgggcagcttttatcgccgcatggttatgcacatattgcgttccagtggaggaaggcaactttattcgccccgaggtttttactatggcaatggaaatcgctcaaggcagccgctgggccattggtgttacaagcatggcatttttatatcgtgccctggacaatgtctaccaccaagtagctgcacgtcaggcttctgcgagtgactgttcttcatttgtgccaggccattttattatgggctggtttgcatctttttggagagggttcctacgtcggcaactttatcttgcccggtgatgaacccgccctttattatagacttcagagactatgagtctatggatattaagagcgcacatagcttattttgggattttaatgatgctggaacggctttacgttcactggacttcttgggacggtccagcatccgttttcccacatccgaccaggaggtcgagttatttgatgaccgttctcccaaggcacacagggcaatttccatggcagccgtggatttcttggtcagctgcactgttggcggcgtcacctataggagaggtgaagtttttgacaatttggtttactgtcctcatcgattcgctcgcatgttcaactatgaccagcatgtccccaatttccttatgatcaccattaacaggacacgtagccttgattttccaagttacctaaatggcaattctagggatgaatcgctgcaacttttgcaacggcgccacctagcttttcataggccgaggggtcactcaatatttattcaacctttcgcccgggacaccatacgttcacttgattacatcaacgggtgctctcaagctttcaattttctaaagcatccgagcctattctgttcacggtcaaaacactccaccaaagctgcaactacgaaaaatgcacccggggcagaaacatcaggcatgcagtttaccaaattttttttaaagaaaaatatatactctgttatcaatatgaatggtcattggttactgtttcctctaatttattttcgtcccccttcttttttttaggaggttcaggaggtagggtgggcacacctaagcaaagaacagccaagtctgtctcgatctctcctgagcaccaggaggagagcgctcaaaccgagatcaagacaacgttgccattacccgcctcgagtgcgaaccctacagagattgtgagggtaggacccgaccggtctggaaaagacatcaagaaaatcagaacatgcattgccaacccagacaatgtcacaactcatgtgtctgcccaagcctcacaacaggagttattagtgttacctcctcgaaatgagactgtactcaactcgtcagccatgacgcatatcgacccctacagtgaagggttggctattccacatgatgatataggcactctgcccacagatcttcttacaggcgatttttctgatctagccactcttttggatggaggggcaaaccctgaaaccagtctctgtttagattcgcccatttttccgggtgctactcagaaggacaacgttaattcgcatctcctagaggacgacgagacgcgtaccgaggcttgtgctgatacagtaaaagggggcacctctcatcacggtacaactcatttattttattttatagacatttctgtttgttcctttttttatacaaataaccaatttcatgcactcccttccttcttatgtgtttcagcttcactgactggagttgaagagttgtccaatgaatccaagaagttatctatggatgttgagcaaatcgtcgcacaaattctaaaggcaccgaacgtagaccctggtgcaggggaaaactcctagttcaagggatttcatgggaacaactcggtgaccctgccgaaactttcagatgatgtttcagctcgtggtcttaaacatgtctggtctgagatcaaagcgtttcaagaattactcaaacaacgcccgatacagaaggatattgtgcttaaagagataagcatcaatctggatttgtggagtaacttcttctcaaaaccacctcctgaaataattaggctaatggaagggttacgtgtgcaaaagggagcgctatcagaggaagcgccactgccaaccactaagattgaccatcatattgatatgctccgcactgctcaagacaaggtggagtcatcgtgcgtcgctttggcagcactaacgagtcaatataacgtagaacgggctgtagaagaaggcaataagagggagtgctctcgacaagcccagaaaatcaaagcagagatagcaatgttgcaagcaaaacttcaacaggtggaagatgattattcccgtgctcaatgccaccaagatgttgtaatagagaacttgaactcccatcttgagcgacatcgacaagctaaggatcgaggatatgagattgcggcacagttagagcaggcgagcgtacaccaaaagtctctccaaaatattgaagactttactaagccagacgagtttggtctgtcccaatatgtctacaatatatttgattttttcataggctgctcattagatgagtagacgctgttttaaaatcttgtttcaggcttgtaatagctcttcagatattttatttgtttctgatataacagagtgaactcctttatttgctattatatactttgatttgcaccagaacaacggagtgaactccttcaaatttaataggagcgttgcattgttaccaaccgtctttgtgcactggcttcttccttttttttctttatatatatacatttcctcacataaaagatgctcacgttcagattttttagtggctttactactgtagcagtaacagtaacgccactaattcttcacgattctggttcagccatagattttttttattcaattttttttactggcttttaaaagaccagcctccccgctatagaaattatagcgaaattcatgcaacaatgcaaatgtcgataaatataccatagcgaagattcatgctatgacataaaattccttgtggcgaagaatcatgccgcggcgtgagaacaaaaaaaaatttaaggaagaaaacgtagcgaaaaattcgtgccacacactgatgattatatggcgaagtaatcataccatcttataaaattctattgcgaccaaaataaatcggtgccaaccaatagaaaattaatcaagctagacgcgaccgttaaaatggttacggtactaggcgtctaaactcgaagggtttcacagtcctgcattgaccgtactggcatgctttactgctcccaaatattgactgaccatcatccgaaaatcatagatgctggttcagtgcaactgtacgtaattgactgggccactgtgagaacgcgtcccagtataaacttgataggattaattgccgtccgaaaatcatagacgttggcataatccaattgttcatgaaataataagatcactgtagaaaaattcgttacagtgcagaattgttggaattaatcgtcgtccgaaaatcttggacacgggtgaaacccaattaaataataaaatcactgtagaaagcacattacactgtacaacttataatattaattgtcgtccgaaaatcatggacattggtatgatccaaccatatattaagtaatcatatcactgtaataagaacaccacagtaaacttagtaggaataatttccgtccggaaatcatagacgttgtcatccttcttttcttttgccacgtgttttttttgccacgcgtcataaaggccttcttcacacacatcttgtaaattcaggcttcaaatattattagcatatgagacggatgcccccgccgagtagagttcatgtgcaaagcaacagggactcgactcggggaaacaataaatgagttgtcttgtttccaaggaggagagagaaaaaaaatatgtgggatttttttttgtgtgttggcttttcttccggtcgccaagctatgaggtaacgaatggcaaactgctggaggatgtaatatgccctcaatttctgaataacgacgggatctcgcttaatgcttcaactccctcgtgtaacttgtgataatgagctcacgtttcatcaggatctcttgaaaacaaaggggtcttttctgagttttccttcaattatgtgcctcatattttttacctttatcccaggaaggaggataggataaggctatatttcaaaggtggtttgggtcaataggctatgaaattgccattacttttgctgagggtgggagatgactacttcccgctttcagattgaagaagagcaaccaacccggctacaggctgctgccaagacattgccatactttcgctcattttcttgacgatgtcgctcgagatgggagttcaagttctctgttacaacatcttgtcggtgttgtgcactggagtgggcatcttccacttgttgaagtcttgcttgcaacactgctatctctgctctaactttccgtgcttgtcgtgagcactctctcttgttgccctcctctactgcttgctctacattatattgactcgtcagtgcctccaaagcgacacacgatgactccaccttgtcttgagcagtgcggagcagatcgacgtgttggttaatctggtcctgttgtgcgagaacaagattagtagttggcagtggcgcttcctccgatagcgctcccttaagcacgcgtaacccttccattagcctaattatttcaggaggtggctttgagaagaagttactccacagatccaggttgatgcttatctctttaagtataatatctctctgtaccgggcgttgcttgagtaattcttgaaacgctttgatctcagaccagacatgtttaagaccacgggctgaaacaacatctgaaagtttcggcagggtcacggggttgttcccatcaaattctttgagcagggagttttcctctgcgccacagttcatgttcaccgcttgtgaaacttgggcgattatatgctcaacattgatagacaacttcttggattcactgaacaagtgttgaatcctagctggagcacatgagaagaagggtagtgtgtgaaattgattacataaaaaaaaggaaaacagagtggacagagaagtataaaatgaaagaaaccagttgtaccttgcagagtggtttctcctgcccgcatgacagaattatccccattacaatgcttactagtggcttcggggcccactgccttgttagaaactccatctggtcgtcatcaagaagcttactagtaggttgagttgggggcatggtgcagatagtatcacacggcgtgtttgatcctccgccggaaaaatcaacatatgttgcggtatgatagatatgttatgtttccctgtgaggaagctgtgatgatccacatgaaaaaataagtcggtggccctgtttgatgttcaaacaagaggctactttagacaaccacatccacttcttcgctgtcccgattgccgttacatcttcgggtgagatattttgctggtcaatgtgatagaaaaatttgaagtcatcacaccaaagaaacatctcgccattatcttctcttggcgccttcttggctagtccactgtataatgtgtagattgaggacgcctcaacataggggttccccttttaaaaaaaagaggcacttataagatggatcaattcacggaagagtttaacgattcagaacctaacttctgtcccttttttttattatgatcttttcgccgtgagatttttgcatgccaaggcccctcccttgctgggaagtttccttgataccttcatcactatcatggccaggcaatggtgggtcatctgggatctcctgccaagtataagtggggttgcacacgctggtatgatcggcacgatcactagccttctgcattttcttgtcttgaacagtagcaaagaaattcgatcgactgctttccccagtcgatcaccgttaatttgcagtagctctgatcgaagattttaacgatctaacatgagctctgttttaattactcgattaagaagctgtacagactttatttatatatataggacatacggccatgagcccgtatgatacatgaactcggcttcaatatatatcagatcatgcacgtcatttgccgattggcagccagcttgtgaatcaagccatgtaccacacggagatggattaatccttcgtaacaatatactactgagtatttcaccgagtgaagtctgtcctgcttcgcgtacaaactacactcggtggggggcatttgtttgatgaatttttgtgctaaaaattcatagaagaaataataaattattgggcatttaattttatatgagaatattatttgtagcacaattttactgaatatatacgagacgtgtctatatgacatgtgggtctagaaattttaaatattatggtgtccgaatatattcgatattggactcgttttgttgtataattgaatagaaagtgatggttcaaatggattttaaatccgatatacgattcaaaagattggaactattaaaacaaaagaaataagaagtgctatcgttactacgtgagcatgcatggtcattggctgtggcgattaaacatatggggcccactgtcattagacatgttaatcacataattatctccagactgcagtacacgttgacggattggctcgtctctgcgtcggcttatcacgaagattagcacagggcgctggaaattcggaggccgcttccgtcgccgctgcctatataagaagcagaacccatctagagcgggggacgccgaggacgccacaggagacacccatctgcccattttcattcatcccattcttctcagtagattaggaaaatcaggagaggagattgaagccggccggtgatagcaaaccggcgccgctgcggagagaattaaacaccgcagccggcgtccttcatcaagtcgagtcatttatcgacaacaagccgccatttaggatatttgcgctggatggtgagcacattgaataaatattaattttctagattaaacacaatagatgttcggttcttattggcgatcggaacatctgcgtgtttttaatctatcttgatcttgatgattaaagccagatcaatgagagccgaagcacggttatcatcaaactccatttatacaatcgatggtataaggctggttcggtcctcattggcgatcggattatccgaacactatttgatatattttctatgctcaaaattagatgtccggccctcattggagattggatcatctatttgttactatgataccgataacaacggcgctagatatgtccaactttcattggtgattggacaatctaaccgatgttttacaaaatatattttgataccatgcacacacatgggagctattcgtgatctttggaagttaaaaattatggccgagtatttatgaggtcggtgtcacgatattattaacatgtccaaacagataggaacggatacatgttactaggttccgacgaggcaaaagtaacgatatatccacatctaataaaagctggcatatatgactgggcaccgacgaggcaaaagtcatcccctttgttatgatacctgactcatgtatggacatggtgataatatattgtgaacaggtttcggcaaaacaaagccacctatatcacagttatcattaaatctctgcaccaacttcaaccttcggcgagcaatcaattttgaagacgacgatcacaagcgcagcttaatcggaggtgttccataggctctttcctgtggatgtaattaaccggccgcctcattgctaggcgccgggaatcagcggactacacgcaatctccagtcagcatacctttccattaagtattcctcgcgaaggcaaaaggcgaactcctgtgggagccctcatgtatttgtaaacattcatgttaatgaatcgtgattaataaaatacagggtttccctattttctgtgtgttcgttgttttgttttcatcaaacatctggcttggagtgagattgcattgcatgtgacttagcttctttttaatattccggtgcagtctgcaacacagaaatgacgcagaaggaaaatcaagagagggcaacgcaactgaatggatccaaggctgaatcgaataagttgtctttgtttccttcttttcctgtacctgggagttggttgtataccccctctgactttgcttctttttatgcagttttgtacaaaacaaactcaagcagaaagcgaaacaaggggtggaatctcaaaagagagaaacgaaggctcacttgagcaagatgcttgctggattgaagattgttgaatttcttcatgctgaagggtggattggagggattatctaagaggttttttttttcattttaaagctattctaatgcctacattgtcaactacattccccatatttagtatgcttgtccacatgtcaatggcaccgttggagcaaatccataatgtgcatccttattccttaaatagtgcggacatccttaaataatcctttgagaagaagtatcctaacctttacaatctagttagaaataaaaatgaggtagtggccaaggtaatgagtagaatcccgttaaatgtgtctttcagaagatcaatactgggaagaaacttgaagcctggtatgagctagtgtcgaaggtattaagctagtgtcgaaggttgttaatactgttttgacagattagaaagatcgcttcttttggaaaaacaataaagatggcctttccacagtaaaatctatgtacaagttgctcatgtatgaaggggtggttcctaagaagaatttcatttggaagctcaagattccacttaaaatcaaaattttcttgtggtaccttaaggaaggggtaattctcactaaggataatctagcaaagagaaggtggaagggtagtctaagttgtttttgtaactcaaaggtaacaatataacaccttttgtttgattgctcaatggctaggtatatttggagtgcgctcctttttacatttgagattaggcaactgtgtagcatgtctcaaatgtttgggaattggctgaattgtgttgaaccaggctcaagagaatattgtttgtgggcatagctgcatttctttaggcaatttggttatatagcaatgatgtggtctttaattgctccaatcctacatctttcttgcaggtcattttcataggaacgcattgggcaatgacttgatctttgcttcttaagggaggcgatgaagaaatagttgagagcagcaaactgctggagaagcgtgtgttggagttcttctccgtgtatggctggaaccttacaagaagattggaagcctagtctttttcttcgtttgttgttcttaaaactctttgtgctgtcatctcttatgcaaaatcattttatatttaaactgacaaatagaacctggaatcatatatttctccccatcgaagaaaaaaaatgtacagatgatggccacgaaatatcaaaatccaaatgagcagattgatcgactcaaacaaatccagcaaactcggcaaaggaaacgaagacattttaattaatttatagaaatcagtcaaatgagatataggagtaattgatatgaccaagtccttatgtgtaactattttcttccaacgggaaggtgacaggttgtgcatctgccgattgatgacttttaatgcatatgatcgcctgacagccgtgaatattgcaacagaattttagttgtccagcaaaaagagatttgcagcttgcaggttcatctagaaaacctacaccagtaaaaaaaatgccgagatagaaaaaaaaaccatctagaaacgaactaggctggctcaagaacggagtgtggagctattccaccgtatcccagtcatagtagaaaaagccgggttgtcccggtggagtgctggcttcaccggtctatcggtccaacagttgggtcactggatgaaccgcggtttattccctatattttgtgttgccttccagtcacagcggctaagttatagtataacttagcctagcggttggcaaggtttgcatctatcctagcagcctgggtcgaatctcatccctgcaccattttttctcccataaaaatcaagttgggctcataagaaagatgctatcaagtggcccaactagctttgctcgaaaaccgcagccggttcacaccgggtcgattgtgtgagcgatcctttgagggaaccgagccatgcgatcctttgagggaaccgagccggtcagggagctggttccggttttttctactatgatcccagtagatcttttttttttcggggatgatcccagtagatcttattatatacttcttctgttttatactatataagtcttattatatacttcttctgttttatactatgtaagtcatttgcttttttttcctaacttcaaactttttaagtttgaccaactttataaaaaaatatattatcattttcaatacaaaacaaacatattatcaaattatatttaatattgaatttaatgaaactaattttgtattgtagatactattttttttaaacttggtcaaatctaaagaactttgattaagaaaaaaagtaaaacgacttataatatgaaacgaagggagtattgaaaagaaaagtttggtcaggtcgttatccgtcatacatggcacatttgcggcccagcatatacatacataaatctgtttccaacacacagcatattctctactctctacttatactatactactattgtaatggcaaaatctaaaccgagaagcctcttagtttagtgtaaactagcgaccaaccggttgtgagaataagtactactacacgtgcatgctttttttcctcttagacatgcatgtctttttcttccttcttataaagttttctcaaattacttatccaatctacaatccgattacaccattgtattcgttacaattaaatcttcacaacaagatcttacatgattatattacgatgaaaaatatttatatttgcaaattacttttattatatacgtaagttacttttatcatatatataagttacttttaaatttgactaaattacttcttagatatataaaagtaaattcaataaagtctaaaagtaatttacatatattataaagtatctttaaacaaaactaaagtaactttgtcacaacattagaagtaaattcgttgtagggataaaaatatgactttatctagaaattaaatttaatcagcacagatcaacacacgtaagtttaacaatttttaaaagtaacttcaatgttaattggaagtaatttttgcatggttcagaagtaactctctataaatcttcaatgttaattagaagtaacttttggatcaatgaaaaaaggcatgcattaaagttactttttttttcgttataagttacttctataatatatctaaattacttttaggctttattgaatttacttttatatgtctaagaagtaatttagtgaaatctaaaagtaatttagatatattataaaagtaatttattatttttcatcaaaatataatcatgtgagattctgttataaagatttaatttttacgaacatgatggtgtaatcggatcgtagatcggatgagtagtttaagagaaaattttatttaaagtataggtggatagagtctctcatagatagagtggtagttggtttagacaaaccagctaccattagtagctatatatatatatatatatatatatatatatatatatatatatatatatatatatatatatatatatatatatatatatatatatatatatatagtcacgtcctactataatataatataattaaataaaaacgatcgtaatgggggtcgtgatttctacaactattatttctgaccattagatccgcaacaatcaatggatgagattcatcttgcgatccttccacgcccacgcgcgatccttcccttggcgtagaaaaagaaccgttgccccttttccttggcaagtccgcacatcgtgccgcccctccgccgtcctcgccttccccaccacgccgtcgtcgctcccccgtcatccactcatccactgcgctgccgcaaaaagcgatcctcctgcatgcatgccgcttcccgccggagccgctcgcctcccgccagagccgctctgcctccctgctcgcgccgcgacggagaggaaggatagctggggtctgctcacaccgccaccaacggagaggaagtattttggtgtgtggtttaaggattgttgatataacgatttcattttgcctaatagtgtttgatgaaattttgttcacgttttattaattatttttcactaatgtgtctgcaaatacttgagtcaggataagagggaggatgccatattcagcctgggtgctctctgaagatgcataaccgtgtgatgtctataaatttcttctagtgcctgttgttgcagggtttatttctctatctgtttagttctgcttattcatcaatataatcaaagcttctgcttattactatagttttgtcatgactgaattctttactaatcatgaggcgctacactttatactacctaaattgattggaagaatatgccttcaatggaataagtgggactatacttaatcatccagttgtattactgccaaaaccctattccttaatcatccagttgtacataaatgttagatgcacaggttgcatatataaccctattccataatcacccagttgtacatctatatgttcgtgcttcataccagccttctgccttcaataccattaacaatatgtatacttatgattttttccccgctaaccatggctgctaggagatcttccctgttgtgcttcctaaggccgtgcccaccatgcaaggagcagagcaatgattactgcgttgataagattgactgattgagagggtcatggtgagcctaattgcaacattcattagataaaatggttgtttgattgctttagtactcttgtcgatatgtgacaatgttttgcactactaatattgtaaatctcccgggattgtcctcaatttcttttcactttgtctacccaataggagaaacctatgggatgtgctccgtgacaacatctgctcactggatgctactaaaattatgtcatttaatatccattttttactgtgatttttaattgaagtaagtaaatatatactacagatattttactgcctacctgcaaatatttggtttaatttgtattttctaacacatgcattttgatattcttacattggattatattttcattccattttgagctgaaaaagtggtattcagatattatgtttgacataactatttggacctttttccctaaactatacttatgtgtttcttaaattttaactgaagatggttctcttaggcaaaagttttttcctccttctgttagacaaagaaaagaaaaatgataagcactggataatgcatacatgtgtgcttgattataccgtatactaattgcgcggtgtgatatttgttttcagctgaagtgatagatataactgtgattgcaaggatgctaagagaccatggcaagcccaagggatgtaaggatgccaacgcgaaaccatggcaagcccaagggcacagctatcacggcagaagggggtgggcagtgttgatgttagaatagagcagagctatcagggatgtggagcaggtaatctcagcgtacaatagactaataatttttggggcaagagaaatgcaaatctcagattgattataatggaatgggagcaaaagcaaagatagtaccagatccaactctcctttccaggtttattacactattctcagcattttagttggtttccctgttagttgagtgacttagagattatcagattaggcttaaatagtctctaacaacctaataactcagattggatgaccattactactatattagcaatttcactgcatcaattgagtgttaatttatatctttgaattacgcgccattttcacaaattcaagatatcagaaattacgtggaagtgtaaatgaggtcttcaatgcattgtcttatgttacatctttcctgctcccctgttttcgttggtatatgcctcttacatccagtgttatgatgccataggaaggtcagaaggtgaatgatgaactgatgatgctatctgaaggtgagtgacgatgctgtctgaaggtcagaaggtgagtgattgcaattcttgcaagggaaaatacattgctccatgagtgtgactcctctagaggtatatgatggaatctcatttctacggcaaccttaagtgctatgtgtctgttggaggagagggaatgctgatgaaacctgaagttattaggtagtacaaggttgttagattcttacaagtttttagaagacatgaaagtactattcttaacgacctaattcttttggcacagacgacaggtccatcaaacatatatatcaagcaagacaaatgattcaagtgataattcaagatttatgctggtatcatttttgtggaatttgtattggttgagataggaataattttagctccattggcttttgtgggtcaatatttggattttttttttgcgttggacaatttatttctcactaatacagttgttagtttctacctatgcataatttagataaattttgaaagtgattatatatccctgtgggaggtgtgttgagaaaaacgtgcaatgtaggtgtacgttgaagagctagacaaataggttcgccacttcgctggctggtggatgataacttgaacctcaagatcacatcactaattaattctgataataaattattactttcgaaatgttgtgatttgatcattcatggatgaccacttgttctgcttggacagctgaaacaggaggtagctgcactggtgatgcctacaagagagctcactgcgacaagcttcatcaatccaattctgaaggttgaccagaacaagcacaagattgatgaaaaaaggtatatgccagtataaaggctgtctgtttcagtgggagaaacagagaatggttaggatgtccatcgatgagtgcaatggttatgtttactttttgctaaacatagagatgtgcaacattagcaattcctgggtcatacttttttcccacaatagaccaaattgttaatatagcatgacagattaatttgttttgagttctaatcagtgaagtgtatgcttgaatagtttatatactactaaaaacaaaagtaggggctgaatgataattagttgtgagttctgactataataagaggtgaagtggatagcatcagatttattctggtcctttatacatgctagctctgattgaagattcaaggaatagttacctagaattggaggacaaggaatccaagtatagactgattatatggtggagatcatcttttaagtttttaaggcccatatgctcagtaatacttcatagacttaatattcctcgagttgcaaatgtaggcgatgtgcaaatctgtgttggcccagagagcaccaatcatactagagagcaccttggacataaaaatatccatcttgattatctgaatagttttcctttgaaaaaaaatatagctctaaacatgtcctcacagtcacactagagagcaccaaaaggtgcacagcagctcagacatcacttgattcagctaccattgctacatatgtagtgttactgaaatagattcaaatcttttggtggtgatttataaagttttatctgatcaccagttttactattttgattacaacttgcaaccttttcttttggcacaggagtgcttacattaaaaatagggaacaaagtaactgcatatattttcaaatggctggagttctatatttttaccagtgtcagtgatattcatgataaatattggcttgcaaacatcatcaaccgtgcatatcttttggctatcttttcctccaatttttgtgcagtaatattcttgagcatggaagctgtaagcttccctgaaaaaaacagatataatttactctagattttctcatcatgtgcctatggtcaacagtactgagatttttccttgattttagtatagcatagctctgcactctcccggaatgcttcggggggtgtgtgggaattgaaagctttggggggatgggggggataaggcttattttgttcatgtgaatagcccttcacatacttcagaaaaatggctacgatcttgtgttcaacaacttgactgaaatcttattagtttttttgcaagtttgctgtaatttgccaattttgtgttcatcatttcaacaagagccactgaatgaaattaaaagctgaatttgctgctgctttcagatgcaagagcagcattcgaagcgttccattctaggaacggaagcagcagaggatgactcgttgatgaagtcatacatgctgctgttgtcagcgaacgccgactccggcaacttgacaaggtgagaggaagtgatggcgcagctgcacaagtttagcctgtcgtaacaattgattatgctatgcatatatggccgtctaaggggcatcgatttgcacatatttggttgtctggcaagagtgtacaatgacaagacttctccgaagattatgtttggtcaaaaaatgtgattgcttgtttggttgtatcttaggtgtagatatctatgaatgatttttgtgttttccatacaatctgattattttctaattgtaagatttctataattcgctctccaaaagagcctattattagtctttaatccatgattattttctaattgtaagatttctataattcgctccccaaaaggagcctattattagtctttaatccattgttatggtttgctttgcaattagattgtccaattcatagtgttatagttgattgacatcatttggtgttcatcggagtaactattgttgtattcagagatagattaacagcacaacaatgcacatttttgtaggatcgtaaagggcttttcctaccccaaaacctagccattgaggtgaggggctcccccacttatatcttaggtcatttgcccttccacaaccaatgtgggactattcaacaatctcccccttcacacattggtgtccctccctcaacccttcaccgccccttcaacaatctcccccatcttaggtcatttgcccttccacaaccaatgtgggactattcaacaatctcccccttcacacattggtgtccctccctcaacccttcaccgccccttcaacaatctcccccttcacacattggtgtccctcagcccttcactgccccttcaccgtgtatagaccccacagaacaggcccacggtccatcaggtatacgggccccgaaggcacccacggtccatcaggccttcacatactgtgtctccatcgggctagagatgttaacctagccaggctctgataccaattgtaggatcgtaaagggcctttcccacctcaaaacctagccatttaggtgaggggctcccctacttatatcttaggtcctttgccctttcacaaccaatgtgggactattcaacaattttattgtgttttcttccatgttatattattatgtatttaaaactcgttgcagcgcgcacggtcatccaactagatgatgttgcacgcttcagaaatcagaggcaatacaattcgtcacaaagttatatgctgatcaaagatggatggaaattgcaatcccattttctgatgcttattatagattgcaggctgcaagcatctctcttggaaggactgtcaagttgccagggtaatagatgtgaaagtgcatgaaatttgagatgaataggtgactcgaattacaattactaacttagcctgcctctctaggtaaattaatcacattcctcgttctgtgttttgtgatcttgtctttcagaattggaaaagataggctggaatgcaatgtcaagtaaaaggttcatggagaaattagtgatgggcggacatccgttaggaaaaacacaaaaataaatttcattgttctgtagactgatacttaggctgctttttaatgacttagagtagcttatgactatagatatacatgacaagttcattttcaatgtgcttgttgagttttgaatggctctatttgatgcattgatctgtcagtctgatgtagctgtttttttttaaaaaaaaaattcagcttatgagtgttgaatttctgttggcaatcaattctgtatgctctgtaaatgaggaaatccaatttgttgcaagccaatatgacaatggctctgtaaatgagaaagttacaatagattcagattgtggactgcaatttggaaccattaggttgtaaagaactggataagcctatttatgaaaaaaaaatatatgtcaaaaacccaattctctttgttgtcatgctattttcgaataggcctgtaacagtagccataagcgtaggtctgtaacttgagaattagtagccgctgaaaaatcgaaatgatattcaatatttgctttccaccaaactaattgttataactcgagtacaaagctttgggaggcaactctaaaatttcatatatgtacttttcactactgtcactttgcatatacatatttacatgagctgtgtgagttttaaaatgcatgcactctgtcttgtctcttgtacaatgatgaccgaaggttaactttatgtgttaagtccccacagattctgggtaattaattaactttgcaaaagtttatatccccaactgcaaatgatcaattaatatagtagctcaattagagagcagattttcatggatgccaaattttgtggactcaaagtaaagttgtaatcacctacatctataagcattgctgaagtgtaaacaatagtttcaggactgatcattttaggagcatagtgacaaagtgaacttaatagccaggttagaaacaacttctaaaataagagagaagcatcttcatggcttattgaactctggtgccttgcatgtgaataaatctcaagatacaaaagggtgataattttcttacacctaggaattttaattttaatttacaacatgtatacttatcgctttgaaattgtatgcctgccggagacctgtgcaactaggggcaaattgtcaaattgtagaatttaagtgtttgtcaattgcaaaatttctttaaaaagttatattgttcctgttgcaacgcacaggcacccagctagcatacatatatgtcgagagaacgttttggttctaggatctatatacatattatatattatacatattatacatgggtaacaatctagcatgctactcaaaggacgaagcttttgaacattggggtttccaagctcaaggttcttctgcttgtaaaatcaaatgtgtttttgattattattatgtgatgaacaattggcattggagattattggttttgatatttggaatttatttgcgaagtggttttggagataattggatttcacatgtgatctacaggatactgttggatttgggtccggtcagaccgggctgtgtatgccggtcagaccggcggtgatcgagcggtcagaccggccagtccacggtctgaccggccgactatgtgtcggtttcggtttcgggttgtttatttggatatccgtgattgtgtcattgttatgacttctagatagatactatgcgtatgtaatactgttgtttgctactaataagttaagttggggatagcttggtctcggaatatggtttctttgtttgttctatgtgtaggtgactcgagatgccggaagagtatttgcggtgatggaccgggagtcggcttggggataagacgacgtccgtggtggtcagagatcatgcgggatactaaggctagagttcaatgcacgtggttgataaagattccatatggcatacgatggaggtattgtgttcgtatgagatacggagtcgaatttggaaggagtccaaatttggtatgattggttatgtatagtttgtttcttgtactagagggtttcctagggtgattaggacttctagtatgagtttggttcgtggctttaggctgcctaccttgggtataaatagagagggagcgtgaggcttctcggtatcgcttttgagaacaattgagttgatagttgagttagggtttcgagtttagtcgaaatttttgtaaggagttctgttggtgcactttgtaaacacagagagaatcaataaagtcgtcatccactttaagagttcttcgatttgtgtttcatcgggtctcggcggtctaaccggctacacaccggtggtcagaccggcgactgctacagggagcggtaggtgatctcggcggttcgaccgatcaatctacatcggtcagaccgatgttcatcaggcggtcggaccggcacaacatcttcggtcagaccacgatccgtcgaatttgacggtaacttttatttccgctaaaagttttggttttttggtataccaaccattcacctccccccctctggttggcttagttgttgtgattcgatcctacactactaatcaatgctttaaactccattgcaaaaagtagcaccactacatatcatgcatattttcttaatttaaaataccccacaaaagttattcgttttttatttttccgtgtgtcatcctagaacatgaacaacaacaagaaaagtttactctcacccgttgtaattacatgcattttgctagttacctattataaaaattaaggatgattatgcaatggacactgctgtctgatgatctgatgcagagaggaggagttggtttggacgttcatccgccatgatagatcatactactacatggttatgctgctcttttctttgcttcattgcatgcatgcttcatccggcatcaggatacacaaaggtgcaccaaagcttacaaaagtcagaatcgacttggcaggattgctatactgtgctagagtatgtagctacagctacagaattacagagtatatgcactgtagagtttacaatgctttcgacattcttaattaattggccaacgatttattaacttgcatgtgttaccattttatatattttaggaattatatggtttttgctctgttatgttttttggcacacatctcggcatctgtatgtctcttgtagtcatagaatcataaagtcacaaaatcgtatggcaatagagatttcgataacctttttattattgcaaacttagtaatctatacaacgtaattttatttcaaatcggtaataatatcttcgatgtaatcatacatgggactggatttaacatctacaattaaaattgccattgtcatttttacccgttgcaatgcatgggtaatatgctagttagaccaaaaagtataatattgctgagccatgatttttgcggaacagggaagacaccctactccatttttttttcatttaggaaatacggaaaataatagtcttacatccaacacataatcatggttcaaattagataagtagcaaactaagcttagcaagtcgataaaactaattgcggaacagagtagcacgagctttaagggtacttaggcaatacaaattaatagcacaaataatcgcgcgataattgagtaacataagcacggggaggaattaggttcttgcttcttatgcagagtcgtagcggccggttgtcgagattactgcaggtaagaaacaatcgccctgtccaaaagttcaatagcacacagatataaaacttgaagacacaggcaaatgcatgcatgcatatgcaagaaaaaaaaactgtaagtcctagaatggcacattaattggtactccatatatggcatcgatcgagcatgcaattggacattcgaaaaggatatatatgtacaagcatcagaacgagttcatcaaaagaacagtacaaacatttctttttcataccatgccaattaatttattgaataatattatctagctaggataatattttattgaatattattgaataatattatctaaaatctagctagtgactaggatatggaattaaaaaaagacgtggatattaggatatggaattattgtcgactaagtacttgttgagattatagacatataatgatttaatctattccataaataaatcatgacattacagatgaaaactagcatgaacgcatcattagatctacacatgtaaactacacagtataacatgaacagattaagtatgcgcaacatattgaacacgtaccgaggtgacggaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcagaacgtcgaaggcagaggttccggagacctgctctcccgattgccggtgcacgccggcgagcgggatggagtagtctacgagcgacggcgcagtacagagtaggaagcaaaccctagattgatttttttttgtatgttgcgtgaagacggcaggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaacgaatccgaatttgcagcaaaacaaaactgcaaaaggaggctgcatctgcgcaagggtgaggagccaatttttcggaccattcgacgcgtacgtcgtgcacgcgcgccgcctgccctgccaggccaggcgaggcgaggcgagcgagcgcgcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttccttcaagaatgctctgcaggacaacatctttgctaattaaagccaacagaactcattaaggcatagccaacctgccttgcagctcacaagagtatatgcatcttcacttggatagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagttctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccgcaggatacccagtatagtgaagtcccaattccacagtacctttcagatagcgcattactcgctcaagcgcacgccagtgatcatctcccggattagaagtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagagtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgttaaatttctcatgccattgcttaggagcttgtttcagaccatacaaagacttcaacaatttgcacactttgccttcttgaccttcaactacaaacccatcaggttgatccatatagatctcctcatccagctctccattaagaaaagttgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattggaaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctaaagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacagcctccgcactcataacctttaccaataaaatatccatgtttagacacgactactttattagactcaaaaaccaacttaaatccgtctc

SEQ ID NO: 72909 - DNA, 1726 bp, Oryza sativa
acggtgtcaaacattttgaaaccgagggagtatatgcgtacgtaactccaggtataacatgctgctcttaattcaatcgaggctaagaaaaactcgaatgaaaaatacagccggtcgggagttcgttagtagatcgccacctcagtccatatatgcacgtatgtttgcatgctccggttgcttggtgatggttgtgatcttgattcagttgtgttgtcagcttttcatgcattgacctggtcagcttgtgatcttgattccagagcttgtacatccgagtcgaacatgagtatctctgacatgcatatgctgcttgatcgggttggtcgaagtcatggtcaacggtcaaagaaagcactcggtgttagagattggcatcgaagatcgaactcgccgagccaagattgatcttcccggctagtttgtattcaagtccatgtcgtcctgcttcaaacggataattgactctcgccggaaaatttaatattgaaaagaaaagacaccgatggataggagttgatctgttgcacggtggcgacaaaagttgaattgacgacaacgattccttcgacgaacagtgagattgcattgcatgcttggttgtagaggcttctggtcttgctgatcaaggaaaagaactcggcggcgacactgattagatccatcgccgagattaatcttccatgtacttagctggcacaccccttaaccattcggccaaagcgttgcggagtaggctcacggccagttggctgcacatcgacgccaccaatccatgagccggtgatattggagattaaatcattgaatctcgccgagactgatcttcacgactggattgaatccgagaagggaagaacgagtttggagaatccaatgacgtcggagattggttccatcacaatcgttgatgaggaactcgacgcgacccctacctggcgcgccaactgtcgaaacatgaattcggcaataataaaagggggtaacgcacgagacctaaaagtggatggatgctgagacaaaggatttagacaggttcaggccctctcaatgagaggtaataccctactcctgtttggggatttgaatctgccgggtgtattatagatctgacgatcatatgtgctcatgccccctagagggcctcctgcctgtcgcgaccgagaaaattgccttttcccgaacgctaatgtattaatccccgtcccaggaaaagccggggtacaccacacaaacatgatataaaagacacatctttattatatcgataatatttacattattacaaaggcacctcaggcctgacaaacaaaaataaacagcagcggacttgcgggcctacggctccatcttcacaggcgctcaactggggtataagccaggactccacctaagacttcttctcccaagcttctcttactgaaggggggaaagattgagcaagaatgagtacacccacagtactcagcaagtcacaccggcagatgcatgattaatgcagggggtacaaggggttaataataagggttaagttttgcagtaaacagcatttaaaagtcacttagttgcccaaagccattttaaaaagacgatcctagagctacacagtattattaatcaaggtcgtgaaccctcacgaatttgccttaacccagggcctacgatgattcagaccgaactgggcaaccgaccctgggtcccaactgttcccaagccaacccaggcc

SEQ ID NO: 72910 - DNA, 15728 bp, Oryza sativa
aaaaagtcaacggtgtcaaacatttcgaaacggatggagtatttatcaaggatcaacacttcacctgacagtatttaccattaccaggtttatcgttctaattttcttataaaaattagattaatcttggtatttttctagtcttctaattgacagatcactaatgttgtttgatctgttatgcacgtacatctgttgcatccgccgttacggttggtgtactccaccgccattgttaatggtgtcattgacttcaccgccggttcgccttcatcgccgtcgagtgatgttttcgcctacacggatggttagtcacaccaccgttgttgggcatctacgtcttcactgccggcctgcctccgtcgccgccgactggtgttttcgcctgcacggctgacctattatgccgccgctgttgggcatctacaacttcactgactggctgcctcatcgccgccgaccggtgcttttgcctatacggtttgatggtcacatcaacgttgttgggcatctacgtcttcaccgaccagctacctcgtccgtcacgccgactggtgttttcgcctacacggctggcctattatgccgccgttgttaggcgtctatgacttcaccgccggcctgcctccctcgccgccgactggtgttttcgcctatacggttggttggtcacaccaccattcataggcgtccacattttcaccgccgaccgcctaggctgcctccacggctggtgttttcattgccattgatggatgactttgttcccacatcagtcacctctatcatcaccgcgggaaataccaaaaagctaagtcatcattaattttctttatatgatattttccttttcctctgcctcactacatcaactggttcgccgttgactagtgagtcgggggctacagatgttatatcatatttttttaacaattttcatttatctttattgcttgcgacataatctgagtacaaaagtgcctatcgagttatggagttccatcttcctatgctttccgtttggtttgccaatggatagttgcctttgggccgattcctagcactcgggggctcgttggatggaccgagtaacgcaaggtgctaagtattattcggaataaatcaaaagcatagagataagataaatttactttcttctccacaattgcaaaagtacccgagtagtaaattctgattcgtgaaactttgttccattaatgacgaactcatgtcactcatatgcatgtttgggaggtgcctaggccgactcccgatgcttgggggctatgactagtcggacagagtgtttaaatgtacggagtcatctgttcggggaaatcaaaattggcaagaggagaaatacatatttataaatttttaaaatacttgaatttttctcgagtattatattaacatcagatactactcatcctatatgtttgttctgcaggatccatatctaaatatgcataaaagggattcatggctttaagcttatctcttacgctccaggaatggatcagtcagaacatcaccgactggcttgcctccgccgccgccgactggtgtctccgcctgcacgactggcctattatgccgttgttgttgggcgtctacatcttcaccgaccggcttgcctccgctgccgccgactggtgtcttcgcctgcatgactggcctattataccgccgttgttgggcatctacgtcttcaccgaccgacttgcttccgctgccgctgactggtgtctttgcctgcacggctagcctattatgccgccgttgttgggcgtctacgtcttcaccgccgtcttgccttcgtcgccgccgactggtgtttccgcctgcacggctggcctattatgccgccgttgttgggcgtctacatcttcaccgaccggcttgcctccgctgccgccgactggtgtctccgcctgcacggctggcctattatgccgccgttgttgggcgtctacgtcttcaccgctggcttgcctccgccgctgccgactggtgtctccgcctgcacggctggcctattatgccgccgtgtctccgcctgcacggctggcttattatgccgccgttgttggacatctacatcttcaccgatcggccgcctcgtatgacgccagctggtgctatcgtcttcacggctggccacgttgccgccactacaaataggcgtcatcaccttcaacgcaagctgtctacgtctgctgccgactggtttcttcacttcgatggctgcatgattctgccagtgttgattggacttatcgtcttcatcgccggtcgtctcgtctgctgctgactagtgccctcgcctctacgtctggtttataccgctaccactactgatggacatcatcgtcttctatcgtcgactggttatgccgccgccgactggtgcttttatcttcacagctgcgcgtcttcgctaccggtttgcttttgttgccgccaactcgtgttcacttcatcacggcaatgcaactttgtcatcatggtggagcgacttcatctttattatcttcggcaccggcaaactctattgctgctacttcgcaagttttgctacttcaccaaccacgacgtctttgtgaacctcaacatctcggcatgcgatgccgtgttattttactagaacaagtggctctccaatattcaggatttctacttggtcatcttcaacacatatcttcaatcaagcaatgactactcgacgacaagaagctataattctcgactctatattcagttgtttctcaactaaccaaagagtcgggggctacacaaatacaagactcaaaatttgacagatgctatgtcaacatgaagcaatcaattaatcagccaaggagttctatggaatctactttgggagtcatcagcttcgtcctcgctccaaagcaggcgttctacttcagcaatctcaattattttaccggcaattttggcttcttagcgctgccataatctactcaaaaaatgtcaagtatcaagttcaagatttaatctacatgttcgggagcttagagttatcaactaatcagctcagtttcgacgagttggacaacaacatctactttcttctaaatgaagcatctgcaatagctacaagaccaagttctactgctatcgtcataaatcaagaggcgttgcattaatctcaattatgcacacgctaacatcaagaaaactatttgagcttcgccatcttctcaacaatttgaaggattattgtcactgacatcatcatcaacacccctacttcatcggccctgacgtctccgccgttgctaaggggtgactacgtcttcggttgcttttgtcgtcaccaactttcatcgtcgacttgttatttcgtcttcacggttgacctactatgcaaacactgatgagcgtcttcgtcattatcatcggttgctacatcgctattgcctggatcaccgacatcgtcatcttcatcaacatcctgtcaaatctcttcaacatagcccactctactgctattaatgggcaacttcgtcatcatagccggctatctctattgccgctaatcatcattaccatcggatgcgtttgtcatcgctgactattttcttcatcttcatgattgatggatttcgccattgccattgatgagcatctatgttttcaccactggcttgcctctgccaccgcccatggtgtcttcgctttcacggttggcttattatgcctctactgatgggcgtctttgttttcttcaccgagcgccttatctgttatcgactgattatttcactgccacggctacataactttatcgttgggcgccttcatcttcactgatggctgacctgactgctgccgactggtttcttcgcctccacggctgtgcaacttcatcacttttgactgatatcactatcttcactaccaccaatatttttgccacctctgatggacaatattatttctatattggtcgtcttgtctatatgccaactacgtcagctaccatcaatggacaattatgactacgacagaaggacaagctatatgctcaggggcttactagctcaaacacaagtatcataccatcaatttggacttgttccggatacatgcaacatgaattcatgaccatgggcctattttctacgctcaaagactggactatttattattccccgtaagggttatcaaccgaatacttgtgccagtcgggattcacttattatatctatttgggagtatcccataagggataatcactcagatcagaagctattcatatgagctacacttggtctatatcacctggaagatttattactcggaagcatgttacatgcgtcatcctttaaagggtgtcgaaggcatattttttggcctatgcctaatatgtctgcagcccatattttcaggtgtggcctgtcacgttcttttagggacttaggcactttttgcttaggccaaagtacgcgtgatcaagtgcccaataccttaaaatccttttatatcgcagttactcaactttttaggagttggtacaatgcatcttaaaaggtgttaaatagtaaagctttatatagctgccccgctgacttttttatataagtcaaggtgatgtttgggtttttaagcaattgattggatacaatatcgttgctttttgccacgtaagtgtgcacttttattgaccaatattatggcttaggctgattatatattgtggtcattttccaggcggttggtaaatcctttatgagtttatttactcggatgttacaccacatatgccatatattttcaggtgtggtgaaaccatgtgtcttttagggacttaagcacatctgttaaagcagtgtacgcatgacgtatgcccaatactttggaaaattctttattcacagcatacaaggttctttatagctatttttgctatgtgatttttcaatgatgtagtcaactttaggttgtacgcatcttgttttacaaagcagtcagtatatcacttggattatattattcgaggattcacaccgcatatgctacatattaatatcaagtcgcttggttgactacaattatcgaaaccactcggttggttggattattttccttgactatatgcttggtttgttcaattgaccacatagttggggggctacacctattaggtgcatctagtcgatgcacctgactttatttttcagccctccacagtcttcagatttggtaaaagtactcgggagaccatagcaacgatgattgaagcactcggctttggagtaatctagttcgagagaagattatcttttcgactatgaaggtcttaggggctactgtggagattatgggtaccccatacccacacggcatggttatccgactagtcataggggatagcttatatctatggaatatgtaacaaatcatgacttgggtattacgtttccttttatattatggagcagcctaaagtcctgatttgataatattgtaaaatagatttaggaaaccgataccgtattggttaaggtttctatcttgtaattctgccccccatcctatataaggtgggtaggaggccctgtagggggcatgagcacatatgatcgtcagatctataatacacccggcggattcaaatccccaaacaggagcagagtattacctctcattgagagggcctgaacctatctaaatcctttgtctccgcatccatctacttttaggtctcgtgcgttacccccttttattattgccgaattcatgtttcgacggtgaagtaattttgattgatgtactttgaagattgcatgaatgaagaaaatgattcagtttatgattcaacaattccttttatcacaatatttcattaatgctctgctttatgtacaaactatatcaaaaataatatttatgttagttctgctctcatgtgttaattccaaactattaaatttatcgatcgattgagtcgatgtcgccgccgtgtttcaatttgtgtgcactttgctgctgccgccaccgccgtcggccgtgctgctgtgcaatgccgcttctttgccgtgttagtgcgtgcgttctagtaatacgttacgtcgatctgccgccgtctctatttcatgtgatgtgttcgtctccacctgcatgcgtgggtcgcggctcgcgatcgccggcatccttccgtgcacacgaccggcggcatccttctgcgtgcgagattagcgatagccagttaattagtttcatgcggttttgaaggaagatgtgctccaagatttgtgcacgctagggggcaatatctccataggggtgccatgcaagctttgtggcatggggtgccatacaatttttttccagggcgctgccgccgcctgccgcctgccgcctcctccccgtggggagggtgccaccgcctcccctcccgccagatctggctgaggggaaggcgccgccatcaccgctaggccgagaaagaggagtgcgcgtgcgtgagagaaagaggaatgtgcgaaatagagagcgagagatagagatagagatagagatagacagagagaggagagagtggagtgcgagagagagagcgagagactctcggtcttatctacgcgagagagaggggcaccgagccctctcagccttatccgctcaagaccatcggtctgctctgttttttagtgccgaattttaaaaaccgagtgtcggttttaataaagtaaattaatggtgttagtttttgttaaaaaaaggcacttatagtctattaaaagtgccagtttttgtattttcaacctgcagatatgagaaatggtctataagtgctggttttatcacttgtggcacctaatgtcgatctctatatatctttttatagtagtgtgatcaaaacatatacgtatgattttgttactatataaatagtctaacagcataagcatattagaatacttttatgatttaaatgtaatagttgcctaaatgtttttacataaattttgctttctattagaagaagcaaaataggagagataaatagataatagaatgaaaagagaagaatggaaataggagcgtacagagttgttacgtatatacgtgcatccgtacacattgagtggggcccaaattggaggtagattaggatgagtggattacttatttttttctacgtctaatctaatggtcgaaaaggatgcacccatcaatttaaatgaaaatcaagggttagatgttttttgccacgtggcagcttagtagcgtttgtagagtgtcatgtgacgacataggagcgtttgtaggaagttaatgaacttttagtatatcctccctctgtttctaaatatttgacgccgttgacttttttaaatatatttagatgttcgtcttattaaaaaaatttaagtaattattaactctttttatatcatttgattcattattaaatatacttatatgtatacacatagttttacatatttcacaaaagttttttttaataagacgaacggtcaaacatgtgctaaaaagtcaacggtgtcaaatatttagaaatggagggagtaatagatatttttaatataaataaatctttatttaaaaaattactccacaaatttatttttcctcttttttgaacgagctgaccatcaggagacgcttgtgggccatcttttccatgctccattttcatcgttttctattgtccgagtatgcacttgcaacctgcaagcaattttttgtctgtttcggtgggtgcctccgtggaggccaaataatccacgattttaagacttgttcataaatactccgtatctagtgccaaaaatagctggggctggtgatttgcacatgtatacatctggacaggggaccttgttagggaaggttggtgccgtacgcagacaccgtcattatcacgattaggatcgagattttcaacgtcctctcctaattactatagtgcacatggatgctaaggcatgcaattgatgtgacgtgatagtgtaattatacaatcattgagacctgcaacgcgcacattgaatacaaatatatgaacgcaaaatggatatctaaaaagaaaaagcctaccgaaagcaagtatccaaaatggcatccattttgattcgattcgaagtcagtaatagaaacggacaaggttagataatggtaaaaggtcactagttacaaactacacagcaaaattcgcgatgagaaacgcgtacacaagcgctgacaaaatgaatacaatggcatggtaacgaccaagccaaactaaaccctatctcgctaatccaatcaattaatcagcatacattgttatgttacatagaaaaccctcatttgtggggtttacacactcaaatttccagcgagcgatgcagcacaccgccattcatcccaaggcaggtatgctgcatgctgctctcctcccaaaaccggcaaactctattgcccattgcaccactcgcagatcaatctatcccaagacaaccgaaacgagattgattgatttcttttgcctccactccactccacaggttccacggccgtgcatgtgtggtacaaacacttttcgtacatgcgaaaaaacactttacaatgtggagctgtttagcgtaagccatacttaaaaagtagtaagccttttgcgtggtgccaaaatatgtcatgagtcatgtgagccttggactatcaaatttatgcgcttgccgctatcgatgcggaggccatcactttttaggcccaactgaaaaagaaccgatgaattggttggaaactgattcccagagtaaaacaatcgagagatggaactcagttgatatgaacgtgtacctccacctgattgctatcaacagaaaaccatctcaagagaacaccgaggtggaccaccgcgggtatcattttgaatagaaggggtgttgttacctgcaatggtacacacgcacgacataaggtaaacgcatcatgaccacaacaatgtcacaaaggtttggtgatcatgctctcatttgagccgctccttcaaatgtttgctgagtatcatttacagtgagaacagaatatagcttaaaaagaaatgaagcgtataggtgcataccagactgagtgcagtggttccaagaagaagcagataaagtttgccctgaagaaaagcaattcagctatcagatgaaagtacacgcacctcagtgctcacaagacaacatatattatcataacagaacagttaaactattgactactccaaaagcaagctagagcaaaattagtcagaagctagctagaactgagtgtaaccatgagagtataaaacaacattgacaggcaggaagctttggagcaacacatgataggaacaaaatatggagaaataacctcaatcagatggatgcttgaagcacggcttagaagaacaaaagcaaactctcctatttgtgcaagagacatgccaacctacaaggaaaataacatgagatcagtgtaactgcatgagcaataacagaagggagcacatgtaaagcaatcaagacttacaagaagagatgttttgttgctatagccaaaccctttaacgacaacagcaacaataaacgtctttacagttatcaccaaaatcacagctgcaaggagtatatcgacatggttccaaaggaaatggacattaattagcatcccaatgctggcaaggaaaagagcagcgaagaagtttcgaataggttcaatctgcagaaacaacaaacctgaaataagagaacatataatgaatcattaactacatgaatctagctaaaactttgactaaagcagtaaaagaaacataaaacaaaaaaaaagtgcattgtcattcaaattgtcacagaactgacaaacttcacccaaaaaaaaaagcatataatttcacggcaaggaattacttgttcaagtgtgtgttgtgcaagatcagttgttgatatcattactccagctgcgaacgaacccaactcaagactcaagcccaacttatcactgcactgcatcatagaaggccgcacatgagtaaacataagttttaggataccgatagaagagagcaaatagaactgttaaaaggataaacataactacattttcttgcaagaaaactgtgcatgagccataacagtaaagaaagagttgctgaaaactgaagagcaaaacttacaaagattagtgcagaaacttggaacagaagaaagatagaggcaaagcactagagtctgcactacacattcactataatacatgctataaatcaatctagaatagtgtaaaagatcaagtttagcaaaattgttactttcacaatttttctttgaataaatttaatgtttagcatcctttaccggatccagttagagtgtcacaacttttggccaggtttagtacatgtaacagttatctgcactactccagtcatccagtgtttaaagaaaaatagtttcccattactgaacaattgcattcgatactaacatacgagcagttaaagaaactcacccaagcaaacaacaagcagaatgcaacagctgccaactggtacagttcatttgtctgcaagaaatgcagaaatgttaatgtaggataacatgatgatctgaaccagaactaaattaaatgcaaattaaatgctcaacaaaactattcatgtagtgcctgtcgattatattcacctgagatgaaagacttatcatcagcttaagaaaccaaggcacaccagttcgggagaggatggaaaggattgtaaggaatgttatcaataccaccaacctgagaatgtcagaaattgtgacaaaagaatttaatccaacacctgattatattatggaacaactttcacagacaataggaagttcaaatatacataggacaacatgatgtcattatcaagatataaggcaataaacttttgtgctgtcatgatgtaaaggcaggtagcactgctattttaagtaccaccatttagacattgatgtggcatgaatttactgcaggagacatgattctagtgtacagattattgtagtggtaaaaaattatatgtaaataaaagtttcaagccaaaaacacactacacttacgacttggccattgatgcaactccttgaagaagaccagaagcgccactcagaattggaagaagtgcaaaaagaagaccaacagcacagtcctgagacaaaggaatgtcaaatcaccaatacaaggaaagtagtgaagctcagataaagaaagaataatcagtccactcgttcgattcttaagaagaagcaagcaaaacgtgcaactttacgaattcatctccccaaacaactcaacaaatttagaagatggtatccatttctttcatacctgcaatatgagtgtgccaaccgtaacttggccatgaagggcattgatgctatttctttccatcagaaatttcaaaacctacatagaaaatattttcccagaaaagttaagcaaaggagatggaaatgggatttacaacacgaacataaccatattgcaagttatacgacattcaggaaacagttggcacatgagtcaagcaccatctacgaggtaacaacgtgctaaattgaaaaccatttggcatctatcgtctatgaaaggggtaatggttccactacgaaccaagacgaacaagttgatttacaacaaaagctgcttgagaggatgtgtagcaaaacactaaaagataagagtggcattccacggtggagtgaaatgaggagttaattagcaacacaaaagggtcatctccactgtctctgcacatcagaaaggagaacagaattgttgtgcataaaccactggaggaactgaaccaagcacagtgttttccggattaaaacccatgaaactcaacgtcacaaaaaaaattgagtcccagtcagattgtgcaaccaagtccttgattgtggcagagttggcagaggcaagactaatagataaggaaccaccggctctgcccaatggtcgtcaccaacacaatcagagctcccaccaacaaattgggcaccctgccacaaaaattagagctcttgatgatgaattaactatcaagttccttgccatattaacctctcgctgccaagaagagctcctctctccctgccgctaaatcatctcccgtttgcagttcctcttctcctcctactgccaggtcctgcatacttcaagttccaactgcccaatctactcaattttggcaccaaaacagtagatgtggctagctttttgtggagggtgggggaaccgagagagggaggcagaagcactcctgacaacggacactgggagagaaaaaatcaaaccgaacaaaacaactgcatgccccaaatttccttgtttggttcaatatatcctgatgatggcctgattactaagtagtatcaataagattatcgataacactgtcataaaacacatgcgagagagaatggacatattgctatttaaagagacaaagaacagtaaacggctcaaggactacgcacattgaagcaactaaaagccattgatgttataaatcataagcggacctgtagggtccattgtaaacttggatgaaaggcaatcgaatgcacagatatgcaagttcaaagatttagaaattaccacagccgttgaagacatagaaagaagaacaccaacaaaaacaccttcttttgttttgcctccacatagctgcaatgtgatattaaatataaacaaaaattaaaagagctgtaagacgtgttttttaatcctaatccataatccagagcaacatataacagggtgtacagtacttatgcttgaaaatggaaacatcaaaacatggttatttaaattacaacaatgaaacataccgtagcagaaataccacaaagcaacatgaacaggatgatttggagcaatcctccaacaacagcaaccgcacgaacaactcgaagctgagacaatggggaaacacctcatgttgttattatgtcaagtccatgcttgcataagtgcaaatatataaaaaaatcaaagatgtatacttttgctgtagaaaattcaagtcccagagcaaacagcagaaatatcacaccaaactgagctactgtttcaacctgtatggtaaagtatgagtcataaacacacaaattatatacaagtagatatatgcattacactcagtctttttacatgtagatttattgattgcattacaatttctacagtgtctgaaagccaaaataagcaggaaacacgaatgtgtataccagtaaagaagataacaatggtaagttggcaggacagaaatggtccaagaaaaaacagatgagcaacaattgagatatatacacataaaaaaaagaaatgtgcacagataaataaatatttgcaatgttacgagaagcatgatgtttttctagtcaaatgccagagggaatttctcgagcatacagctcgaaaatcaattgaagtaaacttaggcatttaaactagaaccttgatcttttacatggatgggatttggtttcttcaataagtccaaagttaatggcctcactgttatttatgtgaagttcactaaccactacacatgtattgtacgaatacagttaccaatttcagacaatgcaaaacatatctcattatatggcttcatctcaaaacaattccaggttaccatgccattttccagcaattagatgaagcgaatcttaattttcatgtacatctctatctaacaactgatagtgaaagaaacagagtgttcccatgaacttgtagggtgtgaagatagaaatgtaaaagcacttaagcggtatatatttctctccatgtgcacaacaaattgccaatagaaaaacaattacgatttagctgatagctgaagaagtcaaacaattgagcaaaagcacaaacatattttgagaaaagcaaccaacaaaggaaaaagcaccttacttgcaccatttcactgacaaagctaaaacctcctggtccaattatagatcctgcaagtaaataacctgtaatcacctgcaatatattttagagttgtagccttaggtggcttaatataaaaccacaacactcaaatagccacaagaataaatgccttgtacaagtaatgagaggaagaatgtatagcactcacaggttgcccaaggcaagcaaaggcaattccaccaaatgtagcagacacaataacaacgacaagatccgatatcaatctacaatagttcacaatcaacaaataagttaatacttaaggatactttatgaatattcaacatcagaattggataacatacctaaggtccagttgcagcacagggtattttgacttcggatttgatataataaaaacattatcctggatttgcaattgtgtcaattcaggacagtaaatcagaagataagaactggcacgttgtgcacaagtggtagctttaaagtcaaataaatccttcaaccaattgcagtgcttgtaccttccgatcaatcaatgtgggaacatcctcttgctctggccgatccaagaaaacttccttaaatgggaatgacctagggggttaagatcatagatttggggggtttaataaagagtaagataaataatataggataaaatcacttaaacaaggaatatcacaaagtcaaattttgatcaataacatacttattgtctttggtctcattcttctttgttactcttctggccacagtttccaggactccctggtaggataaagaacaagatgagcacttctacagagacacatgtgcgatgtatacagtatagccaacaatatttcacaaaaagtaatgaagacattgaaattcagaagaggaatataactagtttaatacaaggaacttcagaagaagaatataactagtttaagtttagtaagatttttcaagcaagtaaatacattaacctaggtacaccataaactaatattagttgtgtttgaaagtttcttagttccaccataaataaatattcattattatctagtctagtacaatgacaagctacaaacatcatccaaggtattgtcgtcagcactaggaaaatgtcaacttaactacaccaggtcaaaatatactgggtcaaaaggcacaaaaactacatagcaacatatgaaagcatcacggggctcatggagtttacagcggtagaaaacctagtggagcattatcaatttagcatgatcagagccagaattaacagttgcatcctcagtttaaacgccaactccatcgaatttaagcatgccaagtaagaaatttctttagaggcacacacccatatcgaaccaattctcactcaaattccaggcacaaataacgatttgaacttccaaaactaaagtcggcaggatccaaatatcccacccgtttccacacgcagcatatgatactaagaaatttaaccagattctaccctcaaatgggaacgaatggctgaaagtaagcaagcaaacacaagtgcgcaaatgaaatcacctgcttctcagccaccgtgttgttgaagctgccggggtccttctctgcaaaaaaccagagccgccgaaacaagtaagcacaaaatggcagtcccaaataatcccaaaatcccccaccgccgcggccacggaggccgagatctcgacgccgccgaccctgaggcgccgagtgggagtaaccagatccccaggcggatcacggggcacccaccc

SEQ ID NO: 72911 - DNA, 14066 bp, Oryza sativa
atcaaccgggactaaagatattttcccgctatttccaaattctttttaaacccggttagggttaagaaccgggactactgataagcgcactgaatattaatttccattacatatgtgtttctaaaatagaaaataatgcattaaaattatttccaaattctaagtcgaaaaattaatgacaattacttcaaaaaattattattgtctgtagtaaattaagtggataaaacgtaataagcaaatatatgatttaaattaataaaaattctaataatcatatatacttagcatatgaatgatattaaattggtaagaaattgtaattaacatatgtatatacatccgacatgcatgatttaaaattaataaaaattctaataatcatatataattagcatatgaatgatattaaattaattgttaaaaactctaattaacatatgtaaatgccacatgcatgatttaaaattaataaaaattcgaataatcatatataattagcatatgaatgatattaaactaattgttaaaaactctaattaacatatgtaaatgccacatgcatgatttaaacttttaaaaattctaattatcgcatataactagcaattacatgatttaaaattgttaaaacctctaataatcgtacgtaattaacatatgccatacatcaattgatttatatggataatcaatacatctaaaatagtttacatcgtgtacacaataattacggcaatacatcggaggtgacggttgaccgcacgtactttctcctcactattgttccctccttgtgatcgctacttgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacgtgacgcttcggctcgtcaggccctctgcccttctttcctttgctagacatgtccttcacgtaaaagacttgcgttacatcattggcaaggacaaaaggttcgtccgagtatccaaccttgttaaggtcaaccgttgtcatcccactgtcatcaatcattacgcctccaccagtaaacctaacccattggcactggaacagagggaccttgagaggaccatagtcaagttcccatatgtcctcgatggtatcgtaattcgtgccagttgttccatcatgtcccatggcatcgatacgaacaacgctgttttggttcatgctcttcatgtcttgggctctcgtgtagaatgtgtacccattgatctcatatccctggaatgtcgcgatcaacccagatggtcccctcgccaggaaggccagttgttggttgatcgtctcgttacccatgagatgttgacgtagccacgcggcgaaagtatcaatgtgatgtcgtgtaatccatgcatcggacttaccgatgtttctggcgcgaactagagccaagtgctcctcgatgtaaggagctaccaatgaagattgttgcagaaccgtgaaatgggctttacggaataaattgttatctaccgtcattattgctttccttccgagagttccctttccccgtagtctcccttcatggcgtgattcaggtaccccgattgggcgaaggtcttcaataaattctacgcaaaattcgatgacctcctctgttccataccccttggcgatgcttgcctctggacgagcacagttacgaacatacttcttcagaacgcccatgtacctctcgaaaggaaacatgttgtgtaggtacacagtcctgagaatactgatctctttgacaaggtgacaaagcagatgcatcattatattgaaaaatgaaggtggaaatatcaactcaaaactgacaagacattgcactacatcattctgaagggcttctaatctatccggattgatgaccttctgcgaaattgcgttcatgaatgcatatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatctagatggtacctttatgctctccaagcattcaaacatactttccttctctgccttgctaagagtgtagctggctggactcaagtaatggcttcctttctcctttagttctgggtgaaggtcgccgcgttgttccatatgctttagatcattacgtgcttccagtgtatctttcgactttccatatacacctaggaagccaagaaggtttacgcaaaggttcttagtgaggtgcatcacatcgattgcgtggcagacgtccaagaattcccaatagggtaactccacaaatatagagttctttttccacatcaccgcgtgaccatcttcgctctctgtaggctggcttccaggcccctttccgaacactactttaaaatctttaaccatagcaaacactgttttcccactacgatatttaggcttcgtacagtggtccgccttatgttcaaagtgcttgcctttcttccgtaccgggtggtttgcagcaaggaatcgacaatgacccatgtacacaaccttcctacaatgcttaagatacgtactttctgtttcatccatacagtgagtgcaagccttataccccttgttggactgaccggaaaggttgctaagtgcaggccaatcgttgatggttacgaacagtagcgctcgtaggttaaactcctcctgtttgtcctcatcccacacggggacaccttcctttttccacaacgggccaagtgctatggccgctgctcatctctccaaaaggattcatgccatccgtacttaaaccaaaccgtatgtttcgtgcgtcctttccaaagtctttaaattttctgtcgatgtttcgccactgcgaaccatcggcgaggtgtctcagcatcccgtcctgttgacgctcttcagcgtgccatcgcatcattctagcattccccttgttcctgaacaaacgccttagccgtggtattatagggaaataccacatcaccttagcaggaattctcttctttgttagctgcccgtcaacttcttctggatcatctcgtctaatcttgtatcgtagtgctttgcaaacaaggcatgcttctaggttctcgtactcctcaccgcgatataggatacaatcattcggacatgcgtgaatcttctgaacttccagtcctagagggcagactatcttcttagcctcgtacgttgtctcaggcaatttgtttccctccggaaggatgttcttgacgagtttcaataaatcgccaaatgcgttgtcactaacaccattttttgccttccattgtaagaactccagagtggtatctaactttttgtgcccctgctcgcaacttgagtacaacgacgttctgtggtcctctaacatcttgtccaatttatgggcccccttttcactttcgcagtcctccttggcgtcctgcaacatctgaccaagatcatccgcaacgtcgttaccatcagcatccctttcctcctcgcccgtttgatttccttcaaatccagcgtactgagcaaagtccggaatattgtcgtcttccacttcatcttctttcatttcaacaccttgctctccgtgggatgtccaaaaattatagcttggcatggaccccgactcaaacaagtggaaatgaatagtcctggatgcagaatactccttctaattcttacacttattgcatggacaacaaataaaacccttatgcctgttagcttcggccactctcaaaaaataataaacgtcgtcaataaactctttggaccgccggtcagcgtacatccattgccgatccatctacatgacatgaaaaaaaatcgtacacaaataattattcttacaataatgatagtcatacaataattataaataattacaaactctttcaacagtcatacaataatgacatatcattattcatacaaaaattataaaatattacaccaaataattcttatttactatttctaaagttttaaactaatattaatgtgttgtacttattttaattttcattttagtttgttttctattatttaagattaactttcactgtattttccttctcaactattttataaaaccttctttagcaaataaactaaatttctatatattctttcttccccacacaaattttctctctcatcaacttacaactaaattttggagacataaaagtgtgcaaaacatagctccaaatgtaatatgacaaaaaaaacattggaggatgaagttgctaaccttttaagcacctccgatttgtatataatcaccaaaataaattcactagaaattttggcatgaccctcttttttgaagaaattttgaagcttgctcgggcagctggaggaggaagaagacatatatataggggtgggacttaagtcccgatgggtgtaatgacttggggtaagtatccaagggggcctaccaagcctacagatttgatttggataagcggttaaaaagggtaacggacatatttgatctttagtcgggcatatttgatctttagtcccggttggtaacaccaaccgggactaaagatcatctttagccccggtttttattgcaaccaggactattgtggatatcggccgaccgacgaaagatggtttctccaccagtggttatgagtcttctgtttggaaagaaaatataaaaaagattatacgacggttcaaaaaaaactcgttattaatacgatgctagataaaccttaggtcagtgtcacgtatacgaagagggtgaaatgcgatgagcctcatcaattttatgcctacaagaataatgcatgtgtatgtgcacacaccacacatcgctataaaataatttattattatctatgatcgattttaggaggtgaattttttctgaaagataattatagggtgttgcgatttcgtataagattatccataatactgacatacttatagtaaatatgggtttttaactgtaaatttatctaacaacataaacttacactaccacagaaacctggataggtgctggttgggaaatccggcacctatgccgagttcccaagcgatacctaggaagcggcacagatgatgaaaatcaaatgtgctagttccaaaaccttgacctttgaggcttcaggaattccaaaaaaaaggatcgagtagcttcccttcaccctgcccagaacacatcgaagaacatccaagaacacttgaacatgaacatcaagaatattcttcccagccactgggaaccatcaaagctactcatccccatcaagaacacaatcacaaaatacacatcaagaacatatagataacacaaaaggctgccgctcaacaccaactccgctgctgccgctcgacaccaccgcccctgccgctgcctcccctccgccggatctagcggagaggagaccgctgggaaaaaaattgtatggcaccccatgccacaaagcatgcgtggcacccctatcaagatcttgccacctggcgtgcacaaatcttggagcactgatctaccttcaaaaccatactagggcaaaaactaattaacaggctatcgctaatctcgcgcgcgcggaaggatggcggcggcgatgcgcgtgacggcgacgcacgggcaggaaagacgacgtgcgtgcaagaaagggcggccgctgccggcaacggcgacgcggacgcacgcagcaacacggcggaaatcgacggagctagcgctgcccagattgatcgcgcggcagaggtgcacgggttgatcgatcatgactcgaggacaaacttcgctgacgatgccatgaaagaccaagccactgcacatcatcagttcggttcagatgatgaggatcttgaagattgcatgaatgaagaaaatgattagtgtgtgagtgtggagattatgggtacgccatacccacatggcatggttatccgactagtcataggggatagcttatatctatggaatatgtaacaaatcatgacttaggtattacgtttccttttatattatggagcggcctaacgtcctgatttgataatattgtaaaatagatttaggaaaccgataccgtattggttacggtttctatcttgtaattctgccaaccatcctatataaggtgggcagtgtcacgtcctgataaattcatcccgaaattaaaaatcattcgctaaaaggaataatagaattaattaaaattcggaaagaaattggcaaacactaaaatacgtacaagaaaaattcgaatgtggcccggagaatttttgttaaattctccttggtctaaaaaggagccctcaaattttacttgaattttcagagcaccggaaatatttattaagcaacaaaaacaattatcagagtttattaaaaagaaaaacctaaaaataatctctctccccccctttgggcagagtctggcccaaagtcctccctctctcccctcggcccgcggccgaagtctccctctcctccctctccttctctccctcctcctcttgggcccctcttcccctcccagcccacttcctcctcctccctctttctcccaggccgcctccccctcctctcctcctgggccggccgcccggcccaagccgcgcccaagccaggccgagccgagccggccgtgcacacgcgcgccgcgcgtgcgctgaccgcgcgtccggccgcgtggggcccgcgcgtcaggcgggtcatcgtcctcctcccgcccggccgtcctctctccctctcccgtgaaccctagcgccattcctccctcaaatccgcgcgattcaagcatgggattcccaaattgattagggggaattaaacccctttccctcctctctctttcccccttaattcccccttgaatggcgcccccaatcgccgggaacggacgcgccaagtccggccgccttcctttgccgccggccgccattcccgtcgccgttccgccctctcccgtgctcggctcgcttccctccgctataaaatgcaaccccctcgctccgttctatcattttagccccctcccgcgatctcccgtggtccctagccctctccccgccgtcctcctctctctcccgtgccgccggccgcctccagccgcctctccctcctcgccggagcgtcgtccggtcgcgccgtcgcctcctccagcatcgcagctgcctccccttccccggcttgccctccgtttcccgcggagacccccggagctgcgttcccgccgtcgcccttccctttcctccgcgtcggccgcctccagccgcctctatctccctgcctgagcgccggtcgacgtcgccaccacctccctcggctccgcgacgccaccctcatccccggcatcacctcctcctcgcccgaatttcgccggaacaccgtcgcccgcgccggcttctccttcctcctcggcggcatctcctccggctgcccctttcgccatgcccgtgcgtcagccggcgctgccgtcccctccctcggcacggtgacgtagccctccacctcgtccacccctcggtttcgcccggaagccgccgcacatcgccgcgaacctctccatccgcctcgccggagttgttcggccgcccgtccctcctcgcccgtgcaccggtcggccacacctccaccacctccggcatcgcagcggcaaggtcgtcctcggcatcgtttcccctccatccaaacccctccgcggtccatcagcgtcgtctccgatcgttctcgtcgtcgacgtcccatcggtcgcccggctcgtcgtctcgcggcgccgcctccgtcgtcggcatcgcagcggcgtggtccgcgccatcctcgcctccgtgcagccactgccggcagccctcatcgcctcctcgccggccccggtcgtcgtcgtcgtcgtcgtcctctcgtcgttcccggtcgtcgtggcgttcgtccctccgtcaggtcgttctcgtccgtctcgtccgcgtccgtcaagtgtgccgctgcagacccgtcatcgtcttcgtcctcggctccgcgtcgtcaagcctcgtgccggccgcgtctcgccttcgtccaaggatcgccgctgaagccgtcccctcgccgttcgtctccgttgtgcccgtctgtctccgccgcgcccgttcgtcgttgtcgttcccacgcctcgtcgcgtggtggtaaggttccctctccctcgctgccccgtcctcgtcctttcggtgtcccccgtacccgttgtgcggttgtcgaccccggtacccgtgtaccggtgtcggtagtcgttcgcttgtgcgtgtggtgaccgtgttagtgtgcccgctcggtagccgcgtggtttccacgtgtgcagcccgtgtggtgtctagtggagtccgtttgtcggccactcgcctcggttgacacacggggtccgcttccgtcgacccgtggaccgtctctgtgtacccggtctaccgcggtcctttaggttgacatgtggggtccgcatgtcaacggcgcagccttcctgtcttttccaggctagcgcttacacctgttttatagttgcaaaacctaattacaataatccgcaaatctccatataacagcattaaacttcggatgatcatatcttggtcatacgagctctgaatcgacccgttcaagtctcctaatgtttgtataacctaaagaaccctgtgctttcttcttatgtattgttattgcttctttttaggcttgtagctttgcttgtgtgcttcgcgtagtcttcgtcgttccggaggttcccgaagcgtggttcgcggccgtcgccgaaggttcggaaggccgttctctctgagcaaggcaagtcacatcatcctttagcatattgaatcccagtttataaaattattttgatttaaattaatgcattatcgtttaattcccgcgttatcactgttttatctagccatgcctatttacctttgttatgaccttatcattgttgttattgttactattaccttgttcaccctagaataaacaaaaccccaactagtgggtactctattcctggttccactagtatgaatttaggtagatgcttcgctgattaataggacaacattaggtggtttttataactttagactttgggaattctcatatcatttggacactatggaatggttggcttatggtggaattggacatacccctctcttcctctttcaaagcccctaaaacctgtttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcaatcctgcctacctgtcccggaggtttcggccgtaggtggggttgggtcggtactcttgtttatggctaggatgggttgggaactatgtcacgtcttccgtccgtataccgtggtggtatgtggcatgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgcttaacaactaaaatgtggaatggttggcctgggttggcttgggacgagctgggacctagggtcgggttgccagttcggtctgaatcatcgtaggccttgggttaaggcaggttcgtgagggttcacgaccttgattaataatactgtgtagctctaggatcgtctttttaaaatggctttgggcaactaagtgacttttaaatgctgtttactgcaaaacttaacccttattattaaccccttgtacccccttgcattaatcatgcatctgccggtgtgacttgctgagtactgtggttgtactcattcttgctcaatctttccccccttcagtaagagaagcttgggagaagaagtcttaggtggagtcctggcttataccccagttgagcgcctgtgaagatggagccgtaggcccgcaagtccgctgctgtttatttttgtttgtcaggcctgaggtgcctttgtaataatgtaaatattatcgatataataaagatgtgtcttttatatcatgtttgtgtggtgtaccccggcttttcctgggacggggattaatacactagcgttcgggaaaaggcaattttctcggtcgcgacaagctggtatcagagccatcttgactgtaggataagccaagtggataaaacctatggacatattttataaatgaaactatttgcgaaagttcctttttcctcctttcccctatgctatttgcaaaatgtttactctttctttcttcttcaaatttcaactagtactagatggtcaggtcagtgaagaagaagacatcgtcagttgtttgccgaagctccggaaggctgcaggatccgctagcgaagtggaggaagcagtgaagccagctgtgaagcaggagtgaagatcttggagaacccgtcgcagaacctaagccaccctatagggtagtgttgttagtcgtgtgttccttgcttgtgtgtgtagcgcgtggtttgcatcggtgggtggtgatgtaaccatgctaggttgtttgcttaatcaacctgcagaataagcaaaacaaacaacacatcaacaaaaagagttagttcctttaaggtcttgtccctagttctggtcgattctttccttgtatgcttcccctctcaacctctaccttgtgacagatggataacactggtaacaaaggctatgggaatgatggatccgatgactcaagaacccaagccaatgggaatgagaaaagcatcaacgaaacctcaccagagctaatccaaattgtggttaaccaaaccaacatgttggcaacagcctttcaactattacagaattggaacaacccagcaggggcaaccaacgttcaagtacctacagtccagcaacagtgcaagttatcagaatttctcaaaactgagcctccaacctttgccattgccgtcgatcctatggaagccagtgattggttgcgcacagtcgagaagaagctagggttgattcagtgcaccgaccaggagcgggttggcttcgcaactcatcagttggttggacaggcttcagagtggtgggatagctacgaagcatcacggccagaaggacataccatcacctggaacgagttttcatctgtattcaagagatcacatgttcccgcaggaatgatcacactaggaaaacgagagtttcgctacctgaagcaaggagatttgaccgtcacagagtacctgcacgagttctatcgtttggctcactatgcaccagaagatgtggaaacggatgaagacaaacaagagaagtttctccaggggttaaaagatgagcttgcagtgcaactactcctagaggattatgaagattttgagaaacttgtggacaaagccatgcaacttgaaaatgagcataatcggatgacgaactgcaagagaaggattgtcaacatcccagtatttctaggtggtaaccaaagacagcgcactgagccacttcagatcaccggatcttctgttgtgcatcaagagttcctgccccaagaagatggacgcaatgcagacaccaacactagcaatactaatgatgatgataccaccaacaaccatggttcttgccccattagtgaccactcgaataaagcgtgcaatgtcagtagcattcaccaagatgtcaacgatagtatcaatgttggaacccagaatgacaaccttagcaatgttgacactgagaaagactccaatggtgatagcaactatggtaccactgatgccaatgttagcaaggatttccaatcaccaattccaactccaagccaaaatgatcgtccccagatggacagctcagtaaagaagacgttgatttgttacaactgcaaagaaccaggtcatttctccagagattgtccacagccgaagcgtaacctgcgccatcactccggccattatgcaagaagaagacaagtcactcgccttgtggtcactggagcaaacgccgtacctgtgaggcctcatgttaatcctaacccatagtagaaacaatgtaccgatgttaagcatcttccctttttgtttaaggtagtgccttgtattcatgtaataagggagacatgtgtgataaaaacaagttctatgaggattattttgcaagatgctgatatgggatcatgcgtataattgtttactgtcaaaggagacctagggtctcattccagaggaactatgttctaacctcgagttaataaccaacctgttgatggaaaagaaaaccaattaaactgtgttggattaaaaagccaaagagacttttgtttggactgagagtttcagatgtgtcctctttggatcaaaggcaacaaccgccagtctagcttttgacgaaccacttgaaggtttctttgaaaggcagcacgctcaagtaccacatcgtcaccagaagcatccacaactctcggagtgaagagtacttagttgacaaaggtcaaaagatgattgatagaagatatcgaaaaagttgcttattaccaggcaaagaagtaggtcgaaaggtgattgataagagaaatcgggaaagaacacatcaaggtcaaaggtgtaaaggaatacgttgaatgctaactgaggacaacatgaagagaatagtgggaagtgaaccaaatgtgaagaaagtgaatccgagttgcttgttcgtgagagctattcccagttatgaaccaagtgatatgttcgaagataatctacagaggtcagattaaaatcgcatctaacaacgaagcctcagatttggcaggataatgattagacaataacaaatccagcagtaaagccatttgggaagacgtcaaagtatatcaagtgggataagttggttctcttgggaagcataattcaaaggcaaagttatcgacccttgcatcaaatagcagaagtagctatcacccagggaccaggaaagctaatatgaggcagttggtggcaagttagaagtaaatgacaagcatgatattctcatgatgacaagcatggtatcctagtaatgacgagctgatctcgacgcataacgtgaaatgggtaacttctatgaggttgacgccaaaaatatgaactatgcgaagttctggaactgaagcaccatcttcaagtgccgcaacccagtcgaagtcagctaaaggttcaaccagggacaagtcaggtgaagagaagattccatctgcaacaagggatcgagccaagcagcctagagtggagaagttttgctaggcaagtttgttataaaagacgcgacggaagaagtcagacaagaagagaagaccgcccaacctatcttcatgctagcctcctcgaatctcggggacgagattcttgtaaggggggtggatttgtcacgtcctgataaattcatcccgaaattaaaaatcattcgctaaaaggaataatagaattaattaaaattcggaaagaaattggcaaacactaaaatacgtacaagaaaaattcgaatgtggcccggagaatttttgttaaattctccttggtctaaaaaggagccctcaaattttacttgaattttcagagcaccggaaatatttattaagcaacaaaaacaattatcagagtttattaaaaagaaaaacctaaataatctccctcccccccctttgggccaagtctggcccaaagtcctccctctctcccctcgggccgcggccgaagtttccctttcctccctttccttttttccctcctcctcttgggccc

SEQ ID NO: 72912 - DNA, 1506 bp, Oryza sativa
cagtggcacaactacaaactgcacaaagtcagggaatcctcattcgtatagggtttattgttgtttttggaaaaagtacgaattaccctcccctgaactgtcgcggtcgtctgaattaccccctgaaccacaaaaccggacattcttcaccccgaacaatgtaaaccggacgaattacctccctcgatccaatccgcggtggttttggtctacgtggcagtccagtcagcaatttatttattaaaaaatatgtgggccccacctatcagtttctctctcctatctctcactctctctcttctcctttagacggcggcggcggaggcaggagcgcggcgagacggcagcggcggcggcgggggcgaaggaggcgaggcggtggcggcatcatgatgctccaacgcatcggcgcccgcatggcgacggcctatctcgcaatggtcgtggcggcgctcatcgaggcgaggtggctccgcgtggcccgcgacgccggcctggtcgaccggccggacgtggcaacggcctgcctcaccatggtcgtggcagcgctcgtcgaggcgaggcggctccgtgcggcccgcgatgccgccgctgcaccccaccgccgctcgtctccttcgccgcaccccgccgccactcgtctcctccgccgcaccccgccgccgctcgccgcctcatcccccgccgctcgcctccaccgccgccgccactccctgttgcccgcctgcctccgtgcgcgtgagtgagagagaatgagagaagacagagaggaatagttggataggagtatgacagatgggtcctatatttttttaataaataaaatactgaatggactgccacgtagaccaaaactaccgcggattgggtcgaggggggtaattcgtctggtttacatagttcggggtgaataatatccggtttggtggttagggggtaattcagatgaccgcgatagttcggggggtaattcgtactctttccttgtttttaatagctgaatgattttgtaatctagggtacaatcgaaaaattaatctattataaagtttaaaacgaatttaattttttaaagaaatttactataatgttttttatgaaaaacatactgtttataaactatagaagcatgtcgtataattaatctattcttcctatatttggattagagctttctgtgccaggaaaggcacaaaagccacatgttttgcatggtatttttaggaaaaatttgctacaggacaattaaaaaacttgtaattggttgtgagatatcgcaaaaagtgatacggctgatggacattacaaaatttgtgtgattagctacaggaaaccagatgcaatattttataatttctaggtcaaaaaaggtgagatttttttcaaaatagcgagattgcccctggcacctctcctctccagctcgctcgcctgtcacggagcgcggctgcctcctgctcccacagcctatctttggctcgtgctcctccacctctcatccccctc

SEQ ID NO: 72913 - DNA, 49506 bp, Oryza sativa
  unsure (1)..(49506): unsure at all n locations
cgcgccaccgggcccccaaccatagcccgccccccgccgccgccgcgccggcctcctccagcagccgcgagcgcgagcgcaagcgcagacagcgcggcgcgttcgcggaccccgccgcggtgaccgcgcccgccgccggggggcagcacgggggcgccgtccagaagctctggggcgacgccgacgaggtcgcgctcctcgccggcgccgccgccttccgcgcgcgcgccggccacgtcccgcgcctcccggacatgggcgcgctcttcgactccatcaggggctccctctccccgcacatcgaccaggccaaggtgtactacaagctgaagcggctcaagggcaagtacctgcacgcggcgcccggcgcgtccgcgggaccgcacgaacgccgcgtgcgcgacctctgcgcgagcgtctggggcgccgacctcgagccccttgctgagggcgacgacgaaagggccgccgccgccgccgccgccgccgccgccgaccagccgcgcactgtcccggacgccgccgccatgctgcctgtgctgactgagatgcttgatgagtactggaagacggatgggcgagcgctgtccagtgtgtccctggcgaaggggttgtcactgctagggacagaggaagcaagattcatcgagggcaagtggaggaggcagcttgattcagagatacaaacgcagatgcggcgacatgatctggccaaggaggtctacgccttgctcatggacgccatcaaggccctcgggccttagctcgggtatgactgtcatctacacgagtaatttatccaaactctgccatttccttccctagtccaacttctcgctggagaattcgttaacgcattgctcgttcgttcaattacagtagaacttatacaatctattactcggcaattgattgttcttgctgactgttggggtattttaccaaaaaggataacacgattgtgtggtctgtcgtctgttcacaaagtagcaaagaagctatttttctccatcagcacaccacagatcgaagtattaagcaattatgcttcccatagcatgatggaagtaacagtcttataatcaggaagcaagcaatatcagcttgattttggtttctgtggtcaaaaaagcctagagaatttcatgtttcatacttgctttacatattctttgcatcaaccttgagcaaagccagaaatcaaccatgccaatcctaaatggctgcaacaccccagtttttatgcactactagtatgtatattgtgtctctgactggatagtttggattttggagatggaatagtagcgtgaaaggagaatttggagatgacacacaataaattatgcataacttcatacacatctaataaccaaatacagcacatgctataagccatatgatgatgatgatctcaattaagttgtcaaaaccaacaaccaagccaacagagtatctttgctaatacttttttccttgaggtgtatcagaaaatgaatttgtgagaggtcacaaacccaggtttttaagctacttcaaataaaactgtttgaatttagaaaaaacttctccaataaagtatgtgattgccaaatcaagtccatggcatagagaattctgccatgtattttcttatgttggtctcttggctttggcaggagtaaacacataagccgtacagttgtccaaaaaaaaaagggtaaaaagagagaagaagaaatgaccccactaagatatggactagcaataattgaccccacagggccacaggatatattttctggctctgctacttggctatctcatgggcacctgaaagaccagatatagatatgtgcacctgaaattttgaattctgcttggttagggaaacaaaattatcagagagatacatctacgaaatattagacacgagctattacatatgagattgatgactaagagataacatatttgaagtaacctatagtgatcgagaattagatgaggaaggtcatatactaattagtggagtagtacataacagggtgttgaaaggaacatttaagtactgagcaccaaggtcctttaataggcatgctgcatgcagctgaatgcttcgtttgacacctatagcaaagttgattattatttcgtctcttcagagcgttagagcactacctcagttttctttttaatggaagaaccggctattgatttttgccagcctcattgccaaactttattaacgatctgatcagctttgtttaacatcatggagacgtgatgcattatatctatatgactatatctacatatatcttcattcataggatgtactgtgtttcccttttttgctgaatttttgttcttatttgatagaattatagaatgtttgatgtttaggcatatctgttgggtatcttttatatagcgaagtacctggtgcttgctgggtataagggtattactgcggtagtcaaatttgttgagctcagcagctcaatgcagcttttctatgtttggtgcactaccgttgaaaagaatcttatcaaacttcattgctctcaggatctcaatttaccttatttgcagtcagtcacattgttcacaaactgaactgacacttaccttgcagtcagtcacattgttcacaaactgaactgacacttaccaacgtccgttttgcaggtacaagatggtggtttagatagagctgggtctgggtacatatatctgcaatgccttttgtattggctggtcgaagcattgtactcggttgatgattgacgaggccagggtacatatatctgcaatgccttttgtattggctggtcgaagcattgtactcggttgatgattgacgaggccagggtacatatatctgcaatgccttttgtattggctggtcgaagcattgtactcggttgatgattgacgaggccaagaatcaagtggaactcattttcgactgtatcaaataatttaggttcataacggttgctttggccgttctcccgtcagatttagatgtgaaaatgatttagtggcttaacctgtttgtaaatcgtatgctaacttctgtatctgtcatattagtgcattttcaagtgtaaggggtcagcatttcgatatttactacatggtgtggtaaaaaacaattaggccatcttggttaatgattacaatgttgaaactatatttgcttatcattcaacttctaaactgattgttcactttgtaaagcttgttccaaacacaatcgctgctcaagaacacccaattcccttagaaaaactagctcagaaagccttattcactccacaagctgttcctgttgcacacaggtcaccaaagagttcgcaagaagcagcatgcttatagcttatgaaaacaacatgcttaggtaaatgaccaaaagaatctgatggcttctcatggacaagattaggctagtgagagctctccagcagggatattccttttcaccaatttctcccatgattcgttggtttcttctatgaccttcagagcatattcctaggagagagaattatacaatcagaatgcaaaaatatcctctatgtttaaatataactgaaggagtccaggcttaccttgcttgtgggtttgttgcccagaccaaatctgtttgcaggcttaccgtctggtatcttgtagtccctgaaccagtctctgatggcagtcaatgttccctgaataggtaatgtaaaatgtcggacaaagcaattgtaaaatatagagggggtgaaaactaactgcattagcaacatttttaaccctgcccatgtaacatattttaaatgcaaaactaatcaaaacttccaagcgaaaaaacctaataacctcagcaaaaaaaaagcttcagggtaatgcagtagtcatttagaaaaggatgtgcgcaactaggaatctaggataataattatggcaagagtaacacatctgtctttttctcatgttatgaataaaaggtaagtttgctaaaatatgttttgcttttaaaaaatgcttagccaaggtcagaattcaaaacagaaaacatttgtcataatctaagggaaaaaaagcctacattctatcaacgagataggcaatgccaatcagtggagaacaaggacaaacactaaaaataaaggcaggcatcagtcataccggaaaatgcttctcaacatcatccacatcattcacaagagatgctttaggatcatccaaagaaatagccacaattttccagtcaagctcaccctcatcaatcattgctaaagctgccaacggttttaccttaagaacatctccaatgttagcacgtctttcaccaatctcaacaacatcaactggaaagaaggccatcagcaagattggtcagagtggctgaagatgatatatgagccatatctaccaaatacaatgacaccgaaatgtttattaccaggatcattatccccaaatgctccttcgacatcggtgtttgcaagagttgggtcctcccatgtttggggaaataatccataattccaattaatgttgtacctgatataccagataattccatgatgggtcatgcacaaagttcataaacagggtcagcaaggacaagatgcacaatgttcatcaacaaggccagtaacagcataaaatcaattgcttgccaacaagcaagtttcacactgcaaggttgataccagctataaggcggaaaaggaacctgtccacaaaatatgtacactaatccttttcaaaaggactgaaatggaagtaacagaacagcctagcattgttttgattaagaaaaattatacagaaccatgactgcaaggttgaacttgaaagcagacgaaattcaaaccttcttgtagcacagttttgatgacaagagcaggtcagctaaatctattatatgataaagagaaggctaacaagagtcaccgcattcgctccaaggtcctagaaaattaccatattaactgaataaaaagagtaagatctacgcagttgtttatcatggtttgtccaaattataaagtgtagattgattgatatagttgtatacaaaataaaattgaatgtatagaaacagaaacaacagttatacataaaatccaactctgctttcgaataaactttagcctagctctgtgcaaaactgtgtggaaatccagctagttcaattaacatcacatctttgtaaagatctgctatatctaagatggccacattataccttgtgtgattccaccgccaaacatgggagaacaaaatgttcttttatggaatcccaaaagtgcacaaggtggtggcagctacagtctgatattgacaaaattcaagcagcccatctttttcacactgaagtaaggtcccacgaaagagcaccacataaaaaacacaatctcctacattatttccccagcccacaacaaatattgtaaagcatgaatttctggtatgaaaagagttgctattctatccttaaagaccaacctatcaacaattgatacaacaattgaaacagaccaattaaactctctaatacaacttcccccattcttaatgaaatttggtcgaccgaatctttcggccgacccggcaaaaaaaaaaaactcactaatacactaaaattattaataaaagaagatgcgacatcctaaacaaacaggataggattaaataaacaaaactcatgcaacaacattaaggatttctagaattctcaaacacgaacaagcatggacacaaaagaaaatgttacatttgcaaactaatcatggcatccacttgtggagtgaagatctcagaaggaattcccagttaaattaaacggccgttatatcctcgatttgcaagtcgctcgtccaattttaacacaaaagacgcaatattttcagcagaaacgaacataaacttagacattcagaatacgaatttcctcagtttctagtccttacgggtagtatcggaggttgcccttcttggtgtcctgcttgatgggggtgaatgactcgtcggtggcgacctccatcttggcgctgctctccttggggatctccacgacgaagtggaacaccccgtcgcctgcgcgcaggggcacgtcgtgccacggcgacaccttgcggcccccgccgtcgacgaggaacacgcggtagtcgagcgtctcgggcaggccctgctccttgggccggagctcggcggtcctgaggagcgcggtggtggcgagcacccggcgctggaaccgcacggccgtggggaggcgggccgtgcgccggagcccgacccccgccagccgcgtgaagcgggtggccgccgtagccgacgccgtcgccgccgtcgccatcgtcgagagctcgccgggggatcgtcggagttggtgcggagtgaacagcggcggcggcggcgggagactggaaagtgggagctagtctctccggatgacgaggcgatgggtacttgcggctcgcgtggtagctagcctgaccaggtgggcccacccccgtgatgtggtcgcagtcgcagacaagtgcggatagatcgcgagtggtgtttgggccgggccagatcacccggttctcttcgtgaaggataaggcccggaccatgtgtgaattactccggcccacctcttgacacgatcactaccaattctggcgatccaaatggggctcccggtggcgatgtacaccgttcgatcgaaaataaacgaccagatggagggtttccctcgggccattgtggagtttttgcagaaaagccctcgtatgatctcgtattaccgttgtgttggcggacggtacagatcggcttggaaggagaaaaagataactctttgcatattagtcctcgtactttgtagaatttaccgttccaactgggaatatgggagaaatttcagtatttatcatccaatacgatgacctttaaggagctgccactcaatacgttggcctttcaaaatttaccaccaggcacgcgaaattctttatttggagccactccgtccgcctgccccgccgtccatccgcgcgactgtctccgagctaggtggcgtcgtcgcccaggcacggtcatcgtcacctcgcatcccgcccccgccgccgtccccatccccaagctcgttcggcaccgtcgccaccgccgttcccaacctccatcgccaccattcccatccccaagctcgttcagcgctgttgctatgctcgcgccctatcgccgccgtccctgagctcgtctgccactgtcgtcgagctcgcattccgttccgccgttgccgccatgcctgagctcgcgtccggtcgccgccgtagtcacccccaagctcgcgttctgttgccgccgtcgtcgccccagagctcacgttccgctgtcgccgccgtcgcccccgagctttccgctgttgccgccatgcccaagctctcatccgatcattgtcgccgtcgcccctgagttcgtgttctgctgttgaaccgccatgtccgcaaactccgtccccgtctaccatctagacgtcgacaaaaccatgtgctctttcgtccctgtcgaaggtgcaatgtctctcgctggcaaccgcgacgggagtgagctcagggatgatggtcaagccttgagacgacggccgacgagctcggagacgaagacaaagacggacgacgcggacaagcagacggaatggcacgaaatgaagaatttcgcgtgtctggtggtagatcttgaaaggccaacgtattgggtggcaattctttaaaggttatcgtattggatggttaatactgaaatttctcgggaatatggggatcggagaagccgcaactcgcagccaaagccttgccggcgacggcgatgcaggagatgcaagcgccgccgccgccgccgattcttcttttggcgcctcaggtacccaaaaatataatcctgtttttttttctactgcttatccaaattgctcctctgttgcttaattacctacttgtattcgtgcaatcgtgcttgccttctctgggatctaaattattactagccctattctagttcttatgatgttttcgaggttggatttgaactgatttagaagaattattatagaatagaatgatgcctccatagaatgggtagatttccaaccatggtggaagatggaggaactaatgtacctcactcagatggcaaaacatcgtggatttgtggctacttgctaaagcagaagggcgttttggtgtcactgtcagtgtcaccagagccaattggaatggacccctagctggcaaggacgcatcgtgttcttcatgtgtccatcaatgtccggccaccgtaagatcggatcttgtgagttggtgattgcctttcgctgtttcgcaagcatgtagagagcttggatgtgcgccgcagagggaggcttgtctgaaacttgtgtagggcatggtcagcatgtaggtcttccctatgaagaagatggtaagcagctaggccagtctattccatgtcccaattactatgccaaacgacttccagatgatagaggggaagcacatgatgagaccttttctgtgtctgtttgacatggcatgattggtttcttgggaaatgcttgatatggttaccagcaatcatttatcatcctattttcagctgaacagttagcaacaaaaccaactttttaagcgcagtaggtggactggcaaaatcagtctttagtttgatatgtgcttgatcagaacatgtgaacgacttattaagtacttttcttaggctgcgttcgtttggagaataaagggagtgagtttgtttcatattccgcgcgcacacttcccgaactactaaaccttttgttttttgtaaaaattttctataggaaagttgctttaaaaaatcatattaatctattttttaagtttaaaatagttaataatcaattaatcacacgctaagggctcacctcgttttgcgtatcttcccaatcttctctatctcattctcctcaaacacagccttagagaggtttcagctggaacatgaatacatgatttgtgatttatttatttttattttttttggcagtttgattggtgtttccctaaagaagcttctgcattatactactgaatcgcttggaatatctttatgatttcaaataatgaggctccttgatctctccacctgaaattctgtagaactggatttccttgacgaaaaagggccccatctgctggcctcagtggcctggggacaaaacttgacgctgaaaatctttatgcctaaactgtaatattgattaatgaatattacagcccatagtcttttttttttcttttttgaagattgtcatagtctcaactaaaaatacaacaatgatattctgaacttattcacatgcaacttcgtaccatttttttgtaagtaatacagaactgatgcttaattatgatgatggcatcttatctagactgtactgtacaattacaatgatgaaacagacagataatagtagatgacatcatgggctaagtctcaatttatgattttttgagattctatactagtggatagcttcactcccataatattgttctagtactttgttcaaaaagatgaaatactataaatattaccttttttaatctttttgcagtatggtttccactatcaaccgactcttgaagaattttggcaaagtgcattagtctcggtgctggttgactctgaagtcaggaaattgtttttcggagcaatcagcgaagaaaatttggagtagtatttttcttaactctaatgcctaatcagtaagagaatataaattgcgacaacagagtatcaactataactaaataagccactaaattgaactattgcttttttttaaaaaaaaataaacagttgggatgtattagtaaatttcaaagtgtgcagccttctgaactgaaaatattagagagctgatttcaggtaaagaaccaaacctgatgtactttatcattcatttataaattacaataatgaattaagcagcgtatctgcttagataagctaattgtatgtccaacggataagatgcagcaaagaaggatgaatccttttctcctttccaacaaaaggggcattttcgtgaaggcaaagcaaacgcagatattctagaacgcatgatagaagtggccaagaactcgaaatgtgcaagaatgtacgcaatagcttaatctaatatagcatctcaaaagcctcaaatcattgctgcaaatgacatcaccttctgcatgtaagcattggatttcaattgaatatttgttggctctctgttaacctcatgtgacaaggttagcattaacccttttcttttgcaagaatgaaggttaacaacagcattacctccattaaacattctaatatacaatgccggccaacagaaaccatcccatgcatatttaacaattcatagtgtttctgttcttcagttgtggttgttaacttgttattgttgtttcagtggcgttcgcaaaaaaaaattgttgtttcagtgatgtccatgtattggaactgcagctgcataaagaagagagaagacactgtcgttctacagggagcatcacacaacgatggcaacttggctatatcagtagctgactaataaactactcagctctaatggcttcatcagcccactgctttggatgaaactagctgcatgcgcaccatggcactaacttggcttgggtatgtaattatttccctttcccttaatttctcctggatattgacctgaccttcagagagagagataaacatttcagtgcgtctgattcatggccgaatcagctcatcagaggtgcagcggaggtcgttgtggaatgtatgatgatgtgccacgcacggcaggaggatcggattgctgggaagatacgcccatgtccatattcatctccttttgcttttgtcaggcgccgcgtctcgccggctggccgccgcggccaaaaaaaggagagcatatgctcatcactggatcaaactatgtctaatgactccacaaagtggcagtgagtcagagctaggcagctccctagttcttgttgttcaagtgaagataatcttggttttgaatacctgtttggaagtcagttttgaggataaacttggaagattggagtcttttaccatcgactcacacaaattttaaattgcatcatccatttgtaccctttttcaattggaagatggtaacaaaaagatcaggggtcaagtttgtattatctatttgtacctttttttccaattcaagtttttacaatgtatttgggctgtctccctctatcagatcctcaagtgtggaaagtatatatattaacaagcagtccatcttatatagagtactggattatggaatttttttaaagcaattatctcattttcagacaatgaatatatgaatatatttctggggccaaactggtcttttacccaacagttattggaaccctgctcatcccaaccaggaacaaaagacattgtccagtgtatataccactggacatggcaactttcatgttgtaaatttttatagtagtgggtgtacaagttcatcttggcttgtgcctaccaggcagcagcaaccagtagcagctagcctaggttgcgatcgaattggatgacaggctgaaagacagagagaaccgaagccgcgagcgcaagagggattagatagaattctgacgcagagctcatcgatcgaccgatcagaaggttctttgtgcctagcttttcgtgcagatatgcagaaacacgtacgtagtggacgctggaggccactcactaatcgtgtgtcaacctaattaaacactcccgtccctttaaccacctcgtaatcttgtactgtaccacttacggattcctcattgagtcattggtttttattaccaaaccggatgctacgtaattaaccaggtgcttttgtgatgactagggtaagcaaccaaattactttccaggaaaggatacattcagttgcatgcagctgatgagagagagagagacaaagacgacaatattttataatatctattaagaaaattatgagtgaaattgtttacatactacctctgtttttaatagataacgatctttttgtcacacgtttaaccattcgttttattaaaaaaattatgtaattataatttattttgttatgagttgtttttatcactcagagtattttaatcatgatttatttattatatatttgtataaaattttttaataagataaatggttaaacatgtgttaaaaattaatggcgtcatctaattaaaaaacagagaaaatatattattctaacgacttaaaagccgatgtaaaaaataaactacgataaaaaaataaaattagctctatattttaatatttaatatttcaactttggttgcagtcgatatgctgctgtaaacacggtagagctcaaaacactagtaagaaaagtataactttcggactctacgagatcaacagatgaagttaaaggcttaaagcctagcggtactattttccgtgggtcgcgaggtgagaagagaggcgatggatgcatgcacgcacgcacgcacggatggatggatgcaaatcctgtttggagcgcaccatgccggcatggaagcacttggcacatcagcaagcactagctgctatgctagcttgcatgggccggccggagagacgccctgattgcttccattaggtttggtgcccctctcatgcgctgagatcatcacactcgcgatccaatgcaaatctcagagccctgattgcttgttgcttgatcgatcgtatctttgggttaaaatgagggagaagagaaagggggttagaggggagctgtgcatgaatgatgtatgcaccatggatagttactcgctcctatgtgtcggaactacatatcttcaaaaaaaaatacgtgcctttttatttatggttttgatagggttcacttgttgaaacagggtgcaggtctatcgtggtttcctaagtgatgtgtcttgcactcttttaattaaaaagaatgaccgagcgaggagtgaagatagctcgatcgattagggtctatatagtggaacctatccacgtgaattcaaatctcaaacttaaacttgcatacaatgctcgtattttttataattaatctaatctcgtaaagtatgcatggctacatacacacatgattatgttcagtggtaaagtggtgttcttgcgttatgagaggcaaggcctctaatcttgtttagatgtgggagagtgtggttggtgtccgtgagtatgttgtgcgcatatggttacgcttgagaaaaatgaccaagatataagtagtctaatggctaagatcattaatttgatgtaatatgacaagcaaaacatcatgctatatgctcacaaaatagaaaacataagtctttcatgtggcgagtctcctgcatctaacgactctcgaggatctcttcatgcaccatctctactatcccctttctcctttgcggcattctcaatggcgtcgagaggcaagcaaatatgttagaaaggtatatgtctcttgtccttatggagtaactatgattttagggttttttaaaacaaagtggatgaggtttaaatctattagacaatttaggtgtctttcgtctacggtttagatacgtttagagtatcttggtttttgttatctctctttgttgatgccttatttgtttgtgtgaaccttgatgaaaatctaggtgtctgctggtgatccaactagcgacacttgattcaaggttcgagttgtagactcctttggtgatactggtttattgacctgtcaaaagaatgaagatggcgaccaatgctcgttcatatgcttttgcacgtaccggggttggtcaacgttatggatgtgctcgtctacttacatgtcttttggcaatctaagatgctctatttgctaggttttatattttctgatgttgtaaaacacggttgtaatcttttctcttatttgatatatttggcatggtttctactactataaaacgtagtcgccctccttcctccccttacgttgcacacacgaccgccctacccttaaaactaggaaaaaaatggttggttaaaaagaaaatcagagaaaaatggttggttaaaacaaatggttggataccatgagcatgcgtaatccatccctgcatgagcccattgcaatgtacggatagtcgggcatagcatagaataaaaatccatgttgtatacccctcaagtcgttttgactttggttaaagtcaactacttcaagtttgatcaattttgtagaaaaaagtagtaacatttttaacccaagacaaatatattataaaaatatattcaattattgtagcgcccgttccgtcgtggcacatagcgggaaaactatctcttaaaaaccctatttgcgaaatctgtttctttgcttgctgtctagtgtccgtgccatctcagatctcaaatccccgatctatcgtcgagttcaatcccgaatccaaatccttcccaaatcaatccctccgcaaaagtctgtttcgcctccctcaggttcgatgggccgaatctctctcggcccatctccccctccctccccggctatctctctctctctctcgctctcgctatctctctctccctcttctccgctctgcccgcgcgccgcgcgcgcgtgcgcgtgagccgcgccgagccgagccctccctctccgctcccacgctgccacttcccgcgcgccgttgttcgcgtgcgcgcgcccgcgcggtcgccgcccgtgccgcgcctgcgccgtctgcgtcatccagccccgcgtgcccgagcagcgccgctcaaatcaccgcgccgcccgttgcttcccgcgcgcacgtgccgtggtggccgaccgcctggtcgccgccgccgtcagcctctgccgcgcctgtccgcgcctgccacccgtgtcgtcgccccgctccaaaccgccccgccgtcatcgccgtcatcatcgcccggcccccgccactccgcgcgcaagctgccaagggacggaggcagagcccctcctccctctgccgcgtcgcccccgctcccctcctccttttcccaaagaggcaagggggcaagccccctttctctccctccttttcccctttttcctcccgccggcgtcatcctccgcctctgtcgccgttttggccgcgagcgccgagcgccagctcgcgccttgaccgctcaaggtcggtttccaaaccgacatcgtcgtcctataaaccaaggcgccctcccatcgattcctcctcccgtttcgctcgccgccaccacgccattgccgcccctttgtctcgcctccgccgttcatcgccaagcaccgggagagccggtgcgttcgtggacgcggaaggggactccgggcgctcgtcttcttcctcttccccggcccgaggccggagagatcactcccgcgccgtcggcctctcgtcactgcgcccgcccgcacggtagtgcctccctccgttcttcctcctcgttccatctcctccccttagactcgggtagtagcacgagtagcctccccgtagttagccggcgccgccccgaccgttgccgtcgctcgccgtgtgctcgccgccgtcgccgcccgagctcggaagcgcctctcgtcgccggcctccctcgatgcgtttcctcctaatccggcgcaagggacggattcccgtagccgcgtggatgctctcgccgccgggaatcggcccctcgtgacctcatcgccgttttccccttttctctccgccggttgccgccgccgcaattcgccgccgacaagctccctccggcgaatccgagccgttggctcgtctcccctcgtcctgtgcagccacccggtgtgctcgctttcgccggtatcgccgtggttcgctccgccgctcaccgctgtcgtccgccgtccgttccggctggcatcgtcgtctacctcccgccggcccgcgtggcagccacgtaggcgccacgtcggcgctagctcggccaagaccgggtcgagccgaccccgatcaggcccttcccgtgcgcgcggtccaccgcgagccgtgaggctgcacgtgggcccgccacatccgcgtcctccgcgaaccgcgcgcgtgcaccgcgtccctcccccaaaccctagcacgcgccgcgtgcgtgttccgcacggtgaaccgtgtcaccgacaagcgggtcccactcgggaccacgcgaggtgagcccggtccaccggctccctctctcctcccctcccgcgcgcgcgctctgagccgccttcttgggccggccggcccattaagctcggccgagccgccctttctctcgggccgcgccctagccgcccgagagaagtctaatttccctccccctttcccttttcttttcttttctttttcaaaaaggatttaattaaatcctttttcctttagaccaaaaatccaaaaatcttagaaattcgatatcttcccaaccgtaaatccgtttgactccgttcaacttccaaaattcctcaaatctcgagatctatctaatggcacgcttagaggtcattaatagggctttattttcgccgtttgttgagtcgtcccgttttgcgtgtagtttcggagcccgaagacccgcagtgcgaggatttcgaggatcaagctcaagatctcgagcaaggcaagccacctttgaacatattgagcctatatttgaacttaattatattgctcgcaaaatattatgcattgataggattgcacttaatctgtttgcaccgtctgcaaggcagaccggtgggcctacccaacttgttgcatctgatccttccattgttaattgttatatcatgttcccttgtaaccatctagctgcgcctcgatattcgtgcactctgtgcgagtatcgacggtcgccttcaaacttaaaatctgagtaacttcttgggtaaaacttgggttttacagaagacttggaaaacccgacacctgggtcggtgcttgcgaactaaatgaatttctaaaaccgcggaccggggaacgtaccgggtgtacggtttcccgctcttgcacttaaggaccgtttccttggaatttcatccgaacataagacaagtacgaccacatgggtggaatgggacacccctgactgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcagctttcgaaatgccttgtcatgaaagcttggaggtctctcgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgccttgtgaaattgctgttgtggaaatgggatcgatgtttggaaaatctgcagctgatgggatcagctaggcccgggtggccgtttgaaagttgttggcccgggtggccgtttgaaagttgttggccgggtgccaaccttgaatcaattcaaaagactgatactttgcacatactccgaccggacgagacgcactgtctcatccgtgtcgtttgagaagcactcacttagttgatttcagaaaagagttcaaataaaatcaattgcaaaaacaacagcctttccttgaagcctgcattaaacacttatttcccatggcttgctgagtactcctgtactcacccttgctctatataaatatctcccccccagttgctgaagaagatgaagcggatcccgctgacgaggagttcttccaggagcaagccggctacgatgagttttagagtttcggcctagttcccaagtcacgcctgtgatgtttggtccaagtcttggcttccacttcccttttgcaatgcagttgtgagctcgggatctgtccgcagcccaacatgactgtactcctactctataataaagagacctctgttgctgtgatattctgtcttcctgtgataccagcactgtttcctgggactggtatcgattaacaggttaatttggagcgtcacgggctagttccggtcgggactagttcggggcgtgacaattattgatttaatgagactaatttggtgttgtaaatattactatatttatctataaacttaatcaatcttaaagtagtttgaccttgaccaaattcaaaatgagtaattataatatgaaacagaggaagtagtaagtaagacctgatacataaaggccaagctgagcataagtgtatggttaaaccaaaatttgtggcttaaattatcatgaatatattgtccattctccttgtaatgttacacggttacacccatatataaatatatatgcctttatattacactgtcgcacatctcccagaagtgatagcatagtgtaactctttatataaacgaaatgaagataacaattatatatggtttttctgagaatcttcagttaattaattagcactccaagttaaactgaagataagagtagctagcagcaaccaactagctagtcagcattgatgccacatcttatcagtcgaataacccattgacagtattctccctactggtctctagtctctacacatccatgtacaatgcatgcatgcatgcacatcgattgttgtcggtacacaagcactagctctgctagacaggggttaacacaagtagtaaaagcctaggagctgcagatcagagaagttccagctgactcccacaaaccttgacttggacggctctgatcatgcatcctcttctcctcaggtagccaaaaagagacatgacaaagttgcaaaacccatcggcagtatgtgctcactgcattttcccggcaaagcagagagaaaattaaaaagacgacgcagacatatagccctttctttctctctctcctttagccggaagtggaatattaaacaagctggaaacatacaagccagcactgctcgcaacaacaacattcagaagagagagaagtatagagagagagaggggagcatgagtcagatccatgatccatcaatggcaccacacagtccacacttgggcatctgggcgagacgagacgactaatccaacttcgatagcaacggttgctgctagctgctgtgctgaacagtgcagcgtcgtgcagctatatgcctatatatatccctcaaaactcattgcctctcctcatcacagccacaacacctagctagctgcagcttgtgtgcgagctactcctgcagctagctactagctacagccaaagattaccagcaacagaaattaactgtgtgagacgtcgatcagatcgttcgagagaatgggtgtaggaagggttatgaacgatgcgaagccgtacctggcgatgatactgctgcaggtggggttcgccgggatgtacgtggtggccgtcgcctcgctcaagcgcggcatgagccacttcgtcctcgtcgtctaccgtaacctcttcgccaccgccgtcatggcgcccttcgccctctggttcgagaggtaattaattaactagtactagagcgctgttagctaattagttagctcatcaactaatataatctctttctctaagtcaagctagatttaattaattaaacttcctttcatcgttaattagaacgcatgcatgcaaaagcatagaccatgcattgtttgtggtttgtacaacacacgcatgagcttacatgtttgcctgaagtctgaactctgaacaagcatgaataatgaaaatagctagtcttgcgtgtttttctattttcacaagagatgggagtagtccatttctagctatagctagcactgctgttcgttcgttcgttcgttcataagccgggtgacgtagcgttttaattagtccctttcagagttgatggtgcatgatatgcatgctccacgataggcacttctccagatcctaatatgaaaaagcagcttgtcaattccattatgtatctgcaaatttaacatatgccgatcgaaattcgaaaagtatatatttatgcgcgcgtatgctttcttttcccagctagcttttaatcccttgaatgtcacgcgttaaatcagcttatgcacatatatattccaactagaatctatagatcccagacaagaacagcagcggtacagaaagcagaaaatgacaccttacatattaaccgtaccataatcaaccgaattttatcaccatcaatttagtgacggcctagctatatatgtgttcacttagctagttgaatcatgttcttagggccctcctagagttgcaactagcaactgctgcatgagcattttcttcagtaatctcagcttaataacctaattaactgagctaattaattaatcagtggttggctttaataactgattatttgctcctacttgatacaggcgagtaagaccaaggttgaccctcatcatcttcctgaagatcatggggctcgccatacttgagtaagttaattacaagtcaaataatactaatacgattataccgtacatgcaattcagctctagtcctgacacgtgtacgtacttgtcaggcctgtgcttgatcagaacctgtactacatgggggccaacctgacatccgccggcttcgcctccgctctcatcaacgtcctccccgccgtcaccttcgtcatggccctcgtcctcaggtaatcaataattagcatataattagcatgtggattaatcgtttaatcagcatggaatgcgagagattaatggtgaatcggttgattaattaattaattaggatggagaaggtgaagctgaagagcgtgcacagccaggcgaagatcgccgggacactgttcacggtggccggagcggtgctgatggtgctgtaccacggcccggtggtgcagttcccgtggaccaaggggcagcaccacgacggcggctccggcgccggcggcgcggcgggcggcgggttcctccagggcaccatcttcatcgtcgtcgcctgcgtgtgctggtcgggcttcttcgtcctccagtccaacaccctgcagagttacccggccgagctgtcgctcaccacgctcatctgcctcatgggctccgtcctcagcggcaccgtcgccctcgtcgccgagcgccacaacacccacgcctggctcatcggcttcgacacccgcctcttcacctgcgtctacgccgtaagctcgatctcttgctcgatcgatcagccatggcggtgttcgccgccggcgagctgtcgcgcgctgacacgatgaggtgaatggatatgcagggtatcgtgtgctccggcgtggcgtactacgtgcaggggatcgtgtcgaggcagaggggcccagtgttcgtgacagcattcaacccgctctgcatgatcatcaccgccatcatgggctccatcattctcaaggaagaaatcaaccttggaaggtactactctacctcgtacacgaccccattatactatatatagtaattaatcatgattagagtgaataattaattaacggtcgattggttaattaattaattgatttgtttgtttgtttgttaattaattattgcagcgtgatcggcgcggtgatcatcgtgatagggctgtacgcgctgatctggggcaagggcgccgacaaagtcgagcagacagacgccggcgcggcggcggcgggcagcaacaagggcggcggcgagctgccattgacggcggtgcccaacggccacggcagcaagcacggcaacggcggccatgtctacgacgtcgagacgccgccggcggcgaacgggcactactagcctaagcacatgcagcagcagtccgtcatcctcggcagtccattgtaagctagttgtggttcgatcgaccatcgatcgatcgagagcgtgacacgatttcttcttcttcgtcgtcttcttcttcttcttcttttccttcttgatttctcctaagaattcttgtgaggtattaaaattttcacataatgcaatgtaatggataaggccaggacgtgtccggaagtgcttgcttaagtaatgaatcacatattattctctctagctctgctgtcttacgtggccggagctgcaattaatttacttgtcaattaactatagtgcaaatgcctttgcttaatgcatgtgttgtcaacgagacagtactgctaatctgctatactgccatctccgttatttgctcttggcgtgtgtctccactaattacaggctttttgcgactaattaattgactcgaaatggaatccaaatgtacatgcaagctggtatagctttgatcgatgcaacggcatgcattgattgatctgtgcatgtcgtgatctctgcctgccgttttagctagctttaatatgtttggctttggtactgaatgacattttctaatcaaagtcattaggtgctgaatgacatcgattgatttaacaatagatcaacaggcctaaacattctcttctcatctctacttttgcacagtgagtgactgactattgctatctctggtatataggaacagaacatgtcctctgaaactggtgaaatcctagctagacatagttcaactggtttggattggcccctttaaacagtcaccttctgtactcaacttcttcatcaatcttatcttaattatctctatggaatcaaacacgtaaacctagctacctagctaggagcagatagtttagctatctcttgctaattgtctgaaaaaacagagaataactaatttggattttgattggacatcatatggatatgagctgcattggggccggatcgacatgacgacgtaagatgatcattttgtagatgagcgacaggccgtgttgggtgtacacgcatgctgacgtgcgtgcgtcgcatataccatatgatggaaatggcagatcgatcggtagtcactaacatcagcactaattaaaaaaatccccgggatcacgggagatatttgggatttctttacggtaaagagcaggggatatgaaccaaattctgccgtatcttttagtgctcgttcattgtcttattaatgacaatttgtttatctttattaactaaagttagtgtgtgtgtacaactgaatcaaagtgtgcgcgtagtacgtgttctattagtttgtgcgatgatataagttagttcacagtacagtgtgactgtggagtctagaacctataagtctgtgataattcgagagaaattatatagttttctgtaggaaaaaagtataattcctgtaaatttcaatatttttacaatgcctattgtaacgcaccaatatttactggtatgacgaggtgtgacgatagaattcccaggcttatttagagagccgatgcgaagctggtttataagaatttagaaaatataagtttgtcaattcctactctccagtttcgtaaaaaaaccatttaaaggtaggctatatctagatttgaacgcatgagtttctttttgtgggacaaagatagcttctactatctcattgtctagattctaagttaaatgcatgtttacttgcttgtcattttaccctaccaaattttaataggatagtaaactaaacacaaccttaccattatcactccaccaaaatttgataattctagatgtttcctctcataaaaacatcatcaatatttgacaaggcaccaaatatatctaacgctattctttttcgataatgctaaaatataccaaaatttaacattactctatccatttcatattataagactttctactattgcccacatttatatagatgttaacctataagtcttataacctgaaatggagggagtatcaaactttaataaggctaaaaatgacaaccaaagagaacaaccactgtgtgagaatctgcagccgctgaaactcaaccttactccatccatctaaaaaacaagctagtactggatatatctctattcgttgtattataatgtgtcatatttagtcctaaattcgtttttttacggagggagtatttcatttgtcttcaccatggaagaaccggtcccacttaccatagacccaccacagtagtacactacagtagtgagtagtactgtcagaccctgtttagatgggactaaaacttttaagtccctattacatcggatgtttggacactaattataaatgttaaacatagtctattaataaaacccatacataatcttaaactaattcgcgagacgaatctgttgagcctaattaatccatgattagcctatgtgatactacaataaacattctctaattatggattaattaggcttaaaaaatttgtcagataaattagctttcatttatgtacgtaagtagtctatatttaatactctaaattagtgtttaaatacagagactaagagcacccgcaatggtaaagtagggtgctctctataaaacatgtacatctcagcaatagactagattaatagtaaaccacctcaatagtatgtctacataggtatctatagctctctcatgcattgcttcgtttttctctatagactatctctaagctagtagatagctttgctctctctcttcatttaatatcttccaagtagaaaaatatgctgacatggatctcttgtagatagcttatagataaccattgtgggtgccctaaagtttaagtccctaaatccaaataccacccgacaaagcccacctcacgggcacccctaaacagaagtaaataatttcaaaatagtccctcaagccgtcgccttcctcacgctctctcccactccgccactgctccagctccccctccccgcaaggcggcggagatcccaaggtcgtcgggggatggcggcggtggcggctacatctccggcgctaaccctcgctgtcgcggccgcggtgatagcggccgcgtgcctcctcctctgcgcggaggcggtgtggctggacttgccgcagtcggggaccaagtgcgtgtccgaggagatccagtccaacgtggtggtgctcgccgactacgccctcatgtacgagtcccacccctcctcccaccccaccatcgccgtcaaggtaattccccacatttctagccgtctctcgcttcggattctatgatgcagtgaggcgcttccgttgttttggaatttttggatgggctccgatctaggttgcggtagttttggacgaattaggtcaactccatggtagaacgatagatggatgattattccgtgaaacggagcggtggcgtgaagtttttggttttgctgcgggtttagagatgcttagcgcacattatattgtgctggaataatcgttgaactggttgagtccttgagtgcgagggattatgtgttattggtgcagctgtgctcgcgaaagacagaaaaagtttgtgcctagtgttcaccggattgcgatgggagctgaaacttggaatcatatattctttgtgtaacctgctaggaatttgttgttctctaggatctagtgctctgtctagattccatttgcatcgcagggaatgatgatgatagtattctagaataactggctgatgcgtcaagtggattggtatgattcgcattgatgacgcagggtatgcttacatatgatccacaaaccgcgtcgattccttctgtctaaattgcggtggtttctgtccaggatgtcactcgtaacagaatacaaggtgattcatcttacagaatcacacacttgcttttctagcgacttctgtaagaaactccatgggttgtgggaagtaaaaggtgatcaataagaatcgcatcgatgcgaaataatgagaagacaacgatgcaatcatgttattatgtgatgtgaaattaatactgtaatgacttggtaccatatgtgtatctttttattcggaatcatttgcatgaatatgacagtgtgttgccatgctttttgcgttcgaacaaacaaggggacatactgaataaatagactaacgtgtagacatatggttgataaattgcgagtgccgtataagattgaataagtagatagacttaggtgagataatggtaatgtcatataaattattaattgtagaacccacttaagtgagcaggtgatatctcaactctttcttaatattattttccttgaaaatgcacaagaggaacttcatgggactaaaatttccaattccaaggcaaatggatggagtagattgtaagggttactagggttaaatggccatgcaactcgctatatactagtttctttagtctttactccaatttatgtccactgattgtaattttatttatgtgaagtataatattaattcattaggagatctattttcatccatgaattagtactggctagattagacactaagcatactatttgtgtttgctccattttgaacagtccttatgttttttcttttcgcagctttcgaatcaagaatatggttttttttttttactgtgcgagtatcaatctgcagttactgcagtccactaatggagtaaacgatgctactccaatcctctcaagcttagcatttcttcgagaagcttagcaatttgcttttacatgatttgttgaatgaattactatctacttgtgctgttatagttctgcaaatgcttatgcttggtgcaggttacatcaccatatgggaacaccttacatcacaatgaaaatgctacggttggtcagttcgcattcacaacttcagaagcaggaaactatcttgcatgcttctggatagatagcgcagagaaagggtcaggaatatctattaatcttgattggaagattggaattgcagcaaaggattgggatgttatcgctaagaaggaaaaaattgaggtaggagtaggcttagccaaactgctgacggtccatatgaccatatttcactgatgtccagtttaattcactgcttctctaattgctgcaatctaattccttttgtagggtgtagaactagagcttagaaaacttgaagtggcagtacaatccatccatcagaacatgatatatctcaaagcaaggtaagttttacttccacatgattgacttactgtggttgaggctttaaaacgaatattggtggtactaatagagggttcagtagattgccaatggaacttggaagtggtaatgaaacaatcatattgtcttcaattctcagcactagatacattcaaccacaaagagcgagcattgtttacaaaacttacgatctgcagtccagatctgctttctactttgagaaactttatatttcaagatctgttgcgattgaacccagtcattgcccttatatggttaagaaatcatagtgttatatgagattatgtgaacttgaagacatttattaccgccctacaggattttaaattagcggcaaatctaatgatttatttgatttgttcatacagggaagcagagatgcgaacagtgagcgagaaaacaaacgctagggtagcctggttcagtattttgtcactaagcgtctgcattgtggtttcaattttgcaattgtggcaccttcaagggtacttccagaagaagaagctcatctaggttagctcgcttgagctgtaccgtgactccaaaattgcaaatgttgttacattggggaaaacagttttgtcatgttagttcgaacttcacgctagcgaggagctgcttgtactttatgtaatttaaccatggttcagtttagatgtgttgtgcattatgattgcaaataggtgataacttaaatctccctggaatatttgatgccttcaggacatagattacaagaaattcatcgtcttataatgggatgcaaaaattgtggcttatgtggtagtgggcggtggtttttcttccatttgctttagctattacagatgtcatgtaagtgtcatagtatggtccgatccttgtaccagtaaaccggcttagatggaaacaccgatatgagaaggccaattatctagcatgtctttgtcctgaacctacagtttctgtatgggacaaatacacgttaacggatgaatcacgcacaatgatgcaaagtcaaaacaaccggagcaacatcgtcagaaatctgatcacagaaagaggctaaggccctctttatttagactttagactgattggcctagacttttaagtcagcttattggcttatatgatttataagccagtggatttaatgtcctaagtttaatggtagagttatacatctatctcatataagccaaaaaaaaagcttctccaacctagtttttggcttaatagtgttagagtggcttatggtttaaaaaagccaaatgaaaaagctgcttgtttgttttggcttagacttttcgacttataagttggcttataagcctaaacaaagagggcataagctggctaacttgctattaaaattttcatacgttcttaaactaaaccagaaaaccaatgacagccggcctaagctgttaacgacttaagcattcacatcccaaaattcccaagtcctaacacgtatccatccctattctagtattctgataactctcaagctcttgatgatatcaccatgtccgcgtcgccgttgcgacgacggcgagcaccatctccagctttccagctgctcctcgacgccacgcagccgcagatgccctcagctctgatgatttctacgctggcgagcctgagaaaaaccagtggcagatgcgctcaccatgggcaaggccggtgacgccgagcaagcggtgcacagcactgcgccggcggccggccacggctccgccgtccgccggtacgccgccacgattggcggggctgtcgatgccaagtgtgtccttgtgctgttcctctccatcggcgtcttcgtgctggtcctcttcatgcttcttcctctccatgaccatgcatcagaaaccatccctgatgatgaccctggggtacttcctggtaagaacactttccttctgcagcaactttcagcactgattaaccgtctgatcatataaattgacaagctacatgatttaattatgtttgtaaagtcagatgcattatccccaaaatccagacagtagaatcaaaagatttcgtaaccaaatgatctcaaatagtggtagattagaagataccagctactcatgctagctaagctttcagcaaatatgaagataaagtgtgtcaagcttacctttatcctcttatgcatctctcaaaagaaaacgcctatcattcctccaggtgaaattcaggctagcttcttcttgttaaagaaacgtcaacagctcattccacatgtcagaaggctacaaaaggacatatacagagaaatagggatccccaatactacggtatgccattattccactttgacaaaagaatttgtcttgcactcaagctatactgaaatgatcgctgaaaattttgcaggtttcggtttctatgcatacatccaaatataaggattccacttatgtaaaatttggtattctaccgaacccaagaaattcctccataagtgcacaatccattattgccctgagaaaaaacttgatacaacttacgcttgagcagtcgaatttatctttgacatcatctgtctttggagatccacattgcttggagatcttggggttcccaggagggatcacggtgcctccaccacctgatggcaatatatgcccaacagctcttttcaatgtcacactcaacatgactatacaacaactaagggtgcacctcaaggagctagagagtgagcttagaattatattgcagctgacaccatatgaggtccatacatcttatctcatctgatatagtcagttactccctccctttcacaatgtaagactttctaccattatccacatacatatagatgttaatgaatctaaacacatatgtatgtctagattcattaacatctaaatgaatgtgggcaatgctagaaagtcttacactgtgaaatggaggaagtatttgacagcaagtgacaacattttattttgtgcaggacttaattgtagagataacaaatgaaaatggttcgacgatcaacctgcccgttacagtccacattttaattgccccaaactatcctagcaattatctagaaacctacagactgaaacaactagcccaaatcatcattaaattaattccaaaaaaccttgacctaaacccaatatttggcatgattgagaatttgtggctgtcaccatgtctacaaagttatattccatcatgtgctcctaatccagctccagctccagcaccatcactatccccatccaatcctgaacatccacagccaactaccaccaagccttatggaagtttttcatgcccggctttggaaagaagaaaaactgtctctgtacatcgcaggttatcgacgatatctcccatgatggtaccaccagaaataccgacgaggtttgatagttggagtgtacacactgacaggaaaaatcgctctccacttgcaaaaccaatgtcccttgtgccagcatccccatcaaaataagtaagttgcttatagaattaccaagctagtccttaagtgttcttatattgtttagcaagattgatgcacgtttttgttacatcttagagttataactatgaaacatgcattaatgtaaattagagcaaacaaacaagagtaaattagtttacatgacagcaagacagggattcagatgttaggttttcattttatcatctgaatattattatttctatgataaatgtttatcttagttataaagagttgaacacaagtttcagtattcgaacctcaagttgatttattttatctgttatccatgcactctacaggccagtgccttcaggtcagataactgttgttactgtcttctgcagttgattctacacttgttccttcaatgtgattttgtcagttacatccaaggttgcatgaagtgcttctgagcgaaagtcctacactaatgcagagtaatgctcaagaaatcttaaccaagtgtatatatgaaatggttaagttctctttttgaccaaaaacactgtaggggaaatggttaagttctttagcagtaagatggaaaacctccagctacgggtggttaaccataagtttctttaatgcgttcagagatttttcatccaaacagcttgtgcatttgcatgagttatatagattgctcttgtcccaaagaaccattctgtgagtatatgggtaacatcttgtgctcagatgctcgcttatctgtatttttatagcgatacggatgattatcaattatataagcaagcacaacttattctgaaccgaatagagtatccagaaaaattagtgtataatttctcaaatccatagagattaataaagattacaacaagtaaagatcacatatgccatccattatccatcggcattctcatagctgctgactcaaaactggaagaaaaaaaacaccttctgaaagaaactgtgaaaatatcttactgatcaaaggcagaaaacactttcttctgcacgagctccacgcttagacgaggcgataatctgggaagcttttcctgcaaaacgatcattgatatgagctatgatgacacaaactctagactcaaaacacctaaactgaaggccaggagcgagcgcgattgggaggacgacaccacacctcgctgccgtcgggaagaaccttggcgagcaccgggatctcgtactggtacatctgctcccaatccggattcgtcgtgatgtccctctcctgatcgaaacacaaaccccaacttctcaggatgaaaccccccaagggagagagagcgcaagagccacgaacgtggtctagtctgcttgcctggagctcgagggaggcgagcgagtagggtgtgccggcgagcaggaaggcggcctggagcttctccttgaggccgtcgcagaggcagcacccgggcttcgtgtacagcaccagcctccccgcccgcggctgccggggacgcctcgccgtcgccggctgcggcgcagagtaggcgggaggcagacctcccatgctgcgagaggcgcagtacgcccgccgcgcgcggaagcacggttagcgccgccgccgccgccatcgatatcgtttgggttatcgctgagacgctccgcgccggcggcgagaggcgaccaggttagccgcgctgccacgggctgggccgcacacgtgccaggcccaacgcgcaaggctcgcgtgttcatgatgggccaggcccacctcacttttgttatgggcccaaaacgcgcaaggctcgcgtgttcccgatgggctaggcccacctcaccatggatatgggcccaaaacacgaacccacaacgccgcgacgtcgcgcatctcctcctcctcctcccccatccaaagcgagcgagccgagggctcgagggctcgaggccggccgccatggcggcatccgctatccgccaatcccaaatctcccccccaactctcccccttctacgccgcacgcgccatccacatgccggcggagctggcggcgcggaccggcggaacctcgtggcgttcggtttccggtaagttttcgctacttccgcgtagacatttgttactgcttgtctggtacactggtacagtccaccatggtggagcacatcagcggtagtgcttatctggaaatgcccttgccacatcgatggtgatgcagaaaaattgccaaacgggatactgcagagtgtcaattagttgatgcaagtagcgggtagaatacactgtggagtgaatatgaacgaattatcatctttgcaagttgaaagcttgataaggatgtgattttatcaccaattaaatgcatggtgttgtggcgtgcgatacaaaagatgcatattactgcgcctgtatttttctccagtgttgataaacagtacgagagagatggttgcaatgatttgtagattggattgcaattctgtagttaattgatggtttaggactttatgtttcaatagttcatttgtcagtctttagtttctcgaatgtatatatcataactatgcagctcaattctttcttgtaattttgcaaccgaagagtgggtattatacacctagttttctggtgaatatatagacaatgtatcaagatgttgttttcttgtcattttcagttcttttctgtgtagcaatgctcgatggtcatatttactgcttatcatcagtataatatgccttattgtcatgcctaccaattcagaaactctgttaatgaaaattgactgatgttggctgagaatgatttcacatggttttcaaatcaagggctctattttccgaatcgagaggattggagcttgtctacaacatttcgcattcgcaagaaaatggaacactgacaagagctacccattggccatattttagtattttgccaccctaatctgctctttacagttttaggatttattaagcatatgagttggggccttgggggatctatgggcctgcttataatgaaatggtgattcttcacaaactgaataggataagtgcatctactataacaatataatgatacaaataatattgcttatgattaagacatgcataaggtgaatttctagcaacattagtattatggtagaactataaactatagtatggatcgactacagtaagcacaacccctgggttctgtatgcatatcatcttaaaggacatacatgctagtgagctctttctctaaaaaaaaagataagggggacatgccattatagcagatggtctaatagtatagctatttgttcttttcacctcagtacattttgaatttggtgctcgtgccagttgttttattctggttctatcattcagttagggtacaatacaaatgcaatcttactttcactatctttttggagattgcagaatagatgccagtaccaatctatcagctgttaagcactatcaagtatcaaattttaatgggtaattgttttcttggtgcagagtggctctagtgcacaaacaaatatactgctgctgtaccttttattgaagtggccacaggagagccatacaggtaccataacatcttgctactactactcatgatttctgaggctgcttttctttctttcttttttctgaaatccttggttacattgacaagcacttttacaccagggtgtttcctaaaccatttgatttgtgatagttctctcaaattttaaacaaattcctgagcaagtaacattgagtcacagtatgaagttggttagtgagagtgtgagcctaggcacttaggcagtacaggccaccatcggttggcttttttttttctaataagccaaaacggcttattagggaataaaaataaatttgtaggtaaaacttttatatatgtgttctttgtaacttaaaagccaatgctgaaaaaaaactacgttgaaaatatttcaaaatcaatttcaaaattaagtttaaaaattcaaattttggcttattctttggcttattggaccatccgatgggagccacagccttcagtgactgatcattctagaactcctccaaacaaagccatcctccttttctcttacttttgtactgggaaagtgaaatcaatcaggtgattgatgcagtctcatttttaaaaagggacaaagggtagctgttgaaatttcgttttctaaaaaattgtctgcgatatagctgtccctaattcccaaaaacttttcaggttactgattcttgattcccagcactttgaatcgtagccatctctaatccctagaccttgtagtagtgactgaataccactgtcaatacaagtgacgatcctagttttgaaagttagatattgaaattctcacgttcctagtagactggaaaggtaaatggatattttaaagaccaagtgagcctcaactctcaactcctgcaaaatacatgtccctcttttgctgaaactttccccgaccagtggtcatgatggcacaacgtagaaagtaagtatttgtgtagtacaattaagtggtcctttgaacaagatattgcctagaactcccatatttttctaatgagcaaacacttaaaagttggaaaccatttctacagtggaagaccaaaatcccctagtaacaaatggcagtagaaaataatctccatctaatctgtcataagttctgaaccttaatactagtagaattctgtttctactgataacagaactcgtaaatcaaccgttggtatcacttcaattcatgataatattggcaacaaaatactaacagtaatgactaccgtaaagttactcaaaattcttatctgctacgaaatcctaatgtcttcaggatcacactacagttattaggctttatttaacgcttcacctaattgaataatgttttttcagatgtactaaaattaagtgggacttaacatgtgtttttttaaaaaaaacacttaggctgagtttgaacctgtaggttcggaacctctatttggcacgaaaaacagagtacctcattaacaaatgattaattaaatactacaataaaaaagtaaaaatagattaatatattttttgaagcaaatttcatatataatttttttcagaaacgtactctttagcagttcgggaagcatgcgtgtgaaaaagagagagtagaagattagaaccatcagtttcgaacgcgcccttagaccataaaggttgtggttatacgacacaagtcataatacaataatacattgatttttttacgaactttgactatgtttaaacatagtgtaaatttgttcggagttgaaaacccatttcaacaccctagaacccgtagttacacattgcagtagaaaatgatccccacctaatttgtggatcctctaatctgctacaaaatcggaatgtcttcagaatcacactacagttattaggcaagcaaagtttatttcccagcagaggcataaactctgccttttccaaagccaggttaacatcaccttcaccccctccctcacatgcaaaacagaaaaaccacagcactcaaaagcgatcgaagttgagccgagagcggctgagcccccgcccccatcacgctaataatcacgcacgcaagaggaagcttccctccccatccactgtcccctgctcctaatgcattccagctctttgccgcgaggatgaaagatcttcccctctttctctctctctctctctgggagataatttattcgagctgtccttctcgctttgacgatccgacgaaccagaaggaaaagaggggaaggagatgacaaaaaacgatcatccctgcccctgtgtgtagcgatcggattgcatcatggggttttttttttttcttgtgcgagctaggctgttaaaccgcgtcgccgtgggggcggcaagacggcagctagtttgttgtcttgctcactcgctgtcttgctgacctctgagagaccggttcttctctcgtttgtctgatgaggtagacgcctgcctgcctgcctgctactgctggtgcattcatgtacatgctgtgagagggacaagagttccaaaatgcgacgataaccgctcggttctcgggtttattggtgttgatgtgttgtgaagttgatccatatttcaaaattatccaaacaaatgttcaattttttgataaaatttgtctaagttccatcgtgtttttatcggtttatcgtggttgtcaatgaaaccggtagggggtagtattggactacctgtcgtatttgtaaattatagggagagatattcctagcaaagtgtgagatttgaaggcgtctttttaatgaaacgtctctctgcacatcgcaatcgactaatcgagcgatgtctaaacgaggtgacgttagtctgcttgaaaaatgaggctggtcatttttggtcgctatctcctctttgatcttggccttttgaccctcctggatttcaggcttgtctacgtagagggttacagaagaccagctgtcactacctcttttgtattgttggtatacgtggcaaattgctagggtgtgttttacttacctgtgtgattatactagggattggtcgtgatcaggttgtgtcatgagaacaatatgttcataccaattctttttctttctttctgatttttttgtcttgcactggcattggtatggaggctatacctactcgtcggcaggttggcttttttacagaccaagttatttaggagatactcccaccgtttcaggttactagatgtttttactttcattatagttaaactatttcaagtttaactaaatttataataaatatagtaatatttatcatgctaaattagttttatcaaatcaataattgaatatattttcataataaatttatcttgtgttgaaaatgttattatttttttctacaaacttggtcaaacttaaagcagtttgactttgaccaaagtcaaaacatcttataacctgaaacggatgaagtacaatagtggacatctgttggtgatgcttttagatactctttgtgtatttttcttttcacattatatttagatagagattatctagttatcaatcacctgaaaacaacagaaatttcactcaattttttttgggtggataggattgcaaataaaccctcaactctaacctcgtcaccgtcgctgtgcatttattgaagaagagtttgtcgtcgctattgccgtcgcagttgatttaccccttctccctcccaaaatccagtgctcgattgaaggtgagtgaaattcatagtaatttcagtcactttaaatctcgcaaatcccatttaaataatatgcaaataacttgtataatttttggccaaaagataactcgtaatcccatttacataatatgcaaaaaacaaaaagttgtacagttttttaccaaaagataactcgtacaatttatttttaacaatgcagaaaatgtaatattgtctataaaaacgggtacatcgttttattgttcatgcatttaacagtttattgtatgctacgtgttctttcaactttttttcatgcgccaaaatgtgagatcggtgatatgaccatgtgtagttgtgtactcatgtatctgtgacatagagagaaggggtttggcaatatctgttacagattgctcggaaattcaccgagattccggcatttccaaacatgcctgactgaactgcataccaatcatgtgagggtaacacagtcaaggcaaaagaaaaaatagaagtcctatgttgatatgtgttcctactttgaccagtgatatcctgcgtaagcagataacgctatactctccttgaacacacacatcctagccaatagccaccatacagaagaaccccagctagcagtgatccatatgctctgcttacctgcctcccggaccagcagagccccttgtccaaatcaacaattccacacccccaaacacacaagaatcaccgtgactgataaaacaagtacagagccgagctgcgaggtatcttctctgaccgagcagatccatctcaccgttctgtcataaaactaatccctttctctaatccctttcacactactaaattttatgcattcccttatatatccctgaattttaatttggatttcttccatacccctttttgtttagttatcgtgagttgactgttgtattcctatcaaaaagtccatttttttcctttggtacgaagaaacatataagattatgaaatacttcatccgtttcatattataagactttctagcattgcccacatttacccacatttatatatatgttaatgaatatagacatatatgtgttcctagatacattaacatctatatgaatgtggacaatgctaaaaaatcttataacctgaaatggaggtagtatattgttggaggatagaaatttgttatttgagactattatatctataagtttattatgcaagatattatttatcacaaaatttacttgtagatatggcaaaactaatatttatttattatagttattaaaaattatttatgtagcatataaatagatttgtttatatagcaaacatgttgtactactatccacaaaataaactacatatacatttttaataattaaaaaataaataatatttttatgtcatatctaagaataaattgtcataaataatatcttgtattataaactcataactataaaagtctcaaataataaattcttatattttacaaatttagagtatttgtttttcataccatagggtaaattagacttcttcataagagtttaactgtcactgacgtaaaaggtatggaaggaatccaaactaaaattcagagatatataagaagatgagcaaaattcaggaacatataaatgggcaaattttcaaagacacgctagaaattttctaaaaaactaatcaacacacctcaacctttaaaaaacaatccaagcacccatcccagaacaagttactgttctttagtcttcatgaccaatcatgtgacatgcgcacacgtactctgtaccacgcatgcacgctgctggcacgatgatatcgtgtgccgcctgcacctgtttggtcagtactgtacgcggtccgagcatgaacaatgtatagtggcctcgaggtttagcttcgaagagagtgtgcaacatagattagagcaaggctaatacagccgacctgttggctataaggttctttgtagccttctcttagcctacccatataatagttagcactttattgttaatacagggcccacttgtctctctcacagagtttcttggtccttgtgtccaagccggctataagtttacagcccgcttcttctctcttctctcctccacccttagcatttagccagcttatagtttaccattatacttgctcttaaagataaaatcacaactgaggatacctcattcccaatgcccggtgatttgaatgggtctagaaaaggatttgcttctcagccttacttttttttaagcaagaactagctctatctattactatattatctataaacaacttaatagtcttcacatataatagttagatacatatttattgcattattgataattggtcacaccttattcttacaaaatttcttagtgtccctgctggaactgattacaaatctatcgcttgtttttttttctcttctcttttctctcctccaactcagtacgaatttgaggtggcaacttctatagctcatctatatcaatttattgtacatgctcttacagtctataaaataatttaactttgatacaaatatgcacattaatcccttatatcataaatcattttataacaatgcactggccctcgtgtcaggtgaacaaatactcctctgtccttcccctagctccattcctttcttttttgttcttcgatatatgcatgttgccgaccttctcaactctttgttgctgttgtcctttttggctctcgatggcaccgtagctctgtgctctagatttggtcactgcccttctgtgctttgggatctgtcctccaccgtcgtcaccagtggtggagctacatgttacctatggggtcagggtttttacaaaatagccaaaagctattgatatttgggttgcaacaacagaaaacttgccatccatccctcgtgacttcaaccagccaccatagtgtctttgtgctccaaacgtggccgccccgccactatgctcaccgagtatcgattcaccttccaggcatagttattaggaccggaccggacatcgaaccggtcgtagcctcggttcgcggtttgattggtttgattggttgaaccactggcccaacacggtttaaataaattgaggtatatagcctaactgcacaagtatgcatagctcagtggtggggttgcttgagtctaaaggggagattgagtgtttgaacccctcaacccacctttttctcctattttcttccctctcccccacgtttcagcctgcgctgggccctttctcacccaatttccccacatgcacccggttctttagcggtttacttgcccggttctttccaaaaactggtggttcaatcgatttttcctgggttgattgcacgttcgatctttaaattggacctgacctgctaagcccctggttctggtttttttgggtcagaccgtcgatccggtcctaatagctatgcttccaggttgctaaagtcaaccgcaagggtaccctgatctaggagaagcgcggcggttgtggttgcgagagtggtgtatcaccgccctcttgctcgactccatgagagatactcgatcagatgaccttagcgtccacctccttcccctttcaagcaacagttgaatgttctctcaccataaatcacatcatttttgtcaacccaaccacgctctctaaaagccactcactttttctcatctctcctccacggcaacttgccattgaggcggagccgtaaagtcataagctacggtgggacgttgtccatgccctcaggcgaatttagatatactttaaaacacattaattttatttgaattttataaagaaaacttaacatgaatcagtctaacagtaggataaattttctgtattttaaaggaagcctcaaccttgaagcggcatggcgatcactcgaagtgagtgcagagctagggtacatgtggttgtacggctggggatacacccaaagtcaagatcgtgcaggtggtgggttccggcgtggggtggggggccgagcagcacgtacagctagctggcctggaaaccggctggccgccggcggcggctgccggccgggaccggacggacgcggaccacggtacttgttcgatctggactataatggccgccagtttgtccccgtggtacggaggcgctgtggctatagcgctggtttaagagcaaggtcaataatgcagctaacaacaggcggtaaaacggcccatgtcagatagtgcagctaatattaaaagctagtatgtacagcagtaggctgcactccattttccggtgttagtttttcattttctaatcgtactttactagatcagtccatcacgtgattaggtggtgttaggttggccccacaaaatgtgtgaaaagctgcgctgtagccgggcggtaaaataagcgtcggcttatttctctctcctgagttctctctcctctacataggaattaaatgatgtggcatattttggagcctgtctagtcagcttattgtacctgctctaagggagaaattacatgatgtacatctctcgagtgtgagtttgcgatcactaaattaatagtttgatgcagtaattaactcggactcaatttaattaccagtgaagctagtacttaatgaatatgttgctcgttgttaggcctggtttagtttccaactttttctttaaatttccaactttaccatcacatcaaaactttcatacacacatgaacttccaactttttcgtcacatcgttccaatttcaatcaaacttaaacttttaattttggtgtggactaaccacactcttagtttgcctaagattatggctatcgttggcgcacaaagacagcacacatcagacaaacctatatgcctggtacaacgacagactctaaccaggcaagaggcaaccatatacagttacgcacgccctcatgttgaacacaaatgtctgccacttttgactgaaagcacatgtgacagattaagattggtgtgaatgtgtaaatgtaatgatgattttctatatggacaaagcatgtgagcatgtatgctatcttcagataccctccgatacccttaatgccttgctccggagctgttcttctttttccgtgaaggaaaatgagtcttctcctgaaacatatagcgatttcgtatcaaaagtcgtagttttcaaccttttcagttgctgacagcacgagcgaatgtgatgtagttttcaatcacccaggtagaagcacgtatgtactttccagccatccgttcgcaccagtattgtacgctggctactataataaatacatacgatccaccaaccattacaatcttcctcgactttggccttgtacttttctagatttttttattagattaccgaaacggagtatttaattcatgctttagaaaaatacgttttactcaagaaaaattcttctaccttaagtaattagatcacgcattttaagttaattggtaagcttatttcagtaaatatttagcttatccttatgatcaagctgataattcacaacaatcatatgcagtaatctactacaaattaaataagacctttggcgatgaaggtcatgtacaccattgcatttttttagataatgaaaaaacctactattacacccgggacatggcatatgcatgtatacacgcatgccgtcatagtatagggcatgtttggtttgaaactctaccaaaacattggtagtaccaaaccttgggcaaattttggcactaccaaatttttgatagtatagatttggctccactctattgatttggcaaaaattggttccaatccaaaatgctaacatgcactattcaaaactactaaagaattgttagggcaagaattggtaccaaaccaaaatggcccatattgccatagcgttattaacgggcagtagtaccagtgtacaagtaatcactatggacaaatagatgtggctacagtcctacgcaaggcaacgtcagcgtgaggcagccatcgctatccgggaatctgcttgcagctgctaaggtcatcggctagctaggatagatggatcggagtgcgacattgacgtgctcaatctgatcctcttcctctcgatcgccatcgatcggtatcaactccacgcggtttgcggtcggtcgcaaccctgcctgcctgccagtgcagctccagctagctctcgctatagcatcttctcatcttctctcctctcccctcccccctccctgccgccgcgacatcgacgactgcatgccacgcgcgcgcaccgaattcaaagcgccggttggttgttgtcttttgtctcccctcccctcgcgcccgcgcagcggtgtgtctcgtctcacttttaaaaaatgagttaaatttgataagtgcaattgtaaatttgtcgttacaattcctctctttataaccatgccacttaaattctataaaattagaaccatgctacgaattctggtcaaacttttccttaaaaaaaataactgacacggttacgagtaggcgaattgtaatagcatttatttgaattggtgcatttgcaatgacacatactccctccgtaacaaaatataagtgattttaggtggacatgacacatcctaatactacatatctagacatgagttatgtacaaatttgtagtagtagtatatgtcacatccacccaaaatcctttatattttgggatggatggagtatcaagttaacccttaaaaaaatatagggttcgttcgcacagtttcagctctagttacatcttttttttagccgaagaccaaccagatttagcttcacccaaaaaaggagtggagttgactaaactgctctcacaaattaaactagggaggtgaagctagacttaggcagctccacaatttcaatacagacccaactcctgaagttaaatttagaaattgaaacactaccaaacagactcatagtaccccatttttttaaataatgaactccttcacatgatgaatgttgagtttttggaaatacaccatgttacttattagagaacaagcgcaaaaccatcccggggaaaatgaagttatttgaactaagggagtttttgaggtaaaaccataaatcggtaatagacagggtcggtcaacgaggagcaacggcattgtcgcaatgatttcatccacatgcctctactagcatgcatattgtttgaaaaaatggcgatcctttcagttgccttcgtaaaccgcacaaattgaggtttatagttgactcatagttttttctctcaccggactcactcaaatgttgccatggttttcgctgtcaaaattgagaagcactagcaacaaacttgtcgtccagtgttttcataggcaattgacacccaacctgaattgcacatggttacaactataattaaagtactgagaacccgcctccgatcctcctccccatcttaatccaatatacatggttcgtgcaaggttttggatggtaaccgtgaaatatgtttcaactggaaatcaacaaactgcaacagaaggcaaaaataacatcaaaggagtcggcatgaccactctcttttctacaagaagtcggcgatggccttcacagagatagcaatattgaagtcgtcttacattgtccacaacttgatgtcggagcacttcaccacctggtattgccccatatggtttaaagaccggtgtcactttgtctgcttcctttcaactggatatgatggtttcaagcatacccctccctaccccttgaatctactgattgtttgccggaaccagcaaccacatggaacttcgccacccgggctgcctctaggcgacaagatccagcaactgcaagctacgcatccacttcaattgcctacttcaagttttctttgagttttgccttctgttgacacaaaatatgtcgtgacacacgaaggccttggagatctgcttaactccagtgcaaatcctaattttagggttcaagacgtattagttagtttgatcctacaactaacaaggatgatataaagaattgaaccaatgaaccaatcgaccaatactgatataatgtggtagatgcaggtccgatggttaatgctagcgtacatcggctggagatcttatgcaagtagattcgcatgtatatcggctagctagctgatacgtatgatagttgaagcccaaaattatgataacacatcagctagaactctaatggccattgcataaaaacctatcgccttacaagaatcaaacttattaacaacaataatctaatagatcagacctaaccgagacagtataagatcgaagatgataagaaaaacctatttagccaatagatctacacaaacatgatggatatcgaatcaatcaaaaacaacaatgtgattagagaaataccagcttagtcggaatatcggacctaatcgaggaagtactaagccgatacgactctaaacaacgatacagtcaaaaatagaaccaatatattagatagacatccttttgcatcaacttggttagaatattgtacctatcagagaaagttctaggcacactgatatagacgaagatgatggaaattacttcctcgctgaagatccaaacgatgtagcccaactcgaaactaagaacttgccggaataaaaggtggcaatgcaccgaaagtaattgtattgatgtgtggagatgtctcgtaaagccctagggtgtaaaaatttataccctcagattgatacaagtcttgatcaaacacgatacaagatttcttaataacaagaaaaggaaaataaataacctgtctattcaagatatatgtactaaaaatacaaaaattgcctcgttgtggtcttcacaattccttcttgaactcggtttgatctagataaacatccatctaccaattagttaatttctttaaccaaatccactaaagaaccgtaccaaatttcattaaccaccatggttaatgctgtggtgtttttgggcacaccatagcatagcctcaacgtttcttccactatcctcgagatgaggagaccggatgctagcaaacttgatcacaaaatgagaacaacctgattatgggagatatccgaccagcctacgctcactactaatagtggagatgagcctaatctggcctctccttcccttcacccacgtgaatcgccgagcccgagaggaaaatgggtcataaatgggagttttttttttctacattactttttgcggaagtcagggagggatcgagcaagagaacaaatgtccctcactatctcagaagcaacattatactactcctcttatctaaaaatataagagattttgacggaatataacacatcctaacacttattcagattcacagtactaatgtgtcatatccggttaaaattacttagactttgggatagagagagtacgttatttaaggactggcaagtgcttaaaatgcgatggtaatagttggtacaaacacagaaattgttttataagaattcgggctatttcttagtttttttaaagaaaagcttattccgggtttcaccggtttttaccggtaatatatcgagcggtaatcacagtggaaacgccgttcaggaactgtattcggtaaccgaacggttttaaacaagtggccgtggcgccgcgtccccagttccccacggcacacacatctctctgggtcgctgcaaccgccgccccgccccgcgcgcgaagctgcctacgaagccgcgggtggcccctggcccttctccgtgcgtgcgtgcgtgcgtacggccgcgggggaatcaacagatctgcacaagggttcaatacacaccagcacacacgcatatatgcacgtactcctacgtttcgccgccccgtactaggtactactgttccggcaacgacgacgagccggtgtgcatggtttcccactactgtgcatgcaagctgtctgtcttgcagacgcgccacgccacgccacacgcgacagtggtccatgatcgcgcgtacgtgtgtgcctgcgttttctcggcttaatttgcaactactaatcatgcttacttactgtctcgctaattaagcatgtggctgtgctgacatgtcgagctaggatggagcgggcggtgcactgcggcactgcacacagctgtgcgtatatgctactgtgggtagtcaacacggcggctgtttgatgatcacggttcagtgtaattagcacgagggttaaatttaactaacaacccgaggtcgtcgtcgccgcaggcacgtgtgtcttgtagactttttttcacggcctttttcgctggcctgctggctggctggctgcaggccatgtacacagccgtcgacgatgtgtcggaacaccaccagtactacgtacatgaaatatgcaataatggtttctcccaaaccatttgcttgttgtactaggtacgaacaggttgtgattcgaaacgtgtctaattaatcagaccgtgcagattctgcagaagtacacgggtcgagttattaattacttcctccatttcatattatataagactgtttagcattgtctatatttatatatatatactaataaatctagatatatatatatatatatgtccctagattcattaacatatatatgaatatatattggtaatgttagaaagtcttataacctgaaacggaaacggagctaatacaaattaatcaattactccacaataattaggacgctactactgtcaacacaccctgtcacgactctggatagacgtcggtcgtcagttccaggtcgatgtactggcccaaacccagccatgtacaagcacgacgaccggaccggttttgttggacacctgtacagctcaaaatgatggtagattccacaggagcgatcgatcgaaccaccatttcacgccaatgctcctcatactactaatcatatacgcatgcatgcacactgtgcttataactcatccacactcgaggagtaaactttaaggaaaaaacgtgttgctgttcggatcatgcatatgcttgctggttaattagctagctgttctgtggctgacatgctgcgtacgtgcacgtatgaagcagttgtactactactggccaatcgatcgaatcagtagaatccttccttcttattccctttgtctcctaattaatccgatcggttttcttagtatttcctctccattattgctaatgtagctgcacggtactgtgtacaaattgcccaaaaacaaatgacattatcagcatgacgctatcaaaaatggttacaatactcacaaccagttcagtctagacaagaataagcaaataaataagataagtcatggagttaattatacacagtctgatgctgctcagctgctgtgccctataaataagccatgagatgcagcacatcacaccagccggtagccacacacacgcattacacctacacctacctactactctcagttgttgcagccgtcttctttgcagtttggtccgaaccatcgccatctccatctccatcgaacgatcacacgtcggagtatcagaggtgagcggcggcggcgtcggaggaggaggaggagcaatggtgaagagtgggcaggaggcggcgccggggagcggcggcaatgcggtttnttttgggtttagttgttcttaggaaggtgtaacgcgacgctagcc

SEQ ID NO: 72914 - DNA, 11484 bp, Oryza sativa
ccctccccccacccccccccccctcctcccgcagaccgtgtcctgctcctagcgcacgcaaggtcggcacccacggctgccatgattcgccctccatgacgggtacctcattgatcttgacggcgaacccatccgctgcccgacgcccatcgcccgttgcaacgtccaggccacgctcgccagggagaactccaacatcatcggcacctgctcctctgcccggtcagcgagatgttcaccagcgtggtggcgaccacccctgtgctcggcgccggcggcgacaacactaccgatggattcacctgctccggcattagctgctgtgatgcccatcgccatcggctgcccctcctacctcgtgcagttccttagcctggactagaactaggagctcagcggcaagctacccatcgccgtgcgcatcgccgagcggggctggttcgagggcgtcgctgccaagctcctcaacagcagctcagacgccgccactcgccggtcccggtggttctagagcagtaggcggttacgggagctcagggcgcgcgaggcggaggcggtcgcgtgcgaagcggcggccgcgctatgtgatagggccagtgagctggagaggagcggcgccaagggcaatctcgccatcttaaaaattttatcacctcttttgacccaaaaattataaaatattgtatctggtgtcctacaactaattatacaattttggtagtatccatcagctatgttacgtttttatgatgtcttagccaattacaagttttttgagtgtcatgtagcaaattttgctgaatttttattatcaaagaaaaacatgttgctcccatccaaagataatgaatcaaaaaacatgcttgaaattaattgcatgtattcccatcgaaaaaaaaagtaactgaatataaagattgtctccactctcctaattaactgaaaaacatgttgctcccatccaaaggccttgttaggctagttcctttccataggtattggaggaggttaattcagcatccattaaggtgcgtagaaaatactagggatgaaaatggtatggaaatttttaagatttctggctgccgtttccagttttcaccgaccgttttagtcggtatcagtaaccgactgtggtggaaatggaaacggtaatttcttctggaaatggtagtggaaatgggatggagatttttccgaccgtttgtcggtaaccgtatttatacggtaatttccatcaaaattccgaaagttccccagcggctcagccacctcaacttatcggaagcccatgaatgaaagaaacccggtaggcttgcagcccataataaaaggggaagtgaccagggaaaatattgttaaccctatgacatggcatgtggattttgctgaactttagtctcctcaacttatcgatgttgaagtatgaagtattgttgaactttctttatgttgtttgtcaaacttattatcgtatcaccaattatcatataacggtgttatgtggagtgtgatggtgcaaaaattaagttaaaaattcatctacgtgcatagttaaatgcgtgctatgccacactccgctgattccgacattaaattttgacttccgaccaatatcggtatattccgttccgatggtcccgtttccgatataccgatattaccgatatcgttacaatttccgagtctattgttccgattccatttttgagaaaaaaaatacgaaaataaaaatggtatagggtttttccgaccattttcatccatcgaaaataccgaacaagccccagatgatataatgtacagtgcttcaaccttatgcatttaggagaagttctgaggaaattggagtagagtatatatgtataattttttttgcggggatatgtataatatcatttacaaatggaaaaaaaaagatatatcgtgtcgaaatccaccagatcgaataggtattcgcacctgcaaatcactacaccattccctatgaatctgtcagcaaggcccacatacgctgaaaaagctactctttcacacagagagggtcaggttgtcactgtacccacgacggaataaaaattgagcatatgcctaatttatatcacaatttctatatatatgattactgctcaatataccgacatatatttaagagcaatttttaaaaaaggtaaatagtcagaattatgttctagctttagctaaatatttcagagaactacaacattatttatttgccttacgaatttagcctacttatcacacaggtactagtacgtggataatactcgcactctcttaataagagttgttccacattccatatgcattgaggataaaattaattttctcgtaaaaccgtttgctatttgttacagttttatgaaatactccctcaaagttgtagcaaagagatagtctcggcttttgtgaaatttactttatatttagcatttacatccgctccaaaaatatttgtgtcaaatacaatccccagtttatttcaccccgtacattcaccaaacttaatgcaacaggcaaattgtatgtacatcattcatttaccaaaacttgaagcgacgtatatacatgccagcgcagggtttctgggtttgtacagtacaatcgcaacaaatcagaacaagctgcatccggcactcaataaaaggacctagagtacacacactcaaatatatttgtacgaaataaaatggtcacagaattaattcacgttacgcacacaataaaaaatcaaatatatatttagtttcatcacaattctgtctgtgagaatcaaatatattatatatatttagttgacaatattgtaccctttttgatacattgagagtagagtgtgcatgtgtacatagaactaaactcgtgtgcatatgagcatttgtattcgctacagaatactcaaaatttgtgtaatttgcttatagacataaaaaaacgtgtcatggctgaaagtcacttaaaaatcagtaatttgttagaggacacttttggctcaattggaaagataaattattaaaaaagaggagattgccccaagaccatatgcttcaaatatggcgtgagagtaaaatttagaaattatgcaaatctaaatttactatcaacccaagtacaccactaacatacatcatattccatcatagtaatttactggagggcattttcattttcttgaaaaaattctctcccaactaagccaaaagtgttctctagtagattaccagtttttaacaatgtctggcacgtttttacgatgtctaacagtaaattatacaaattttaaatatcatgtaacaaattttgtcagacatggaaccagaatgagtctattagtggagtcacaactacaactcaccctctgtttcatggccttcgtccatctcaatcacacacgaagccgaacttggctggaatacgaggccagggtctaaggtggtgtttagtaagggacttgtgcttttgtgagagagactaaaataagtccctcctctcccaaacaccacgtaaaccccacatttaaaatcttgcctggaattgtcccaatttccatgacacgtcgtgtctgacgaatcaagatgacagtaccatgttcccttggtcatttatgcatatgccaccaataaaagttgctcaccgatcgagcttactaaaaacatgaaaatttgttgtgtcgtgtcaccttcacggcaagtgtcactccttatcttgcctgtgtacagacatgcagtgagtgttattttcaccttatttgcaagctgtccatgttgcaactttcaccatttcacaattccccacatagagaagacagccaacaatcaacaatgtaatcagatcttcaccaatgccttgcccatgacacaaaaggggggccaatgaaggcagcccttcagcatcagatacccctgccaaggctgcaaatgccatttgggatgaggccaacaaatgcccatgaaccaaacgtagcaaccaaaggcagccatcgaaattgttgtaccctctcaaacacacataagccaagcaatgtagctgttatcacacagtaacaaggcaggcagccatttctggtttctgccaccttgtagcctgccatgtggggcttcaggaatttaaaggaccacactctcacacacacacacactcctccaacacatatttacacaagttctgaatttacccatcaaacttcttgtaatcctttgtgtttgattgtcttcaatgtatagagatgcaataatcttgtagaagtttccataacatccgtaccatatgctcttaatagtgcagtaacgtagggcttgcttgaaaggcactgcagtctaattataagctagtctaattataagccgcgaagacacaataacgaggaataagactaattataattttaggtaagactttcctacctatgctcttcgcggtcgaaaactggctaaggaacaaaaacgactagaaaaaccatagattggaaaatttaagttgcaaaaattcaaaattaacaagcatgccctacaggttttaggggaaaaaatatgtaaaatgcatgggtggatggctcttaattgtatgcagctaactgggcatccaagcacaggaggcaggctagctggatagtaacatgcaggatgcaactgctccagatttaatggctgcccaacgccggccaactatccgtcgatgtccccatctacacggaaggagatcttctgcagtagtgaagctagctgctgctgcgttggggttggctcactgacgtattcacatagtattattgtactcctatcctatctacggttttctctgtttgtaggatgctggtgagttggtgattgcgtttagacgagggctgtgcttaattgttagctctgccagcttgatgggtttttgttactcgctccatcggcctgtttagttcgtgaaaaataaaaaattttgtgccacatgagatatttaaccggatgtcggaaagggttttcagacacgaataaaaaaactaattttataactcgtctggaaactacgagataatcttgagcctaattaatccgtcattagcacatgtgggttatcgtagcattaatagataatcatgaactaattaggctcaaaagatttatctcacgatttcccccctaactgtgcaattagtttttttaatctatatttaatgctccatacatgtgtccaaagattcgatctgatgtttttgaaaaaaaatttggggaactaaaccagacctaaaatacactaagttttcattcgacacattctcagttacctcttcgaaatatataaggcataggtctggactaattggggctacaataaaatcaagtggtagtaaacttatataagtagtttagtgctaatagtctcattttaccaatactaggttgctaatatttggacaaagtttaaactagaaaagttgctatattttgagacggagtgagtattattctcaacactaggtgaaatctattatggaaatgtgaagttttatggagtcacaaattttgcgacttgtgccgccaatattgattgagatatattcagaaattctataaattattaagttatgatattggagttcaagactattgtatatgcctgattttaccgtgtacaatataaatgtatttttcacgaaagataaattgacactcaatgtttataaattcttgtatatcgtccaaacgtgtatcaataaatcttgcagaaaaaagataaagattaaatacagacacgtaaaacgagaaagccattaatacatgattaaataagctttaattatttcaaacttaaaaaatagaataatataaaattttcgtacaaaatagtgaaaattaattatgctaaaaaatcaagataaaatatgtatcccaataaaaaaatggaatctacgtcgcaagatctcacaaccccagcaccaaccttttggatcccaatcaatgccacaaaagaaaaaaaaaaccctagaatatccacacaattgaatgattgattgcagctcaagcttcaatccgcacaataaacagattttacatttctaaacctctaaaaaagaaaatgcaatattagattgttcataccctcccataaataatcctcctgtacaacataattgcaccctctcttctcttcagcacactcccactgtgggagtcccacaaaaccccccctcctctcctcctctggctccctctgccacccagccaccacaggatggcatcctcctcctcacctccactcctcctcctcgtctccctcctcgccgccgtcgccgccgccttcctcgcggcgcaagctctcgcccaacaccaaccccaagtaccactcccatctccactctctctctctctttgcatttcaagaaaccaagaactgtactgaccgtgttcgtgttcggtttcgtagggaaatgatacggcggcggcgggggaggggtggaggccgaggctgaggaagacgtacgtggagggcggcgccgccgggatggtgccgcggcggcggaggctggtggggaggttccagatatgcgcggtgtgcacctgctgcgggggcccgcacggggtgtgcatcccggcgccctgctgctacgccatcaactgcaacatcccgaaccgccccttcggcgtctgctccttcaccccgcgaacctgcaactgcctcaactgccacctctagcagatatgcagcacagcacatcagccaagaaaatcaggcaagaaaccccaagtaaaagaaaaaaaacagtaatgcttaatgctgcttttaatctctttgtttttttttctctttttgatttttctttggttggtgccaaatcgagaaatgctaagaagaaatttgtttgggattggaagaacacttggatcatatagttagtagttgtagtgagtggaaatattggtagctatgagtagctttgtgatggatggatggatggatgttttttggttagtttttttttccccattttggggggtgactggttaatgtggtgcctattgaattgtggatataattaattagtatcttggtatatttgaaacaaaattgaatttgttctgtattgttacgcatattcttcctagtggtcgtgtaatatataccgctttagtttactgtcttcaaattcatattgcagagctagtatggttcttctcagagacaatgggtgacttggtggatttctgttcagtaccagagaaaaaaattgttttcctgatttggttttgttgtgattgaatctagcatgtgtacaactgatgtttaatatgtggtgatgcgtggaatgcggcagcgatagatacagggtacatgcagcacgactcttatcaatcataatatcatctacaatgtcaagttctgtttcctttcttgttatgcttttaattgatgcaatctagcattcattctgttgcacagtttttggtttgcagttctaatgccttgttgatgtgatgtccacctgattctattagcacaattaactgaatattattctgactctgactgttggagaagaatctgatgaatttgtgtgcaaggtttcaaaaaaaaaaaaaacaaaagttagctctgatcagttcttgtagaagtatgttttttgtgtaggaaactttttagattgatgcatttgagtaagttttagtctaagtagttcctattataaagtataagactaggacaagcagatgtactgaagtaattaagggccagttcgtattagatgatattggcatctggcttgactcgttttcaatccagctgaaattccttttgaatactacatttcaagctctgccttagcatatgtcctcctatctgattttgaaggtttgcactttacactttgatattgcacatcagctaatctttgccttttctatcaaattttttaatcagctgtcctgagggatgcattccttctttaattctcctgtgcagtactacacaataactattaactaccgtcttcaatgaaagtaaatgttgtggttagtggctgtccattttagtatatgttttttatattgtttgctgtctttgttgacagtccatgccactatggcaatgtcattgagacatagaaaggaaaataagtatattagggtaggacttgtccacacttcatttggctcctaaaccatccatagttgccttctgcagattttctgtttagattattcgaagataaattaatgttgatggattaattattatatgttataaatctgataaatagcttgccacaagtggtttaagcaatgcagtagaaattatttttctttcaaaaatcatatttttcgaagcatgtactaaataatccgcaccaataattcagtgaataaacaaaaatgagcatggtgatttggtcatcgacatcataagtttctgttgcagtttagagccatttccaatgctcgaatttgctgaaaaaaatcgaaaactccaactaattataggaaaataacctcagggggtgaacagagcgcaaatcactgagagagagagaaacaaaataccagcaagattatcagattgagcgtcgggtcggatagatggtccaaaaagagcgtgccctacaggatatggttttttcacgctgtgatggcatttctaagccagcttcttcaggacactgcaacagtactgggcggcatcatggaccaaaaaaattagttcggtattaaattgagacctcgaccattgatttgtgctcttgtggtcatcaggcaatgcacatgagctcctgcacaaccacatctgatctgagtctagctggagctccaggcctgtcccaccctatcttattgtcatgtaaaaccctttaaccctcaaccatttgtcactcttgcgatattcggaacacggtaatttcacgggagttatgtacatattccgcaaaaaaaacatcatatttccatatgtatatatgaatgagtttttttttagcacctcaaacagtcaataatgccgagtacaattcaaacccaacttttgtccttggtgcagctagagattcaagtctcccatgccacatggttcttacagctatatgactcctcatgggagacaatttgtccttggtgaggaagatattgtcacatgaccaaagggcaggcacgagtgttgtatttaccctttgatggttgtgtgtttctactatctagtgggtgcctgatagtgtttgcaactgattctaaattttatgagttccattttggatggattttaggaggttcatttgccactttcgttgtccatctctcttttaatgattgataagaagacaactaaaaatatacctgaaattattctttagaactaaaattcaaaattagttttggattttatgataatgttgtgccaaagaaccaaaccgagctaatatgtatttatccatgtaaacaaacagagtaatttttagaaagtcccacatttttacttgtggcatataactataattgttgtggcctaaacattttataaaaccccccatttattcaaatctcgagtaatttgagcatatctaaaacaatatttttaaaagtagtaaaaagttaaattgttaacgttagtcaagaactcaataatttaaaatgttatatacactctgcattttaaaatttgaagtaaatctatactcaacatgcatagcggtactttaggatcataatatatgaggttatatgtcaccagtcaaaatacatcgtttgaaatatggggttttgtgaagcaatgcgctcagaaaaaactaaccccccacccccccacgcgcacgcgcgaaacagaggtagggtgtgtttagttcacgccaaaattggaagttcggttgaaattgaaacgatgtgacggaaaaattggaagtttatgtgtgtaggaaagttttgatgtgatggaaaagttgtaagttttaaaaaaaaagtttgaaactaaactcggccctagtatgtattcgtgctcgttagcgtagagtccccatcaaactttgaaactttgctgaagacattcgcatgcaagatgcaataataacaatacgaataatcacatcaaaagaagtgataataataataagagtcaaaatttcacctatattgtcatacttccaagtgatccttaaaataaaaagagaagtgagataccactaagctatatagaaaaataaaggaaaagaattactcattatgtttcatagttttagttgtttcttgattttttttggcaaattttgctataggacaataaaaaattatgtaatttactggtagatatcgtaaaaacatgtcattgttgagagactataaaaaactgataactttccagatgacacttttggctcaattagagagaaatttttcaaaaagacaagaatgcccatagggtcaaaagcctttgggctgaaactggagcgaagatggaatataatttatactagtaatgtacttggggtgacggcaaaattagagttgcatgctttctaaaattttactcgaacatcatgtttgaaacatgtggtcttaggagcattctcttctttcttaagaatttatcaatctaattaaaccgaaagtgttctctagcagattaccagttttttaggacgtgcttcagccgtgacatattttttcgacgtctatcaacaaattgcacatattttgggtgtactctagcaaaaattgcccctttttctggaatagttgttttttttgtgtatgttgagtatgttgaacaatatttgtttacttatacacttcagaggattttaaattcatagaaaaattactaagattctatttaatttagataagatgactactccatatgaattaacaagatccatgggtgtaaaattactagagattctatttaatttagataagatgactactccatactagtatgaattaacaagatccatatgataagatgactaatccatatgaaaaattactagagattctatttattttctttttaaacttaggctgtatttagatccatgggtgtaaagttttggcgtgtcacatcggatatacggacacatatttaaagtattaaacgtagtctaataacaaaacaaattatagaatccgcctgtaaaccgcgagacgaatttattaagcctaattaatccatcattagcaaatgtttactttagcaccacattgtcaaattatggtgcaattaggcttaaaagatccgtctcgcaatttacacgcaatctatataattagttattttttttcgtttatatttaatactccatatatatgtccaaacattcgatgtgacagacagtaaaaatttgtcaggggatctaaacatgcccagagtttggaggaaaccaaacttgaactcgaacctcgcttctcggtctaatcagttagatacattcaatgtaaaaaaagaaaaaaaaatcctatgagacgtcaaaaggccatttgatgagctactgta

SEQ ID NO: 72915 - DNA, 34688 bp, Oryza sativa
aaacaaacaaagaaacaaaagatggcaagtactgaaacaatatagtaaccttttgccgagaggaatcgttctcatagactcttcgtagactcgtcggagactcatcgtccgaagagatcaccaaagccttcaacacctcctccttctccttcatcgaaacctctatacaactatcatcgtcatccatctcttctcccccatacctaatcaccttgccgtcatactccagtacaaagtcctcattctcgtggacacgcacgttctctaagaataagcggtactcctcttcgatgtcggcgttgacatcgtacactgcgggtactgtagatgagcccttctccttgcctttcttgatcttggttttactcttgtgtcctaacccaccctggtaggacacagtggagtccatcgggttgccgcttgcagtagaggcggaggtggcagaagcatggtggttcggcttcggcatcactggggaagggatcttgggtagagggaatttgtgcctgtaacaccccaggaatcacaacaatcctgagatgccactaaacatccaaacaaccatgccaaaaaaagaaaaaagaaatttcagtagcatctcctttaaaacaaagaaaactcgcagaagtatcaacttagagatatatatgatcgaacaacatactaccatacaagaacaaccctagtccgagggaaaactcggttaatatccaactttatcacctataacacctaatctaaactactccctagaacacaaccaagacaggagaaaaaccttacatatgtccccttgttgaagcccctctctttcccccttctcctcgcttcttcccttctccctaatcctcgatttctcctcttttttagatgcagagacaacaagatgggatgggggtaggagagagattgaccagggggagatggtgggggcaaaaggcggccaagtggatggagcacgccctccctagggttttggggagaaaggtgagttggttgggccttgggctaaccccttaaccgacccacctagccctcccacgctaattttaagttttcctcttattatttcaagaagaaacacatagaaacatccaaaataagtttctagggcggtctatacttttttgtggtatcacagtgtcaagctcttgattaatgggttgtttctaatcacgcctgggcttcaacatcatccatcatcattctgctttggaattagtgctaggtaaaactagatgtcacatcaaattaacgggctatacatgacaagaaataattcagatctggttgtttttcaccaatccatttttaaattacacatcatttccttataggatcactttgaaaagaatgtgattgagttttccatctttgatcgcacagaaagtcaagctggttaattatgtggaaatgtggaattgatttatttctatgtaaatgcttttgcactttccatttttatgtatataagaaccagctgatggttttttttccacaagcttcgtcgcaacaccgttacaccactggtcatcgtcaaggttcatcgccgaactgttacgccaatggtcgtcagcgaggttcatggcctccgcgttatagatagtatatatgagaagatgttattgcagcaggcaataaataatagttgccatgtatttgcaggataatgttttccatcatgagtgcacatgcatagagaacatcaggatgcctgcagttccgtatattgaggatgcagatgcaggggtgctgcaggaccatgttgaggatcacgatgatgctcttccacctgatctctcagggcaaatcgtggacgagcaagagtaatccggttgaagaggcattgcaaaaacaatagatgtgtttattttgcaaccagaagggacagtacagcaccagctatagatgcccaaatgggccgcccgaatggcacgggccaagcacggttgggctagtgccaagggaagttgcgtcggcatggcatgattggtacttcgtgccgtgccatgccgtgccagcccacgggctgcacgtcaggcccaggcacggcccactagcactcgggccgtgccatgccggcccgaaggcacgatagcctgtcgtgcttctctattaaataagtctatttttactccctcatctctctgggatgtgtcttatatggctggaataagtctatttttgctccctcatctctttgggatgtgtcttatattgctggaataagtctatgttgtatacctcatgtctttgggttgtatctcaaatggctgaattaagtctacaataggtccctcaactatttttctttggtcgtgtcgagccgtgccggcccaccgtgccgaggaagcaacctaggcacgtcatggctatcgggcccggccggcataagcatgacccagtcgggctgtgccgtgtttgggccgggccaaattgcctgtgccttgggcgggccgcgggctcgggccatatggccatctatagcaccaattgcccttctaatcttgagaatgcgtcaaaggccaaattttagtagatgtgcatgctagtgattccaattgccagatcattttgcattgtattgtgttgttattttgtaatctcttgtctagctcaggccttatcactttgataaattatttgtacttgttgatattttaattcctaaattaatgttattaaactcctctgtaaaaaaaatcatatgctagatactcactccgtcccaatatataagggatttcggacggatgtgacatttactagtaatataaatctagacaggctccgccatattgcaccatattgccatgccatgaggtactaccatggtaccgcaaagccagaaatcgtgatagaacccttcgcataactccccctaatcaagcgcaccacactgcaggttttgcctccacccctaaaaacaaggtgggaagcccctctattaggggtggcaatttccccgttggggccggggatccggcgggggcccgcccctacggggacgggggcaggggagaattctgacccacaggtgagtggggacggggccccacaaacttccggggatgggggcagggatcggaattaacccacgggtgatccggaggggccccagatgtgaggtacttctcttaaagtagctcattgcaataatatagatccaacaaacccattcaaaattgacaaaaaagctcaacaccctagttcccctcaaccataatacctttcctttcttcaaacaacccacacaaccgggagctattgaaattttatcataatattattcagtgtattgcaatattttataatgtattagctccatccgggtaacgccgggtcgcggtcacccgctaggtcccttgtgggggcggggacgggtgatgtttttcacccgacttcctttgcggggctggggacggggatacccgcatgagggcaagggcgggggcattccaacccaacccggccccaccctgccccgttgccacccctaccctctgtgccacaatgaatccaacaactacttaccccttaaaaccggggataaccaaactccatcagcccatgttcacctaggtacattagaaaaggaaaagatatactacaagtccagtagtggacttgtagttgcccacactagcttgtggtaagcacgacaagtctttcaaggatttcccatgaaccggtctttaattgccatggtgtgataataaaaaccatgcacccacatcccaccattaaaccatattttagttgaagaactacaaccaatgaaacatggccaagtgtgttgagctcacagctcgtcaatatactagatgtaaagaatgtgattatcccagtagtaattaagcatggctaagcataacataattctagctaggtcaagacaagtgacacaagcgagttaaattatcatccaagttatcaaggaatgaatatccagtaaatatggtcacaagcaagcaatccataccccatgtaattagcaaaatatatattttttgcaaaagataaaaccttttataaagtaggctcattatgctcaaagtggaacgcatgacttgccttgcttcttcatgttggcatgcaaaacagggaaacacactaataaaaccaagtaaacaatacatggaaagtaaacaaacatgtatagctcaattttaaaagaattttgcaagttgaatggcccaacttggagttcgtatgaattagatatgaattttagaagtcttgagccatttaaatgtgtttatagaattaaactccatttatcgtgtaattattatttatttctctaaagtaaaacaagaaggattattgcgtgagcagaggacgggcgtggaccgagtccacaaaaagtgggccccacgaatcagcagctcaaacggagttgatccaccgtgtactgagaccacaaggtggtccatgggactgccatgcgggcccgccacgtcgatggttagggcgaccacaggcatgcgcaggcacaacagattggcagctagcgccagcctgatggtcaccacaggcgaccactcgacacggcggcggcataagaggcggcggaagggacggggaaaagggaaggggcctcaccgagcacccaaacaaggaaggctgcggtgcgcggggctcggcgacggggagatggcggctactccgcttgtggtagcggtgaggacgaagattcggggctcccggcgtagacagaggggcagccgcggtgcatcggtccctggggaacaatggagaatgggctgggcggacttggtgagaagggatggcgagaggccaggaagaatgggtgaactcatccgacgtggtgtcaaagggattccggtgacgaggagcttcgaggaatagggtgcccggtttcctatcgccactgcgaagccagtgaggaaggacacaatgccggaggtggcctggaggctggagcagcagcgagtgccgaccaaaggaggagaaagcggcggtggcttcgggttgcaggaggaggtggcgcttcggcggtgttcggtaaggcggagcggaggccgagttgcctcttgcggtggcggagctaatggtggaggcggcaactccaatagcgggaaattggagatgggacgatagtgaagctctatatagctcgaggaagcagctctaaggccgggacgaggcggataggaggagccggacgtccacggggagtgggggaaggcgtgcggcgattgcattggtgtggttcgagatgcgagggcgggaacagggaggcgcgctagatgtgtgcgctgacatgggggcgtagccggttctcccgacctgaggttggagaagaaaatggcaggtgggtcctggtgccaccagttagtcagagagggagcgaaatagacctcgcaggaagtagggggcatgtgtgggccgtcggaaggagtgggcccaacatctccagcagggaggagggagagagggcttcggcccgtggggaggaaggaagggaaataaacttgggctggaaacagcccaggacagagagggggattttaatttatttttccatttttaattaattgatgaaatgaactttgtgttattaaaattaattagtgagctctaaaaattcaggagaaattccaaagagtaggagaatattaaaaaaatattcccagttatgatttctaaaagaaattttatttcccacattaaaatcacttgataaattgatggaggcggatgcggacgatttacggcacaaatcaacaaagatggacgaactaggctagaactaggtaaaaagtagatgcaatattgaaaaaaagcgattcaattggttaaattggattgagattagattgttgtttcaattgaaccggccttgtcccatatacaggggctggtcttccctcctacatgttctcctctatgtcaaacttgggatagaaactaatggaaacccaaaacatgccctctcaagtaaggaaatccgatatccgacaaaaacatctctgaatcgaactctatcggtcgaccagctacacttcgctggttagaccggctcatcacgttggtcaaaccggcccatatacgtacggtggtcagaccggctctgtgaaggaaaccgacgcctttcaaattttggtaatgtttttctatttggaacctaggtgtcaaatttgggtgtaaacattattttcactgctagttctagtcaagtgattgttatttttccttgataaaaaggagtaccttttgtatgtctgagtcgccttggttgatttcaatcttcatcggcatcagctacaatactaaaacatctgtgcatactcgatagaaaaacatcggtgcatactcgatagaaattgcagattaatgtagctgcagctatgcggagtcttgaacatttgctttgcttgtaggatggcatttttacgtctggaaattttaaatttatttgaattgtgttgttcgaaatttcaaatttgatatggttgcactctagtctctatacattagaaatatttatgtttgaatttgtgcagagttaaactagacgtagatatagtgtacattgctggagatgaaatttttttttttttgtcctgaagaaatggaggtagccccatttagctcgtaggaagtttaaatacggacacaccaaagaagctgcataatgaaatcatgctatatgtggccatgtatattaaaaaatttcccaaaatacaatttaacaaggccgatgcagcatactaaatcaccaatcttgatgtggcacattgtaatgtttcggtgaaaatttaccatccttttaattacgcacctacaatgatgtctccagatatagctgaggtatttatgaaagacatgatgatgcctacatatcatggtagtgcacgcaacaatatattgccatcaatgtgatttgaaaaaaaacacaaaaataaaagttatcaccaagatagacggatacacgcagtaagggtgcatagctaggcgagacccatgctatgttgacatggtatatctaggtgggcccagctagccaacatgcgtagtagcaaagggttgtaggtgcacttttagcatcacctataagagaataataggtatcagacaaaagtgtcacgttgcaagaattgtgtgtgaaggtcggcgtggaggcatgataaaaaggcgtacatgccgaggtttgtattgcgtggaattaagactacaattgcactacaccatggtccactttcgccaacacacgattatgttggcaaaaggcatattcagcaactacacaactgtcggcaaatcctttgccgacaattttcaccatagtcggcgttgcagcagctggcaaaagtttgttgacagttttaacatttgccaacacataccctgaaggctatgatagctatctttgccaacagataaatttaccttttgccaacacttcatgtttaggggcacaatacttttgccaacagacttttggttttgcaatatgtaacataaagccaaaagtatttcaaataaattaatttcatcgagttataaattaatattcgtcatagcactggtggagaaagcgtttgtagtctcggttcgtaaccccctttagtcccggttttcaaacgggactaccaatccgggactaaagatcactatctttagtcccaggtgaaataaccgggactaaagatcgaactgacctttttttttttgcatggccctgttgctgtatataaaccatgcatatagtttcaatacatatatatgcataatatatatatatattatatttatatatgtttcaatacatatacatgcataatatatatgtatttatacatatatatgttatgcaaatgcatatatgtgtatctctctctctctctatatatatatatatatatatatatatatatatatatatatatatatatatatatatatatatatatatatatatatatatatatataagaggaccactcttatgtactcccaggtgtacatactctctcttccatattggatctaataggatccaattaggacctgcttagctggtgggaatttttttttgaaattcctgattttcagccgaacagggaataagccaagttaaaaaaaattaagttgaaaaatatccatgcatgtcggcatggtattggttgcacgcctgtatctacgaatttgaaatgtagtatttgtgcacctagctgtagcatggaaattcatgacttatattctgttttattttagattaggtatatacttattttttaggaaccagtatatactatatctctgtttggaagattatataatttttatttgatgatccagtatatactaaaagctggtttgagaagtatatactacttaatttaagactattagtatataccgttatctttagagtctattagtatctgccacttgttctagatttgtttaatgagcatatactgttctatctttttttccgtatgtaaagagtcagtatatattgcattcctcattgaagatctctttgtttagtcagtatatactacatttctcgttaaatgagtatatacacattatttcgttgaaggagtatactgctcctttggccagtatatactacgtttgtcattgaagtttgtagctctctgcttttggtcttttgcggcttaagatacgtggagtaatttgtttgaatttcctcattccaaatggcgaccgttctacaagaaaatattaaaatattatatcagcatcagtaagaaaatatttgactcatcaatacatgtaatacgagatagaaagccttaatctctgcatcctcgctgacatatcagttagtaggcatcctcgctgacatatcagttagtagggatcagagagacagcgactagtagtatataccagtgtttctagagaacaagtataaatcacttgttttagatttatagatttatagtataaaccacttatctaaatttgtagtgtgtactgaattttttgttgaaggagtatatactgttcctttttttgggaatacgtactattcttttctctcttttttttcagtatgttactacttttttggtgtaaaaaagcactatattgaaaaagtccagcatatctatggaaaattcagtatatacttttgtgtaacaaagttcagtatatacttgaccatagaaaaattcagcatatagcactccatagaaaaatgcagtacatacaaagtccaaaaatcagcatatactcctctattgaaaagttcagcatatttatggaaaatgcactgtatactagtctaacaaagtgatcagtacatacccctccaaagaaaaatacagtatttaccactccatataactacagtatatacagagcatgccgccatccagcatattgttctagcacgccaccatccagcacattgtgacgagatcgatctggtcacagcagttggcatcgatcgttgccacggcccgcggcccctgcgtttgttgatgcatgtgaaatcaaataaaatctgatgcatcaattatgatcgacacaatcacctgaccggaattactgctgcacgggcagcacggcctgtatgccagccgatggatcgatgccgtcgtgtcctggacgctggccgggaagcggcgcgatggatgacgatggcgccggaagcgcctgtttctaccaggcaaatcctggtagtctcgttggatgatgatcatcagttggagggggctcgccgttgccgatgctgtaaaagctagtggtgtaggggtgtctccagcgctgcttgttgccatggttgtatgatttcagcgagccgatggattgtgtcgtcatcgcctccggcttgccgatgggctgcactgtagacaccgatctagtcgtcatgacgtggccgtggactggatgtcgatcgaatcgtcgccgtcgatgccgagttgccaacagatcaccctgccgaaaatcctcgatggatctagaagaaaaagagaaaacagggtggacataccagaatcaatcacctgggaattgatcaagccacccgcaggtggacgaactgcattgccgccgtggccgtatgattcgatggatcacgtcggcgtcagcgcgtcgcctccaaattgaccgatctattatttgcagtccggtttagcagtaagtcagaaagagatatttatgctagcatcttggtatggttacggttaatgcgggataaaagtattatgaggattttttttcgtccgcaaaaactttaatgggtctgtatgtggattcgttagcaggttcgatcggtgatgtccgctgatggacggtggatgagagcaggagtacgtacacctgggtgtatagaattattttcatatatatatatatatatatatgaaagcacttaatattttatgtgcatatatatatatatatatatatatatatatatatatatatatatatatatatatatatatgactaaaatatatatttacattaaagaaaatgtgtacatgtatatagaaaaatagatatgtattaattacaatccattatgatgtcctagctagctacgatttcgacgtagtagtagtcgttatcttagaagctaagaacctatgaattgtattttcgtcgtagtagaattcacccttgggatcaaggatttgttcattgatgaatcccatgagttgttcttgaaccgccacgataaatttcttgtgtgtgatcaggttatccctcatgcgaataaactatatgaatgtatgaaattaattagtaattaaacaacaaatcgatacatacgcaatgaaattttgaatttatttgtacgtacatcgagctctcttgtggtgatgatttggtctgcaaggcagtggcaatactcgcacacatagtagccgcataagttagttccctgcttttgctttgcgcactataaataaatgacaaacggcgagagatctaattaatatacacttatatgtatttgaattggagattcaatataaatgtagagcatgtgtactcactggaaaattaaacttctgcctaagtctttctctccatttgccgcggaccaaatgacggaaccgataccaagccctagatggagtttaaagctatgattcatactagcaattaattataacaagattcttaattaacataggaaattttgacagtacctgtctataagttcgaaaaccttgtcaaacgtagactcttttttatccattgagccatatacattgacggtgcaggcctccaagtcgaagagtaaaaggacccagtggaatctgcaatgtgcgtcggatgcattacatatgaaacacttagtatgttagtacggggatgaaatttggtataggaagacagtaaaaactaactctgtgttgtacggcaatagtatgaacgtcttgtaatgctgcgccttcaggagatggacgagattgtcctctgtggcttgcggatactggtcgagcattgcgacgtttactttctgagggtcgatgaatccagtatcgaaaaccccccgccgtcgggccctttgaatctccattctacaacgataaaaggaagtatatattatatatagtctacttatatacaaggacctaattaattaaaggaaacgtaataagaaatctaactgaacgataattacaaaatccagcaactcataatagagacgtcgagggcgtccagctggtatagttcatagacacccttgaaattgatccagagaatatcatctccttgcaagaagtctatgtccctgatcctcgctccgatcatctctctaccggtggcgctcatctccatgtacagttgatggaatttgtacatttgtgtgggtagggactgcagctgctcaggcttgacaggcgtccatgctctgtgatcctacctgccccgttgaggcgcagctgctacgattgcctgaagggctcaccattgcagggggaatggtcggctagggatcatgggaccgatgtgcggccatgcgttcatcaaccttccttgccacctcctcttgcatgctgagctcgtagctcgataccctgtactcaagatctgcaatcttcgcctcggtatctctcttgctcctcatccgactcctgtacgtgtggatgtcctccttgaatccagtcttccaaggaatcacccctttccctcgtgttcgtcctggatgctctggagtctgcagggcgagtgacagctcgtccttctctctgtcgggtcggaacgtgccctgagaagaggcttccactgcgtccgttagtcgacgcacagcctcgcgtatctgatcgctgaagaccagggagccatcaactgggtttagcgttccaccatgagcatagtaccagaacttcgatcgatccggccatttagcggtggccggttcgatacccctcttaagcaagcttgctccatctcctcccacttcggcagcgcgatgctatagtcgcctgaccccaagtagtgatggtacttcttcttggcggcattttctttgtttctttccatcatcgcctgcccttgttgacctgtcttttatgcaacgaactcgtcccagtgatcccttagctttgggaatgtgtcaaagttcagtgtctgccccttcaggatatatttgtggtacaaatctcccttgaagctctgaaactgttctgccattttctttaaagtccaccttttcactttgttctctgtacccgcggaaaaggtgaatatctcgagcattgtggtccacagcatctctttctctgaatctgggacaaagctctcattatctccgcgtgcccttgttctgcgccagtactgacaggcacgttatcccacacaacccaaccgttgtgtcgaacgtagttcttggctgcttctgccggggcactaggtcggccgtcttcgtccacttccgttatgatgtgccaaccctctagcttcttcgcggcacctcgttgcccgcgtgccctcttctgtccagcggagggttgacttccactagcctcctcctccccgttcccctcctggttcccctccgcatccctctccacgttcccttcctcgttcaagttctggtttggatcctcgttcccctcttcttcgttccagtactggctgcttccctccgcgattgtatcgtacagtatctgttcctcatcacgatcagccatctgttcatagaagaaatagttatatatgctaagtctaattgtcgtatattagaaccctagacaatcatatatcctaagtctaattacaaatctaataatcttatattaaaactcaaataatcgtgtattaaaactctaataatcttatattaaaactcaaaaagtcatatatgctaagtctaactgtcgtatattagaaccctagacaatcatatatgctaagtctaattacaaatctaataatcttatattaaaactcaaataatcttgtattaaaactctaataatctcatattaaaactcaaatagtcatatatgctaagtctaattacaaatctaataatcttatattaaaactcaaataatcttgtattaaaactctaatagtcaactatgctaagtctaagtgtcgtatattaggaccctaggtaatcatatatgctaagtcgtctaagtgtcgtacattacaactctagataatcatatatgctaagtctaagtgtcgtatattaaatctaatagtcttaattgcattaaaaatctaacaatcatatatttaattacatcacttgcctgcgcgaattccttcgagagctaactaccactccggcttgagggacgacaacgacaacgtcttttctgcaacatatatgtcacagcctgaattttcgttttaggatttataaattatctaataaattattaatagaatttatattaaatgttctttaatttacaagtgaagttaaatgtgggatataaaatttcctaaatataaagcatggatggatttaatttttattaaattctccatgattaattacactctctgaaattttctcggatttttcagagctcaattcctaaatgatacaaagaacagttcagtaattagttaatcaattaatgatctaattataattatgttaagtgcttttcttgtttaaaaatccttaatttataaattgttgtctaaaaggaattattagaaattatcttaaaagcctagaagagaagatcgaatttttttttaatttgttaaatctcaatataaaagtgggctagaaaaaaaaatcattaaatactttacttgattctatagttcctagatttttctgggatttatttgagccaaggaagtatttttaatcaatagaatatcatttcatgaataattttaatagaaaaaggttttaaaatctttcttttggttttgggccgaaagtcagcccaagtctctctttctccctctcctcggactgcttgcatctggcccagccggcccagtccaccgcgcccctccctcctctctctcagccgctgacaggcgggacctacctgtcggggtcgtcgtcctcctcgagctgcccggccgcgcccgagccaccgccgctgcccttccaaattccgtcgcccctctctttttccggtcaaattgattgagggcaaatgatccttgagatctcctcttccttttctcttttggaaacatcggctaattttctttggaaaccggtggatttgagttggattcggattcatctctctcctctaaccctagactttccttctcgccgccggtcgccgtgggcctccgttgccgcctcctagccactataaaagcatccccgggacctcctctatccgccgccacctttgccttagcccgccgtcgcgtctagcgccgcctccgcgtagccctagctgtcgccgtcgttgccgtcggttcagccgcgccgcgccgccgttgcagccgccgtcgtcggtcgccgtcgccaccatcgggatcgcgaggtcgtcgccgtccccgtccaccgcttcgccgccactgtagcacgccggagcaccgccgtcaccgtcgacccaaagaccgccgctgcttcaacctcgttgccgtcgtcatccgtcgtcgtttgtcgtcgtccaagatctcggtgagttcgccgcgtcgccctctacccgttggtgtcctctgtttgcgtcgtcgcgccatcgttcaccggcgagcatgcgttgccaagctgccgccggtgatgacgtcatcgctgacgtcatcgtcgctgtccccgtagacccgctgtggaccgttttgatctcggccgcccgttttggatagaatcgatctcgggcgttcgtttccttagaccgtcctgtgcacccggtttaccgtggaccgcctttgatgacgcaataatcctcattttccttttcaaaaataattcattattgcgtcataattcaattaaaatccatataaatgctttaatccggtttaatctttaaaaattcatatctaattcattgtaactcggtttaatgtggttcaagttgcaaaagttgtgtaaaataaagatctacatattaaaattatccataaattgaattaaatttatttaattctttttaaatgggctttaattagatttaatctagtaaaattcataataaattcatatgaagttagaatgaggccgttcaagtctcataattcatctaaaattatgatctacatgtttttttactttatatgtattgtttatttggtttttattagtctttttctttgttttgcatgttagcttgtcgtttccgtcgttgcgaaggttcgtgagtgcgtcgggagtgttcagaagattaattgaacaccgattattgcaaggcaagtcacacagatcctaaacacaatcctttgagcatgttgatcctatgtttaaattctctatttatttcaactgtgcatttattttcgaatgtcactgggtggtgtgaatctattcctttgttatggcctgtttgcattgattactctattccttgataccttgggatattataatttgactagttgagctttatatatattggttccactagatgttagatataattgcttagccatgtttagaaacattagctcactaatgggatgaaccatatatattacattattatttatagttatatttaatggtagctcacgatggttaatcgtgttatgataattaattggtaattaaaatatgattaatggtgggttgtgagcacatggttttgaaggtcgtgctcatggcaattaaggaccagttcgcgagctactgttgtgaaacattaaccgtgccaaccacaagccagcgtgggcaacggctttacattttgtatagcatggttcattgcggagcaccagactgagaagtggcggagataagcccacgggggtcgctggggagtccatgccttgtttataagggggtgattatgatccaggaacggtgcactgctttgagttgtgttgtgcgaggggtactgtcacagctcctttccgaggtaccgtggtggtattgaggcgcatggtgacatgttgtggggctgtgtcttgtgggtacagtggtacacctctggccagagtaaaactattcgaatagccgtgcccgcggttatgggcgggttgagcaatgtttttcgtgattagtctcacacctctcacaataattattgatgctataactggtaataatttgtttagcttctggtttggagttagatctgtacagccgggtatggttgttcaggatggttgggcctgtgcagcatgggtgtgctgttcagtgttgattaaaatttctgattaattactctactgttttactactcttaactctatgctaaatgctgcgctctatgctaaatgctgctttcgcaaatgagactatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccctagttgagctgcctgtgggagtggagctgaagccatcgctagaccgttaattccgctgctgtttttcttttcttttgtaagtatgtaacgttattattatgatggatttgtatattaaattgtcagtttgtgtacctcggctgattcctggactaggattttatgcacaaattagttcggaaattattagtgaatttccgggcgtgacaatataaaaaaatgtattaggataaacacaaagtaacatatattgtatttcacattcgcgttctcgttaagttcacgtttcgttcacgatcgttcacgtaatcgttcgcgttctcgttaacgtacgctaagttcatgtgcctatcacgtacgttcgttcgttcacattaacgtacgttcgttcgttcacgttaacgtacgttatgttcacgttcacgttcacgttcacgttcgttcacgttaagttcatgttcacgttaatttcacgttcgttcacgttcacgttcacgttaagttcacgttcgttcacgttcgtgttcacgttcacgtacgttcgttcgatttctcattcacgtacgtttcgttcgttcacgtacgttcgttcgttcactttcacgttcacatatgttcattcgatcacgttcacgtacgtttcgttcattcacgatcgatcgttcgttcacgtggcggcagcggagcggcggcgtggcggggcggctgcggcttggcgcggcggcggcgtggcagcgcggcggtggcatgccgcggcggcgtcggggcatcgcggcggcgtagtgtggcccggcgtcgtcggcactgctggcgcgatgtcgtcgccggtggcggccgcatcgaggtcggggtcggcatcgtcgagaagcagagtcgtgttcggccacgacgatgtcgacggcggcgtcggcaacgaggaggccggcggcggtttggggagagagagagagagatcgcgaggtcgtcgagagagagagagggaggcggcggcggctctcaccccagagatgcggcggcagcggaggcggtggaggcggcgacgacgacgcccgcgagacgacggcgagatacgacggcggcgttggcgcggggatgccctaggcagtggcggcgaaggagaagccgagagagatcgatcggggaaaaaacttctaagtgttggtggagaagacgagaatgcgcatcgggaatatatatacccctagatctttagtcccggttcgtaagaacaaccgggactaaagatattttcccgctatttccaaattctttttaaacccggttagggttaagaaccgggaccactgataaacgcaatgaatattgattttcattacatatgtgtttctaaaatagaaaataatacattaaaattttttaaagtcgaaaaattaatgacaattactttgaaaaattattgttgtctgtagtaaattaagtggataaaacgtaataatcaaatatatgatttaaaattaataaaaattctaataatcatatataattagcatatgcatgatattaaattgttaaaaattaaactttaacatatgtacgtaccacatgcatgattcaaaattaataaaaattctaataatcatatataattagcatatgcatgatattaaattgttaaaaattaaactttaacatatgtacataccacatgcatgatttaaaattaataaaaattctaataatcatatataattagcatatgcatgatattaaattgttaaaaattaaactttaacatatgtacataccacatgcatgatttaaaattaataaaaattctaataatcatatataattagcatatgcatgatattaattgttaaaaactctaattaacatatgtaaatgtcacatgcatgatttaaaacttttaaaaattctaattatctcatataactggcatatgcatgatttaaaattgttaaaaattctaataatcgtacgtaattaacatatgccatgcaataattgatttatatggataatcaatacattcaaaatagtttacattgtgtacacaataattacggcaatacatcggcggtgacggttgaccgcacgtactttctcctcactattgttccctccttgtgatcgctacgtgagtaaggggtgtttcatttgataggaggatgctagggtcaatcgtcaccgtgacgcttcggctcgtcaggccctctgcccattcaactgatcataatcctcatcagtcttgtcctcaactccgacgatttttcttttgcctgggagaaccacgtgacgcttcggctcgtcaggccctctgcccttctttcctttgctagacatgtccttcacgtataagacttgcgttacatcattggcaaggacaaaaggtttgtccgagtatccaacattgttaaggtcaaccgttgtcatcccactgtcattaatcgttgcgcctccaccagtcaacctaacccattggcaccggaacagagggaccttgagaggaccatagtcaagttcccatatgtcctcgatggaaccgtaagacgtgccagttgttcgatcgtgtcccatggcatcgatacgaatagcgttgttttggttcgtgctcttcatgtcttgggctctcgtgtagaatgtgtatccattgatctcatatccctggactgtcgcgatcgagccagatggtcccctcaccaggaaggccagttgttggttgatcgtctcgttaccaatgagatgttgccgtagccatgcggggaaagtatcaatgtgatgccgtgtaatccatgcatctgacttaccgatgtttctggcacgaactagagccaagtgctcctcgatgtaaggagctaccaatgaagattgttgcagaaccgtgaaatgggctttacggaataaattgttgtctaccatcattattgctttccttccgagagttccctttccccgtagtctcccttcatggcgtgattcaggtaccccgattgggcgaaggtcttcaataaattctacacaaaattcgatgacctcctctgttccatacaccttggtgatgcttgcctctagacgagcacggttacgaacatacttcttcagaacgcccatgtacctctcgaaaggaagcatgttgtgtaggtacacaggcctgagaatactgatctctttgacaaggtaacaaagcagatgcgtcactatattgaaaaatgaaggtggaaatatcaactcaaaactgacaagacatttcaccacatcattctaaagggcttctaatctatccggatcgatgaccttctgcgaaattgcgttcatgaaagcatatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccaggtgaaggtcgccgcgttgttccatatgcttcagatcattacgtgcttccagtgtatctttcgactttccatatacacctaggaagccaagaaggtttacgcaaaggtacttagtgaggtgcatcacgttgattgcgtggcggacgtccaagaattcccaatagggtaactcccaaaatatagagttctttttccacatcgccgcgtaaccatcttcgctctctataggctggcttccaggccctttccgaacactactttaagatctttaaccatagcaaacactgttttcccgctgcgatgtttaggcttcgtacggtggtccgccttatgttcatagtgcttgcctttcttctgtaccgagtggtttgtagcatggaatcgacgatgacccatgtacacaaccttcctatagtgcttaaaatacgtactttctatttcatccatacagtgagtacaagccttgtacaccttgttggactgaccggaaaggttgctaactgcaggccaatcgttgatggttacgaacagcagcgctcgtaggttaaactcctcctgtttatcctcgtcccacatggggacaccttcctttttccacaacagtttaagatcttcgaccagtggtcttaggtacacatcgatgtcattaccaggttgcttggggccttgaataataatcggcatcattatgtacttcctcttcatgcatagccaaggggggagattgtagatacatatcgtaatgggccaagtgctatggccgctgctcatctctccaaaaagattcatgccatccgtacttaaaccaaaccatatgtttcgtgcgtcctttccaaagtctttaaatttcctgtcgatgtttcgccactgcgaaccatcggcggggtgtctcagcatcccgtcctgttgacgctcttcagcgtgccatcgcatcattctagcattccccttgttcctgaacaaacgccttagccgtggtattatagggaaataccacatcaccttagcaggaattctcttctttgttagctgcccgtcaacttctcctggatcgtctcgtctaatcttgtatcgtagtgctttgcaaacagggcatgcttctaggttctcgtactactcaccgcgatataggatacaatcattcggacatgcgtgaatcttctgaacttccagtcctagagggcagactatcttcttagcctcatatgttgtctcgggcaatttgtttccctccggaagaatgttcttgacgagtctcaattaatcgccaaatgtcttgtcactaacaccattttttgccttccattgcaagaactccagagtggtatccaactttttgtgcccctgctcgcaacctggatataatgacattctgtggtcctctaacatcttgtccaatttatgggcccccttttcactttcacagtcctccttggcgtcttgcaacatctgaacaagatcatccggaacgtcgttaccatcagcatccctttcctcctcgcccgtttgatttccttcaaatccagcgtactgagcaaagtccggaatattgtcatcttccacttcatcttcttccatttcaaccccttgctctccgtgggatgtccaacagttatagcttggcatgaagcccgactcaaacaagtggaaatgaatagtcctggatgcagaatactccttctgattcttacacttatttcatggacaacaaataaaacccttatgcctgttagcttcggccactctcaaaaaataatgcacgccgtcaataaactctttggaccgtcggtcagcgtacatccattgccgatccatctacatgagataaaaaaaatcgaacacaaataattattcgtacaataatgacagtcataagataatacaaactctttcaacagtcatacaataatgacatatcattaatatcattattcatacaaaaattataaaatattacaccaaataattcttatttactatttctaaagttttaaactaatattaatgtgttgtacttcttttaattttcattttagtttgttttctattatttaatattaactttcactatattttccttctcaactattttataaaaccttctttagcaaataaactaaatttctatatattctttcttccccacacaaattttctctctcatcaacttacaactaaattttggagacaaaaaagtgtgcaaaacatagctccaaatgtaatatgacaaaaaaacattggaggatgaagttgctaaccttgtaggcacctccgatttgtatataatcaccaaaataaattcactagaaattttggcatgacctcccctcttttttgaagaaattttgaagcttgctcgggcagctggaggaggaagaagacatatatatatatatatatatatatatatatatatatatatatatataggggtgtgactttagtcccagttggtgttatgaaccgggactaaagatcccggggggcctgacaagccctgacagcatttgaaccaggactaaagatctttagtcccggttggtattaccaaccaggactaaagatcaaatatacccgttacccttccaggtttttattgcaatcgggactactgtggaattcggccgaccgacgaaagatggtttctccaccagtgtagcccatacatccacaagcattgtacatatttcaagaatacatttcaaatatcccaaggttacattcgttcagttatgcttttcaaatgctcaccaccttttcaattatgagaaggctaaatttgtttttcaaaaataatctttgctatatagttagttttagaattctttttacccatgtttaatgagtaatccaacaactatctcactgaccatatcaatgtttaaaatgacacactggaggatctatatgacgatgattttgcatatttatgtccttccatccataccttaaggaagaaccgaattttttttcaagtgtaacaaaatcatgtgatttgcggccgtgtgtattcaaaattttcccgaaatgcaattttagaagacacactctaatttcgtttaggctgcattcctagttacgttcattttgagtagattgggagaaaaattactcgtttttcacgcgcacactttctctctcctaaacgatggtttattgcaaaaagattttactttaaaagtgcatattaatatatttgtaaatctaaaataattaacactcaattaatcacaacctaactataactcttctcgttttacgtgtcatcccaatctttttcattttccccttccaaactccacctttacccacactgcaaaggtgcaaacgattttgaacatatatatatatatatatatatatatatatatatatatatatatatatatatatatctaatttgtatacaaattagatgagtttgatcacgtgaatatatattaaaatctctacttaaatctttatttttaccacttgttagatctcacttagaaataagtatcaacataataatagttattatagtatggtatcacttgttatggtatcactcttatccttatcatctccttcctactggcgagagcagatcgaggagcgagagcgagcgagcgaggctggcggagggcctgcgcgcaccggagccgggagggcaggcggccgggcggcgggcgacggcatggccgtgcgcagccacgcgcgatgggcggcggctggtggtgggcagcggccggcggaggacggcgaccggcagtgtggccgcgctgcaggcggcaacctgcgcctctaccggaggggaggcggcagcggcatggatttttttttaagaattttttattcattgcatggatctgagatgtatttgatatgtatgcgatgtgaatacatgatgtatttgtgatgattttttagaaattgtgatataatttttttagaatttgtgatgtatttggagatgatccatttgagaatttggaaatatatccttttgttctgtgatatgtaatgatcgatttagagatgatttgaggatggagtgaaatcaatatttaatgttaaaaacaataaaaaatagcaaccagacctagcctgactctatctttatttttaatctcgattatttcacccaagactaaagatggatatctttagtctcggattcgtggctctggttgcataaccgaaactataagggaggtaccaaccgggactgatgcccctttctccagcagtgtacagaagaaacccacaacctttccacccgacgagtgatagttttgcccgttaagagacatgtaaggataaaaattgaattatacattgctcctaattaataaagtaaatactcgtcaggttccgggtttcaggccccattgtcatctctaggttggtctatcctactaagagcaagtataatagtaggctataagccggctaaatgctgaggtggaggagaaaagagaggagagagaggagaaacgggctgtaaacttacagccggcttggacacaagaaccaagaaaatctgtgaaagggacaagtgggccctatattaattgtaaagagctaactattatatgggtaggctaagagaaggctgcaaagaaccttatagccaacaggtcagctgtattattagccttgctctaacatgctaatacgtgtggggggagggctgtgggcattgggcattgagcatatcacacaccaaaggagtacttttttttttgagaaccaccaaaggagtacttggggtgggtgcagaggcatgacataggtgcattcatacagagtttggattggtttgcgtggagatgaatcgaggatgggagagattgtaacttcagaccgcgcatatggtgcacgacatttgttcgcatcacgaacaagtgatgttttgaatagggtgaatagtcaaagtggtcctccaagtttcatctgaggctcagtttagttcttgatgtttcaatctatccatattagtccttcaagttttcattttagttcaaacttatccttgaaccaataactctcttcataaatgacacttatacccctcatcattcacatatataagagaaaaattgcatgtttgaattttttatagataatacatagtatattatgtaaaacaaaaaaaaattatgtactaacaagtgtatacgatagcaattgcttaagtttcatgtgcacatgttgaaataatgggaagtacatctgtaatgttgtttattcatgttggctttctcttttctagtatatagatgtatacaaattaagggcaaacaagacattttctaatagaagtattgactagaaatagccatatggcatattaagtggacccaatgatggtttcaagccaaaacaaatatttgaaggacctatgtggacaaaatgaaatatgaaggaccaaattgagccttcgccgaaacttgagggactaaattagctattcactcttttgaatacgtgcagtttgcaatgatattttttttatatttctaattcaacttttaaaaatgggaagactatagatttgtcttcaaaatagtttcaaagtgttataatttgcttgtatgttttcttaggttttatactaatattactaattaataatatccaggtgaccatgtcaatgtttaaagggttaaaacgccacctatatatatatgtcatgacaaaaatatatgatggtggtttgtcatatttatgtgcttccatgtggccatgtattatgtatattcgaaaatttcccaaaatacaatttaacaaggccgatgcagcattctgaattaggaatcttgatgcagcacattataatgttttggtgaaaattgagcatccttttaattgcacaggtacaatgatgtctccagatatcgctgagatatttgtgaaagacatgatgttggctagatacatgcatgtaccaatatatgccaacaatgtgatttgaagaaaaaaaatacaaaataaaagttatcatcaagatagactgatacatgtaacaaaggtgcataactaggcgtgacccatgctatgtagatatggtatatctagatggacccaacctgctaacatgcgtgggagcataggcctatagatgccccttgagcatcacggataaaaggagccgagcaagagtgccccatgttgcaagagttgtgcgtgaggtgggcacggaggcatgatatagaggtgtaagtggctaacccgcgaaacccacttataagctaaaataagccgcgagcccgcttattagcctataagtgggttcgcggctgacccacttacacccctggcatcacatgatgacaaaggcatacatgcggaggtttggattgcgtggagataagacttattgggcattcgttccagtaacaaacaaaagatgcttttcaaatactcaccaccttttcgattatgagaaggctaaatttgtttttcaaaaataatctttgctatgtagttttagaattcttttcaccaacactatattggtaatccaacaaactatctcgctgaccgtatcaatgtttaaagggaaaattggaaccatgccattataattttgtaaaatttgagatatgccatcctgacccacatgtcattgactcatgtgggttctacatgtcattgagataccgatgacatatctcaaactttgtaaaattataatggcatggttccaaattagccttgtttaaaatgacacattggagtaagaagcacttctcgaccagcatatatgatgatgattttgtatatttatgttcttccatccataccttaagaaacaacggtatttttttctagtgtaataaaatgtggccgtctgtactcaaaattttcccaaaatgaaattttaaaaggcacactctaatttcctttaggctgcgtttctagtgtagttcgtttcgagttgaccctgagaaaatttactcaatttttcacgcgcacactttctaaactctcctaaatgattgtgttgtttgcaaaaagattttactttaaaaatttatattctaatacctaattaatcatactctagtaataataattcttatcgatttacgtgtcatcgcaatatttttcactttccccctcccatactccacacctttacccacactagaaacagttttgctagtcccactccaaaaccatattgccctagcgaaacaatcaaacggtccaaacccattgggcccccaccaaccaacccccccttccctccgaccccatgggcaactcccgccgccccgccgccgcggccaccgctccgtcgccgtcgccgccggcgtcggacctggaggtagggttcgccaagcttcagggggaggacttcgagtactacatgcagacctactccatcgtcctcggccgccacagccgcaggaggaaccagcccgtcggcgtcggagtcggcgttggcgtcggcggcggaggcggaggcggaggcgacgccgccgcggacgacgtggacgtcgacctcgggatcctcggcggcgggatgaacgtgtcgcgccgccacgcgcgcatcttctacgacttcccgcgccgccgcttcgcgctcgaggtgctcggcaagaacgggtgcctcgtcgagggcgtcctccacgagcccggcggcgagcccgtcaagctcgactcccaggacctccttcagatgggggacgcccagttctacttcctcctccccacccgctccgtcttcgccaccgacgccgcgcgccgcgcctccgccgccgcccggcgcgctgtcccgccgcctccctcctcctcctccgacggcgatgatggggaggaagaacgcgaagcggcggtggctaagcggccgaggaacggagacgccgggtctctcgctggtcggtatcagaatctcgcgattcttcatttctatcggattattattatttatcgctgttggattgtgcgacctaacattatcttatcaaataccagtagaatttgattttgatatgttacatatcttatcctcatagggctacttgcaagcgtcactcaattccgttataaataagatacaaatacatttggggatacaggggggctgcttgtgtgttactgtggcaattgggtggtttctgggtggaactttgcttcctgtttgatttgattggataatacgaatgactgcttctggtttcaggtgaaaaatgaaaaaggttaatggacacggttttgaatgtgtggtgatgcaaaacaagaaatcagggtgttcgttaagtttttgctaataatctaatttgctatttttttgtgcccacaaattcagtttgctgtgggcattatgtttcttttatgatctttgtaagaacctatttgcttgcctgctgcatattgagtttgcagtttctgatcccgtgccttgtgttgctaatggttctttatgtcttatcaacatttaggacttagaagacgtgagtggtgaaaattagcgacttatgcaagtgatttgttcactaaactgcagtttacatgtcattagaaatttataatatgtatgttgagcaatctaagtttgttggactgtcttttgcttccttcatggatacataaaagtgatatgcaatatgaaagttgcaggggatatttggataatagatttttgtcttattcatgcaaattttggttacttagttatgataatttgcatatgagatcatttgtcaatttttcctcttaccatttctttacaatattggcatgtgtagcttgaatagcatgtctatctataagctatttccatcatgttgcttttgtcacttcatttttctttgaattacgcaacaatcctctcatcagaactcttacattgatacattctttcctattttttgaatagcccattgtgttgattttgccacatttatctgttaaagtttccaggaaaatttggttctatcttatattgatttgtaagttatgttcttacctgagcaattcaaactctatgaaatctgatcttagtaattactgtgacaacctttagacgttcctgtgccttttaatttttatcctaggtttttgaatgcaatctactaaaggaaccacatacagttttctatatttttggtttttaaataatctcaacattgctatttcctttagttttagtatatttgtgaaggaatagttcacaggcttagtgtatcagtcttctgaaagggtggcaattcatctaactaatgcatttggatgggagtggttgaatagtagctaatgttaccaatttggcatcgatgaaagttctatcatcattgtatatagtactacaggacatatgctgatatcctttatatataagttcatattaccctcaaattactttgagcatgttgaaaataattaatctatttgggtattttgtacaggaaggaagtctgagaagggatcaaaaggttacagacaatcagataacctacaactcttgcagttggaagagaaagatgttatctcatcaacagctactgtcttatctgatctctgtggacctcaggaatgggtgcctatggacaggcttcatgaagtggtaactttctcaatcttttcttcattcctcttgacgaaatgatcacatgtctaaacatagcatttggggtttttttttctgtttgttacttaacactgcatgaattgataacaacatgcctgctcctgcattttgtttattcggctcatttatgaaaacgataatacatttttctagcatccttgcaaggtaataaactaaacttacaagataaaaatatgatcattctgtttttaacattctaccagagctaaacaaatggcggaaactggtgctttttcagaagaataaatatttgtaaaatttgtgctctcctgctaccctttcatcctttatccaggaaggccctgtgctatggtctatggcatcaccttacttgtccactgtccatattagcttatttatgttctactggtggcaagttttgaaagggataagtccttattagcccccttatctgtcacgtttgtctaaaagcaaccctaactccaacattgggtattagcgagaaaaaagaaagagggaacggagagaggtggaggaagaagatgaagaaggttgtcaatgacatgtgggccctactgtttgttttagacttattggctgacagtaatgtcacgctagcgtcatgtaggcaaaaatccactctggtgactgagtgtaaagtaaacggtttatggagttacctttcttttgaccttaattgaggctgcctaaatgttcagtgatagtctttctgacctgaattgaggctgccgcagtctttgtatattgcagccaacagttaaggaaaaatacttctcaggctatgctactctcctaagcctggttttcacaatatggctctttcatatatcttttacacatgaatccgggaccacatgtctgtaaggcactaaggcataggcaacattgcctgtcataatgcaactgatgtttcaaattttggggcacaaatttggccattttgtttgtatataattctccctcagttcacaatattggtcaaattatcctatttagagatttatttgtttgttgcactacacgattgccttgactagcatagcatcaatatatatgtatggagtactacttcacaattcttatttttattccagtaatccataagaataaattttgccaagatcgtgttacccaccacatgatgtagcttcttagtagtagtgaccagattgaattgttactcatctagaatcatcccttaaaatgatgggttaccagcaattcttctgatcacaaattaccagtgtaaaatcatttctcactgccttcttaatgacatagctgcataagttgtagaaatatgttccaattggtattttcggtttcagctggttgaacagtgcaggcttttagttttgttttcatctgatgattacagcataaacaatcattttgaaagaaatcgggctctgctagaaactgtatacttggtagttcaagttctttggttcttaaccagtactctcttggtttttagttctttagttgaattttgtttcagggatagtttgtgttcgtcttgcacctgtgctaatgagtttgtcataatgcaatttcctgtaatatgaacatcgtgattatgctgtacaaacttgttagattgttcatatatgctctgtccatttcgttccatcctgacgatcatactccttttttcagatgtttgagaaatatggcgacttgtggcaccacaacagggtgcggaaatatttgacatcagaagactggcccaagagcgaaactgatggtagaccgtggcacgggctctctctgctgctaaggaagtaccctgagcattttgtgataaacataagaatgtcaggggggcggagcattgagtttgtctctctggtttcgctgcaaccctgactagttcgtagtgagtcgcatcctgtgtgggacaagctttggagcgtatgtttcgctgctcttgtaaacagcaaaactgaagttagcaacagggtaggaaagaatcctacaaaggttttgtttttgttttctcggcggttaaattggtagatacatagagtgtagggcaattttacctgtgcattatcagagtgcgaaagtttacctttcatttctctcttttgttgttgttgtgtgtgatctgcctcttggtgtttaatcgctcggtgcctggtacatgctgagctgagatggagggtgttttcctgttccagttggtctctgtgagggtcagagcgcagtgttgcatgtgaagtggtcagcaaatggggcctaatttggcaccgttcacccttgccctgctaaccatgcgctacaatcttttcaaatgtttttggaaatcaattgtagcagtagcatgacggatagattgagacataggaagtggatgtcaaaataattacctaatgtctgcacactgattcaggataagtaaaaactccagcttctcaacaaaaagaagaaaaaaagatttcacatgcctgattttttttttattttgtagtcacataaattccactatagtaagatattttttgcagtgttatgtagtctgctatttcacttaattttactgcaatcttgttttttatatgtatttgaattttgtaaatctttatcaattgaagatttattttaagcataggtttgttgtttgacctttatctaatagaaaaggaattttaattagggaacgggggagtgatgtgacctgatgagagtggctagattggcatccatgttacaatttcttttagtcacataaattccactttactaatctaaggctatctttgggaggtgagattgggtacttcaccttccgcacacgtaaaacggagctacgtattttcttataatcaattaattattccttacacttccattctggttagaatcccgtgtttttcctgtttcttcgttttttattcctgttattaaaagaccctaaaggtacaactttatgtagtctgcaattttagttaattttactgcaattttgttgatgtatatgtatttaattttttataaatctttgtcagttagagatatatttgaagtataggtttgttgtttcaacttttcgtaacaaagaaggaattttaattagggttaggggcgggaaggcacgacaaccgctatgccaaatcctccgggtggatgagatcatccaattttcttaacatcaccacgcaggccagactgcgagtctaacaaaaattattccaacaaaatatcgtacagacgcgggcttaattgttggcaccaggattactcaatcagtggactcacagaacaccaaacgttggtacgatattttcagaatgatgctagaccaaacaatatgttggtcattaattatgtagcaattacgtacgtttatcaatttttcattgaattactggaacaagaagagaagtttagcaatctttaattaattatttaattgtttttttacttatactgtctttatataaaaatcacttttttctatatctacatggttactatttttagtagcaaaattatattttctaccattaatattccggagttgaattttatttatttattatgcaccaaaatagggagtcttttagaatcccaaatttatatttcctattagtttcaatccaaaattatacattatatgttgtacataaatagtgtcctttccaaatttattttgtttataaattaatacggaatgtttttaaatataaatatcaattttaatatgaatggctacatttattcaggaatttatctttctatctgttcgttcactaattttagagcattgagcatacttaaggcaattttaaattcgccttaaattcatcaacataacacagtaaagagtcacaaataacaattgcacaactagcaggaatatatataagcccaaaacatgttaaaaaatggtaaattttatagggaaatttttctggaatacttttgactagtgagcattgaagggggcaatactgctactactagtggctaagcaaatgcaaaatcagttggaaggggcactggcactaggccatgcttaaatgagcagccagctttcacattggtctcttgattattggtgccaacaaaattaattggtggttttcaatgcacacccatctacaacctccaactaccttcccaagttctggttggctggataatgaccagcaaaaattagtaatttacatatgcaagtttttagtaagaatgattcacagggtaacaatactcctactgctaactgtactaggtgttacaggtgttttggtggtttcggctgtttaattagcgtagctttagggagtgggatgatcttgaggtacttgtagtacattgttttttttttgagtaaaccatttttttcgatgttttatctctctttatcaatgaaacgagacatgacttatgtctttcttctaaaaattccaacagggagaagcataagaaatggccttttgacgtctcataggatttttttttctttttttacattgaatgtatctaactgattagaccgagaagcgaggt

SEQ ID NO: 72916 - DNA, 25551 bp, Oryza sativa
  unsure (1)..(25551): unsure at all n locations
ctaggatcccccccattcggttttaggttgctatattctgggatggagggagtaagaaataaaagtgtgtcagttaatgggtggggtcatcagcatggaaacaagggatccccatatctcagctcgttgacaaactcttctttcttctctctttggatgttgtttgtgtcccccatttgggtccagagcatgcttgatgagtttcctttggagaactctaatgctttgtgtatacggttagtttttcttctgtatgttgagttgcatgaagtaaccactttacctgatagttcaaggtgagagaagtgctgctggtcattctttatgttgtagcgagcttaagcgctgacgaagaatgattgcaatttcaacacttttccctgatcacatgaaaattcacacaaagcttcaaaagcagaatgccaaaaagatttttacaaatgcaagtttatgtggacacacatgctgagccgttggatgctttgttaagatctgtgctttactgaaaagaggaataatacaatattatgccttgttaaattttgcgttgtacgcacaaatctcaaaacaacgatgacgatagaaggtgcaggttgtactttcagtcgcatttgtaactagacttttttttagcaagtcaaattggttttgtttatggatggctaacattatgtatccagttacctttatattcttctagttcaaggataagtgccggggatgcccttttataaaaagaagaacaaatactttctccatctcaaggatttttggagttttacattggtacttaaaaaagtaagtgaaacaatgttgtgacttagtttagatgagaaagtaggtgggaaaattaaaagattttattgatttatgataaattttatgtcaaaatattttatgataaattttgaatgcatgaagttgctatattgtacaggttctgacatggtttatcattaaatatacattttaagtataacttacatttttcataaatttgcacaaaagttttagtaagttaaatggtcaaccgtatgtcaaaatagttactgctacagaaacattttttttcatacggccagaatgcgtgcctgtgagcaagtgtctgcacaaattgggactcttccaatcgaacagcgcaaccacatacaaagacgtaattttacacgtaggcacattatgtacgtcgcccatcggaaaaaaatcggcaaaaaaaattcccaaaaaaaccaataatacataaacccaggctcccatttctagaaaaaaaaaaaaaggcattgccaccaccattcctgaagccgttgcctctccaaaagccattgtcatcggggccgcatggatcttccattccagaggacgccactgccggatccaactgttgcgaggctgccggcgctcgatcaggccgtcgctctggccggcgaaatgcccctgggtatgtcgttgctgaggccgccgccgtcgtcatagtcgccctagccgccactgtcattgtggtcgtcctagctgcagtcatggtaaccaccattcgtctctcctttgtcagcagtgccggatttgcccatccagctgctcccgtcatggcgccggcattgttggctgctctcgacgtaataccgcatcacaggcccagctcacttcccgtcaaccccgccagctgtttctgtcgtgggtcatcgaggaatggagggaaaagaggacataggagagggacatgcgcctgcatcggtggcagctagttgggccctcctctcagctcattactggtccaaccagcccgatttaatctccggtttataaaaaaccgcccaggttaactagtttcatccggtccgactgcacgcccgatctgttaaggggaccggactggcgggggccctggttccggttttttttggtcgaaccgtctgaccggtccgatcttaataactctgcttctttcagctcgtctaaaaaagaaaagaggctgtccgagaaaattatattttaagtgtcattagaagggggaagtagatagggggctgtttgaatgctataataagttactaacattataatcatttgttacacttgtttaccatatttaactaagttgtgaccaacaaaaagtaaaccacactttaggtagcaaaagaagagtgtgccacatgtttttgagttgatgacatgtgagactatagtaaataagagggcttttttttttagaaacacatgctcacgcattctcatctctatgaacgcacacacgtataacctacacctatgagttatatcttaagattgacgaagtcatcatggatacctcggtatcgatgggtacgtcgcctaccattgaaataataattagccgtaaatacgagtacatgttcaagtctagcggatggactggtttctccacaagaaacgtaaccagttgactaagctcgcttcacgaataaaaggaaatattgtaacaaatatgaccatgaacaaatcagtgagtaatatgagatatattaggcaatgtttggcaatgaaccaaacagccccatcctactggttcagctcatcagctggcacatgcgagaggaaccaaaatctagaaagctcgcgcggatccatggttggcgtggtcggatcggatcgatgatcatatatcgacgcacgcgagcgcggcatggacgtatacacacatgctcgtcgtcgcgcgccggccgggcagcgcccgagacttccgaagaattgcgatggatcatgcacgcaacggacgggttcttaaatttgtttttccttttgtctcgcccgcccgagctgcgcactactacaagaactattttttcgtgcggttaaattgatttttccgtgcgaagattttcccgtcggagcaaagtgtctgtaaaagtaaatattttcacgtgcggacggtctaaccgcacgggataatcatttttccgtgcggtcaggttaagtggaccgcataggataatcgattattccgtgcatactgcggttaaataatatcacctgcacggaaacaaaaaaaccaaaaaaatcgaaaaaataaagaaaccctagccctaaccctagaaacgcccgcctccggacttggccaccgccgccgcgagcaacatgccgccgccacccgagcttgccactcccagattcacacatcgtcgttgtcccgcctgctgtgcatgcacgcggagccacctcgtcatcgtcgtcgctcccgccgccgcgagcaacacgccgccgccgcccgagcttgccgttcccggatccgcggctgcgccgcctcgtcgtcatcgttgtcgcgcccgccgccgcgagcaacacgccgccgccgccagagctcgccgcttccggatctccgtcggtgccgcctcgtcgtcgcgcccgccgccgctgcccaagctcgccgctcccggattcgcgtcggtgccgcctcgtcgtcgtcacgcccatcgccgctcgttcgctcacggagccgcaccgcagcgcctccgccagcagccgcctcccgcgccgtcggcggcagcggcgctcgatcggtggggagggaaggagaggaaagaggcagagagagagagaggagagagaggggtgggaggagagaaaagaggcagatagatgggagggaggagatcgaggggacgaggagagtaaaggggagagacggcccgtttggttggggggagtttttaagaagggattgggagtttagagggatgatgctattaaatgttttgtttggttggaagacatggaaattttggtgggatggggatgtggaattgaggaaggaactccctccttttcaccgcttgtttggtaactcgagggaaggagattgggagtttacacgagggaattgatgatgagattaagatgggaatttgatttttaatcttaatatcttgttttgtagaggtgatggaatttgataaggagtttagttgaagatttggtcattaataaaaatggatggctgagatttgcttagacaaattaaaggaggaattctctcccaattacctgcccctacccagatattgaaaaggatggagttccttcctcaattccccatccccatcccaccaaaattcccatgtctcccaaccaaacaaaacacttaatagcctcatccctctaaactcccaatccctcctaaaaactccctccaaccaaacggaccgtcattacctgggtaggaggtggtaattgggaggaaattcctcctttacttttcctaaacaaataactgccatctgttttcattaatgacttaatctccaactaaactcgctatcaattcccaccacctctaccaaacaagatattggaattaaaaataaaattttcatcttaatctcaccattaatttcctcatgtaaactctcagtccctttcctttgagttaccaaataagccgagaaaataaaaagggaaaagaaagagagagagtgtgtgtgtgtgtaaaatttgaaatgagtaagagggaaaagaggaagagtatttttctgtgcggtccacttaaaaaggcggcacgcgaaaatcgattttttcgtgcggtcctcttaagtcgaccgcacgggataatgaggaatatcatgtgcggcgacagcccggcgctggtcccttattttcccgtgcgatttcagttactgtccaccagaaaacaaaagggcccgtcaccccggaaaatcttttactgcgtgcgtgcgggcatcaggtcattggatcttagcgtagctagctatcatcatcatatcaactatgctcatctgtcgcccacagctctatctggatgcctccatgcatacatgtgtgtgaccgagcagcggaagaggggaggtccaatgggggagggacaaggggtgcggcgctgatctggttgccgctgggaacagatagatatcgatcatcgcccgccgccgccgccgccgccgccgccgtcttccaggcgatcggtcgatctaggtgtgcgtgccgcatgcgcacgcgccgtccctttgtcgaccggtagatcggcggtggtccgtcttgatcaatttcttcttctcctttcccggcgcgccgtgttgcatgctgcaggggttttggctctattcgactcctcgtcgtcgtcactttgtcacaacccttgcaacttgcattgtcacattgtctcgtctctcatgtcatcgtatacaaacagcggcatgcagcgccagccatgggtgcctagctagatagcacggctagctggcatgcatcaagatcattcctcccaactaaactgacgaaacgggagaccaacttgtcatcgacttacaaaattgtcctctaaccacgaaaccggatacaacgctcatcccctaacttataaaaccagttcaaactaggcctctcagcggttttaaccccggttttatccaacgtggtggctgaaccagcatgggacccacgtggaccccacatcggcaggccagcctctcccttcctctcctttcctcctctctctctctcactcttttctctagactaggcaggccggccagcggtggggaggaggtcgccggggcgaggaggtccgacggccggccgacgatgcggcggcggagacacaggagaaggggagggcgacagcagggtgaggtggcgttggcgggcgagcgcgatggcggagaggcggcggctgcaacacgggaggggaggccgacgccgacccaaaagtggaagccgaaggcgacggcatgggtgagcatggaggcagaggggctcttcgccgttgggggcgtaaaggcgtggaggggcggggcggctgccggcgggagaagagaggcgcgcgggtggcggaggagcagctgggtgcgagtgggaggggggagctgcttgcggcggtagccggcgggggagcagctggccaccccacctccatctccggcacgagccgcttgaagtccacctccgcgcggtgctcgtcgttgtcatcagcgaagcgacgcatgttgacggcgtcgactaagccgtcgtcgtacttggccgcgacggagcagtcgatgtcgacgttgtcgtgggaggggtgtgtgagcttctcccccaacccccaccgttagccgaaggagagcatggcggaggcggtgaagaagagcacgaccggtcgccgctagccgccactcgcacccagctccttccctgccgttgttgcccagttctccccattcggccaccgcccgtgcgcagctccttccgtgccgtcgctccagctcttccccctttggccactgcccgcgcccagctcctcacctgctgtcgccgccgctcatctctttcccccaccggcagccgcccgcgcctagctcctcccgccatcggcccagctcttcccccttcggccaccgcctgtgcctagctcctcacctgctgtcgtcgccgcccatctcttccccgccagtagccgcccgcgcctagctccttggtcgttgtcgccgcctagctcctcccccgtcgcccgcacctgctgaaccagcccacgcctagctcctctccaacgctactgcccgtggagaggagagagaagaagagaagtggagagaggagtagtggccgatgcaagaaagacctcgcacaggctcgccgcatccatgtgcagggcggggagagaagcagaggtggagatggacgtggcggcggtgctcaatcgaccaagcctttctctcccatcggccgccggcgtgcccgccacgtcggccctcctcccttgccggccttgatccttgagaggagaaagtgagaggagagagagagagaggaggatgaagggggaggaggggaaagagagagagggggtgctgacgtggcatcctaacatgtggggcccacgtgggtcccacgctgacttagccgccacttcggacaaaactggggtcaaaaccaccgaaggacgtaaagtgaaaggttttgtaagatgagggatatcatatatcgggttttgcggttggatgacgattttgtaattcgatgacaaattgagggaccttggtgtactttttccgtgtgtaaatgggctgagatttaaggcccatatatgggccggatcgtggcttccacgaagcccatacttgtaaatgggctgacatttaaggcccattataacaaggcctttgggtcaagttcggcccagatcagtgcacaagccgtcgacttccgccgccggcggcttcgtcgacggcggcgacatcgatcgccgtcgccggcggacagatgatcccccctcacgacaccggtacgtcaccctgctacaccatctcaaatctttctcctgctttgattcatctcatccgtgtgggtttttctagtagatctcgaatgacggcattccccgttagtttttttttttttttttactttgctcggatgaaatttgctcgttttgtttcctgttcttgcgattgcaagtcattagttgatgggatagtgaaatccctgacgcgcattggtcgtgtagggagctggatctgttccatgcgttgctgattggatagaggggattagagtttacgatttagggctttcctctgcaaaaactccttgccgcagcacaggaagcaggtctcctccaaccgctccacaggcggactgctcgtttcaatatggccttatatgcagatgacgctgtagtgttccttagaccagataaacaggaactccaaaaggtccaaatgataattcaaaatttcggcctcgcgataggcatggtgaccaatttatcgaaaagcgaagtctatgccattagatgtgacaccctcgacttacaggatattctctaccccttcccggcacagatgaaacacttcccttgtacctatctaggacttccactccacatcaggaaactcagaaaatcagatgttcaacctctcatcgataggttctcagctaggctcccaacatggaaaggaaagttactaaacaagactggccggacggttctgataaagtctaccctctccgccctcccgacctatcacctcactgttttcccccttagaaaatgggctgaaaaaaagatcgacaaaatttgtaggggcttcctctggacagggtcagaacagacacaggggggacactgcctagttaactggaagagagtctgtagaccataaaaacatgagaggccttggtataacaaacctcgaactttttggtcgctctttaagactccgctggctttggcaggaatggaccgccgtcaacaagccttggcagggatcgagtcttccttgtgatgaaacagacaagcagctgttcagagcttcgaccacgataacccttggaaatggcaacaaatcaaaattctggcatgacagatggttgaacggatcacccctgaaagaactttacccttccctctatcagttggccacgagaaagaacagatcagtggcataggagatacaagggaaccactggttgaaacagatgagacgaatgaataccacaacacaggttagggaattcatccttctatgacaccaaatccaacaggtggagttccaggaaggcatagacgatgcgatagcttggagatggactccaaatggatcatattcagcaaactccgcctacaggatccagttcgttggaggcatacaagacaataggtctgatttcttctggaaggcgaagatagaaaacaaatgcaaattctttggttggctcatgatccacagaaagatcctcacagccgacaaactccagcttcgtggatgggacaacagccacatttgtcctttgtgtggagtagaaccggaaacagcaatgcacctcctcatggaatgcgcctttgctaaacaggtatggagacacatctggcaaaaggcagggctccacatgcatgtggcttccaccttcgttggagatatgctacgatggtggtcaacctgcagaagagagatggccaaagaacaaagaagaaattttgatggcctcttcatctacacagcttggggcatttggctacagcgcaacgcaagaatcttcaatggtacttatagtacagtgatgcaagtggttgattcaattatcgctatgtgcaaagcctacgttggagcgcatgttctagatgagtagtgcccatactccctttctagttgcttctcattttcttaaaattttagccccttatctccccgggttgccttgatagaagaatgcttgggatcctttgtaatctgggtttgtaaaaaacctttgttgctttttctctactccttaatgaaattggcagagctcctgccgtttactcctcaaaaaaaaaataatctacattgaattgaggagcttgtccgatcattttaccagtgtccctaaactttattttagcctagcatttccctgcaagtctgttattgtggttcctaattaaacttttttagctgttctactttagcctgcaaactagcctaattatttgatagtcttacctaagtgatacagagtttagggacctctcaagctataactaagtaaaacagcagaatatgtgctttaacgacatctaagttaagattacatcaaacacaacatgattattttgcacaatgtaattaccatgagcaattttatggttnttgagaangtnttatanngtannantttttttattgtaaatttggtactttttngtanttaantattataangtnnnnnnttnnnnnnnananntntnanncntnanngnncctcctcaaggaccgtagaattgcttaattaccatagtaccatatttggtcctaattgaattctccgtctcccccgcatctgctgaaataactaacgtgcaaagaatttgcatattgttgtactgtgcaaggcatcaagcaccgatcttgggatcaaaattctgtctcactgacaagaaaatgtttttgttgatgtctttctaattccacaaaccactaaaggagtgtgataaggcccttctaccagtcttctacttcctctgtttcacaatgtaaggctttctagcattgcccatattcatatagatgttaatgaatctgaatataggcaatgctagaaggtcttatattgtgaaacggagggagtatttcatgattgaattactcatcttctttatcgtgctctgacaatgaacggtagaatcatgttgcattccgcttggaattagcccaatattcagccacaagtttagcaaaggctgtttgtttatcttccaacaacttggcgggcgtgtcatattctataagcttccctgcacaaacagaagggccatcagcttgaatcatccaaatatgtgcagtttatatatgtgcagtttggatgacagggccatcagaggaaggttcggatgagcgatgactggaccagaaccttcctcagatattcagattgatatgcgtgtgtgtagtaacttaccatatgaaagtaccatgaccttgtcactgtctgttacagttggaaccctgtgagcgatagttaccacagtgcaacttgagaattgctgcctgatgaccctctgaatgattgcatcagttgcggagtcgatggatgccgttgcttcatctaacacaagaatcttgttcctacggaggagaactctgccaagacagaagagctgccgctgcccaacactccagttactgccatcatcactcactacaattggccaaatgaacaaattgtttgagatttctaaaaatattttgcatggtaacttttttcctctgaaattgatgtcacttacctactgtatcaagaagagcaggtgtgctgcgaatggctgtctgtagttgacacttctccaaggcctgaaacgttcagtgttagtttaatcaattcatgaaaccattttggtctaaacaaaggtaccagtctggttaagttcaggatcatgattgagctcaagttcttctattgcttatgttttgagaagatttttgtaaagtgattctattagaaaccgcactattgtgtaagatttttatcacgtcttatatctgagttttgcacaaatgtaatttttcttacctcccatatctcttcatcggaatgcagaccaagaggatccaagttgttgcgcacagttcctctgaaaagtgtaggttcttgggggataatgctcagttttgttcttagatccttgagaccaatagagctgatatccaagttgtcaatgagtatcctcccacccgcaggatcaacgaggcggaacaatgagctgatgagtgtcgatttcccacttcccgttctccctacaaccccaattttgtttccagcaggaaatgtgcaagtgattcctttgaggacaagaggcatgtttgggcggtatctgacctgctcataagtataagtgtgtaagttactgcaaacattttttaaaaatgttctgtggccttctctattgaaagcaacttactgtagttttaccttgagatcttgcaggtcaatttgtccctcctgtggccatgaacttggagccctattctctggtataatggctggaggctctggtggaaggtgcatatactgctttattctctcaactgaaataatatagttttccatgtaggagtagaactttgtcaggaaaacctgaactgctgtcagcgacaaagcaaaggagaggctgagacccgcaaagcctggaaaagttaacattggaagtgttatacatccttgttggatgtagaggccgggttttaattaatccattatctaaaaaaaaaaactggaagcgttcattgttcagcatactgaaaataccattgtaagatgaacatgttaaggtgtaatggcttatgtacatacatacctggtgagactgctcctggaggagccaaaacaaggagcagtgctgctgttagtagtgtcaggctctgcagtgcttctactcttatgagaacccactcttgcgccgcaactgtgtggaagaacaatgtcgcgtcggtatcgataagaagtaggttattgcggatgaacctgtctgtttccccaaaagacctgatggtcaccacagcaagaattgattccgccgcatagttcatgactggtgcctttgttgttccattgattcttgctagatctcttgctgaggccacgtagtgcctcgtcaaaggttttaaaacaaacgtgagatcttgagttcagaaggtaacatttgatctatttattcatctactggtttaattaacgatggtagttgtttgcagcaattaggggactgacctgaacatatgccacagtaattgtaactgggattgctacaattagaacttgccaagttacagcccctgtaaccagtattgttgtgatgagctcactagcgccaacgacgacataagccacggagtaaggtatgtcaaagtccaggatgcttaaatctgaagatgcctgcagagaataaaagggctacagtcaggtactagcaaccacttgacctataataattgttcatggagaatctaaaggttagctcttatgatcttattttgaagtccatacccttgtcaagattcttccaaccggtgttgaatcaaagaaagacatgggggccttgaacacagaatccattaggccggtaaagaatgctttggaggccttgagccccaacttagctgcataaagggttctgatataggcaaagcagcagctcaagatggacagccctgaatatgcccctaccaggagagcactactgacgttcatctggacagccactgccagccagaatgtggccatcatctggaaggatgtgaagagcacctgagtaacacccatcacacagagatgtgtgattcccttggacacattgatgtagtccttatatggcttccatccaaggtctccaatctccttttcttcctcttctgtgagctgggttgcagaaggttggccttttgcagagattgaatcaatatcactgatgtattttgcagaaggttgtcctgatgtattttcatcagtcacattttgctcctggacttggctttgctggctggaatcatccaatgctgtgattgaggacttgtgagctgagacaagcttctcaaatgctgtcccggattccattagctctgcgtaaacaccttgttgtttgacataaccatcttccattacctgttgaaacaatggcagatcattcatctgaaggatctttgataccctttgatatggctaaatgatagtctgaagatcaacttaccagaatccgatcagtctcggtgagaaattcaacctggtgagtcacaagaactacagtcttctctgaaagtgctgtcattacacaatccagcaagaacattgccactgattagaacttttttttcatcagggagtgcatccatggatgcaggtcaaggagcacctcttacatagaacagaaccgcagcggtgtgcgcatcgaccgcgctgaaaggatcatctaggaggtacacatctgcatcactgtacacggctctggccagctgaatcctctgcttctgaccaccgctcatgttgattcctctctggccgatctctgtcaggtctccatggtcgaagttctcgaagggcttcccgaagaggatgttgtcgcgaacagtgccactctatccatgagttctgggaaacatacgccactgtgccatacaactccacctgaaaattgattgtagttttgtcatgttcatattttagaaaacatagatttgtcattgtcatttttttttttgtatatgaacatgacaagacaatcttgtgttttctcctttcatggtaaaatgaaaagaaaggagataaatatagagtcgaagattatcttgagtcttttttcaggggaaagtagaaagtttttagtgataatgccctattgtttttgcatgaaatctaaataattatgagaaattatgaacagattttaaatactagattataatgtcatcagtcaaactaaattcaaacttggattacaaaaggaaaatattttctttttgaagtcaaaattggatgtaaagttttacttaattttgaagaaaaaaaaatctatatatgaagatgggatttgattttgtatgtttgtgaaaggaaagaggacacatcattttttttttctgaatttgctatgaactacttggattacaaaactaaagaacatgatgattcaatctgtatgcgaaaagctgttcttttttcttcaaaattcatctcattttttctatcacttaccattcctgatgttctaggtatctccccaagcaatgcacagaggagtgaagatttccctgagccaaccgggccacaaactgccaccttctcccctctgcgaatgctgaggtgagcattcttcagtgtcagctcagcttcactcccactccagctgaagcttccatcctggacatggatgattcccgcatccgaattcttcgtcgtcgtcgtcgtcgtcgccgctctcgtcacgtcgtcctgtttgatctcctcctcggcgaggaacctcccgatgcgttccagcgacaccttgtactggatcatcatcgtcatggcctccggcagcatcctcaccggctccgacatggccctgagcgcggcgagcgcggtgaacaccgtgccggcgtcgagcggcgcgctgccggcggcggccgtggcggcgaacatgacggcggacaccacggtgggcgccgcccagtagagcacggcgccgtaggccttcttcagctgcgcctccctcagccacgcgaactcgccgccgaggcgcgactcgacggctcgccggaacgcgccctcccatgactggagcttgatggccctcatgccggcgagggcctccgacgtcgaccggagccggccgtcctgcgccgccatgaacctggactggtagccctggagggccctggcgaacggcacgttgaggaagccgaaggcgacgaggggcacgaggcccgggagcgcgccgaggcggagcgcccagaggagggtggcgacggcgagggcgagctgcagcggcgagctccacgacgtgtggagccagctgacggcgtcgccgaggcggtacgcgtcgacggcgacgtagccgacgacctcgccggcggagtggcgccgccgcgcgcgcgccgacagccggagctgcttccggaacacggccgccatcagcgccgaccggacgcgcatccccgtccgccgcgagctgaagaaccagtgccgtgcggccagcgattgggcgagcttgatcgccagcagcgagccgaccagcgccaccgccgccgatgcgccggcggcggcgaggtcccggcgctcctcctcctctgccttgtggctgctgtaccggacgacacggcgatggccagcgtcttgacgagcgcgtagaagccggtgagcatgatctccccgaggaagcacctgagcagcacgccgacgaggcggccgccaccgccgccgtccttgccatggccgtggaggctccatgcctcggcgaacctctccgacgcgcgcgccgcgccgtcctcggaggcgatgagcgggacgtcggcgaggtcgagcgccttggagcggccgaggcggagcagcgggttcagccacgagaaggacagccggctgagcacgccggcgccgtacagctccgagtaccggcgaggcgcctccttgccgagcagaggctccgacaggtcgccgccgccggcgccgccgttctcgccgctccggccggccattgccgagcccagttgttgccaatgacgcgcgcgacgtggcgccgcgcggttttttatggcggaatttgcttgatgaagctcagagaacgtactcctctccatcgctttcacctcagattttgggtcggatcatgcgtaaaagagataatctgtaaaatggcaaatcacatgcataatcaaagtggtaatctctataacatcaaataatcatttttttcctctaggagactgatagctggtaattagtccctccattcaaaagtattaagaatatttcatgttttgttttttccaaaatatatgtgtaaaaccaaagcgtgtttgattgttattttgtgatgaactattggtatatgagattattggttttgatatttggagattattaccgaagtgattttggatataattagaatttttaggtgatgaatagggattactgctgacacagtgtattcggtcagaccgggttgtggtagttggtcaaaccggcggtatatgtgcggtcaaaccagccagcacgtagtctgactggctgatgttgtgtcggttttggtttatggtcaattgtttggatatacgtggataattcatgtttatgacttctagatggatactatgtgtatgtaatactattgcttcttaacaatgagtcaagttggtgagaacttgtgctcggatatggtttcttggttgatgcatgtgtaggtgattcttaatgcttcggaagagtgttgtcggtgatggatcgggagtcgacttgggagaagatgacgtccagatgatcaagatatcatgcgggatgcttaggctaaagatcaatgcacgtggttggtgaaaattctatatggcatacaagggagatattgtgtgcgtatggaatgcggagtcgaatttggagggagtccaaatttagtacaattggagtttgtaaagttttctaagggattaggacttcttgtactaggttggctcgtggctttagactgtttacctcagataaatagagagggagggtatagcctcttggtgttgatttttgagagagttgagtttagagaaaagttagggtttcgagtttagttgagattttcatgagtgatgttgttgcattttgtaaatacaaagagaagtaataaagtttcaatttacttcgagagatgttcgatttgtgtttgttcgggttcaatggtctaatcggtggttagaccaatagatacccggcggtcaaaccggtggcggcaacaggagacagtggcgcattgggcggttagaccggaccaactccatcggtcagaccggaggatattgagcggttagaccggcgcatctactccggttggaccgatcaccgtcgaatttgagggtaacctttaattccgctaaaagtttcagtttttggtaccacaaccattcaatcacttctggttggtttagtttcttgctatttcgatcctacaatatgatcatatttttagtctgcatgttctaaaataattgattggaagcaagcagccgtcttaatatttatgtatgtaagtatatagttctttttttacatgggagatgagagatgagttaatttttctttagtcttgataataaaagaaactagatgatgccccgcaatttactgcgggatatatattagataatagagaaatgatgaaatgatttggattgaaatattatgaaaatgattcaagaataatgatctagcatatgtatgtttagttttagaatgaagtaaattgtagatataattaatatatggttgcatattgagctttgtgtgcttaatgggttgatgtggcatgtttgcatgtaggtttttggagtgataataaatactatgtttacatgttgagctttatgggccttttgaatcgtaggaataggaaaaaaaaggaggaatggaaaaatgcaggactaggaaaaacaaaagattctgacaagaatgcacatataaaacaaatgattgaaaaatacgagaaaaacacaggaatgaccgtttgattggatcataggaaaaaacacaggaatcggatgaaaaagatagactaaaggaatttttttcaagaggttggacctcttgctaatttttctccaaaatctctataggattactcattccatattccataggaatttaaaggatagaataggattcaattctttgtttcaaaggcttccataggattgaaatcctccaaattttccacacttttcctacaaataaaaaggcccttaggtgtttagtgggcattactttatagaaagaaagaagagataagtcttacatgtttggatggagggagtagtagtgatcgccagttcttttttagccttatgtagaattactgtggttgtttgattttatttggaggttgggtttttattttaagttttttgggtgcatggatttggtttggtgttgattttattttgtatttttccttagagcataatggaggactaacatttaatttcacgtctatgaacctatgattttgctaatagaaaatagcaacgacgctggcaagttggagagaagttggagagttgaatcgcaaaaatataaagttccaatatttagttgtgcatgtactggcaatatttaggccaacagctggccctttcatattttatactttttttaaggatacgtcggagaaatacaagataattttctatcataattattatagttattattaatccataatgttgattgtggatatatgaaaatgatatagccaagtttgtcgtcgcaaaagctttacaatataatgtttatataatttttccgagaaagactacacaacggtataccacttatctcccatgccgcggctccacgtgctggcttctcccgagcatgtcgcgtgctgctaggattatcatcacgcacgtttgttttgtgtatcagtgtatagtcttgttcctgacagatagctagtacctagcatggctaagtcctgcctttgatactagcctagctaggaaataaaaccggaggtactactagcttgctgtgcatgccaaatccctataatagctactagtagtcccgtaccctagctatgtaaggtacttattaagcctagtagcctagctatgtgtctaagattggttgcatctatttgcatgtgtcctataccatgcacggattagaccagataaataattacctatattatatatggatacaatggattctaattagatatgtcatgttaggctcttggttataccacatcttagaaactctagtatgtgatacatagatgctagattatcatatctgatatccaggtactgggtcaaatacctaggtaccaagtatgaaacctataaatacaagatctgatgccgagttatcgggtctgatacctataagtaccggatccgataactaggtatcgtgtctgatacctatgagtaccaatcggatacccgggtattgggtatctgatcttatacctatgagtatttgttccaatacctatgcgtaacgggtcggatacccaggtaccgagtatgatacttatgaataccaagtctgatacctaagtatcggggcttatacctatgagtatcagatttgatacctaggccaggtttgatacctatgagcaccgaatccggtatcgcgtatgatacctatgagtatcagattggatacccaggtatcgggtatctaatctaatacctatgagtatcagttccgatacctgtaagtactgggtccgatacccaggtaccgagtatgatacctatcaataccaagtctaatacctagatattgggtctgatacctataagtaccggattcgatacctaggttgggtttgatacctatgagtaccggatccaatacctagatactgggttgatacatcttagtagcggatctgataccaaatatagggtgtgatggcatgagacttcagatatgacaccactaattctaatatttatgggtattcaacaatcaaataaaaagatggaccatgcatagctaggccagaaagtacagcgaaacttcctcacgtgctgctgacatgctttgtttaggctcatgctactagctctagtgcttaattctaactttgctaattgaagcaggtgtcagacccatatggacctaaagaggtgtacaagtagtgatgtactagagtatttcatagctattttgtactgtaggagaaaagagacctctcgtcagtcgtcactagtcagcagtcttcatgtgaaaggataacacacgacacgcttttagagagaaaaagaatcggtgagtgattggtaagtataaattataaactataccgttaaaacggtacaccgtcccattgtttttctcaatttttccatgtaaaacaattaatagtctaggggattttcaacaaacaataattatgttgtgttgcatgactgaatagataaataatttgtggcaattatttgaaagcacaaatgaattaattaattattataaagtagaaaaaatatctaaaatattatcatgagaaattaatatacggtgtcttggtgtcatgatagtttagtggttgcagtgacctgagtagtatcttaaagttctgagttcaaatctcaatatgaacaaattttggattgggctatttgaggagtcaagttcataatgtaaaaaagctgcatatatctggttagatgtaaaggccagataaaaattacccttgtctaaaaaaataataaaaaaaaacctaaaacctatgtcgttccggagcgaacagcacacgctagaacatgcccatctcgagcagtcacatattttttgtttgttcaccagatgtgtcaatcgcgagctatcatttcctcgggagacaacaccgtttgaaccaccaagacaccatttgtttcaattatttgccttattaactttgaaaagaccaaaatggcgtcgtttgtgacatactgacatcctcgatcgactgatcaattcgatccaccattaggcactaacttagatgattttgaatctgatgttagaaatcatacacgatgcaatcattcgagcaatggtagattggtagaaattgagagaatagcactgcgttagcagttccagtcaagggcttcgttgtcttgcactcttgcaatatcagtatgtcagcattacaactgttattgtcgtgaaagcgtcatggctactgcaatctttgcttttcttctgctgtcatcatggctttttaacttaagctcagtacacagtgacaaccaaaatatcttcaaatctacttcctccatatcagaaaacattaagcattgttttctcattctgaaacggaggatatatctatattcatacctaaaagttaatatttttttctgggatagaactattnaatactctctggcttttgttctggctggcttgtgtggtctgcacacatagattgatcatatgtgatcatgtcagcgcctctatgcttgctgtttcttcttgtcacgttttctttctatccgacaagtcggctttctccttgcaggaacgccaaagaattttttgttttttgcttcagagacactatacaacatacatatgatttgatagatgctggtacgacgaagcagatcacttgccgtccatctggcatctgcccagcaagttctggccccacacaacagataagcgttaactctaatccgatcattgcaggttatattatcaaaacataattagcatatataacctcgtataggttctgcgcatcttaattaaaacttcctttatttaaaagaactatataatctcatgagagaggccaatatcttcaattaatataatcaagttaactgatccatagttcatttgaagtgctggtgtgtgtaagtgtgtttcttccatatattcggggaaaaatgtttgaagtgcatgatgttttgagatgtcaccctccactattcttaccattcaaacaaattttataggagcacttgcaattattttaggctcaatttagagagcttactgtagccacggcttattcgaaaattttagctttcaaacactggttctgagaataggtaataaaatctagaaaataaatcagaaggtggaagctggaaacaccatctttgaattctccaaacagggctacccggacctggctggagaactgcaagggacagcttttaccttgaattattggacaatttatatataacaagcatacccatcaaatcaaaacttgcagacacattgacaaggcaaatgagtcaaagttccagcacactgcatcatatttactctgttctaaaataaacaaaccaaatactcccttcgtctcaaaatataagcatttttagcaaagtgacaagtcaaacaattttaccaaacaagtggaaatgaatagtcctggatgcagaatacttcttctaattcttacacttattgtatggacaacaaataaaacccttatgtctgttagcttcggccactctcaattatatatgtttggtaccaaccgggactaaagatcgagctgacctttttttttttgcatggccctgttgctgcatatatatatgtttcaatacatatatatgcataatatatatgtatttatacatatatatgttacgcaaatgcatatatatatatatatatatatatatatatatatatatatatatatatatatatgaaagcacttaacattttatgtgcatatatatatatatgaccaaaatatatatttacattaaagaaaatgtgtacatgcatatagaaaaatagacatgtattaattacaatctattatgatgtcctagctagctacgatttcgacgtagtaatagtcgttatctcagaagctaaggacctatgaattgtattttcatcgtagtagaattcacccttgggatcaaggatttgttcgttgatgaatcccatgagttgttcttgaaccgccgcgataaattccttgtgtgtgatcaggttatccctcatgcgaataaactatatgaatgtatgaaattaattagtaattaaacaacaaatcgatacgtacgcaatgaaattttgaatttatttgtacgtacaacgagctctcttgtggtgatgatttggtctgcaaggcagtggcaatactcgcacacgtagtagctgcacaagttagttccctgcttttgctttgcgcactataaataaatgacaaacggcgagagatctaattaatatacacttgtatgtatttgaattggagattcaatataaatgtagagcatgtgtactcacaggaaaattgaacttccgcctaagtctttctctccatttgccgcggaccaaatgacggaaccgataccaagccctacatggagtttaaagctatgaatcgtagtagcaattaattataacaagattcttaattaacataggaacttatgacaatacctatctataagttcgaaaaccttgtcaaacgtagactcttttttatccattgagtcatatacgttgacgatgcaggcctccaggtcgaagagtaaaaggacctagtggaatctgcaatgtgcgtgggatgcattacatatgaaacacttagcatgttcgtacgggaatgaaatttggtataggaagacagtaaaattaaactaactctgtgttgttcggcaatagtataaacgtcttgtaatgttgcgccttcaggagatggacgagattgtcctctgtggcttgcggatactggtcgagcattgcgacgttaactttccgagggtcgatgaatccagtatcgaaaacaccccgccgtcgggccctttgaatctccattctacaacgataaaaggaagtatatattatatatagtctacttatatacaaggacctaattaattaaaggaaacgtaataagaaatctaactgaacgatgcttacaaaatccagcaactcataatagagacgtcgagggcgtccagctggtatagttcgtagatacccttgaaattnnnnnnnnnnnnnnnnnnnnnnnnnnngaagtctgtgtccctaatcctcgctccgatcatctctctaccggtggcgctcatctccatgtacagttgatggaacttgtacatttgtatgggtagggactgcagctgctcaggcttgacaagcggtttaccgagttctcatgatttcacttccccctttcaaaggtgtgcctcgtaccaattgatccgtagttagcccgatgcaataataaattcttctatccaaaatcttcaccggtcaccaacggctcgatctcctggtttggttgctctccaagctgagggactggtttggactttccagaagatgctttcttgagtgttcgctcatagtccgatagctttatggcctccttggcaggtgcagacatacccctgaagaagttcctaacacttgggtctataggaatcttcttttctggacttcgaggcttcaattgtctcctgacttctgatgccacataagcgtcaagctcctcttgcatgcaatcataccccaggtccttgttcttggcggcgtcaactttcgccttcttcgttgcccttgtgggggcaggcggtgaagcttgggggggccttgacttggaaggtgccggacgaggagcttgcggaggagtcggtgtaggagcctgaggagtctaattataaatctaataatcttatattaaaactcaaataatcttgtattagaactctaataatcttatattaaaactcaaatagtcatatatgctaagtctaactgtcgtatattagaaccctacacaatcttatatgctaagtctaattacaaatctaataatcttatattaaaactataataatcttatactaaaactcaaataatcttgtattaaaactctaattatgttgctaagtctaagtgtcgtatattaaatctaatagtcttaattgcattaaaaatctaacaatcatatatttacatcacttgcctacgcgaattccttcgagggctagcgaccactccggcttgagggacgacgacgacgtcgttttttctacaacatacaaaaagatgtattaggataaacgcaaagtaacatatattgtatttcacgttcacgttgtcgttaagttcacatttcgttcacgatcgttcacgttcgcgttgtcgttaagttcacgtttcattcacctacgttcgttcgttcacgtacgtttcgttcgttcacgttcgttcatgttctcgttcacgttcgttcgttcgttcacgttcacgttcacgttctcgttcacgttcgttcgttcacgttcgttcgttcgttcacgttctcgttcatgtttgttcgttcgttctcgttcacgatcgttcgttcgttcacgtggcggcagcggagcggcggcgcggctgcagcttggcgaggcggcggcgtggcatcggcgtggcgcgcggtggtgtggcggcccggttgtgacatgccgcggcggcgtcgtggcgtccgggcgtcgtgccgccgcggcggcgtggcgcggcccggcgtcgtggcgcggcttcgtccgcactgctggcgcgacatcgttgccggtggcggccgcatcgaggtcggggtcggcatcgtcggcgcggcggagtcgtgtttggccgcgacgacgtcagaggcggcggcaacgagacggctggcggcggtttggggagaaagagagagatcgaggtcggagagagagagagggaggcggcggcggctctcaccccagagatgcggccgcggcggaggtggcgacaacgacgcacgtgagacgacggcgagatacgacggcggcgtcggcgcggggatgccccaggcagtggcggcgaaggagaagccgagagagagatcgatcggggaaaaaacttctaagt

SEQ ID NO: 72917 - DNA, 10980 bp, Oryza sativa
gagatgcaggtggacgagaagtgcaaccaatgcgtcgaggagatgcagagcacggcggcgaggttcaacagcatggtgcgctccaccggcggcggcggcggcgggctgacggcggcgttcgcggggcgggcggtggcggcggcgtacaggagggtgaggaggcgggtgatgggacagctggtggcggcggcgacggcgaggtcgtcgtcgtcggcggcggcggcggcgctggaggagaaggagcggagctgggagtcgtcgttcatccagaagcactgggcgatgcagcagctccggcgaggtgaccagcagtcgtggcggccgcagcgcggcttgccggagaagtccgtcgccgtgctcaaggcctggatgttcgagaacttcctccgcccgtaagctcaacccgcattcttataatctcttcttcttcttgctctcaactctcacatgtcacaaatgatcactctgtgctcatgatcatcactcttactagagttctttttttttttgaaaaaaaaagtttcaaatcagaaacatgatacaatcacacagaaaaaaaggtattaatgtgataatgtccattctttgaagtatagaacaaatataacttgattactggagtaatttctatcctttagacttcagagtggacattaatacctttctttctatcctttagaatggacattaataacatgatacaatcgcacaaacatattgtaagtaggagtagtatgttaacttgagtgctgaagatcttatagagaagtttgcttcgaacggtattgattggatagatgtcatggaaccagttcaaactcttggagtcaagttgtaatcattttttttttttgaagtttgacatctcaaatatattttcctataggtatgaaaatatgactgttttaacagtagtttctactgatggtagaagtggtctagacatttcatcttttctcatccaatggaccatatctactactattaatcatccaatggaccatatcatgattcaaagcaacacaagttcaatgaaaatatgtcaaatgctgattcaggtatccaaaggacagcgagaaggacatgctggcggcgagaagcggcctgagcaggagccaggtgaagcctcattcaatctttcatcatcaaacatccaagctactactacttcacaagatcagagaattgttttcctacttatggaaaaataggggaaaaaatagtattaatgttttgcattttcaggtctcaaactggttcataaacgcccgcgtccgactgtggaagccgatgatcgaggacatgtacgaggagctcaagaagacctccggaggaagcgatggcgcagcagagattgagcatcttagcagcaaagatgtgctcagtttagaaagttagcaagtttcagatgtacaaaatctgagctctgctttgtgagcttctgcatttgcagctaagggccaactagtcacgagtgtccactactgatcaggcccttatctatgaaaccttgaggtttttccttgcatatataaatttatataagttaatttctggtgcctcaaaattgcaatggatagacagtgtgttgccctcttctgtctcctcattttttgacagattgcagattttgctacagttcttgtttaccacgggaccaagactgaatagtttcatgcagatagttccagtccaaaggcagggatctgcctcatttattttaagaaaaaagaaaacagtccattttgagcttatgattgatcgacgaatattccattgatctgagcatttttttcaacgtgactcttctacccaacccaattatccatgcatataaaagtgtactactctcttgttctatattaaagtcatattgagtttgtcctaaatcgaacaaagtttgatcatgtttttagaaaaatgtagtagtgtttcgaacacataaaaaacatgctgtaaaaacatatttagtggtggatttaatgaaaacaatttgatgctatagatatcactatattttttctataaacttggttaaggttaaagaagtttgacttgtaacaaacctaaaatatggagtgaacagagttcaccctaggcatctttgggttgaactcatgaagttggcaaaatccaggtagggagaatcttgcagttacaatgtctgcaaaatgtagatagatatccagtgcacatttctgaagattgaacctgaaccaagcagggtcaaaaaagccatcacatttggctgttcagtgtgatggaaaacaccatgacagattcgcagtcactcagatggaggtaaaaaaaccgaaaagaaaaagggaaagggttttgaaagattttgaagtggccacaagtacaagcatgcttctgttgctgattggatccctttttgcattgcactgttccttgcctgtttgcaatcatgccccatctccctgtatatggttcacggattttgaaaaagaggaaaaaaacatcatcagcacatgaattgtttggcacctgatttggcgtgtgcatccaagttggagtctttggaaaaattattttttttgtttatgatataactggattttccgttcagttttgcgtgatgagactagttgtactggattcgatatacaactcttagggagtgtttgaagagaaggggattgaggagattgggaagatacgcaaaacgaggtaagccattagctcatgattaattgagtattaactattttaaatttcaaaaatggattaatatgattttttaaagcaactttcctattgaaattttttgcaaaaaacgcaccgtttagtagtttgaaaagcgtgcgcgcggaaaacgagagacaatctctcctatctccacctaacgaacactcccttagtttcttttttttttggtatgcagggttgtaatattgtagatatacaatagatttcgatagtaagatttcatttgatataaaattcttagctcttgttaccatttataaaattgtacgttgcacacaactattattggacaatctacgctattataaaatgaacccaccgtaataaattgggattttattcgttttctttgattaatgtgagaattttgactcatttttttagctattttgataatataatagaaactctatcgagcattggtacacatatgaaactgctaggaattaaaacacaagtatgctttgagctgaccgatcatatctgaaatggcaggagtcatgcttgtatgtgcatggatgtggactcatctgggtatacaaggaacaaaggatggattgggacacctttcatctcctaggatattgccacgttagctaacaatcctaccagcacaaggaaaaggtagtattctctcgatcgacgaaactgatgtggtagattcatgggagaaaaaaaccacttcttgatatgttattgttgtacgaggttatggatgcacattcaaatctagatgtgcacaaatacatatatgtgagtgtgtttatttaagatttttttttttgcaaggcatatgatcttatccctggtctttgtctatttctgtgtgtatcaatctaagagggtgcacctaggatggatattgcagggcatgaacttacatgcatgatgtagtgtatgtccatggttctgtttgaaaagcttctggttagaagtcgatattgagttagcttggctcggatcattattctaacgagctaaaagaccttgagctggtaaatgagccgagcaaaagaagactcctaaatccctagctgctagttggtgaaagcgtaattgagtcagcgtgataattcgattaatcacgggccatgagtacatatagagacaatacttccttatctctacatccgacttgtagaatcagaatcgggaaataattagagaaaccgactaagataagatacaaaatatatctctaaatgttggattcctaggttgccagttttcccatggcttgtttggctcatgaggcttgttatgtgtaacactaaaccccccttgctcagtttgttggcaattctaaaagagtcgagtagcgagctaacgagccattatttatctagctctacttctggtaactatagcttatcctagaaccttcaacaccctaagcaatattattgattctcacttagatcttggtagtatatagtcatatttttaaaaaaaaaatgaaaagaagctgagaaatttaattttttagattctcattagctgcctattcacgagctatttcttaaaatccagagttcttaaaccaagctgcatttcttttgtagctcggtaagagaattgaaattgcatgtagctcggtaacatcagcaaagaggaggaaaaaaaatatatattttaaaaaatccgcctcctacaaaagttgggcatgaaaaaaagaccagtacatcgatttgggctaccggtacataagtataaggttcattttatacaatgggcttgggacagcctttgaatccaagtgtggaaaagaacccaacaactcgatgggcctcattcttcttgtttgccttttatgctccttaggatctatagaggtttataaagtataaaccctgaaaaccaagtgggataacaagcagagcattttttttaacgtggaacgttagagcaaagcacattatttttgtagcgataaaagatcagtctgaaataagaatgatcttctaaaattattttgtacaagtaattgtagccactaggtgacaatcaacaacctcacataatgtaggatatgcctattaatctattttgacctaatgtgttgcatactaaactttagcaccgagtgatgatagacagttcatgaattaaagaaaaacttacaaaaattcgttattttccatctgtttatcgattaacttaattctgcataacaaaacattttaatccaggtaaaaacatagtaacgacgatatcctaaatgttatgatcttcttagatgcgttgtgttggaagtctcctattagtgtggtgtccttagtggtggtccccaccggatccgttcgatggtttaggcggtagcaagatttgagtaaatgactaatttacaactcagttactctctgatattatcttttgttgtggttttcgtcaacaaggaggttaacgaaattcaatcggtaaatgaacgactgttgttttcggattttctgttttctagtttgagaaagataaggactacatatacaaacgcagatgaagtagtttgcttgttttcaattaaggcatgattttgtagttcgtagttatttgacctataatttctaataatttgttgtagctttttaaaattaaaaccggaatgaatttcattataaacaatcgacttcacagcctgaaaatttggtgcacatgtgctaaaaagaaacaggggttaaaattaaagtgtcatccactaaccctgctttcagtttagataaggaagatgaacgagccatgcactgactgactaacatatgtagatcttttatctatttttaggtttcatggcattgacttgtcttgttagtgtactgcgttgacttctgccgtggcacagagatatttttctatagttgggagttgactttggtgtgtgaggacataaggctggaattatccattgcatggggcaggtgccatgggccatgcattgatgctgcttatgcagctttgcatcttcaacaaactttctttgacagcgtttcagcagaaatgtctgtgtgctatgcgcaatctgttggaaaccactgaatcaaaaacttatggcaaatgctttcagtgctttatgctctcctgtttcatattataagtcgtttgacttttttcttaatcaaacttttttaagtttgatcaactttatagaaaaatatattaacatttttaatatgaaacaaacatattatcaatatatattcaatattaaatttaatgaaactaatttaatgttatatatgttgctatttttttctataaacttagtcaaacttgaaaaaagttaaatgatttataatataaaatgaaaggagtagtttatatattgattaacggaagagggtttttatattgaaaagataacatgaagtaatatactcgctctagtcaaatggagtatactaacttggttctcccaacatcaagtaaatttgattggaggaattgatgacctttttaatattgatttgtgatacttttggtatcttgcgctagtttatattagaggtatcacaaatttataggggagaaatatctttgtcctacgaaatacgatcaagagaaaattgagagttactccctccagttctataataattgacgttttggacaaggttggagtcaaacttttataaatttgaccattaataactttaaaaatatttagtttaaagaaactagaacaacatatatagatttgtctttcaaagcactataataaaagtaaacatgcatttatttattatttatttattgtatatattataatagaaaaataaggtcaaagatatattttgtagttcgtgtcattgtccaaaacatcaattaaaatgaaaccggagagagtagctccgtttggaacaatgtcttaagacattttgttaggagaaaaaacaattttgatctgcttagatattttgaggcaagtttgacttattttcttccatagtcacgaatacacaatttattggtacctgaattcacctattatcaataatcatacttctggtcaaactttgcataaagtgtgataagcattaacacatataattgatggatacagtcatctcctttggagggaaaatgcctttttccttttcttttctggaaaaaaagtgtgagactcatgaggccatacagtgaccccacaaagcagcttagccacccaataagctaactataactattcagctaatttaattattcagctacctatatatttgcatgtacatgatcagttttgctttagggagtgacttgtcctaatctatgccgcttgttcttgctgtttttctgtgtgtgcttagctgctttgctttggctacccaagcaatggtggccactgctttttgcaacaactctttttcatcaggtcagaatttgctcacctaaaatttttatttagagtcagctcatcagagtatttggaatcttttcgaattaaaaaggcatcattatatatatgatgtttatattttagtagcatttatctgataactgtaaaaaaaaaagggtctcacgagatactcgaagttattgacatattgttgggcaggaaattccagaggtttcaggccggccgtaccttcaatatttgtttggatttaagatgaaattaagaaatgattttatccgaaataaaaaaaaagaatttgagaaatgaaatgggaattgaaagcaacaccgtcttgagttcatcctgcttgctgttatcaaccacctgaaactctgaattgaacaaaaaaaaaagggcagatgacagcaaagaacaaatgaccatgcgtgcatcagaatttcgtttgcctttgcctatcttatcattttaaccctgagtactatcagggttcaatatttttaaaatttcaggtctatcggttagcactggtaggatgtgcctcctaccaaaaactttaaacaaaaataatgtttagattcccaaacatcaattttttttttcaaaataccacttcttttcttttcagtttcttcttcaccctaaaatcacttcgcgttttgtaattggtttgtttggcacagctacagctccagccaaatagttttagctccatctgaaatgggagcgaagctgagtggagtgctctcacaaaattaactagagaggtggaactgggtttagacagcggcacagctttactccagactcaactcctaatctaaatttaggagttggagctctaccaaacatacacgtaatcctaaaatgttattactttgtgccaaggtttaatctaccgccgaaaacaattgttttcacgatattcttttacctatcgacgtggctcgaaatcaattttcgggagtgatttcgaatggtttttgacaaactaaaatttaaaaatagtaattttgatcgcaatttggtcaaaacttatcaaaatgctgttgaaatttgtcgaaaacagtgataccaccatggtgaatcggaaatgtaaatcccttgctcgtacaaaccaaaacaggcttccttatgccacaacagttgtttttacaagaaaaccaaaaggaaagcaaaagaaaaaaaaacatgggaaaagcaaaactaaaaaaaaaagtaaaaagaagaagaagaagaagtgacaaataacacgacaccgccgccgccatggacgacgacgacgatttattgacgaggcctctcctagtcgcgccgccgcgaagcagaggaggagtcctcggcgacggcggcgagcatctggaggttgagcttgacgacggtgtcggtgaacatcctggtgtcctccgccgtgttcccgtcggggacgtcgacgacgtaggactcgacgacgacgcagtacggcggggcggggccggggccggcggcgggcggctggaactcggtgacggaggtgacggagcggtagttgcggaggcggtgctggccgccgacgacgcggaagctgatgatgtggcggtcgtcgtcgagcatctcgaggcgctcggtgctggtggaagccgggaggccggacacgacggtgacctcgcggacgctgccgacgctggcgccgtcgccggcggcgagggcgcaggtgcggacgaagtgcttgtaccgctgcgggttgccgaagctgcgcacgatgggccacaccgcgcgcaccggcgccgccacgcgctgcgtcaccagcgatgtgcacgttgccgccgccgtggtggcggtggtggtggagggcgggaacgtgtggtgcgccatcaccgccggctccagcgccgccctctcctcctccgtcaggccctcccggagcgccctctccacgtgcgcctccattgatttctgatcgacctctctctctttagtttctctagcgcgtgcgtgcgtgcgatgttgggggtgagctaagctagctatgcctatatagggagggaggtgatgtgtggggcgcggtttactaggaagccgacaagcagcaacttttcactccctccgtccagtaacacgttttaactttgatcaaagttaaattattttaagtttggctaagtttataaactaatatagtaatatttataatactaaattagtttcaaatcaataattgaatatattttcataataactttgtcttgggttgaaaattttactacttttttttacaaaattgatcaaacttaaaccagtttgactttggtcaatatcaaaacgtcttataaggttaaatttagcacggtgtatgaaactaatttttaaacttataattatatactataaggtttatagcatcaaaattataatatatgaaaataaattcaaataccaattcgatgatattatttttagcaaataaattcaaattatattatactaattgttcgtcaaatgtttaatagttgaatattaaaatacgtgcgtgttttatagtatgggatggagggaataactttgattgttttttataagggcaaattatgctaagtacaaatacacgcaacaatttataaattatttgctctactgcaactcatcagtagtttgcaaaaatcaaaccacaattgaatggtctgacatggtgcattggcgctaaaatggatgcaatgttcacttccactctagcacagttttatcatggtttttcatttttctttttccagataatcccatatgtgtggttatattcggcgtcgaggtttctgctgtgcttattccattccacttccctctgtttgagacgaaagaaacaagaggtcggcgagaggcaacttgctgctgaaatcatcgccattgtcgggacgtaaatttcatatataggtaacatatatataaatatttctgaaaaaaaatgcatccgaaataggatttataaactattgagatcacaccattagaaccaaattgcatttcaaaagaaaatttggaacaccctaatgcagtaaatgcaacatcattttctcatagaaataccctattgcaatttgaactgcaagtttctcgatcaatctctcactagaaatctccatgcaccaatctattcaattgtactatcatgaatcgatcgtgtaaattagagcctacacgcctagaggtctcaaacatgttttggcatctgattgatcagcaagattgccacaggacagctacacagcaatacgccagggcccgatctaacagcacgaggtcacaaattagtttgactccacttattgattgctggactgttttggccttggtttatacttaagcaagttgtatggaatgtgcaatttacaagtttgttgcacctatttaaggatcctttaggacgcataaatttgtccgattgattcctataaattacttcagcttttgtaatttttttttaaaaaaaacttctctatttcaaaggagactttggggaacatatcagatgaatactaaggtcctgtttagttcccacgcaaaaattttcacccagtcacatcgaatgtttgtacacatgcatggatattaaatatagattaaaaaactaattacacagattgcgtgtaaatcgcgagccgaatcttttaagcctaattgtgccatgatttgataatgtggtgctacagtaaacatttgctaatgatggattaattaagcttaataaatttgtctcgcggtttacaggcggaatctataatttgttttattattagactatgtttaatactttaaatgtttgtccgtatatccgatgtgacacgccaagtatccatgtactccctccgttccagaatatagcaacctagaaccggataggacgtatcctagtacttagaatatagcaacct

SEQ ID NO: 72918 - DNA, 70595 bp, Oryza sativa
agacgttttgctcgacgagcagcggggcggggaggcagacgatgtgtataggaggaggaggcggagagcggggtagcgctgtgcccgatgtggcagtggcgcgcgcgcgggagaattggagcgattggcgcgcccacgccgccgtccttggcgcgtgattttggcgagggtatggctgtgcgtgttgttgtgtgggggtatgttctgttctcgtgcggctcgttgctccccggacgaagagagacatcgcgtggcgtctgcgagccgaggcgctagcccggcccggtttctctacggtccaacaaagacgacgtagaggcgcgggtggaccgcagatcagtttcgggggattggcccagagtctaatcccatacaattgcatcaaaatactctcctctcaaccaccacactaaaagggatcaggttcctctacacttctacagttgaagtcgtgtgactttgttactgacgtatgagcagtattctaaatctccggcagctatagccggagatagcggattgagaggaaaacagctaggatacttcaattttaacgctatgatttatcaaccactaatagctgcacttagtcagagatagccgctaaattacccgtatatagcggcacttagctgtggctaaacaaatttagaaagcaaaaactgaaaacgggctttcgacttgcatggcccataaagttcaacccaacaacaaaccctaaatagtcgactcctatcctctcccactcatgcgttgtgagacacgatcgaaacggtggcatcttgcggcgacagcagcggctcctaaggtggcggcagcggggtgcctcccccaagtagcggcggtggcggcggctgctgctgcttctcccggtgacggcggctcctcccccaagcatcggcggtggctgctgcttctctcgacggcaacggctcctcccccaagcagtggtggcaggtgcttcgtctcccggcggcgacggatcctccctcaagcagcggcggtggctgcttcgtctcccgatggcggcggcttctccctcaagcagcggtgacgactgctacttctcccagcgatggcgactgctcctcccggcggtggctgctacttctctcggcgacggcggctgcctcttccccacaacgaacggccaccattcctccccatccccttcaccaatcctcctctatgtgcaatcaagtaagtgatatgtcagtttttagttcaaattctatgaaaaaattgaatttttttctaatattttcaaaaactgctaaatgtcttagctgcagttatagccagctatagctgctcttagatactggagagctcaaccgctaagaagcttagcaggagatttagaacattgcatatgagtctgatgatccctaggtcagcatgtcaatgacaaagacaccatacatttgactgcagatgatttcaatcccactaaaagttgtgttcggtcttgttggttgggaacgttttcgctttgcatggaaaataaagtagctcattagcatatgattaattaagtattaaaaaaaattaaaaaatgaaataatacgatttttaagtaaattttatataagtttttcgtttttagaaaaaaaaatcatcgttcaatagttccggaagtgtacacgtgggaaaacgagttagtggaggatgggaacctacgcatgcacgttcataggatgagttaggaatttctccatcctgcaaaaaaaaatgaggtaacgcataattcattaattattagtttaaaaaataaaaataattaatcgtttttaaataaatttgtctatataattttttttgcaaaaaaaatatattgtcatgcagttcggaaattgtgcgcgtgaaaaattattaaaaaaagaaaaatggtgtaccgaatgtagcctaatacttagaaaaaaaaacgaggtaatggtttccgcatcaaagacaaggaggaaatgtaaacacagcactaagaaaatctcgtgtttttcttccacgccaaatccattctatatgtataatactagcacgtcaccgtacgtcgacttggaatttcttgataggcctgccatggttggtggagtttttttaaaaaaagaaaaatctcagaaacctatttgttgaagctattagttcgttgcaagtttagctcgttgttttaactttactagtaaaatgtccgtgcgttgcactggataatgtcgcggcaattgaagtttaactgaacgattttttaagcaatatagtatgtcaataataatcgcagagttttttttgacaattattccacgtgtatgtgtataatatgaacgatgtacctgatgagttaatagtgtgaatgccatggtcattttcatgcaagaggcaatggacaaaaaaattgtgattaacaaaaaaatgtatttaaaatagaaaattttcataataccaataataatcaagatggataaaaaatacttttggatatttactaatagccttgtagaggttacgcctgctttctcgcttatgtcaactctcacgttgtaagcatgcgtcttgtttcactatcatatatggacccgcgttgagaccggtatgtgacatgtgaatgatagcacacatttttttacaattgatattttttatctcaaataaatattaaagtgaaacttccggtgattttgatgtcaacaataaaaaataataaacaaaaaaaatcactcattgtatctagcatcagaacagagccgtagttgtcgccaaacaaattgagcactgactccaagccattgttgatgcgcacactgatccaccaccagcgcctgaatcctatcgcctctctgcctctatctcacgcggatccgccgtcagcggttacgggaggggcagattcggcgaactcttctcatcccacactgatcccgtcatctctccgcctccctatcgcacggattcgctatcggtgtgcgacgtgaggagtggattcgacgacctcttcccctcccgcatggatcacgtcgactctctgcatcgagaggaaggataaaggcaaaaaaacgatggatggaaaaaaaaaggaaaaggcaaaaaaataagacggacgaaaaaaggcgatgaataaaaagcggatgagaaaaagggtgaaaaaaagattgacgaaaaaacccggaagccttatgtaaatccccgtgcgtcgcactgtgtaatgcagagtgattgaagtaggattttaacgatttattaaagcacccaaccataatcataagaatcagagatatgttcgatgactaagaagtcgtgtttgtttctagacaattaattttccctacatgtgcgggattgttagcaaccgaatttggtagtatcagcgtcggaggtgaagatgggatcgaagcggagtcggaaataaggattgttgcgggaacagagtaagaatcggctggagtccagatcggctacgactaaaatcgactaaatctgaatcagactgggttaggtgatacagccgattccggcaatacgacttggtgtacaacatatatgcttcaagatgattgccgcacatggatagagtcctgagaaggcaattgtatctattaattaggatgttttacgtaatttccttagagatatgcttagggcaaaagtctgccgcaaagacttatgatatcttagagtttgttagagataatagtcgtgtccggtatggacatatcttataattctcgggtataaatagaccccgagccctatgtaactaaaagaacacacgttcaatacaatcttggcgcatcgccaccctttttgctttagttttatttcgacgagttattgctttcgagttgagctgcatcggtttcgatcttcaacaagaggtaaaacttgttatgacggcttgcgttctcgggattagtgattccatctttatgacactctaatcttgtttatgtaattcgccgagttatcatatatcctacataatccctggcaatattgatatctaacctacaatcggctaacatccgtcaatagaaggcagccgattaagttaaataccgatgctgacttagattatataggatatctaccactctatgacacatccgacggcttgattgtctagatattgtccttcttttcatacttatagctgcatcagttaagtttgatcttatgagtcgtgattagaatctcaatctctactacttctcggttgctgattagggtagcatcggagtttcagccgatcttacttgatttaactactttttatcctatatgcttgattgacatgttaaatctgccctttacgttaagatcttgctgcatttaagtatgttaggctgttgtttagtatattctacttgctttgatatcttaatataaggtggtatcagagtattagccgatacatgctagatctatctgatcggttatactatgaacgtatatagtctcattattaatatatatttcgatctaagtgatttatactgtctcggcatagcgaccgatctatcccaatcacttaatttaagtatatatcgatataaagattatatattgttaatatctgcagttgatcgagtagatttagtcccttcttatttattaatgactgccgatcgatgcatatatgacatcggctcaaagataattgatatgtcatcggcacctagccgattgactatcatttatagatttaactgcggtttctttgcttctatttcttgttgattacaggatcaaatcaactggcacgctagcacacccgaatgcgagctttggacctgtactggagttaagcagatctcccaggcctcgtgttttctgtcaacagggatgtggatgatgcctctgacatgtggttcggatggttgtagcgatggaagaacgtttggaagaacattacaattgtgtttgcgcagaaggcgacggatggaaatttatgtgatgaacataaatattgatattttttaagtaggtaagtttaataaaaaataaatggaattttctggtaatctatgtgctttaactatgagaatatatagtacgtgttgagacatgaaaaaaatgtgtggagttaaaccgacgacacattagaattgtgaatatcgatgctacttttttgcattttattttcttttctgaaacctttatatcattttttataatttatgatttttgtcttagtaaatattgaagttaagaattgatgttttttatgttaatattagaaaagtaaaatagtgaggaggtgatgagctgttgcacaccaccaacctgaccagctgccagctctcactttctagatagctcgaggaggtcagagaaaatgagagctgttacacttacacaccactctctctctctctcgttctctctatttctccctgttttcctgtgtctttctccacctcctcatatatcgccagcagccactcctgctcaaagccgtcgttgccaaccagatccaccatgccaccacctgctattgcatttagcttcttcgatagtgcatttccgtattgagacggattcacccctcctcgcctggatcccatagtttctctgcctccttctcgcgcagatccgccatcgtcggcgacgggaggggcggatccggcgaccccttcccctcctgcacggatcccgtgggcggcttcactcctcctcgcttggatcctgtcgtctctcctccccactgtcgcgcggatccttcgtgggtggtgatgggaggtgcggatccggcgatctcttcccctctcacacgattctcgtcgtctctccgcccccctctcgcacggatctgccgccagcgacgacgggagggcggacccggcggcctcccctagggtgacgacggcaattggtttcaagaggtgccgatgtccatgatgagaccgtatgcgtctcatggtctccatcaccaaagccgccgatagcgccaagaagatgtacattgctcttgagctcccccgatccccactcgttccatcaccatcactcaacggactccccgctagctgtccggccggccggagaggagggttcaagcttgcagacgaaggtggaccgaggagagcgcagccgagtggtggcactgaagatagtgggcgtttcttcatgatttcaggtgcgttctcggttgattaacattttcctagctttttgattacacggttagacatgattttgtctgtgtatgtgcatgtgggggtccgagggatatggatgggtgttttttttttttgcttgttgggggtattggtgtaaacttatcagatatctaaacatagtaaatttttttctcctgtaaagcatatctgattcagtttatctaagtgcttaagtcctatggctgccatagattggggttagttttgtccttaatataggattataggactacaaactctttgatgatcctgtttgtgtgtacctgtgtatgattacttagactttgtaggagctgttctgctattttcacatgcaaactttttatccatttttcgcatctagaattattggtcaaccattattgaactcatttaaactatatggatctgaagtttttatactgaatatacctcattagttgccacacaaggtcatatcttgttacaaagtcagtgattctaaaaattaatttgagcatatcatgtctgtggagtagttcatgttcacttttcttctttcggaatttgtgttctttgtttgtgagaccaacatcttcaggattgattaagctgttatacagatattttaatcttttagacatatattgcttgaagaattgaatttgggaaaaatgtgtagtatttcagcatccttgattaggtcacacatgttttgacaaaataatatgttttgtaatcattatactcaagcgtatgtgaaaatagtaaattctggaacatgttgatcagtccgaggttgggaacatgttagttaggtaacacactgtccatctgctctatgttgtaggggaggagcggattgttgagtggattcgaggcagagatggtggttaggatggagtggtgatgtcatcggaggttgtctcgaatgctgcagtcgaggtgtctgaaccggtgagtttttttaagctgatatgagctttgctatgtttttctttgtcagaataattagattggacaaatagtttatttgatttgtttggtttgagtggatcaaccaagagcatatgtctaggtggagaagtgtattcattaaaaacttgtcctgttactctatattggtcgaatcttgatgcgttcttctcggtggggctcgtggacgatagcaatgttccagaatttactactaaaattttagtagtatttcttaagtaggagggcaaattgtgtttttatgattatgttatcatgtagcttcctagtgcaagaatctagtcgataaatactatagtgaacaaaagaatggaattatttccattctgaaattctaaacatacatatacatatgctagtctgtaagtgagaaaatttgtcaggcagcttaattcctggactgaactgcttgttttccttttttttttgcccccttaaaatgcaatgatacatcttgtgactacaaatgccattattaattaccagttgatcatcttgataaatgagaccattgctgctagcttgatctccaaaatcttaggacgcccaacaaaaccggtttggtgctcaacaattcagaaaaatccaattaattcagattatattcgtatgataattgtatggtgtcgattatattagttataatgagcactaaggcaagtgttcaaattgactaagaattctactatgattttgctgtcagggttatacaatagatcatgcattcgattcccgtgttgagggatgttctcatgatactgggcagctattgttatggatttgtgtttgattatttattgaattggttacttttcatattctctgaatttagccttgaaggttaatcagctaaaaattatcatgtctggctctatggattaccagaagtatctaaactactcatttttctatgtcaattcctgtagaaatctattttccaacttcgggagtggaggagaaactgggttcatgttttcaccgccgctggtcggaaattggtaaggtttttgtcatgaaattaccaatcttaattgaattggttagttttcagtagtttgaatttagtcttgaagcttaacagctaaagtaggaaactcaacctctaaatgataaatgatactgttcatattgatatttgcaaacattcaagtactgtgaattttattacctcaaggtgttactgtgaattttccaatcaatatgacacggtggttcaaaaattgcagattaaatcaaatcattaatttcatgctactatgatatgatctcatattaattttgttacctcaatgtgttaccgtaatggagtagaactgcattagaaattcttgagttatatataaacctaatggaattgtaactgcattagaatttcttgagttatatataaacctaatggaattgtaactgcattcagggttcagtttaatgataacgtggaagtggcttgacccccgaggaagagcctcgtgatttgtatttttgtattttcttgtgtgtttctattatttctatatgtatgtcttgcctgtgattgtattcgtgtatgtgtatttttcccctgcgagagaaatctgtaaaatcgtgttagtgtgagcgctaaaaaatagcggtagaaataacagaagaaaaggaaaacggaggacttgcggtttgtggccttgtgggcttgtggtgcacctggacttgtgggttaggctttatgggcttgtcgcttggacccgggcttgcttgtgggcctgtggacagatgtggcctactgggcaatgatcacacacaaaagcgcgtacggacgaaaaatcggatctgtgtaaactgcgcgtacggacgaaaaagcgtacggacgacaaattggtgacgaaaggaaaaatccgaatcttttagttaagatttgtctaacaaatttgactccacatatatatccctcatgttattttttttgaagtcagacctatatatcattcacatagtagatagagttatatttctttgataaaaaccatttgttgttttggttttgtaaaataccacgtcgaagttatagcaaagtgatagttcaatcgaataattgtaattttccaaattattatttttataatatcgcaaagagttcaatacaaaggatggtccgctaaagatggtttatagtttatagtttaatcaacgagaggcgcggttttccacgggagaaaaatgcgagtgcaaactgaaggtttgggatgcaacattcagcaaagtcacaaataaattatccaaagtcaattccaaatacaaaaaaaaaatctaagtaagaattacacgagattgcaatgaacgagcacgtcaaaaatcactaagcataacactcgcaaagacctgacaatctacaagacgatatcaattcgatcgggcatgcacgcaggtgcatgcagctacggtgaccatcagacaccgtacacgaagaccggcagcagcatggccgcgacggcgagtccgccggcgcctagcgcggaggcggcgccgctggggtgaggcggtgtagggggagcgttcgacggcggcggcggcgggctggccggcggaggcgcgtcgtggccgatgaccttgatgaccatcctctgcccacgctcgcagtggccggcgacgccgctgatgaagtagaagaggccctgccggtccagccccacctccgtgtcgccgttgttggagaagaagatcgggtgctccgccttgcacttgttgtagtcgtcttccgtcactaccatcaccgagtccttcgcgtacttgaaatctgcatcaaatgcaaatcaatgtcgcgtacttgttatttttattacaaccggtagaagttgaatttaaacttaaatgtttatgatgtaatatatttcatattaatatattttgtcaaaattttttaaatttttcgatgactatttaggtggcatgcacgaaacgatgaatatcccctctagagatgaaatcactttccctgttcattgccgacagaattattcgaaatggagattgatcgatcgatcgagtgatcttacggacgctgtcgccgacgaggaagcggttcttggacgcccagtcgttgtacacgccggcgtctttggccggcggcacggcccagccgtgttccccaccgacctcgaaggtggtggcgccggcacgccggaccgatgcgccgaggagggcgagaagcagcagcagcgcgggggagacgaggtggttcgtcgtcgtcattaccgatcgcgagatggtgcaatgcagagggcggagagcgaattaatagcaggtaaagagcgcggatggtcgagcggcaagccaggagcccaggtcccaggaggaggaggcggcggcggttttggagtcttcagccagggagggaatagtggagattgcgactacgtgggccgcattggcgtagctgcaatcttgcattcttgcatgtctagtatgactcggcgattggttgcctcgtttgaccgacgtgccaatcaactgccaactgctaacttggttctcacttctcaggctctgagctgatgggcgtatcctgggcctaattgttgtagtggaagttgcggccctactagccaacggcccagtgcagaacgcagagcaaagcgaacaagaactagttttcttttttataacaggctaaatattgattacccggcttctggagaaagctaaaacaaacacattctgaagaactactactccctccatcctaaaatataagaatataaaatcagatgagataattcttagtaccataaatatggacgagctataggactaggaaatgtctcatctaatcttatattgttgtattttgagatggagcccgtacacagccgttgtatgtagacgatgcactggccagtggcagcctggcaggcagtacgatcgtatcggatccaacggtgtgagatgcaccgagccctcctcgctggcaccggatgcgtgtaaaaagatactgtagccctagtacgttcgagaatccgagcaagcacgcgactcccgtattgtagtactcctaccctatctcgcaccaaggagggacagtgtggtgacaccaaggacaaagcatggcgtccccatcgggagtagcggaagtgtatcggcaagcgccgtgctctgtcggggccgggcgggctaccgcgacagcagcggccgacctgaccttcacctgaccctgccccggcgcgaccttcttccgcttgccgcgacggcaaacctgtgtgccccgcgccgcatgtgcgtgcccgcgagatcgcttgcgtgacggctccgaccaccgcacacatgggcgatgtgtgcgcgactactgtactgtgcgtgcgcgcgcgtgggcgtgggcgggtggtgcttgacctcgatcgcctgcgcggttgagtgcgccacggcgtcctcgtcgtcatcgtcgtcgccaaggccagcgcctccttgcgcctctcggcaagccaacctcgcggctcgcgcccacgccgtggtggcccatgcgggccgcgccgctgacattttcgccgtacgtgcggccgcggttcgatcgccgttggtgccaggttgctcgttctctcacgctggttgtttgtacggctcggctaagctactccctagctatgattcccccattcatcgtaaccacatcttctaaagtattaaatgatgcgatttatacaaaatactttttatataaaagttttttttagaaaaataaatgaatctaaaatttcaagtttgtactccctccatcctataatataagagattttgagttttttttacatcttttgaccacttgtcttattcaaaaaatttgtgcaaatataaaaaacaaaaagttgtgcttaaaatactttagataataaagtaagtgacaaaaaataattctaaatttttttaaataagacgagaagtcaaacagtgcaagctaaaccttaaaatctcttatattatgggacggaaggagtaatacattaacacatccggctctatacaagggtttgtctacctagataatcaaatgttattatattttacaacaaagataatacttaattattcgtgcattaatgttttgtttcatttcgctcgccaaaaaaaaaaaatctgagccataataagctgattgtttcattaatgtgtctgtttcaactggtgaagtcggtaagagagattttcttcacaaagttcctcatggtatacatacagtatgtatgaagccgcaaaattacataggtaggtgaacagttgccacggttttcccaagtttttactggattccacatctgcaaaagggtgcgaattgcactgtgttctcatatgtggcaaccttgacacacagatagtagtaacagctggtagaaaaagcaccaaaccactgcatttggctgagacaccaccccatgttgccctgtacctgtagaactgtactacttccagaattatacttgtatttatacagtgacataccagtatggctacggacgacacacggtggaaacggctatttacacggcgtcttttcggcgggtcccaccatgatgctcccgagctccgcgttgcggaggcacagcgccgcccggaacacgccgttgacggcgtcggacagccggtccaacggcgccgtcagctcctccgtccgcctctccacctcctgcaccgccgcccgcagcgccgcctcgtcgaggtcgccgtcgccgttgtcgagcacggatttgagcttgccgacggcctcgtcgacggcgtccacctcgctgggtttggtggcgagggcggcgagctggatggacacggcgttgaaggcctcggtccacgggaattcgccggagaccagggggaaggcgatctggtggagggcgtcgccgcagaggacggcggacgcggccgccgctgcgagcgaggagacggcgtcgacggcgaggaggacggtcgcggcgccggagacgcggtcgcggggctggtcgaacgggagagaagggagcggcgggggaggcgacgccggggcccgctcgtcacggtcggcgagcgcggcgcgcgcgcggcggaccgaggaaggcagcggtggtgacgacgacgagaggaggtggagcgcgaaccgggacagcaggcggcggcggcggagccggtcgaggcgcgcggtgatcccgttgcaggcgtcgagcagcgcgaccccggcgtcgaggtgcgcggcgacggcggccgcgtccccctcaccagccaacgcgggaacagcgtcagcgagggcaagcgcgaggagatccgcgagccgcgccaacgcagccaacggcgacgccggcagcggcagcaaactcccgagcctcgcggacagcgcggcgccgaaccgggcggacccgggaccaccacccgccgccccgggcaccgccttgcccggcctccgccggtgatccttcacgccgccgccgctggcgtggaaagggagaagcgcgtggtacttgtcggtgaggaacatctgggttgctaagggtgatcggatcggattcaggtgaagctcgcggcggagacgaggagcgaggatgtggcggggagaaggatataaaggtggcggtggcgtcgcggggggtgtgaacggtggcgaaggtgaaggtgacgggacgtgaggcttttgtccccggcaagaatgcgtttccgggaagggggagatggcctctctctctctctcggctgtgaagatgatgggagggcggcagcgtgggcccgccgcgtaagacgcgtatcggaaacacttctgaataagaattcgccttttcactcctccacgcctctctcgtctcaattgagataacgcagtactgcagacgacatgtgtccctctcgtctctccttttggtatcgatcgagaggggaaaaagaaaattcagaatctaattagggttagctctctacttgtccattttaatactggacttaatcgagattatcggtaatccaccacatatatatacttttacttcaagtatgcgcaatccaccacatatatatacttttacttcgagtatgcgcgtggcgtcatctactttttaccttggcatgacgttttctttctgaacattgggatcgattcttttttttcccttcttgttttagcgatcttgtaattgcacaacagcacaccgtaggtacttggcagactggaatgaacacatacacgtaataatttcttctcctaccttgcgggctaaagatatacgagcagaacatactggaacgtttggctaaaccttaaagatattttttttccttatcgtaccattaagggcattaataactagactgggatcactggcttattacccccactaatagagctttcatctttatgacatttgatcttacaatctccaggcactcaagctccgtgcagggccgcgcgtttccactggtgacatcgcatcctacatcatcgtacaactacaagtgcaaggcttgcactcttctgcagttcacactggactagtaagttactgtcagatggcatatgtgccgactcgatcagctaggcttataaacaagaaaatgtacgggctaataggtaaggatggggccataatattttctctgggtacatattgatcaaagaaaaaaaaaatctcctccgatatgcaagttctactagaatgtgcttctgcgattaaagtcgtaacgaaaatttcataggaaacagttacaaaaatcatctttatgacatttgatcaaatcgattccaatgccaggcaaatgtggtttagttcctaactttttcttcaaactttcaacttttctatcacatcataacttgtctacacgtacaaactttcaacttttccgtcacatcgttacaatttcaatcaaacctttagttttgtcgtgaactaaacacacacccaaaagctgatcgaatcacaaagtagcctagcctaggttatgacgagtccagcgtgaacagcacgcccattttatcgtgatttttctttggggtgtgtgtctgtgcccataccacgtcattttctgatttttgccgagccattttactttacttaccgtggatgccacacaacaaaccgtacatcacttgcagggaagatacagatattttacccgtgcaacgaaccaccccgtctttgagggtgtcgcgcacacgtgtaatgggtatgttcccatgttctgttacgcccccattctgcatgacgcaacgctacaaacagcacacttcacttctgtatcatatgcaatgcaataccgacatcatcagattagcagaagtagcaaaggccatacctcctgatacctctcctgtgtcctgatagactcgttgggggtggcaacagcaacagcaacaggtgatggcgaagaaaaatttaccatgagacggggtccagtgctacagttgccaccaccctagcttcgctttggctccacgcatccgaaacggtaggagagaaacgtgggcgcccgttttattcttcgcccattggctgttttttgaaaaccaggttcgggccatcgactttgacctgctgaaaacttgatctgcacacaacatatggataatgagcgataatggtaatttgaaaaactttataaacctgaaattaaggagccgttgacgcagacccttttgaattgacgtgtattgtaggttcagatggccgacttggccccgttgatcttgaaaagaatgatgtacaagtgggataggtacatctaaagtttggcatacataaagtataaactatagcgatctagcaagctagtgaaaattccaaagtttggcttgtataaagtataaactatagcaatctggcaagctagggaaattcctaaagtttggcatacataaagtataaactatagcaatctggcaaactagggaaactctaaagattggcatacataaagtataaactagcaaactggcaagctaggaaaattgtgaattcaacgtttctggacctaaatatgaaaataaataaatgcctatttaacaccggagtatatagcaaatagaaaaaaaagaggcattttgcatgtaacatatgccttgatacttgaggagaaaaaacaatgtattactcagagtgaaagaagaagataaaatcaaaattagaactttagaagtatgaaaaaagaacctgcagatcagcacacacatttggttctcgttccactttgatgctttgatgtgcttaaaatgatctcatgagccatgactatgtggcaactcataagtcctgtctacaactgtaacatatgactgaaaaacacgggggatttagtgtgataaatgatatgagcattttcagaaaaccttgcattagtgcgtcataggcaatagaatgtctaggacaggatatggtatttatttatttgccagatcaatgttggcacacaatgaaggagtaccagatcaacaaagctatccatataaactaaaagagttctccttccacacactgtatcacacaggaagcaaatcagctaaacatcacaatcaacacagctaatatttcctgttttttcaatttttttaattaggtagagtatgctaggaatgttcttatcatcttgcatgtgctcaaaccaatccaggtggtggccccacaatatcaaactttaagagtaatctgttgtggcacgaaagaaagcatcttccctatcgctaatctggtgtggaatttcagcaaggtggaaagctgttgccggattggcccggtcagctctgaagaccggaattgcaaattcagacttcagcgttgtgggtcatatgtgaacccactcaggcgacaaaaatacctgaacttcccgcaaaataggggagcaaacgatctgttttgattaggtagggcacacatggagtccatggtggttgaaactcagacataagataagaacaaacttatcttccttgacaaaaaaaagggagaaaacaccatggtttaccaaaaaaaaaagaaagataaaaggaagtagcatgccaaatgtaatgtatctaacataaattaagtcttggaaaataaaaacagtgatgactgttattgggaaatgcttggctactaaatctaataaatgtgttagttcataagtgatggcccaatcatacattattttagtcattttacttgttgcctctttccattgtgtatgttcagaattcagagaaatgtctgattaactggcacacatttctcaacttacaaaccaaccattgttctgtcaatatcaaaataatagcaaacagaaggtaggaaaatgtgagctgtcggtcaatacctgagcttaaaaacgacaaggacaataaaaagaaaatacttactgtaggtggaaaacagcaaagctactcaatgaggaaatagcagtaagtttgtgcttccacaaaaccagtcaacacaaaaaaagtgaatgcctcttccagctcaatcagatgctaccaaactcgagttccataggatgagcttgcaactgctagcaaatatacagtaaataagctgaggaaactaagttctgaaccatggtctgaatatcatgatatgttttctttagttcaacggacaaggcacccattaaaatttttgtaacactcaaaagcaccttctttgattattggagtgcacacttgagattaaaaaaagctgccgctatacaaaataactaccaaaggctaaaaccatattcaagtcccactttacaggtacacaagcaacatatgtaagagagagaagtacacaacacaagaaaggagtctatttaataaagcacaatcaaacacatgctaaaatattactacctatgttcttttttacttgtcgttttggacattgacacaatctccaatgtatatgtctcatactctcatcattactttttctagttatatatgtataaaacttattaaaaatataaccatgtgaatgtgtttttcatgacaaatctatcaatgtcattttcacatcttaacctttttttttaatttttaatgattatcatatcgagatttgaatgtgttctctaggatgtcatccttttgataacagaggtagtacctctccaatgggcacctctttcactctttgtcactaacttcagaagaagaatgtacgcagaccgtaaaatgtaaatggatttcaaaagatattgaaaaagggtacataaaccacagattgagttatttctcttagcatatcagtactgattgagaggaaagttgtgattaatgatatcgacaatttaagcatttgtgaggttaatgcatgaaacgtatgcttaccttgcatggcatctgtttgttaggaacccaaagggatgaaatgatgaacatgtcagcaaggtagttaattacatccaataacagaaggaaatgttttgatttttgacatgtagaagtgtggagcattgccatccactgaaatttctactcaagccatcaagccctgtcattttcccattagttgttagctttcaaacgagttcatctagaactctggaatacacagacgaaaagaaagaggtagatatgtaatatgttcaacaacttttccaaaaaaaaaaaaaatcctccatagaatatttagctaactaaattacctcattgttgaaattgtgatatgcagttagcatcttcaaaagaaataagatggtaggatctccctgaatcctgatacaaatatccgcttcactcaggctcagtttcaactgacaaacgttacggtgaaacagaaccatcaatccataaagtctttggttgactgcagcaaccgtcattctgtgacctatcatgcaaatgaattggtcatgatagtgtaaagtaacagaaacgttgaacactggggcgaaagttccccacataggctcgtgtcgctccagccccaggggcgatgcgagcgcccccacacgcgccggccgccgccgcgccttccccctccccttcgcctcgccgccgcccgagtggcccaccggaaagccggccgggcgcaaggacggcggcggcggggcatcccggcgcccgtggcggcggaggcggccagatccggggctggggaggcgacggcggcggggcagagaaggtggcggcgacggggcggacgaggcggcggcggcgacggggcggacgaggcggcgctggcggcggccgacggggcggaggaggcgctggcgacggtggcgacaggacgggggtggagctggcagcagggacagggcgggtccggcggcgcgcgacgtcaccgaatctggcaacctcctcgctggatccggcgccccccagtccggatctgtcctctccggcgtgggaggccggatcccctccgtcgaggcggcgaccggccagcataccgacgacagtgtgcagccgggtgtggaggcggggaagaaagagaccggcggctgtgtgggcgcagcgttggcagcgggacccgcgtgagagacgcggcttgaggccggcacggcgcgaagacagcggcattggtccctgtgcggcgacggcgcggtgctcggcggcgatgacggcggtgcctccccagatccgcgcctctcgaccggatctagagggtggtcggctgtggtggtcggcgacggcggtcgacttgcgacagctggtgacggcagttggcaacggcggcgacgggtggttgcggcagttggcggcggcgacgtcggccgacgacgccggcggaggacttggcggcggcgtggcggagggcaacagtgaagtggccgctagcagtggcggtggctcgcggagacggtggctggtggtcgcgacagcggtcaccagaggcatggcggccttggacggctagccgagggcgtgggagacggctgcatttggccggcgcagcatcgtctggtggaaaggtcggagaccggcttggcgcaaagaggcgcagccgatggcagtggaggccggctagtgcgagaggcgcgggcggcggagttagaggccggcttggcgcgagaggcgcggccggcggtgaaggaggcgacttaggtgtgaggaggagctgctggtgggtgtagcgcggtcttcggcgcacgaaggctggccggcgagggacgccggtgcaggggtcccacatgtcggtagagcttgtgtggtggtggagcatcggtgtgtcagctgtggatcttacccctcaagggtgattgccggacgaaagctcagtcttggctcctttgagtttcgacggacggcggtggcagtttttctgtcgcttctcttcttgaagacgtcgttttggcatcccctagggggcaatctcggttgtccctttgttggtctagtggcagccggtcacgcttagcggcggccggtccgatgctagccttctcctgggcttgtgtgttggcgatgtcggtgtgtgggtggtggtattttttcctttttcctgtttacgaccctctagggttgtaatcttgtaattttttcctgctctatcaatagaacttcgcactgtctcgtgcgagtcgttcaaaaaaaaaaagtaaagtaacagaaacttgaccctatccgtcttggttgatgggtttgctccaatcattataaaataaaccttgaacaggaaatcagtctacaatatatacagaatgcagtccttcgggtgaaactcaaatgtaactggcaggatatgataatatgcaagtttctgattcattcgggaactggtgaaacatcatatcatcccttttttgagatatcaccctctgggaattattaagcagtttattcaattatgaataaaatctaagagagtatgtgtaagcttaaaagctgtggttaagtgtataatttgtccatgaacaaaaaaaaaggaagaagataacattgaatagtataaataataatcagaagaagaatgagtgagttttcatcaatgttctccattagatatttcatacctttcgcattaaggggattcaagctgtatagctcaccaaaatgatgatttcctgttcatatttaagggaggtacaaagaaaataacaatattttcgggaagctaatgggtttacaaggaaaattgaaatggtgcatgcattagtgaataaaatagtcaagaacaaaatcatgatggaatcctggaagagctctgagagagcctaacaggaacaaccgcccatatgctggtagagtacatcatcattcgtatggaagaatattttactgcgctaagagtatcaggggtgtttgatatctatttctgaaatgaaactccgtatagaacaccataaagaaaatcaaacattagcagtctcaggtagatttaaaataacatacgggattcgaaagaaatgtttgaggactacagaaatctctattctggtgaatcctcctgatataactagacactgctacgtgctcaactcctgtaaaatccttgaaaaggatacataaacgctgaactatatatcatgtggttttcgaaacgatgaattcatcaaccaatacatacaaaacagtaaacagatgcacgccaaaccacacagatgaacttgaggcgtacaagaccagcaacactgagcttgagagttgaggcgcgctacaaaccaatggaatcagagccttaacaaatgggacacgaaatgccatcttccaatctccatgtcaatgtaccaaacccaaaagtctgagcggttaccgaaagctcacgagttgtcgaattcgttaccctagaaaaaaccgcacgcgcatccgtacgcaagctaagcacgagcatacacgcatagatagagaaaactcggggtgaaaggggagggggggaatccgtacattacgcgctgctgcccgatcgagagcctccttctccggctccggctccgccccggagatgtccccaaactccagtagagctcacccgcacctcgcggctggagagactcgcggcgagaagcggcagcctccggcggggagctgctccccaaatcgcgcggcggccggcggcgagagatggagggagtgtgttttgcgtgtgaaaagcttctggcggaagctatacgatggttgggccttagtgcggggccgaattagtaggccggaacgggactccggcccacgtgcagcgtgcggcccgttctagtttgcctcacgcgcaccgttggaaattggacgacgtcttcaacgaaaaatcaatgacatatgatagcgaaaaagagacaatacaatatatactggtgagaagtgttatacgtacgagtaactcatacatacgactagcgactagcgtacgtcttacctcatcatcagactaatcacgtagcttggattaccttcatgtgagtccagatttttcagagctagttatgaacttgtggttgtacacttgtacgggagtcgtatgcatagttattatgtatgacagtttgagggtctatttgggaaagtttttagcagccgtagcttctcgcataatctccagctcttcaaataatgtagactgtcactcagattataagaatatgaagttataaaatcaataaaatgatctagaaaccagaagatgaaaactcggattttcggaagctggttatcaaccaacagattctcagaatcttaaactctccacacaggacctaatacacactgtacactgctaagaatgattaaggacttttctttaaagatgatggaagagcattttcccggcctccatatagaatgagtaaaactaactagacaggaatatttccattgtttcactaaactattcactattcagaattttcccatccgcccgtcagatatacatttcttgccgtgtgaaacttcctcctatttggatggactatgatgatgatgaaacatcagcattggcaaccttctcccgtagcttttgtacacgagcctgaaacagggggggttgagtgtgtcaaaatggagagttcacagtgttacaattgccgtgcgtgtgatacagacacagaaaacactaaccctgaacgacttggtccggcgaatggatggatcaaggtccagggcatcagcataagcatcctctgcagctcggtactcttccattgcaaacagagcatcgcctcgtgacaagtgagcctgcatagagcagcacagccatgacaaataggcccatggaaaaaaaaaaacagatagtgaatttaaagactggctctctaagaaactccattttatcagtgcatagaatagaacgttatggtgtttcagactttctgttaggcagggggaggctccatctacattatacaagtgaatttcattgaacaccatgtgcgaacgtaagctatatgtcagagacatataaatcaatagaactatacttgctatcgcccgtcatcttttttttgagaatgcgcaaaagagctgcgcatcttttttattaagattggggagaaattgtgacatctttacaaagcaactgaaatagaaaccgaaaaagaaaggtaagaaaaggaggctaagctataatctcgtgacatcaattttgcgaccacgacagccatgatctactatgggagaagacctgctagtctccagagggcggcctcctctgctgctgccctagcaacctcctcccacgatcgctgcttctggttgaagaccctattgttcctttctttccatatggaccaagcgcctaggaccaccactgtatcgaaaccacggcggagttgctttgccactcccttcctggatgccgaccaccaagagatgaaggaattctgagaggcggggaagaggtccggacgcccaatggtattcattacaatccaccagaattgcgcggattccgggcaggaaatcaggatgtggtctattgtttcttcttgttggtcacaaagcacacacctcgccgggtggggcaatcctcggggcctccgtcgatctgcagtccagcaacgacgatgagccacgagccacatgaagtaacggcagcggggaggcgctttgtgccccattggtccatatgaaggctgagggcacttgtgccccgttgaattgaaaattaagcatttcactgtcatgccatccaatgatctaaattctgcaatcactgttcactactatttagtttggcaatcatgcccagccatactgtttggttttattgatcattgtagcaacctttcctctctgcataaactactaggtagccaggtaggtaatctgtatgcatttgcaaatgtttgtggcatacacaacagtccgcagcaaacaagttaagaaacaccaatgtgataaggaaaaaaaatatttgtattgtagcaatcaacagtatggcttggctgtggacgagtagtaacaagaagatgataaattcaatttacagggcaggtgtttacctgaggaaatttcggagcaatctttgttgcttcctcggcatcagcaagcgcaccagtgatattccccattgacaatctagccctagacctgcacttagcatcaagcattcatttcagttaacgcaaactctcattctcacttcccaatagtgcaacgaaggcagcatttcctaagagaaaaacataaattgtgaaaaattaagctatcacacatactcccaatcccaaacactcgttctcataatcaaagctacagaaaggacctgcttctgtacgccaagtggagaccgccaccagcattcatctcgatagcctgcagtgcatacaagcaagcaacaagttagaaattggaacaggaacactacatgatagtacctgtagcacgggagatgcagcttccttgacgccattttcaagagaaaagaaaaaacaaattggcaagcacactttgcttggtaagaatggggtgaatcctctgcagagacctcagtcaggagggcttccgcttcggcggcgccacccttctcgagggcggcctccgccttctcacgcgccgcgagcgcggcgagccccgccgccgcgtcgaatccggagtcgccgagcaggtgctccaggagctgcgcggcgcgcgcggcggtgcccacgtggccgaacaccgcggcgccgccgccggagacggaggcgccgaagtttgggcccgccccgcagcggccgaggcaaccgcaggaggccacgtcgacgcgcggcggcgcgagcccctcgagcgccgccaggacctcgcgcccgccctggcgcgcgcacgtgcggttggtgcagacccgaatctccaccgccgcccccgaagctctcgccgtcgtgggactccggcggtggcgcggggaggcgaaggagcaggagaaggcggttgcagccgctgccgccatcgccgccgacgaactctgatgaggcggggggacacggaggtggagtaaagtaataatacgttttttaaagggtttctttgcaaatttccgcggacattttccgggtccacgagccaaaccggatattctgatctcaataccgacccatgtttttggtgggccttacgaaagcctgtctctagcgagcccaactttagtgggcctaaatacggttagggaggatgtgcggcccatgaaggctcggcccattatactgcaactaggcccaatacctagccattcagagtttcggacctgtggctatcgcggaagggagcggcggcgaacccagctcggtgagtcgtcgtcggcggcggcggcgacggcgacggctaggaccacgtgacgcggatcagctcggaggcagcgacgacccatctctgatctccctcacgttcagaggcgcgaccaagcgtcgagggggagcgctcgacggcgaggtacgcgtgtgcagatccccttcaactctaggtcgcaacgaagcctcgacagtgttcccaaattttcttgatttttctgtcacctgctagtttgttgatctgcttgatttgtttgtcgcctgctagtatgttgcaactatcggtgctaatcgatttaggcgattcttgcacatctttctgtgttgactcgctggtgttagcctgttaggagtgatgctctctagctgttcgatgaaatgcctgataaaagcatctttccacgccaatatatctatacatttattcgcacgatttgttcccctttgctaatgtacctatcaccatcgatttgcatgcgataggatcattggatcattagattactggtgaatgtcgtataatgatttttaccatacaaagtattgaacaagaatgcaagtggcttaatggttcattgttctttctgatttctttttggtttgtagagtcatgcagggggcgcgtgttaatctgaaggggtggcaacaggctgctgttgcattcggttctgcatttggggccttgcttgaccctagaagagctgatctgatagctgctcttggggagactactgggaagccagcatttcagcgtgtgcttcagcggatgaggaacagtgctgaaggcagggtaaactcatgctaccctatatcccctaaaagtgcaggacgttatgtcgatgcatccatttgttgtgcttgaccatctctttatatatagcctttattactagcatattctgtaaatagtatacatatatactcagcttctgaaacagtaacaatttctctgccaacaaatgctaaggagcatatgatgattatacaccaatactacgaagtagatttttttgtgtgaagtagcattatcctttttacttggttgtttcagggagcaatgttatactgaaaaatggaatagtgtaggtcttttcataagctgtccattttttttgttgttcatttgttatttatgcatttaactctccaaaatatcttccttgtttggctgcagtctagacttacccattcaataaatttaaacctgcaattgctatactttgatgattttttccttcttgttacatcactgccatgcaatagcaacacatgccagctgaaaatgtgtactcaacactgtggacttctttcccaattgacttaactaagatactattcctacaggatgttctcctggagcgtcctcgagttatatccacacaagtttctcatgcctgggacatgcctcagaacacatttggtgcagcatatgctcagttcatgggatcaaggaacttctcaccggatgaccgcccacctgtccgtttcatggatacagatgagcttgcgtatgttgcgacccgcgcccgtgaagtccatgacttttggcatgtgctgttcggccttcctacgaacctgattggagagactgcccttaaggtcattgagtttgaacagatgttccttccaatgtgcatgctttcagtcgttgggggctctgcgaggttcaatgagaaacaaaggacactgttttttcagcattatttcccatgggcttcaaaagcaggtcttaagtgcacagatcttatgtctgtgtactatgagaagcattttcatgaagatttggatgaagtgaggaggaactggggaattataccatgccctgatcccaaaaggagcagtgtttagacttttagatcggtacattttgcatgaaagatgtctgaacttggttttcactttgtctacgttagtattagctcttccctttcaagaataatagcaagagttatgctattgatacctaaaaaaactagtaattctctttaacttagcatagcaactaagcttgcaatgttgatgttccctttaacaatagtgtagatgagttaattacatttttatgtgtaatactagctgaatgccggtacttcgctatggacagaagaaaacatatcataatattgtctgaaataaataaaattatattttccgtgagatgtgttgcccatcctctttttgcagcacaaggtacaactatccttgcatagttgcatgtgcaaaagcaaaattagaacctcatactggatcagaatcaaaattatttggcaggccccttgttgccagtggctgaggcaaaggtacctgaaacctccttgctgagttgctggtacacggctacaccacctctgaagagagagaactgcagattggtgcgtatcccaaaacgaacggcagaagtaaaaaaaactgagaccaaatggtactagtagtaggtagtacgtccaaaagctgcactgtaattatggaccaaatcaccttaaagttacagcaaaagaacagaagaaagaaagcatgcagcaaagggacaatggtgaaaaaagaaatttacatcccctgtcaatcttgctcatcttcatctatcttactcacaccgccaacgcaagacacaaaacgaaaaaacaaaagggagagcccaatcaatgcagtagatcatcaacttaatttacaggtgaaaaattaaggcgagctatgtagttaaatgcccctatgtgatgtggtggcaaatcttgaccaacaaaaagaagaattcaaagaagaagaagacgtattactgcttgatccatcattagcacagcctaggcaagcctctaccgccggtttgatggcaggcggcggcgccgaacgacgacgacggcctgccgcccttggccatcttggacatctgccctcgcatctccttgcacgctctctccagctccaccacccgattctgcatcttctgcaggttcagcttgagcagctccttctcgtccatggcgtccaggtccacgctccgggcgcggctgccgctgacgatgatcttcctcggcgtctgcgacgggtcaggcctgcagccgccggtgcccttcgccgcggcggcggcgggtctgatctggagcttggactgctgcgaggctagcgcctgcacggcgatccccggcgggatcctccggttcttggccaggtccttgcacgcctccagcgtcagcttctcgtagttgaggcaccggcatagcgtcgtccgctcctcgatggtcagcgtcgggtgagactgcatgcagacatagaataaacttcagtcaaatttgcacaaagttcagctaagtttcatcagcattcagcaacactctcttgcagcctagttatttaatttgcagaaaattcagcaaagtttcatcagcaaactaatgccttgatcaatggtactcgctgttaattgtagcacaattaattaggcccaatcatgcatgcagctaatcacattagatagtgtcaaggagcagcacgaaaagaagagaatgacttacattgtgaaacaaagtaagtacatcgcagagagaattaaagaattgtttagttcctttttgcgcgcgctttaccacgcttgagagaaaggcagtggatgcgatgggaaacaggaagcacaaacatgtaggagaggattaaagaaaggccatttgcacatagaaagcaccgaagccaggataaaggcaaaatctgggcagaccgggcacttgttaaagcctccctaggtttcattgctgataaacaaattggcgagatctcagttgcaaaaatgatcggttggccaagacgaaatggtcaccaatgtgatgggctaacgacagtgtcatggatcaaaagtgaaacgcagacagggaaaaaggttaaagtttacgtctgcatgcatgcaaataaagcttgaacgactatgtcagaaaaaagcagttgtatctatccaagggttgccaactctgcaactgtgaagaaacaaaggaccacagtccacagaaaaaaaaatgtgatgcagaagtgcagaaatgctgcatggattcctgaggtaagtatgtgatcaagacatagcgagtttcagtaagttgaaattatcaacttatgattttgaaacaacttaaagttagcatttttgttgaaatgggatcagacttcagtggataggactggtaggacagaggaatgtatggtggccaagtgacaaggtttcagatctgacgaacgaaaagctcacactgcacagtgcaaaagggttaaaggcaatggaattatggaaattggacaaatgaattgttctacccataacacaaagtactaggcgatctctctgtccatcattagcgtcccatgatagtactatcaaactttattcagtcctttgtaaaagaccaggcaagaacaggccaacacacaggaattatgcagtggctaagaaaaaaacagttcgaaacaaagttgttgcaaagaaagattggaaagatatgcagagtcctggaggaatggtatatccatgacagaagttccaatcaaagaagctgtattgaagacagaactgacaaaaatgtaaatgttgaaatcatagccattacgaaggtgaccttcaggtacagcaaaagcgtactaccagactactacctaatatctctccaactattaaccttcctatcacagttcttgccagtgtttatcaacattctaactgcctattgccacctccaggaactcatcatggctccaatcatagcgtgagagaatgctcctattcactgtcagtgtcaggtgaaattcccggtgccctaaactacctacaagtctgtttctacccagtcatgatcaatcattcacgaagtcagaagctcagagcagaacaagtaaacctcaaaatccagctaagggggtacagagaaatacaggattcacgtcgaattttccaaaatgtaaaatctggatgcttactagacgaccaaaatgccgtcttgtcccatgcacaacggtaaactttaccttggcaggcaaagaattttaccactgctcctactaatccaagactagactggtacttttttttttgccgggacggccaaaggatggccggccaatttcattaagataggagaaaagactagactggtactgcccctataattagccactcaatagcatcaagctttttgaacagcctatcaatcatgttcccaatcatgaattgaaacagaggtagtactatcctattattcataaacaggtattactattaggacgaaattaacatatattttgttcactgagccaaacactaccaccgaaaataacatttttttttgctgaaaaatatgaaatatagatttcatagaaggtgatctctttaattacctcaaggtagatatccaatgccctgtacacgccgtcgtagcattcccgagccgagtccggcaggctctcggcgacggcgaggaacttggacaccctcaggccatggtccggcgagatctcaccgaggtacttgtcgaccagccttccaaccttcctcatcctctgcgacggcaagtcggcctcctcctcggagccgacgaacaccctgaccagccgcatgaccaggttcacgtcgtacacgccaccgtcgtcgccggagacgaggaggtcgtcgagcgtggcctggtccagcatcagccccatgagcctctccagtttgtgcctgcactccttgctcagccccacggccgacacgatccggagcacccagaagaggccccggcacgagaacgcggtgccgccgacgagcgccacgccgtgcacggccgtgtcggcgagtccggcgagtccgccgccgccctccctgcacagcgccggcctgcgcgtggcggcgcggaggtagtgcagcaggaaccgcgtcaggatcaggttcttgttctcgatgccgtagcagccgagcaccctcatcgccttctcgatggtctgcgggcacagcgacgtcatgtcgtcgaaccaccactccctggcgaagcacggcttcatcgactcgggcgtcttggtggacgacgaccggccgaacccgagcgtgtccggcgacgacgagcacgacgacgacgagcggttcggcgtcccgactgcccccgcggcgacgggcgtctccggattggcggtgatcttggagaacagcgcggagatgagcctctcgaggaggccggaggcgtcggccgccgcggcgaatggctcgcagctcttgacggcggcgaggacgtcggcccatgtccagtagtagaggccgtccacgaatgcctctgcttgggtcaggaggttgcaggtgcacacctcctcggtcatctccaagaacacggcggcgcagtgcaggagcgggaggttggacgggcagagcgggacgcggccattgttgtagcagaacctggccacgagctcgaacccctcgccgccgccggggaagtcggcgagcttgacggacaggctctccgcccggctcgtcttcctcttcttcttctcctgcgtcaccattgtcctcaacctccccgagaacgcacacatgacgctctgcacatgaaacaacaccaatcacttgtaagaatagatgattcttgattacgtgaaccgatttcaaagatttacgcaggtcgcacgtacctgatgaagaagaagcgtgtgatggccattgatgtgcaccttgaggtcgcagagctcattcatggctcgagagagaaagagaaagggagggagagagagagaaatggaggcaatggcactgcagagaatggagtttaatagtatctaggagcaagtgagaattgggaagatttggttgcttggttgctgcctcagttcagttacttgggacctcaaggcagatacagtcacagctcacaagctcacagtgtagtagactagtagtaccacattgcttgagtgcatgtgtcctgtggagagatatggaggaacacctcatgatccctgagaagaaaacaaaagcaagttttggtctgggtaggcaacaggttctctgaactcttcactcttcaatgctgggctgatgggctctgcatgcagttcaaagaatgaaagggaaaaaaaagcacccctgccttccaaaggcacgagagcaaacaaacaaaaacgtccccttgttctattctaaaacagagagatctcatatgaaaataaagaaaaaaagagaggaaaaaaacagaggaacagagagatcttgttcatggccactatggattgagtgtttgcactgctcaaggagatgattcagcatctggatgctaagattgctagtgcgcctggctggaattgattggcaacatgtcaccaacttgacatcagagcacgcaacaaactgtagctatgcacccttatcctgtagtattactccagttcatgctgtgcatatttgtcaaagtgcagtaaaaattctgtggctaggcaacgaccaacttttgcaggatgaaagatgaacttgtagctgttacaagcactgttaaaagttttccccttctttttgctccctagtccctatactatccagacattctatggctatagtactgttgaaaatcctgtgctgaaaaacaagcttagagagttgagaggacatcaggacacatggcccttacaatgtattcaattaactaatcagagagagagagagagagagagaggtcgtgacatttgttcaggcatgtgtgctctgtcaggagctggtgcaattgcagtggctccatcgctccaaaaacctattatgccagggctgtcatattggcaatttgatatggcttaggccactcaaggctttggtattgtcttctccctaagaaatgggctttggagttttactggtgctcacagtcacaggcttatcatattccatgtgggagttggagaggagccctctttcatgcttaaattatctgtaacataaagtgttcatatgaaaagatgaggaggatggagtatggaccattgctactacctttttggtgacatattaatggatgtagctcaagaaccttcaaacaagaagaagaacaaacacgcaaaacaacaacttcttctagttcaggctgagctgtccgccggccatactaatagaggtaagcgtgggaagatttgccaagcgtttagtttttcatgttcagatgtttaggatgtctaatatcaggttagctgatatactgatataaacacatgagttaactaagggacaaatcaattgaaaggtaggtacagcatagtccactattataatcttatggacagaaattcagagggtcaagacgaataccgtgataagatattgctgcatatgcatccaatctagcacggcgagaacagcagggagcagcagtacgactagctaaggaatcccgctcacaagtgccagaagaaatgccactcgtgttagtttatcatcaggctcgcagcaactccaacatgtgcagtgttaataccaccatcaagtacatccaatgtggtactgtagaaattaaccacctagggagtagaagagtatggtcagttcgtgtttgatcagacaaacctggctctgaattggttttgactgtttcggaccaaaaaaactacatatttgaacatcgcattcgaggaatgcgaattcgacacattgtacttacaaaactttaaaccacaggattaacacgtcaaagaaatgctactacaatgtatgctactctcaaaatttcggttggcctatctttcagctgaactgattaaaaaaacatatgctactgcggcacctgttttttcggtatcttgacaggttaatctacaaccaatagcaatcaaaatcaagaacagtagcagccagcaacctgtgtcaagaaacatatgtctaacagatatccacatatcgcggcaattattcccgcggatggatcacgggagagggtttcgggagacaaccataggttggcgatggctaaaatacgggtgttgggaagtggagatgaatgttctcttggcgcccactcaccaactgaaaacggataagcgattgattctcctctccctggacgccacggcatcacctgccggtgttgctcacgagtgcaagagagaccaaagatgataaagaaatgccgtactcacttaacggccaccgttcttcctctcatcgccatcaattcagttagtgaagagaacctaattgcagaggttaattgctactacctacttctaatttttttggatgcttgactagagggagaaagacttacgttgttcagagttgacgatctagtagaagtatctgaactttgtacacaatctgtggttgtttctgaaccgaagcgcggagcgccacatttttatcagcttttctctccctgcatgttgaagaatgttcagtccaaaaatccaatggcgtgagcatttgaaaaagatgaatgatcaagtaaatgtacgggagaaagccaaaagccgccatgaatgggaaggtgaaacgagcaaaggagttcacctcacgaggtaaacgagatccgcctgcagaggaatggcgatgggcactactggggtctgcaggtcgccgcgcgtgcccgcgtaaaccaagtcacggatccgccgccccccaccccaccccagccgatcagtccaacgccacgccgccggcgtgatgtgggcggcacgcacgcacgcacgccctcgcgtcgccatcctctcgccgccgccgccggcgacggcctctcacatgctctgcagctgcaactcacacgcggcagcgaagcccatcccgtcgtcaggcctgtccatgggccgagacaacatcgaagcccgcgtctctttctgtattgggccagcgaagcggaggacgcgcggcccatctcgagtcccctcgcggcggcatcgtctcgtctcgcctccgcgtcgccgccgccggcgagaattggaaaggcgacacgtgattagtttaatcaggaagcttcgggagacgcacgaaaccgcgagcatttctgatttctcctcctctaattaccgcctcctcctccttcctctacgtacgaaaagccaaaacccaaattcgcttccccccccccccccccccaaaaaaaaattgctcttgcggcgccgcggattcttcgtctccaccaccgccctcgacgtcagatcaggtataaaatccgtacgcggggttcaatcttctggctggttgtttcgatctggttcctgcctttgatcgagttttgagggtgagggtttgttttggttttcgcttgcgcggttgcaggtggtgcggtcgatttgaatccatggcggcgacggtggcggaggcgctcgcggtgacggacgaactggccttgccgcttcgcgcggtgggggatctggcggccgccgcgggggtctcgcgggaggaggtggtggtcatcacgcagtgcgcctcgcttggtgagcttctcctcgtctccttgcttccctttttcctgctatcatatgagactccgatatcgattaggatttttcgtgtttagattcaataatatggaactgtgcctaaccctgttacgagcgtttgttctttgctggttaggatcagttccaactcaacaaatcgcaacagttcaatcgatttcaatcgattcatggtagagttcttcgaaaaacagtttggagctcaccattcctttagtttccgacgactccccttatgatgcttcatatgctaattcctatatagattcatttcaccatatatgggaccaaataggttatgagacagtgctattggttgacgaaggaaagaaaagagtttcatattctcacatcaatcatgaggagaaaattttggagatcatctccctatatgttttgtattgattatctagattcattagtggcaatattcaattctcacccatgactactactccaaaattggagtatgttccaaaatttggaccctacaaccgacacactgttttgctctgctatatgttcagtttcgatttctgttatgctttagtataccttatccttgtagtatacattttggtttgtcataagctcgttttgaacattccatgttggcatggttcaggtgggaagttaccttttgatgatgcatcagttggttctgttcttgctgtcattaagaaagtggaaaacttgggcgatctgttcataactgaaataagcagggttcttaaagctggaggcatggtgcttatacagagttccccctctgatcaggatgtatgtactgttttgccaatatactttattttgtaatgcttaatttgcactccctgatcttctgatcttctcttcatcagcccaataactctattcagcgcaagctactgttaggaggatttgttgacgtgcaagcttctgctgcaagttcccaggatagcgagcattctgttactgtgagtgatctagtgccacaatatgtgttaatgcttctgtgccgtcatactttctagtgctaactgaatcacatgcagattaaggcaaagaaggtctcttggagcttgggctcttccttccccctcaagaaagccacaaagggtcttccaaagattcagattgatgatgattctgaactgattgatgaagacagcctcttgactgaagacgacttgaagaaaccagaacttccagttggtactgttttatagaacccttcagctttgttcaacgtctataaatttaatatgtagatcctgaaggtttgcttatgttttaccagttggggattgtgaggtgggagccacaaggaaggcatgcaagaactgtacttgtggccgggctgaggctgaggagaaggtggagaagctaaatctcacatcagaacagatcaataaccctcagtccgcttgtggcaatgtgagcatgactgctttttaattaagtgttttattttttgcctttggtcctctccctgtgaaaatccatagtttcatcctgtgaaatgataattgcagtgtgggttgggcgatgcatttcgatgtggtacttgcccatacagaggtctaccagcattcaagccaggcgagaaggtaattatctctcctgaccctaaattcttgattcatgagaacacccaagatgccagttgaacttgtttttaagaaacaactcactgttctctgattggcagattgccctacctggcaacttccttgcggctgacatgtgatgatagaagggaacatcggcaacagcagcagataggaattggcttctttaatttgttcgttcgttagaatgttgaagttgctgaccaagtatgggtgtgatagtagatggaaagaagaggaccattgctgtagtccctgctagggattgggatccagtgcagttgctagggtaactgcaacttaagcagttgcactagcaccacatgataacaaattaatggttctagcacctgtatactgtagcagaaattactgtttcacgtgttttgtagcaacaaatctggaccattggatgaaaatacaaatggatctcaatccccctgctagttatcaccactttctggttcccaggtttcaggtgtgagtgtgactcgcctatgcgttctgttttgatgatatatgtaactgagaaaatactgcactgttgtttcattgtgaaactgtcaaatctcaaatcgcacgtcgctgctctctgctgatcttgcaagacagtgaccccttaacaaatggcatgttagtttcaatgcagtgggatgttgtgttcttatctgctgcgtgcggcgtggtggtggtggtgttactttttcctgattatagccttttattgctgttgttttgtttgtttttctgttatatataaataatataagacctagtactatcttgtgcagttcgttaataaaaaaaaacgtatgttcgcagtattttgtgtggtttgttttttaaaaaaagacaaacaaatggcatgttcgtgatccctgaaagtgcaaactgcaaatataaacttatctctgcggcatgtaacccacttgtatcaactgtatgtacacaataacaacgtagtagtaataacacagtactaagcatcctatgcttgaaacctgaatacgacttgttagcaggagcatagggtccaaaacaggaacagttctctgtactttagaagtgcacacagactagcgacaaaaaggagataatttatcattcgcgacgttttgggccggttcattttgatgtcatttttaaccttaccaaattttagtaaagttgacaaaaaaatggctacatttagtttgctaccaaattttgtaactatataagaaatcctaccggtatagttgccaaaattttgtcattaccaaaatttggtaaggttttttttagcatcaaagtgaacaggtcccttgtccgagatacaggatatcaccaaagtaggccttctttgaaattgaactaatttatatgaaaaaaatcatgtaaaatacctttgttctaaaaaaaccagagttgtattttgcgattacatggtagagatgtacacacactattaccaatgcaacgctacactaacgtcacgagtgcgtcccctagcacgtcatgtttgacattactctgtaactaagggttgttcggtagtgctgaactgcggttgtacaaccgcagcgctgacgcttccctagcatctttcttgtggtgggactatacctgctgctgcaaggccgtcaactagtagcactaccaaatacaccctaagttttttttacaaattatttggacctgaagttgtgacaaaattgataatattttaatgagtcattttgtttctacaaatataaaatctaaattactataatttaacttgaaactttaaacgtggaggtgcactaaacataaccttaagtgttttccttgtaccagtgtcgcacttgacccggtctagaacttaacggggggttagatcatgcgtatttttgtatatacatcatacatgtgctcaaggaaacagtaccatatattttttttcaactagaatagtcaagctgcttattattatataggaataagaatgacactaatgcttgattaaatagcaatttttgagcttcatgaacctctctgtttacctacaactttttttttttgaagttaagcacctacaatgaataatcctacatgatatgacatggtaagcactacatgaagtactcttttataaaagagaaaagggattaagagcctccaccatgaagcaattctttttgtttggtcttttgtaccgtttaaaactaactaacctcaagtcatcttcccttaaacctgttcttatcgaaacatattctctcctcttctccgtctccgcctctattccgaagtgtagagaaccctgcgaatttcccaaccaccgcctccgctctctcaagccggcctccgctcctccgatccgcgggctcccggtctcctctggtggatccgcgatggaggagcagcagcagcagcagccgctgctcgaggtttgcccgtctccccctttttcttttgccgcgtgctttggcggcatcgccttgtaggggttccgtgctgttctagtgctcttgcgtcgaattgggtccatgattgggagcatcattgcgcctgatttgcaaccgtcggctctcggtcttgcctaagtttcgcacccatctttttggtctccgttgccaacacgcgagggaatttctagcctataggataattaataatgggtcggggcatcgccctctacttgttatgtagattgtagaggtgttttttttgttttgttttgttttgtttcttgggtaatctgcgcatccagttggatcatgagcttggggtttatccttttgtgagcttgggttgtctattatcactcattcaattattgggttattttgttaaaggagacgtctgatgcttgatatctggattatttggagtgccaaatgctctgggaagtaactgatatccgacgagtaaccctgctgtagccttataattgatacgctttggtctggatggtgatttggctttagccttataattttgttggtcggcccagacaacgagtctatgaccatgatcttaagttgtaatgcaattcagaaacacggatattatctgtggtaactgacatgatattttacaactatgtgctccgagaatcactaatgtacccttttttgttggtaaaacttctgaaacaggtactagcaacttaaaataaatttaatttgtgttcagaaagaacccagagataggcagttagcacagcataatcagtaaattgtgttgacattgaacatcatttataatacatgattgcagttttgttgatttagatatgactgctaaaagctgtgcttactgtgctacaatctcacgggagaaaatctgttataaagaattgctcttgaataaaattatgtgctcttggctcagtagcaagaatgatattccctaagtttcttgactgaaatgataaacaagtcaaggttgtgagttacagtttgctgattggaaaatgatatgatgagttgttttaagttggactaatattctctacagtaatgcgctaattgcaattgtccttccatttaggtagagcaatgtgtaacatctataccagaagatcatgaggccacttgttggggatgtggactccgtctcatttttgcaagttatgctcctgtttttaagtgtggctggtgtggagcaatcacataaagtaaccaaacttcacgaaaacctgacagtgtatgcttttctcattggaggaatttccgggacaggttctttgtgactgtgctcatcctcttcatgctcttcgtcatatgtaggttccgagtctattgtcatctgctttagataaaactttccatcttgatctctccatgtttatttgtttattcatgcaatttgtgctgctgttccacatgactaaacttgttgtctcacaggtggtggggtctgggcggtatatccagttgttttctcgatcagcacattttgtggcatctttcactgcatattaacaggtgtactagctgtatttaccatcacaagttattgcttggcctcttttaaatctgctggtgcaccggcagacatgcggtggggcagctatcccatggttgggaaaaatgacctggaaaactataccttctgtacatactgtagtaaaccaaagcccccaagggcacatcactgccgatcttgcaaaatgtgtgtgttagacatggatcatcattgcccatttgtaagtcagacaactctaaaactaacttccaataccgttattcctctctacttatttgacttgacttggtttgtttcctttttctgtgtccaactgcagattgggaactgtgtgggagcttcaaatcaccgtgcttttgtattttttcttatttctgtggtcatcagttgtagttatgctgctggtatgaccatttattcaagttatcatatatggcccccactagattttgaaaatctagcatcaactcaccgttcaatgggttatataaagatgctaattgagattattggtaccttggcaagctctgcattcttcttgtcagcaaggggtcttgttacagtatatattgcatttgctagtctatcagttaacgccggtataggtgtgctgttgttccagcaacttagttatatatatgaaggaaatacataccttaaccgtttaagttcgctgaatgtcatgcacggcgagagaggcctgcaaaaccttattcgattttttgggtgcccctactcagtttctagagtattatcgggctactcaaacactggcaagttacaggacaattcgagttcaaaacttctttagaggtacataatcacaagtcttcaagcactgctttcatttcatatgttggttcatgcatttcataagccattttttatgaactccttcccgatagattatgtattgttggagtaaaaaaaatgtggtccttaactaaaccttccttgcctcttaaatcctttggcttggtcataatgattcatcttgctggtttcaactacttatatttctgcaaagttttatttttactttttcaacttaaggaaatgaataagcatgcaatcatgcataatgttagtatctaggtattactaatttctcgtcgtgattttctttaaaataattttagcctactcacttgaatgaaaaaggactggagccaactaacagattgtaagatggttgtagatgatgttattagttattccacctgcttggttactgcacgcaattcattcatgatgttttgtaatcattgtaatcatggactaaagcagaggtttcatttacatgttttcagtggtagaatgtgtatattatcatttgaagaaacatttatggaccttcttgcagacataatggttctgctgctgacactaaaacagtggattgacagtcaatagccagttagtttgcataactgaagctagttgtgaacataacattacacaaaatagtccacgcaatctggtagaggacttcattttgaagggaagttatactgtcggcattagtcttgagctggaactgttctcacattgatttactggatgcaatttcagcagatgctgaaatacaatgtggtccaatatattcattgcctacagagtacggatgatcttgaggtgctgatggttgaggccataaattgctctatccgtaattgtgagcatcatcagtacttgttctgtgtgaaagatcccagtctaatgcttcggtgttgcaggagaaatcaacgtgaagattaaatctggcagtgatttcggtgttgtaaaatgcttggaccacacctgtttgttgtcgatacattaacacggtatataggaaaaggaaccccacggctgcttttgtactatttacacactaaactagccttaaattggtcggtaatcttataaacgtgtcatatactgttccatgtgttcttgccatttttgtccagattttatgtaattcattcaactgagctttttggcctgacaattgtaacgggacacagctcacgtaattaatattgctgctgcccttgtaaccatttgacctcatttttgttccttacggagtatggcctttcatgaaatcatcaaagtttggaattatgggagctgcctgcgtcagtttgttgaatggttcgtctgaacatatatgcaaatggacatggttactctggccatacatgcaactaaccaagctgcattgatttcatcatttcatagcaacagtacattatattaatattattatatactgatgattgcgttgtccgcctttgaatggaggctggctaggcagacttgtcttcagtttcagcttcaacagtttctttcttctccttttcttttgtgagggaaggaatttggagtatgcaagattgccttggagtaagaacctttttcttttccttttttgtgattagaaggataagcttcagtattacttgttggcttgttgcattttttctaaccttcaagctcgtatgatttgatgttgttgtaatggtctgatcatgggctttcctgaactgcagatctgaagaaattgcttcagcttccactgcatgtacggatgccacttgacaaggatctaccgtgcaatttcacgttggatcggggagagatattgatcatattgttaactacaaaatcactctaaattcagagagagagagagagaatgcggctaagttaactgcaggtatgtatgtctctcagatcttaattccttcacatgctttccttcgatcgcaagcaattttatcaattaattgcctgtccttgcattgcatttgcatgccccgttgtcccagcagcaagcaggctacctctctcatctcatctttcccatgaattaatcatccatctctctttcttccttcctttctttttttttctttctctgcagccacatgtcatgtacagatgtactgctatgccatatacatatgctctcttctgcaacagcacaatacgcaagctgcccattgctacgtggcactacgattccgtacacacttacgaggttaaacaatggcgcattatttgattacttctgatggaattttgtgctctgagctgcacatgcaggggcaagctagcatgatttgtgcatacgatgcattgtatattcatcaccgaagagtacacagaccaatcagcagctgcaaagtcaacatgtaaaatggcaaaagaaaaagccggccattgctatgtccggccggtgggaggagagacagtgcagtgcaaggctaaggccaaagccaaggcaaggctggctggccggtcgtcgaatcaatcgatcgatcgccatgttgccatgtgcttttccaccgttgctgtgccgcggcactcaccggcagccgcaaatatactacagagactctgcttgcttaattggagtgggtgcaagcaaacgacaagcttattacgagctttgctcgcacatagattactccatcccgcttacagcatgacgggtttcggtgccttcctccatctttaaataactgataactttagctttactatttgaatattgactagtaattactctgaaatggttagagtaattgaataaaagtttcatgttttatgtttagaatataatacaattcaataacatattattccttttagtccttgtaaatatttagtaaaacgacgagtggctaaattcaaaagggaatagtgtccactatcagtcatttaaaaacatagggagtattttgtcttttgttttacatcattggcaagtatgaggaagctatcactgaattgaattgtcaaccagtagtaacaattctcaacttatgaaggggaaaaggatgtttgtttttttatccttcggagttccaacaatcagggcccagctaaagaggggggagcagcgagcggaaatggagggaaagcaatctctcgtttcgtttcgtttcatttcatatcaacctgacgtgcgtgttgctgcacaggggaattgcagaggaggaggcccgcttgtctttacagcgcaaagattcactcaccaattgccacatgctcctcctgcctgtctgcctcgcctcatgctcatcccatcttcctccatgatccatccatctatccggttcgctggcgagaattccattaaattttagtattgataagtaaattgatgataaaattttataacaaatacttcttccgtcatataatataaaggattttgagtggatgcgacacatcctactgtaatgaatgtactcgtctgtacagattcatggtattaggatgcgtcgcatccacataaaatcccttatattatagaacgaaatgagtactaatgatattgaagtttgtctggactaaaaaaaatctttctagctccgtcactgcatccatccacaggagagaaaagggcaagaataagaaattaatctcaatcggaagaaaggaataaacaataattctccatggatcgatctcacagctgccgattcaggcctcagatccaacagaaatccgcttttgtaccgtgaattcgccgctctttcttcctcctatcgggagtacgaaccgggctggggccccgatccgtccgttcatcctccccgccttttccttcctgtttcccgcgtccttttctgagtcttgtttgcctctctgctgctgccgttcgccgctgcttttattgatcggtcttttttgctactgcccaagctgttgccgccgtgctcttgccgtgctcaattaacctgcagctaatccgtcatcaagaaggtaattaactggtatctgaattggattgtcttttaatctgctctgcataatcatctaccacatggcctggcattcagaaagattcatcagagatcagggattaattcattcagtacgtgctgattgatgttgtagacttgtagtagcttttactcgtgtggctgcacattcttttctccttttgttgcaacagtggtggccatgcatcatccacatctttctgcaaccccaatgatatccccctacatgcttggttaatcatatgccaaaagctgtgtacactgtacactgcaagttttcatacgctcatgatagcgactgcatccgacaacaatctgagtagctaattaagctaagccaaattagccgtgaaagaaaaaaaaagttcataaatcataggacgcagagtagtacttgccatgtcactgcaagaattcgtgagctgcagtgtccatcagattaacctcatactgagatgagagaaagatcaggtttaaacagtgacctgaccaagtgaattttcattttttttttggggccctcacaaacagggcttgtccatttctctgacagtacatgtggtccagatcctccttaatgtgttagtgcgtacaaaagcccttgcatcaactcgatcagggacaggattagcctggcaattgcctctaattggcccaattagtttatttatcaggggcatatgcatgcagccggatgtacagtggattatatatgcagaagaacacatggccatgacgtgatggcgatagcataagcaatggaagatggattagaaaaaaaaaaacaaaaaaaacgcctcatcactagctgcagctgctgctagcacatggaagggacaatgaatcatatcgctacactaatctgcacgacaagccatggttaaagaaattccttgcacaactggaggcgaaagttttctcgacttctgttttggaagaatgtgtgtatgatattcggttgctgcgtctctctggctatctgctcgttcgttcgatcgatcgctagctcgtggttggtagctggtgaatatactgtattatagctagataggagtagctgatttgtttcagtcccaaactagctgctactcaccgattggtaaactgtagctgatcattgagctcttgcgacggccagttggtactgcatccacagactgatcgatgatctgatgagatcgatgcatctgcttgtcccggccggagacatcttctgactgatcgattgatcgagcatggaaaggaaggaagaaagtgagggaagaaataaaagaattcatcgatcgatcgatcacggagatgaggggggaaatgtgcgtcaggcatgggatgcctcgcagttgcagataacaagatttggccgatttcattcacgaaggccacaatatcaatctttgcgtcgtgtggaagataagtagcatgtgtgaagtgtcctggacgactccggctgcagctagcagcagcgacagcagcagcagcagcaagcaagcaaaatgcaacgtatatccgtgatctcattcatccatcgatcgaaccacctgtcaccggaaaaaaaattcatggcgattgatcgattgatctatcggatccatagctgagatcgagctctagctagctagcccgtgcacgcagatgcagatgcaggggctgtctctgtccgatcgaatcgagtgagaccaaccatccaagcgtgcatgcatcggtggccggcaactaggcctcctagcttagccctgccttgtcgatcgatcgatcgatggccaacgtcataataaccttggccggtgagtgaggtgagagttcgtgcgtctctgcatactgcgtcatcacctatgcttcactcctccgtcctctgacccctctcgcggtttggagtagcttttgtccaccgtaatttaccttcttaatatactgacctgcaatctttttgtgtgttcgccgggatcgtgcaattctcaccggaaaagcaggagctaacaaccaaagccggcgtgtgtgttgtttttttttttaactagtaggtgtggtgagagctgagattgggtggtggtggcagagcatggaattccgggagtcccggtgcgatgccggcaggtgcacggaaaaggaggggatgcgtttgcgtggggcagcgtcgccatgaggccgagccgagccgagcagcctggctggctggctggctgctgctgctgcgtgcagagcagagcaggacaccgtactatataccggcccgtgccacaccatcctcccggttggttatctcctcccgctatttatatccccccgcctcagtgggccgttgcccctctcactccatccatctctctctctctctatctcttcctccttgcaaccacctctgcatcttctacttcctctctctctttctagatagttttcttgctgttcttgggtggtggtggtggtggtgatgatgtgatgaggtgagaattgtgatgtggggggaaagatgtgcgggcatgctttccacaggctttcttgaactgtgaactcgtgggggtgtatgtgctcatgttgggattgtggtcggtggcctccaattctctgaaaagaaagctgaattgtcgagctccccgttctgtctttggtcgtctctacctgttgatggttcaagaaagcccatggaaaccatgccgcgtctttgtgtgcttcccgttccgccatccggagaattccggccacacagatccctgggggggttgaattctgtggttttggttctgaatttggatggtttttggctctctggggcgtaattctctgagaattctctgtgtgggtgttcttggaccatccagtacttgttgctcacttgaattccgccgttgcggcggagaattttgttgaattcttggtgtttgttgacttctgtggcttgagaaagcccatggcattatgctgcatatttactttggttaaattcagcaacaggatggttcttctcttctgaatttcgcccttcttaaatgtgtgtggtcaggcgcaattcggcaaaggtttccttgcttggaagtctgccttctctggatcttggttttcctcgttttgtttcttctgctcgatcctacaattactcttgctgctgatgtactgaattccctactctaggagaatttgggttcaacagtttgtctaacattgacttgttctttaacacactgtttatgaaaattcaattcagcacaggttcttatgaaacaattgcctgacgaaacactagagagctagcatctggattcagcgaaaaagatcttcagatcatacacgcccatggaagtttgatgaagcaaatgctgcggggaattgctgaacggtgcgacagccggtggagagaattcagatcagaagtacgctcagaaggtttggctgaagcaaattccagattttatttcactgaagcaatcttcagaatttgataattcagaacgaaaaacgtactggcgttttcagagtccatctagaattcatcatgtatcccaaaaactacttttgcatccgtatccctaatttcaaaatgaaaccactacaaccaacgcgtttaaatttcaaaattcaccactcacaattctcattggatctctctgttatttgccagaatccgagccccgacagctcgtacttggccacacgaccggaagctactgacacttgggtttccaattctaaaaccggcacgaaattagcataccatgcaagctctctcctaattactgcagcatttacgacaaaagcccttttccaaagtagcccccaacccagcctcacatccctgacaaagaaacaaacagaaaggcgagctaccttagcctttgctgcttgtcctcattagtacttcaccactgtaattagagctaggtcagttcactgcacaacatttatctttccccctactttggcaaaaaaaaaagttaattagaacactacaaaattcatgtaaaattttaaacttatcgtattccaaactgccatttctgagtaaaaaaaattaagagagagagaaatgaagtgaagtgaaggaggcagaggcagagccgccagggcggtggtgggggttctgtcctgagcaggtggaaatcacgcttgtgcagaaagagatctgaaggaggcgaaaagaaaagagagagagagagagcaaaagcaaaacaccgtctctacggtccttgagtagatactatgaggtactaaaaatttagtgtaaaaattagtatctcatggtaccttatagtatttagataccaagaggtatcaaatttataatagaaaaaatggtatctcatggtaccaaatgctaccatccaaaagctaacataacccccacataaaagtcatgtgattctcccagcaaaaaagaaaaaaaaaccataaaatctcactcgatggatccatgatccgtctcgcgattaattactgcatcctcctgctgctgctggtgtgcctgtgcctgcctcacctcacctgcagtgcaacaacccaatccgggcctgcactggcagcaatcagggggaggatggaatttttcgcgcttctcgaggggcaaagcgaactgaattttgcagctgcctgtgatgcccattccatccaaattccccctgatccacgcgatgttactgttactgtatcccctctaatttcttaattagtacacggaattgcatgcagtgtgtccatcagaattacatgttaatctatgcaattctgcagctgttactacaggctgatctccacttgtaacccttctcctactacctgatctctgaatgcagattactgcagtatattttcaagtgaattcatgcaatgttatgtcggagtgattagctagctaggaggtagtagcatggtggatagtagagttatatgggaaactattctaatccctcgaagggatgttccctcgtttacctaaaaaccatctaaacggttatgaaaaattctggaaaaatttaacaacattcatacaacacatatatacaactccacaaaatcttaattccaaactcaactcacacgtcgagatataaaaaagacaaattcaacatatgaatagtagcgtactgtttatatctaaatttgtcttttttgtttctcgatgtgtagatcgaatttgaacttgaattttggtggattagtaggtatcattatactctacattgtcaattttttttcagatttttttataactatttgtatcgaatttgaaaaaaaaagatatatgaggggatattatccccctcgaatcccctcgagggattagaatccattcccagttatatggatcacatgactctcaatgatggagaggccggcctgggctggctggctggccctgcctgacccacgctgggctgtgcagatccagacccttcctgccctccgaggggaccaaccagatctcccacagatattcgcctcgctgtattctcctacctacacacatcaacctgacctagctagctcgctactgctacctccgtcccaaaatacgacacagttatatttagataaaatcaattattttttcagtttcatatcataagtcgtttgattttttttcttagttattttttaaaaagtttgactaagtttgtagcaaaataaagtaacattttcaatacaaaacaaacattgtattaaaatatattcaacattaagtttaatggaactaattttgtgtcgtaaataatttttttataaacttggtcaacctaaaaattttcgaccgaaaaaagtcaaaagactcataatatgaaacagtgggagtacttcatcattctcgccctcacctagcaaaaagtaaaggcgaggagagggagaaactacgtactggttcatgcgtgcaacccaaaaggtaaaatgatcatgttatcctactataagtcgtagtgctagaaaggtacgcacttgaaaagttgagagcccaggtagatcagatttggttgctgctgtgttggttgtggtaatattgacagtccaaataatgtagtacttgcattgctgctcggttcctagtagctatttatatgtgtcacatgcatgcatgcgggctactagcaaaggcatctgattctaaaaggaagcaagacacaaggaggctacgacattaatgtatgtgctactgctagctatatatgaagttgtcatggttgagtgagtggtcatgagctagctagatagatggctagctcgtcgatcagctgcatggtagctaggaggaggggagcttggcgatgaacgcgtcgaccttgatgttggtggtccgggagaggaatttcatgcagatgggaggcttgacaccggcgagggcgagcaccgactgcggcagcgtccagatgccgtcgccgcagatgaggcccgacgcgacggggggagcgaacgccttggccctggcgccgtcgaggcggtcccagacgaagcggatgaggctgccgatgcacatgtcgatgccgaagtaggggccgaggtagaaggggatcgccatggccatcggcagcgggaggaacctcgccaccttgggcgccgcgaggtccctggcgaggttgacggcgatggcggcgacgaagaagccgatgcagaggtcgaggcagtgcttgggcagcgagccgaggccctgcaccccgaggatggccatgttccggtacaccagcgcgttcggcgacgggtactccgaccccggcatcccgatgtcgtggaacgccttgtagaagagccagaacaccgacggcgcgatcacgcaccccatggcggtgccgatcacctggctcacgaacatggaccgcggcgacgccagcgtcatgtacccggtcttgaagtcctgcgtcaggtccgacgccgtcgacacgatcccgatcatcacgccgcacgccgccagccccgcgatgatgccgccgtccgacgcgtccgcccacgcccccaccgtgaagatggccagcttgccgtacgtcgtcgccagcgaccagtccgtcagcccgcacccgtacgcgttgcagaacgccagcaccggcgccaccacgtacgacaccgcgacgtggtaccacctcagctggtggaagatgcggggcaccgtcgcgatcgacaccaccgcgatcaccacgtacgcgctcagcgccagccagttcgggatctggtccttgaggaacagctccgtccgccgcttgtcgtcgaacgtctcctccggcgtctgcccgccgccgccggagaccggcagcgtcggctcagacatcatcgcgcgcacctgcatcaccagcgccgttgtggttcttgtcatcaccttcagaaagttgtacagcccgtcgccgaggatgagtgaaatggagatgaacacctgcatcgatcgaatcacaattactccattgatcatgcaacagatgatcatttgcaagaagctcgttctacccggtagccgacgatgccgcggaggctgctgggtttgaggtcagcaggataccagtcacccttcttgtgctcgatgagaggccacatgattccccacgacatgacgcctccgaggagcacggagatgttgacgaggtaagggcagatcatcccgacgccgacgtacgtcgcagagaaatcgaagaagaacctgcagcaagaaaccaactgaagaattcagttaactgttgttgactgtccagtgtggcgagcatctgtatgtttcaagctagcatgacatttgtctatttcttttattcaaaatacttgtattattattgtttattttattattacttgttttatcatcaaagaaatgtaactttaacttatatttttaaataatgtattatacgaaatattaacgacgtcgtgtataaaaaaacaaagacaatacttgtttctgtaggcctcgagacccagcgtcgggaacgacatgaacccgcaaccgtcgccgccggtgtagaaccactggaagaagccccaggagaagctcatcacgaagaatttgcccagcattttgacctgcatcctgcaggaaaatgattcagaattcagacaagagtcttatttgttctctgtattcaccacatgtacatatctttagcaaactttcttatctgaaaaaaaaaccgtacttggcaagctttgcaccctggggagtgtggaagctgttgatgagatgtgcggttgcagtgccactcgggtatatgagcttgtaatcgatgatcattatctgacagagaaaaattaacatcatggttcaattaatttaactatgtccttcaaagaaatcatatatctctgaattttaggagaaactgtaacagctgagctgatgaaatgtactaagtaccttcctgagtggcacaactgagaagaggcccaggaagctgacaatgaagaggaatccaatcatccagcccaagctggggttcttgatgttgtgctcgtccctggcctcgcctgactggtcgctgatcctgtcgctcatcgcgaatatgtagctgccaaaaccccctgtaccaccagtgcatagatcagcatctgaaaccatcaccaccctgacaccaagcagagaacgtagtgcacagtgctctctgtggatgtactactgataacagggagagcagtgataaaagtctaggacgtgaagaacggaacatgtatgcttatagtaacaaggtgcttaaagaaagataagtttttttttgttagtaaggatgcaaattaccaagtgctaggggaaacaacacgaggaatgagtctccaatcaaatcatttctttgtaggtgctttcccatgggccatggctagttggctacattatcctctgtatttaaatgcagcaatcatttttttttgctaagcaccgtatttgtcctacgtggcaattagaagtacacctatgttgtgtactcccttcgtcccaccaaaaaacaacctaatattagataagacatttcgtaatataatgaatctggacattagtctttttttagacggaggaagtatgctcaataggccagtttccaatggtgtgctaaaaacatcattttggttggaaattcaaacacctgaactttaagaaaggcaagcacagaacaagaaaaagaatccagaaaaaacctaagatcaaaattcatgctacacaccgaaatggaattgtggcctgtgggccttgatatacatccaaaaaggaggccatcgaggcctaatttacggcccaaacaagtgatccgtcgccattcgattcgacgcaaaatttgcatcgcgcaatcactgaatcgtgcagcgagcgagcgatccgatccgcggcgagtgcgaagaatggcagcggggaaaccgtaccgctgaaggcgatgccggagcaggcgacgacgcaggtctggacgacggtgttctcctggcgggtgaaggggcggacgctggcgacgccggccttgtcgaggagcttggtccacgacgtgaggaggaagaagccgaggagccccgcggagacgttgagcgaggggatgatccccgtcgtcaggttcagcttcatcacgatcacgctgaacatggcgcccagcagcgcgctcaccgccagcgcccgcagcgtcacctgctccttccaccccggcaccaccctcccctcgaacacccgctccaccgacaccaccgccgcctcctcctcctgatctctacgctccctcccgctcctcgccatggcccgcgaattgagctctcgctctcgctctctctctcgatcgatcgcggttgcgaggtgtggaggcgaaggcgaaggcgcgcgtgtttccggggagttaagagttgtcgtctgggccccacatgtcagtagtactggttgtccgctacgaggggatgacatgtggggtcactgatgagtttcacttgggttcagtttgctagtgccacgtggcagggataggggcttttccgtcgggatccgcttctatcggcgagtgtcacccccgtctcttgatcgtcttcccgtcaacgtagcactagctcgcggttaaatttggcaaatcaaccgcttgatgatagatacgagcccggaatttgacgaccaaatgcccaaaatttcacgaaacatcgtcacacggacacgtacgtagtgcaaaatcacatggcaaccaaaaaattaccctggcaaaaatgggtgaaaatttttagcgtgtcacatcagatatactgacacatatttaaagtattaaacgtagtctaataacaaaataaattacataatccacatgtaaactgcgagatgaatttattaagcctaattaatatatcattagcaaatatttactgtaacaccacattgttaaatcatggaacaatttggtttaaaagattcgtctcgcaatttatacacaaactgtgtaattagtttttttcgtctaatatttaatacttcgtacatgccttaaaaaaaatttatcggtggatctaaacacccccccccccccttcccccaatcaaacaggccatggctggtggtgctgatatatcgacagaaacatgccatgccatgacaatgcggaatgcatcagcctctgcctgcaccagacatttctgctctgtgactctgtccgagtgaagaagacgacgacgacgctaaaaagcaagtgccacatctgctggctagatgccgctacattttactgttgcgtttggtgttggtgcccgtggtgggccccatctccttggcgatattccggagcacgtacttctggatcttcccggtggacgtcttcggtaactcgtcgcggaagatcaccgtctttgggaccatgtaccgcggcatgcgctcccggctccacgcgaccacgtccgccgccgtcaccgcgccgccgccctgcttgaggctgacgaacgcgcacggcgtctccccccagaactcgtccggccgcgccaccaccgccgcctcgttcaccgccgggtggccgtacagcacggactccacctccacgctgctgatgttctccccgccgctgatgatcacgtccttggaccggtcccggatctccacgtacccgtccgggtgcatcaccccgacgtcgccggtgtagaaccacccgttgtcccggatcgccgccttcgtcgccgcctcgtcgttgaggtagcccagcgtgatgcagccgccgcggagcacgatctcgcccatggtcgacccgtcgcggggcacgctgcggccggtctcgccgtccacgacgtccacctcggccatccccggcgtgcgcacgccctgcctcgccttgagccgcgcgcgctcggaggccgggagcttgtcccactcgcccttccacgcgcacgagagcaccagacccgcggtctccgtcagcccgtacccgtggctgacctcgaagccgatcgcctccgtgcggtacagcacggcggccggcggcggcgcgccggccgtgaggatccgcaccttccccgggagcggcttccgcacgccctcgggcgcgttcgccagcatgttgagcacgacgggcgcgccgcacaggtggttgacgccgcggcgcgcgattgtgtcgaacacctcggcggcgtcgacgcggcggaggcagacgttggtgccgcccaccacggccatcccccatgggaagctccagccattggcgtggaacatggggagcgtccacaggtacgtcggccgcggcggcaccgcccagtcgaccagcgagtcgacggtgatgaggaagatcccccggtggcagtgcaccacccccttgggcgccgacgtggtgccggaggtgtagttgaggatcatcgggtcccactcgctcgccggccgcacccacgcgaactccgggtcccccttctcgacgagcctctcgtacgtcagcgcggcggcgggggcgggagggaactccttctcatggggatcctcgacgaggacgacgcgcggggccgtgtgccccgccgggaggaggcggagcgcgtcgcggaggacggggagcagcgccgggtcgacgaagatgagcttggagccggagtggcggagcaggacggacaccgtgcgcgcgtcgagccgcgtgttgatgctgttcagcacggcgccgctcatcggcacggcgaagtgcatctcgtacatcgccggcacgttcggcaggagcacggacacctgactcaatccagcttagcttagcaacacgaggaaggtgttcgacgaaatgaccgtggaaggaaaaaggatcgatggatgctcacgacgtcgccgcgggagatgccgagggaggagacgagcgcggaggcgaggcggaggcagcggcggtgggtctgcgaccacgtgaagacggtgtcgtggtagacgacggacgggcagtcgccgaacacggtggcggcgcgctccaggaagcccagcggcgtgagcgcgcacgagttggccgggttggcgccgagcttgtccatggccgccgcgtcgatcgccggagcacgagctgtcgcctgtgtgaacgccggtgactccagctatcgcggggtggttggagtggaggcgaggaaagagcgagtgaggaggctgcggtgatataaaaccagtttgctattgaccagatgacttattctccgaatctcagtcaccttgattcctgcccgttggatcgagatcaacggctaaggatagggcaacagcgagtgaaatttacgctggtcaactatgtcaaataaggaggaatggatttagtagtaatatatggagtacagtatatagtactaatttccaattgcatttataaagaaatcagtggtcttccatttaaataaaaagaaatttatccatataaattggcagcagcttcgtttgatggggacggccacgatcagttgcaggcgcaatctggatacacggaatgtatccttccttagtcccagaagtagatagaaaaaacaaacgtatcgattataacacattaataatgtgaatctaaacttactactacctccgtctcaaaataagtgcagccgtagaaatccgtatccaacgtttaaccgtccgttttatttgaaaaatttatgattttttttaaaaaatttagccacacttaaaagtactatttatgttttatcatctaataacaataaaaatagtaattataaaaaaattttaaataaaatgaacggttaaacgttggagatgaatagtataaaactgcacttattttaatatggagggagtactgtgttaaactcgatactaaattagtgttttataaggcgaaggagatacctcatcatatgctagttcatgccgcagtaaaaagaaagattgaagataattcattttcttcgatccagcatcccagccaaacctcggagaacccagagatgagacaagagaacgaatcaaaatacttttcatcatatatgaacagatggcagtagttggcagtagcatgtttttttttactactcccccttcaaccccatagatttgcatcaaatgtgcatcacatgatctaggacctctgtctttctggcactgtagattaacaaacgatacagaagatggtacctccaaactactgatgtgcagtattaaacttttttaaaactggtaaaaacaagactcccgtttccatatacccggaacgtacaaaagcttgaaacttttcatttaatttgttcttgacttatggatatatgatacagatcagcagcatgacaaattaataccttaccatgatctggcgatgtgtatgtacggtccaaaagatgagtcacgaacccacgatatctatacgagccttattggttgacctaattaatcaaagcaaaagctaaaaattaaaattttaaacttgattttgaaattaaatttaagatatttttaacatagttttgttttttattattagcttttaaatcgctaaaaaaatatataaaaattttatataaaaattaattttattatttaataaatcagtgttttattaggaaatatgagcaaccgacgagactctacctatctcccatgctactccactatgacaactcgtatgcatgtgtcgctttcagagttccgtgcaggagatgaacataccagtgtattatcttcagagaaaagaaatacaccggagtatgtagcactgttcttcaccaatccttggctccttgcagctatctaatctgctagttgctactgcatgtgtctaatttggtcagtcaattgcaatgtgcaaacaggctagtcaagaatgtctatctcgtgcccggcgaagaaaagattgtctagctcgtcgatcgttttcattggtagttctagtctagcaattggtttttttcctgataaaaaaatagtgccttttctatgtaggagtatatgtctgactcatcttattttatttcagattattggctggacagtcatcttcatcagttatactagtaaaacattcgtccatactccatagaaatttcagaccatcgtaggtgtaaaatttcttctggtctatttgaacacatgcaccagccgcctttcaattcttacaattctgcgtactcgcgaacgtgaaattcagacgacatcaatggaatttccctcttggccttccgttttttctctctctagaaactgtaaagctaccgtggagcgaaaagatggctggtgtgggcataatctagtcataatccacccaaagcaacgctgatatatttgactgaccactgcaaattgcagattggctagaccaactgcagctggtcattcctgctctgtctccggggctttggaatcatcaccatgatgtagttttcagaggagaatctccttcagttacaacagcatgttataagccaactataaatatattttaagaaaataaataaaaagagagaaggccagcgggccatatatttatagtcagctgtagcacggattccaaaacacagtgtgtatatgacaggtgggaccaagtattaataatacaatatataactattgtatgaatgagctattagattagttataaatgaattggagctagtagttggctatactattgaacctgctctaagagcaagtttaatagtatagtccactaccagctccaattcatctatagtcaaatttaatagccaattcatataacagttacttactatactattaatatatggtcccacctatcatacatacatttcatctaggagttcgtgctgtagctggctacagatctgtagcccgccgcttttctctcttatcttttatctcactaaaatatgtttatagctgactaatagtctgctattatacatgctctaaatcgtttagcatccaagtgtatagaggatgttgctctctgggcataaagattgaactgtgccgacaggatcgtagcagaatcctagaaacaaattctatcttctcctcttcgttcaaatgtatattctctcaatctcaaaaaaagacaaactataagagacaaatctggacaaggagaggcatcctctcctctgttatttttttttgagacggagggagtatgacttaatatattatatctctctttaaatgaaaatttaggtggggtagctctccctctggtgaccagtcaaaaaaaaactgaaactgttcatctccttaaatatcttctagaagcgaaagaaattgcaaagaaaaacactgtcgttggcagctgaattccatcttgaaccagttaaacacaaaactgaaaaaaaaaacattatatcgaaaagacaaccagtgtggaataatctgtcatattccacccaaagcaatgcagagagtcattggcaaactgcagattttctttttgatgaaaagacaaggtacagatttgtttgactaattacaacaatttattctctattcttgtagaagataaagagctttgcaagaaaataagaattagaaaaggaagtcgttggcagttgaatttcatctcaaactagcaccctgtttagatgggactaaaacttaaaacttaatctctatcacatcgaatgtttggacactaattatatatattaaacgtagactattaataaaacccatccataattctgaactaatttgcgagacgaatctattgagcctaattaatccataattaggatgctacagtaaacattctctaattatagattaattatgcttaaaaaatttatctcgtaaattagctttcatttatgtaattagttttggaagtagtatatatttaatactctaaattagtatctaaatataagtactaaagttaagtcactggatccaaacaccacctaagcacaatagcaaaaacatcatgtcacagttttctgcttaatttgaacatataaaacacacaggcgtgcacagcggaaagaatggagaaatcacgaaagctaaaagaaaagctgagagatctcctatgccattccaagtacagaagaaacagtgcatgtccacatctcaaagcagtcgtggtcagaggtgacatcacagactcgttgcttcgagattgcacaccacctgtttgctgaaaagcagcagccaaccacacaccaaaactaaaatggaaaaaaggaaaggcagaaatcagtcgtcgtcgtcgtgccattctcaggccgtcttgtactcgacgacggcgatcttggcggcggggccgccctggatgtagacgatggtgagctgcgcgccggcgtcgagccgtgtcatccacgacgggaactcgtacatgtccttggcgttcgtgcgggagacgccgtagatctccccggagagctccttgatctgcagcttcaggtaggtgatggcgtggccgcacgtgttcttcgccgtcaccacgtgccggtagtagtccacgccgtttgccttccacgtgttcgtcaccgtgtgcacgaactccaacggcgacccacctgacaaagaaacgcacgatcacttggaggagatctcaatggtacaagttcgattgcattgttgatttggttaattaattaccatttgatggcgagggggcatttggcgccggcgtgtactccggcgtgttatcggcgggcgaggcggcgaggcgggcgaagacgccggacatgggggcgttgccggcgagggtgggctcggcgtgctggtagttgcagcggtcgtcgtcgtaggcgtcgttggcgtcggggccgccgacgagggcgccgtggaggacgttggggtcggcgttcttgctgttgtagtacttgtcgaagctttccatgcacccgacggtggcgttcatggcgtagatggacgggatggacgcgccgcggtggtggacgtgcgtcgggtagtagctgccgtatccgaccatgtagctcatccccttggggttcttgccgaggacgtagtcgacctgcgacctcgcgaaccggaggatctccgccggcttcacctcgccgtccgggcacctgagcgttccccgcgactcggcgaggtagtcggcgtagacggtgaggaggaacgccgacgagctcacgtactgcatgttgctccagtcgctcacgtacatgagaccacctggataaccaatccaatccacacaattcagaacaatcacattgcaaaatctattaccaattcttcgaggaagtggatttttgtccctcgggaggacatcccctcgttttatacatctcactcaaaattttatcaatttttttttaaaaaaaaattgtcaagatagattaatatatgacatctttcgtaaacatgcgagttaaaattcaacttatacaattcaaaacaaaaataacaaatttaaccttaaattacacgttctattcattgtcaaatttattatttttgtttttatttgtattaattgaatttgaatttgtatatttattaagagtgatctatcctactaattttttttatgatcatgcaaaaatgaggagatgttttcttaaggatgatttgagttttccatccttggaagaagaagaagctagcaaggatgggatggattaccaggggtcatcttgacgttgtggccgttgttcttctggaggcaggcgcagaggaagaactcggccttggcctgatactgcttcagcgtgtcggcgtagccggcggcgctgccgccctgctcgaagaggaccttggagaggaggacctggaggccggcgtacttgttgtcccaggagaactcggtgacggcccagccggtgccgccgaacgcctccgcgttctgggacacgtagcggaggtactgctcgtcgccggtcgcctcgtacagccacgccgccgcccacagcagctcgtcctggtagccggacgccgacgggtagaacttcttggcgctctgcagcgagtcgtcgtacttgcccctgaacgtgtccgcgaacgtgaacagctgcccccccaaaaaaaagagaaaataactcatcagaatgttgctgctgcatttgctgattgctctcatacgctggctgcgttcgacagcccctcctcccgtcccgcaaaacaaagcttatattattataaaattaattaactattaattatttttttaaaaaaaatggattaatatgattttttaaaataactttaatatatatttttttaagattaaattgcactttggtccctcttttatttcccaagtttcaatttggaccacccttaaagctatctttttaatttagactgggtaaatttaccactgttacggtttgtactatcataaacaacttttctcatcatgtataacttccctttcggcaaacatatgaaccatatatagaggagttcggccgcatactagagttgatgtgtttaagctcgttggttgtactgaaaaaaaatcgttcgtggtaatccaaattacaacaatagtaaatttattcggtccaaagtaaaaatatatgtttaaaggtggtctaaagtgaaacttaggtaataagatgtggcccaaaacgtaattcactttttttttataaatcataccgtttaatagtttgaaaagcatgcgtgcgaaaaacgaggaaggtgggttggaaaaatggacgaagatcacagccacatgtgtctctgtacctgcttggagtggaggaggaggaggtcggagtacatgcggtcgtagggcttgaaggccttggcggcggcggcgagagcggcggcggtctcgccggcgacctccgacccggggttgttgatgtcgatcttgaacgccgtgcgcggcgtcgacatgtcctcggcgcgctcccagcacaggtggtcgctgtcgccgtcacccacctaatcaaagaatccagaaaatttttcttgagggcactagtgggccgtgttgggctcttggtgagatgggccttgagtgcgtgcgtacctggacccagagggcgttgtgctgggtgtgggccttgacgaagtagttggtgccccagcggatggcgtcgaggacgcggtggagcttgttgccgtcgaccatctccttctcgaactcgaccaccccccacgacagcatcgtcaccgcgtacgccatcgggagcccgaacttcacgtggtcgccggagtcgtagtacccgcccaccaaatccacctgcaaattcatccatccttcgattcaattcgcgccgcattactcaacccgatcgagcatttacccggccttgccttttacatccaactggatatacacggccattgcaatagagaactttgtcccgtggacaacacaatctaaaatttacttctataaagatttaaactcaggactttaaagtactactctaacgactgtaaccactatcgagcatttggttgattgaaccggaggcggcggagatgtatgtattaccccctgggagaagccgtcggtgagggcggagtcgccgcgccaccggacgaggcggtcgtcggggagcttgccggagcgctgcgcctcgaagaacaggaggcacttgtcgaacgcgccggcgtagtcgaacgccgacgcctccaccgacgcggccgccgcgaggaggagaaccagcgacgccgccgccggtatcagcaggaaggtggttgccggcgtcttgttcatcgtcgccgccattgctcgacctcggtagtggaatactggattgagggagaggcccgcacggcggaggagttttataaggtcgccatgatcgacgacgtggaggacggtggcgcgcggccgtggcatcgtgggcgcacgcgatgtgcctcgcacgtagcgaggaggagagatacgacgacgacgacgacgaggtgagcttttggcggggtttgagccatgcacgtcgtggagccgaaactgcagaaatggttgcaactcaagcgtgtaatagtttaattggtaatataataatagttgaagattagttttttttttaaggtaatggagttgaagattggatgcttgtagttttaagggaagattagaaaaaaaatgaaaggctgggtgcctgggtctgatgatcattgtctttttttttttttgagaatttgatgatcattgtgtcaactaccaattgtgtcggcttggatcgacatgaagtccactccagttacactgcgtgatcttgtgttgcaaatgattttccaatcaattttatcacgtttgtgccattgatctggatatttgtggaaggtcaacccagatattatgcatatatattcaaggtgagctgagccaaacatctctgtaccttcctgctgttcaagagctttcacagcaccatctgcactcgatctccagtgcatcagaaccgaagtaccttccttgctctcctgtgaatcctgctgtatgagtttcggtttcctttatctcctgagacaggcagaactccgtgcatgttcttaggaaaatgtgtcattttcaaaaaagaaaaagaaaaatgttgtgtcctatagccaactgttggcttgaaatcatctataatcaacttaatagccaactcatacaatagttacctataaatatatactacataattaatatttggtctcatctatcatacacacatacaccttgaagtctgtgctgcaactggttataaatctgtagccccgctgtcattctctctctttttttattttttcgaaatgtgtttatagctggcttatagcctgctattgcacctgctctaagcagaccaaatgcacaactgcacactggttttattcagtgtaactgcacatcgactccgccatggcacggcatcgatctaccatgccggccaggccgatttactgaattcatcagcagccaagaataaaattatcgatcacttcttttggttgttgccaccaggagtgatcagccgacgactagatgtgccagctttcagctctcgagcgaagtggcaatggtgtcggagctacgcggctctggatttccggcgaaggagacggcgcggctgacgtagagccgcaccaccctggccgcgagattcgaatccaacggtgtatgtacgactacgagccatcaggatagcgatctacggacagtttccactcggccgcggtgatcctgagttcctgaccgcttgattcggatccgacggtttccgtacaggcccgtacggtcgctaacgatgcgcagcgtcgcagcgatccatgtcgagcaaggactctaaagaaaatactaacaacaaactgagggctcttttgcaaaagtcaccctgtgcttacgcgatcgcagccatgaggttttgatccaacggtgtcagttaatgccactcctcctctctcttcttcttcttcccccggcgatctctccgtcccagccgccgcggcgtcgctccggcaggcgcatccgccggaatgggacggcctcgtcgttatctccggtaaactcgcctctcagagcctccgatcccctcacctcctccgcagcggggccgtcccaacacgctcatcggccggaatggtgaggcctcatcgtcgtcgtctccgataaactcgccacccaacaccgccctcgcctccgctctcaccgtcatcaactgcggcccggcgccccagatccagcatgcgcgtcctcagaacgacgaagcgttgtcgtttcctccagtcaatccaactcgcctgctcacctctgtcgcagtgtaatccttgtaacgtatgcatctttcactggtcatggactacaccccctcccaccaaaaaaaaaaaaaaaacttcaaactatatatttagatatagactatgttcaaatacagaattagaagttactctctccatcacataatataaggcgtccacatattttaagattccaccttcaaaacattttgaccatcatttagtacaatataaattgaattttacttgctaaaaattatatcattggattaatatttgaatttattttcatatggttataattttgttactacaaccttattatatatatgagaaattataaaacaaagattagttttggagactaatataggatagagggagtagtttcttgaagaaaagaatggaggaagtagttgttagtcagatggcgtcaatttgagccttgtgtttagtggtcctgcatatgattgagcaaacatacttcaaggtggtggttttctttttgataaagtttaagaagatggtgggtgatgtgttctttgataaagaagtttaagaagatgttcttcttaacgaaaacaaagtctacttgggagcaaaaaaaagatgataatgctattgagtattggcaactctttcaaactagacaaagatggtgattctattgacgatgcttccaaactacaatgattccattgcaacttgaacaaccggaaatttaattagttgttgagtgattttactctttagcaggtacagtgaggtatcctttttttattaagaaacttggtatacctcttctcttaatacctcggctattaagagataccaaaatctacattaaaaaattgatctctctaggtatccacaatacctcggctattaagagaaaccaaaataaaaaaaaaatgatctctctaggtatccacaaagacagtaaaatttctcttgttctacatatgggatatattcaactgtcctacattccgacattcctcctggtggcaaaaaaaattgcctcgcgaaaataacattgagaacattcaaacgagcccatcctagctacagaactcttctactatctggcatataaaaaccgcctggaggatcgatctgcatggacaaaaattcccatttcaagcaagcaacagcatacactacaggccttgaacccatctgcaggtacccagaagcaacgctctaagtcttaaaggatttacttaaaggggcaagcatctgaagtcgaaaacccacgggccgagtcgctctttcaaaaaaccaaaaaaaaaaacccttcgggtgttctgctaccagtctactactagaaagagctaaagctcatcaacttccagccttggtatgatggtaccgcgctagagcatagtctgaaactctgaatgttgggactatggaggtgcttctggttctaggacccatacagtacaggtaatggagagaacatgatgtatttcgatgccgtggagatcatgcaaccattcagttagaccgagataggaagaattcatagtctggatgacggttgatagacttctccccgttggccttgggtatcaccatgcttgacataactgatgcaccatgtcttaaagtcttcagcctctgtttcaggacttcagcacgatcagttttggggccaacgtctaatgacattggcttgatctctgggtttctcagttgaaaccattgctctccctgtaaacaaaaaatataaataaggatgagttcagcattaaaatatctatgaaaatactaccagcaagaaaactaaaaggtttttctagtacacaaaggtttccgccatctggtataataacagaaaactttatattcctttactaatacaatgattttccatagtggattgtccacctatgcacaatcaacttggtcacagacagatgggatgaagatgacgtttgtccaacaccatatcttactgtcttaaattaagcttaaaaggggaagtgcactagagatataagcaagccacctatgggaggtcacaacttgattagtcaaataagaaaaaaaaacaagaattaaagtttactcataaagcttttgttagatgaagatgaggttttacattgaacttttagtaccgtgctgaatgtgattagtaataataataaattgtggctacaaacctatactatcc

SEQ ID NO: 72919 - DNA, 856 bp, Oryza sativa
  unsure (1)..(856): unsure at all n locations
cctcctgttattcattcgttnggtttatttaacgttgcgttagtcgcccactgcattantaatttacttcttttctcatgttttcctaatatatcatcttntncanncnnnnnncnnaagcgttgaatgcatgacgcacgcccnncancaccggcccgtggctcgccggatctagactcgagcggtgacaatgggggaagcagtggctgctcgacagcatcttgatgtggtaggcccgcggcggcctttccccttctcccttctagcgctggcgcgacgtccctctccgccacagctcagggagacggccgacgagctcggcggtgcggagaggaggagaacgacgagttcgccagctagggtttgagcaggggcgtcgacgagactctctctggcacggcggcagctgtctccggcgacgatcgccgccgccttacacagggtgtggggtgtgggcatcgcacagagccacgaagcgcgaaagcacgacccccacagtgcaccgtgccgttcttcccaagccgggcagcaacttttctgacgaagaacgcacgcccagttttgggctcacgaaccctcgtaggtcacgctctaatcccagctggtagagaatcttctacgtggcgtgggttggccaaatgccacgtgtgtgcactgtgaatgccctaacgaaaatagtaagtgtcgacgggtgatacccgtagaccggatatagaaggtattggggtacgtttggtacaaggatctacgtattacgacatcaagcaaacaaaagacaggaattattctgtagggcaccatggatttctttgagtcgcttgctttgggggctatgcgtttgggaggggttgggtat

SEQ ID NO: 72920 - DNA, 4656 bp, Oryza sativa
gccacacagccataagcgaggtattattggttgtaaaactggtggggaaatatccaacccgccctgtaaattgtgtctctcccagatgccagcggaggggtaccttcccccaatgttggataaagcccccataaaacttgtacccacaataacccgtatagaaggtgtttaagttaactccccaacagcaccaacaaaaccggatgatggtttaatgggggtgaactcttctaaaacctccgaaccaaccaaaacgttgggttggtgaagaaactggatgggtagccttatccccaaaagaagtaaaaaatttaccttggggtgaagatggttcaagccgtacggaatgggaagcacaagcagagcaaaagagccaaaattctccatgcattttgttttctgtcataatttgatgattaaggaggctttgcagattatctaaacttgttgatttatataccctttttgtctatgaataggtcaattgtatgaattgttgtttatatacatgatttatatacccttgctgctgctgccacaatgattgtgggctgttttattatctagacttgcttgaattgaatggatgaattgctgtttacatgaagttagtagtactgtctccttttttatctacacccctgctactgcccctacacttgttcacttgttccttattaaatggccagtgtagagtagttatatacctctacacttgttctttttttatgcataagaacagattttgtgcacttgctctttttttatgcataagaacagattttctgcacttgctcttttcttctggattgataaatggccagtgatgaattgctcaataagaacagattatctacacttgttcatttttttatctattcttctttttgcccctgttgtggctcaataagtaatgaattgctcaataagaatagtttatctgtacccttattgtgggctgttttttaaatttgcatgattgactcagtggttatatacctctacacttgttctttatggataagaacagagtatctacacttgttctttttttatgcataagaacagatttgctcttttgatgttatgatttcctctttttatcccttcatgcaaatgaatataattgatgcatatttctgagcaaaactgaggccatatctttcatagtataccccgtattacatgattttggtgcagtgaatcttgaatgtggatttaagtgcaactgctgctgtctatgtttgcccttgctgtctatgtttgcccatgctgctgcctatggttgcaactgttagttaagtgcaacttgaatgtggttttaagtgccatttggacatataaccattcatggagtgtgtactgctatatatgttgctagacctattgaattttgtggacttgcatttatactcctcctgctgctgttttatgtcaatcatgcaaattctgtacccttgctgctgctgttttttaaattttcatgattgatttagtggttatatacctctacacttgttctttttttatgcataagaacagattttgtgcactctctctttttttatgcataagaacagattttctgcacttgttcatttttttatctacaataatatatgcatgatttatataccactgctgttgttgcccctgtacttcttgttaaatggccaaggatgaattgcttaataacattctatctatacctgttcttttctttatggataagaacagattatctacacttgttgatttatatacccttgctgtctatgtgaatttccctctgctgttgctgtttatgtgaatttccaccctgctgttgcttgttatgtgaatttccaccctgctgttgctgtttatgtgaatctccccttgctgttgctgcccctgtggcatatatacccctactgctgttatatgaccctgctactgctcttttccttatggataagaacagatgaactacacttgttctattttattgataagaacagatgaactacacttgttctattttattttctatttcctcttttttctgcacttgctcttttcttctggattgataagaggagtatatctagacatgttgttttagttaatttgcccctgctgttgctacccctgtggcatatatactcctcctgctgctgttttatgtcaatcatgcaaattatgtacccttgctgctgctgttttttaaatttgcatgattgattcagtggttatatacctctacacttgttctttttttatgcataagaacagatttcctgcacttgctctgttccttatgattttctctttttatccctttatgcaaatgattgtaattgatgcatatttctcagcaaaactgaggccatatctttcatagtataccccgtattacattggatctaatgctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcagaattgccgcaggaacaacatacgtcgatgtcgggcgagacaagtgcaagtaggtctagtagaaatccgcggtcacaaaatatatggccgaccacagtgcaagttataagagaggttgacgctagtggtaggcccacggcgcccaggactgtcattggaagatggtctaactgctgcgggatagcggcacgtgagaacttcgggatcctccataaagatatcgggaaggtcacagaagccgagaaagagcgagcttggacggcaatggagaaatggttcacatttccagccgaagcaaaggataggctcaagcggaaggcattacaaaagatgggcaaagcttggaagaattggaagtcgaagctcttcaccgagtatgtcaacccgcccggcaatcatacgccgttcgatgaataccctcaaataaccgaagcggtgtgggaggaattctgctctctcaagaccacccaagagtttagggaatccagcgaggcacatcgcgtactgcaacagcggaatgagcacccgcatcggctgggcaccgcagggtacatcggcaaggaggcaatatgggcccaagaagatgcagccgctgcagcagcgaatgtacctgccccgttttcagacatccctgaacaaagagctcgcaactgggcgcgggcaaggggtaaggtcaacccggacggctctgtcacatttgagaacaaaagtgatgccgtcgtctatcaggaactggtgagttcactacttaacctaactaatttccgttcgtataaagtacaagttcgtataaacaactatcttcttttctagttgggcttggttgctgaacaagcttcacaaagcgaggttgagtccgcgccgaagaggcgcgaagatgacatcctcacaaaggcgctcggaaccaaagaacatcctggccgaactcggggaattggtagcgatgtgccctggaagcatggactccctcagtacagctcccaatacaggaaacggaaagtctccaaggaagagagggacgctcgtttgaaggccgaacttaaggttgaggtcattcaagaactagaagctagcatgaatgcaagggtggaagaaagggttaacaaggtgctcgccgacatgaatataccccgagtcacaacacctgctgtgcaaccaactcctcgtatacaacacgacgcgagtccgtcacagcataggagtagttgtgcatccacagaggtgccggcccctggtctcccgatcgcaccactagctgcagtggaccacatcgaggtaattattgttatccgatccatatctaataaaagacatttacacattccaatattaaattcaaactttcaccttatgcagggcgcagcacagtgtgtcctactagcgagagtccacccaactttcgctcctgaagtcgctgagggcatggctttcaagccctcggttacagacaaggtccacggcgcagacctgctagctgggtatgccaaggtgtccatcgatagagtaaaggacacctggtcaggctatccgctgcccgtgcccccaaatgatgaaatcatgactttgggcgatgcgcgcaagacattcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgaggcaaggggaaggtcggggagttggcgccggagccaaaaaggggcaaggctgcgacgtcgatgccggtgagcaaatcggggaaggtcgtgagggcgccagcccaatttgagctaggcatgcctgcaggtcgactctagaggat

SEQ ID NO: 72921 - DNA, 838 bp, Oryza sativa
  unsure (1)..(838): unsure at all n locations
ctcttgctcttttacacttttatcttgatgttggtttgagtccccgtctctattttcatgtctatactattgctctatattcgttattgtatttatgttataaatatttaaataataaatggtatagttgttgacnactctgcaanacnncanncaaaangagaaccacanaagcggaaaggggggcncaaaaccagggaccnganagncngaananaacaccgacccggaacaagggacaaacacganaggggcacccaagaacaaacggggcggagggagccnaggcacagaagcaacggcagggagcanagggagaaacacagccaagcaacgctccggaccccccggcacgacgcataacagcgacatagaagcaatctcaaacaggcatttgttcccttttatgtcgaacgttgaattgtgagacgtagggcatgtgtaaatttttcacctaatcgtaaacattcagcgcgggttgtcagtgacattataggaaagtgtatagacatgggaatggtgaagccctgcatactttccttgaacaaggcattctactaatcatgtaccacacatctgacttaatatctttgtatgataggaatttggtacattaccaaaaatggatgtcgatgtaccccttacttcccttcatatacgacgtactttgctggatgtgcccaaaaagatagacattctaattgtgattatggcagatgatagaagttatgatggtatggaagttagttgtgtcaggttcactgttgattttcttttttgacagttgcatatgatatattgcaggggaaattgaagagatgtgtgagagccttataac

SEQ ID NO: 72922 - DNA, 752 bp, Oryza sativa
  unsure (1)..(752): unsure at all n locations
catgccaaggtgcgtcccgttccgtcccctttagctgaccttgatgaacctgatgtgggtatcgccggaacagagcccggatccccaccgtacctttcatggcatcgctttttggggtaaggacgggacatttccggcgtacacacctgcgcggctggtgggagccgtcggcatcggctgccgtccgtcccctggccggctctcggcaaaccggacgacccgagaagcgcgcagcccgtagctatcggcctatcgcgcgcggcgcactaggcaggcatcctagtttcaccgggttgcgctgtggtatgggcggtgacacccgtcgagctcccgacccatgcgagctcgcggcgcgcgctaaaaaaacgaagcgacgacgccgcgtcgctttcgggtatcggcacggaagcggcacgcgcgcgaccgcatcctcgtgaagattggtggcaacgggtttgaccgatcgggagctaagccggcgctcttccgctcttggacggctgggagaagttttatgggtgggtcagctcctggaacccggaagaagtggacggaatttggaatcggggatctttccgccatgtgcgtgtccagtcgccaccgaagaaaaaatagacgcgccgttttatccattgctttttctaaacgtgactgaaaggaggcaaaaaaaaaacaaattcttgatttatttctgtgtatttattggaggatgatgaggtngtgtnccagtgagtgagtcntaccttggacgg

SEQ ID NO: 72923 - DNA, 778 bp, Oryza sativa
  unsure (1)..(778): unsure at all n locations
gtgtgcaaatcgataacagatggcacagnagctcatcatttttgtcattatacagaaatatgagtatataccccggtctggcctaactagcccgacggtggggtagaggtgcgatcacactggactcccaccaatatgtctgagagtaagggatgtttggttggttgtgtttctttgccaagctacaatttagtcatgtcacaacttcctaggcatgtgtttgtttcgccgtcacaactatatcatgccacactttcttaacctttggccgacttttttttaagataatagaagctttattaagactcaatcaattacaccaagatggtacaatccaactgagccaacccccggcctttgtataaaatgcacacatctaaaaaggaaccataaaagaaaaaacctcatctcaagcacaggagtgtgaaggaaacataaaattagtggttatcaatccatagactagaccaccacccatgcacctagataaaaaaattactgcgccacctggtccaaacatcatgataccactgcaatagtatcccggtttgtggagtatattccaggtgtgtagccaccgagtaactaaagtaataacctgcaaaggagaagacaccattttgtatcaaacaacaactcattcctgcttagccaaaatggaccaacaaagagctactgcgcccatcaaaagatgattttttatgtctttaggaacacgtaaaagccaaagcccaaacatataagttacatttcgaggagattttaaatttgaagccct

SEQ ID NO: 72924 - DNA, 165846 bp, Oryza sativa
tttgtcttatggaacaaacaacaaggagggtttgatagctgtgtttgacctgggaggaggtacctttgatgtctcaattcttgaaatctccaatggggtgttcgaggtcagtatttatgaactacacactgatgctaactagtaactttatgtacaaagaaaatgtagttacataatattcctttttcctgctgattcactgattatcttcttgtcaggtcaaagcaacaaatggtgacacttttctgggaggagaagactttgataacactcttttggagttcttggtgagtgaattcaagaggagtgaagctattgatctggcaaaggacaggctggctctgcagaggttacgtgaagctgctgagaaggctaaaattgaactctcatcgactgcccagaccgagattaaccttccattcatcacagctgatgcttctggagctaaacatttgaacattacacttacaagatcaaagtttgaatctttggtgaatagcctcatcgagaggaccagagagccatgcaagaattgcttgaaggatgctggtataactaccaaggaggttgatgaggtccttcttgttggtggaatgacaagagttccaaaagtgcaggaaattgtttcagagatttttggcaagtccccaagcaaaggggtcaacccagatgaagctgtagccatgggtgcagccatacagggtggtattctccgtggagatgtaaaggagctgcttctccttgatgtgacccccctttcacttggtatcgagactcttggtggtatcttcaccagactgattaaccggaacactacaatccccacgaagaaaagtcaggttagcaagcatcccaatggttaatgacctagcatctagttcattgtcacgtgattaaattttgtttgtattttcatattgtggtatagtagtagattacatagtgttgctctgttctttatcatggattattttgtgattgatccatgaatactcttatatcatgcattacatgatatactaacttcctgctttttagctacgtacttattcttgaccttgctgtttgattttatctgccaggaccttgttcttctatctgtagtgatagattgcttgccacctctttcaaggggtttccatttcatatgtttgacctccttaatttactccatgcattctgcaggtgttctccactgctgctgacaaccagacacaagtgggcattcgtgtcttgcaaggtgagcgtgagatggcgacagacaacaagcttcttggtgagtttgatcttgttggcattccaccagcgccaagaggtatgccacagatcgaggtcacatttgacatcgatgccaatggaattgtgacggtctctgcaaaagacaagtctaccgggaaggagcagcaaatcaccatccgatcctccggtggcctctcagaagctgagattcagaagatggtccaggaggctgagcttcactctcagaaggatcaggagcggaaagccctcattgacatcagaaacaacgctgacactaccatttacagcgttgagaaaagtctgggagagtacagggacaagattcctgcagaggttgccactgagattgagacagcaatcgccgatctccgctctgtgatgacctcagatgacatcgagaagatcaaggccaatatcgaagcggccaacaaggctgtttcaaagattgggcagcatatgtctggtggtggtggtggcgcaggcggttcagagacaggaggatctcagggcggaggcgagcaggctccagaggctgagtacgaggaggtcaagaagtgaaaccgcatgtgctaacagttgccctgcttttagagatagcagctagtagttttttggaagagaccgggatactaggaccttgcgcgttgtaataagttttgtcatacgaaaacacacctaagctcgtaggcctgtctagttgggttgtaatgcatgacttggttgcattggctccttttgcttgcgatacatcgcgcaaactggacgtgatattgtgatattttttttcaccctgttcactcatgagtacaatgaatcctgcatggaagtgatgctgcttctctggcttccgcttgcttgcttgtgctgagcctggtgctgttttggactacaagtcgaggatctcgactctaaaacaagtcattttaggtaatcacggttccgttttgcacgcctactagtaaatattattttgctctgtttcatgaactctctttatctcatgcaatgcataatactgatttctttagttattcttctacggtagaagtgtagaaccttgctgattgataacatgggcaccggcaccgtgtatgtaaacaccgaacacaaacgttctgcacgtgtgcacggttcaagcgtttatagcatctagcgcatctcttcccacaagtcaagctgtgccgaggctggctgaccattattgagagaggccttgacccactccggccatcgcacatttgcctggctaacctcgccattgcaaaccgagtcaaggttcaaagctagctggaactcctgagctagctgtctctgattctaattaagctgtcaactggctactagtcggtgccggacttcatgccggtgatgataattcggcaggaatgaaattaaatgaattacatgcatgcacgttcctcggttcctcctgctatttcctcctgagaaatcgaacccaatcgaattggcacatggaatgccgagtccaaagaagtttctggcgaaaaaaaaaaggtaaaacggctagaagattgtgacatctggcttggaattcggttgcattctggacagtccaagtatgcatctagaagagaagataaattttgattagatgaaagtatgaaacgcctcgaccaaaagttcatcacttttctcttccaactgttgttttctggatgatttgggtcaatttcagcggttgatgtttgtttcaaaatattctgggtgggatcttccgcggcgaaaattaggtacagtgacagggtcaaacacaagtgctactacgtgttcatcttatctacgtgttccaggatgtagctgcaactgcaagcgcggaaaaagggtcaggcgcggaaaccgtaggttaggagagaaaggtatcgaggctgggaaggagagtgtcaatggagatgatggcaagaagcgcactcaaacccttgcagaaaagaggagggaagatagtggaacgagagaatgcaaccgggaataggagaatttactctatgccactggattaatattggtacagtcttttctgtttcattaaggaaaaagaaaatctagcaaggattaatgtgacataactgtataaacattcagtaaagaatttccgtttacgaagaaatgttgattaatcgaccaaggcttgcagcaaacgaaacgtgctcgatctaatttggtaattacgtctgtatattataaaccagtaaaccactgctttgatcccaagaaagtgattactttaaaacaagtagacgcgataggtcattatctagattcaggacgccatgtcagcgtgcatgtcacctttgcttcccctttcttcagatgacaacttatccaagccatccaagcactcttagcagccgcatctccagacacaaccgatgtcatcaagcccaataatcaaacaccaaagcataaacgacgccgcatcagacaaactaaacgcgacaataaaaaaaaatcgaccaaatcgcagacacacaaattttccacagtttcaggctcgcaggcagctcgccacctccttccttgcaaagcaaatccaaccaatcaaatgaacgaagctatcccccaccaagaaaaacaaaaaacaaaaacaaaaatactacacttcaccgcttgcgtacacgaccaagaaaatccgaaacaacatgcagtccggctcgagtctatataaagcgagcaaagcggagaccgagatgaccaaacacacaagctttgatcgatctctcccacacggctcaaacgcgcatacacgtaaacacacaagctttgatccttctgttcgccatggacggcgaggcgacgagcttgatgatctcgccggagatccgcgacgcggtgacgaaggttgccgtgttcgtgctggtgcaggcgctggtctacctcatcctccgcagctcgtcgagcgtcttctccaaggacggcaagctgaggtcgtccatgagcttccggtcgatgcggtccatgagcgtcaggcgcttcctcgcgccgctctccgacgtccccgtcggcaccgacgagccctggccgtcgccgtcgtcctcgccgtcgccgaccttgtcgcgccgctgggctagccgccgcgaggattaattgaagcggttagtgctagcttctgggctctggccagctaggtgctagtttggttactctgaagaaacctgaattatcatgggttggtttggtttgtgattaatggaaatggaaaatttgggaactgggctctgaaagaggcagattattagagtggatcttgtagatatgtggattgaattaagttaatactgaatggtggattatttgattctttacaatttgtctgctttcctcaatctgtaaattggaagtatactattcagatggcgtaaatctgaagttcttatgtacatgctaatacaggagtattatactatacagtacgaagtattggattgagagtttgcactagtaggagctggaatattgctttatttttttttcgcgaacgcacaaaagaattgcacgtcaatatattagagaatattgctttaattattgatctcgttacaacttaatatctgaagagatcatctcaaatctctatttacagtatatatcaattgcttgatttaggtagttagtcacttgtgcttctggatcatttccctaacctcatccatcacaagccatgctttatggcctcctatcacttccgctgcccattctccatccttccataactgaacatgaacgagaactctaagatcaaattttggtttttttttttttgaaaccaaagccagcaattgctggtgttatattaagcagaatgagagatatttacaaattttggtatatggacaatgaactgtgaaggaagtgtggagttacctggatagtgggcattttctgaagatagaagtgcatccaaacacgtggaaagacagaaattgagaatgaataagataagtattggagtcactctgaatcaacagttaatacagaaaaaaaaaagacaagctcaaaatttgctgactcacagttatattccctcttttcaccacagtctgtggaactttgttgacatcgacaaagtagaacctgactctacaaaagaaatgagaaataccattttaattcgagtgaagcaatgggacactcacagtccataccccgcaaggctgtcctctataacttgattgaattcatattgtcaattgtgtcagccctacatacaaacatttgatgaaatttaaaccaaccctggaaattctcctgctatcttctccagtctgggcttcagatatatgcatttccgacaccaactagccatcctggcaagaacaatttaagagaacctcagcatctgcggaagcatttctttagggaatggttgaagactagcattctgataaagaaaatagacattcatctcaacaacatctcaattattgatcacactcctcacaagtccatggaacaatcacaagtcgttcaggtgggtccaaatgaattattttagcacatttcttaagactaagtgggccaagtgggccattccagccagtcacccatttcgaaatcaacattcatcatggaacttccaccgatacaaatttttaacaaaaagcttcaattcgaaaggaatcacatgtcttttagttaaacttgtgacactcccgttgcaatttgaacctgacaaacggggtattccaacaaaactttttcacttcatggtatcttcagaaactttctgaagagaatgataactttcagaaactaacacgatgctacattggtcgcagaatcccaggtcgattcctagcgaatctaagaactctgtaacactcaagcgcagttctaattgctgaattcagagagaattcatgggctggcaaaatcagggatgctcacgtagtaaatcagaaaaatgaaacagggaaaggcaaaagcggatcataccagtcgatgatgatgggctgcttgttctcgacggaccaccggagcgcgtcgtcgagcttctccatggagtcgatctcctccatctccaccggcttcgacacgtcccagaagtaggcctccgccctcaacatcccatcccctctctccctcctcctccccttccccccgcccccgcccccgccaccgctccacatcccgagcggcctccccgccgccccgccaccgccagcgacggtcgagcatgcagccgcgggtggctgcagggcgcctgcggcgggcgcctcgcgcgcgcgcagcacccgggggctcggcgctatgagcgccattgttcggggacgcggcgcccgcgctgcgcgttggtcggcggcggcgatccggtgaggcggtgagcgaactgttcgtggcagtggcggcggcgggaagcctgagcttatccgtattgctgcgcttgcgtagagaggagaggagaggagaggagaggaggggtggagcgcgcggcgacggcgaggtggggtaggaagggacaaaagcgttggcgtctgggcgactgggccctaccggatcgcggaaatatctcgagattttttagtgggaataagttcacttcaggaccctcaaaagtgaccaatctaattcatgaccctaaaccgtaaaaccggatatcttcaccccccaaactattgaaaccggtgcaatttgactcccttggtggttttggatgacggcttcgctgacgtggcgctgacgtggcagtattgactcggtcttctttccacgtggcgttgacatggcacttaggtgacattagaaaaaaaaatatgcgtgggacccattagtcattcacacacaataaaaaattgtggggcccactgacatgtgggccccacatgtcatcctctctctccctttcttcctcctcccttctctctttctttctctttctcttttctcccctttggctggccgcgagggagcacgggcggctggagctggagcggcggcgggtgggccagagcagcggcagcggcggcggcggcggtagcctcgccatcagccttgccaagtggagagaggagaggagaggagagcaggtgagggaggaacggaggtggtgggttacacgagaggcggcggtggcgcgtgagggccggaagggagaggggagaagcggagccgccgagctcatgttgtcgctgccggtgcctcctcccgcactcgtgctcgcccgcacaccgccggagccctgccgctcgacccgctcgatgcctccgccgtcgacgtcccgcgcccgccgccgccgtcgacgtcctgcacctgccgccgccggtgcctcctcccgcactcgcgctcgcccgcacgccgccggagccgccgctcaacccgctcgatgcctccgccgtcgacgtcccgcgcccgccgccgtcgacatcccgcgcccgccgccgccgtcgacgtcccgcgcgatgcgaggatggatgcagggaggtgttggaggaaggcgacgaggagctctgatcccggcgatgcggatggatccgaagctgtagccggcccatagaccaccgtccccccgctcgatctcgtcggcgtcggcgctgtcgtcctctctcgcgtagctctagctcgccgccgcttcagctctcgccgaccgccaccaatccggcccacgccccacgctgccaactccagcccaccgccgccgccgctgctccagctagctccggccgccgccgctccagctagctctcgacgccgccgccgccgccgcttcagctcccaccggtcgcgtcgcttcagaccccgcccaccgccgctcgctccccgcagacgcccgaagtggagaggtagaacaaaaagagagaagggaggaggaggggaggttcgagaggaagaagaaagggaagagatgacaggtggggcccacatgttagtgggccccacaatcttgtgtgtgtgaatgccaaatgggtcccacatatatgtttttaattgaaatgccacctcagcgccacgtcagcacacagactaggtcaacactgccacgtcagcgccacgtcagcgaaaccgccatccaaaaccaccaagggagtcaaattgcaccggtttcaatagtttgggggtgaagatatccggttttgcggtttagggtcatggattagattcgggtctcttttaagggtcatgaagtgaacttattcctttttagtgcgactcggtcaagtttctctgcatgggcttagcaccatccggtagcatattccagcggaaataagtctacttgccgcccctcatcttttcgagtttagttggtatcactacttcctccgtttcatattataagactttctagcattatccaccttcatatatatgttaaagaaactagatatatatgtgtgtctaaattcattaacatctatatgaatatggacaatgctagaaagtcttataatctgaaacggagggagtatatcgcaatattaaaaatattcactcccatcctaacaaaagctgcccgagtaatgtcgtaggacaatatgaatgactgttttgactaacgtggcatcctaatcagtaaaaagaaaatttgaaaacatgtggaacctacatgtaagtgaacttccggatctcctcacctatcccatcccttccccatctctccacatatcccctctctttttcaggagctcattagcagggagaggggcagcggttggccagcccatccatgggaagcggcaacggtggtggcggagggggttcgagtagtccacgatggtgaaggagaaggagccagcaagctcgagctcacttgccatccacaagaagacgacggtgatggtgagcgggctggaaaggatggggtcgcggctatcagtgatggcggaggaaggcagagatgaggaaggggtgctacgacggtagcggcggaactcaagctcaagcagtggtgccatcgccatatcctagtttccgtatcaaactgtttcacgctgcccagcttgcccgcaaattcctgatcttcctccatgagcgagatgcgctccgcatcacatatgcggtggcgacctggcccgacacctctttgtcgctccttggtagctcgggggagaaggcgagaagggagggcccagcctggatgacaaccatggcttctctgattcggcagcccccgctccgagtagggtgcccttgctccaataggttgttcttgctcaggtttgtccttgtatgccgctaagcaggccacgcgccgcaccgaacctccttaccctgagctacttccttgtcagtcacacctcctgatcaccacgccggcatcagtcacacctcccgatcactgctctctatcggtgtgctcaatgcatcgtgtttcagagaaactagaaatagtggcgcgctacgctgcgccggttgaagatgtcaccgaacaaccaatatataattgcttgaaggtccaacagaactacaaactggacatggaattaagcataacagccggaacacgtcagagagacttactaattaccagtaacccgtataaacaaaaggttgtaaatttactttattagctacgaaataatttcagcacattttatactggtacactccagcaatgacatgcacttatgcaacctctaaactactctcctgcactgacgggaagtatatcggatatgcttggtgttgcatatattaccgcagaaactccctccctagtagtcctataacagtaaaacaaaagaagattagtctatgcttgccgatgacaatgatttgaaggttgacagattaagcaatgatgaattttacaatcccatagggaagtatactacagttatcttgcattcaatcaaaattataacgcttttggcgagttctgttatctctctataatatcaagctatcaactatatggtgaaaaggaacggccaagttgagatactgaaataacttttctcgctaaaactttgaagtgcaactgccagtaaaagtgttttccacgtttaagggaagaaaatggatgagcatatggttgaattggaaaattttcactatggtgtcatttactctacatattttgaaaaactaaataagtaacattcagaaacaactggcaatacaatgaactgggcgaatatacccaatgcatttaaactgactattcattgatgcaaataggaggcattaattgtctagacaaatattttttttagttcaaggtgaatcaccataatacataagagccacatctatcctgctatcactccttagtgggctgtaggaaatcatctctattttcgacaacaaatactttgctattctgagctcacagctagtaattcagttttaaaagacaaagagctgaatataattgtggaaactacaattgtttcatcaaaatagttattgcagaaggcctggatgagtaaaatagaaataaaaaacaatacctcaccgcagagaatgatgatgggtaaagggaagaaaaaaaatcctgcagacaaatatacaccatgttagcatacaacctataattgaccatattaaccattcaatgatctaccagctaagagaattaaaagtgtaaagaaggatctagtccatttgatccaatgatctataacattgtcaggataggtataacagtcgtacaacaaaagtactgaaaatggtacacagataatagggtatcaagcaaattggatcttcctgcatataaatcatccatttaactgaaagtctagttctattagtgccaaacctaaatcgtctagaatctacatgaagaaccaagtgggtactgagagcaaacacacaaagaaaaatgctaattcgtaaatgactgaaagcctacctgatgcttgaaatactatattgtctgtgcattgtctgtaagagctcctctaatggtatatagcctgcgatttgaaatgtctcatttgaatgatatgactatttatgtacaattgcaacatatttttgttatgaaaacatatgttaccctcacgcatgctctttgcaaacacctagatcacgatccctctgtacaaagcacattgtgcatatcctcctgcagccaagtttagaaaatattcagaaatcgatcctcctgtagccaaattttaatgatggataaagatggtacagatcagtagctacatgatgtaggagatggtgatggccccagtggctgagctgatgaaggtggcagactgtttgtcgaagtcatgaatgttgacctgaactacgaaactgaacaaaatgatattcatgtaaatagggaatgacagagtgaggataaagtagaagaaacaggactggaagagaaggtgggcataggtgttcaccttgaaaggagggatggtagatcagcattgtctgagtatcagcaggctgacgatggagacggatacactcattcaccctggacacttcgggagttgagattcacaaggcccaaatgattcgcatgagatggggaaacaccgcatctcgagctcaagctcgcagaccgtcgagatgatgctttgtatagacgttgccacaatggcacttgattggggacgaactaccatcgatgggccaacgacgacggaggagaaaagccggcgagagcacgagaagagtgggaagaagagaaggcgaggcaaagagaggggcgtgaagtggggagctagcggcggccggggggcacgcacaccacgccctcgctccgttgtgcgaggcggagagccggcggtgtgcgccgatgtgtcgccctccacgtgcgtgagggctacggcagtgtggcggcgccgcggcggatgagccatatgcgtgcgggccgtgagtgttgctagggttttggctgtgtggggatatgttgggaagatcttgactgtctgttgtcctcttattgatctgatggtggtggaagagccggcaccgtagcccaggtggatggctggatcgatcccaacacagaattgaacagcgctagggtaggtggaactcaaacatgattaaccagaagaacggggtgtttttttggaaaaaatgatgacatggcacgctaatctttcgccattcctacggtgtttggatagtttaatatgaggggaggagatattgagaaaagagggtggaaagagagaagagggaaggcgagtgagaatgacatgtggactcatttttatttttgctaaacgcctagtcaacactagtggactaggtcactttccaatccagtaaaaaccagctatatgtaatatcggaggataaaatttaacccggttttgtaagttgtggttggtgttatggtctagggatgcgaattaaacttgatgtaatgatatggggaaaatggacttattccttcgagctgcgtcacatgcggcgcaagtctccccgacggcccaatcttagttccggaggcccaaaagtaggcaatgggctctaaaggaattaatgcctgcgttcctcacgtcgcgtagttctgatttttctgaaagcgtacttctgatttttctgaaacggatgggagttcagattcagtgttcagaattcacatgttgctggcctgaccatcgaatttacatgtttctggcctgatgaccatctatctagacacgcattcactcaactccttgctgcagttcatcaatggcagatggacactcgatcgacagctgacatgatgcgaactcagttcatcgatcggtcgacacatcacacacttcgcccagccaaagctgcctaaactgctggatagccagccatgctcgaaccgaacagccatgactctgcaccgttgagttaggagtagccgcacctaaaactaaaagatctcatcaagaattcaagatcctcgtacaccacttgcgagttgcgacgcttcagtaatctaatctaatcgtacaggtacgtactctactgctgtatacgtacgaatcatgcttctttactcctttacacgacggaacactttcaatccgttgctgctgctgcttttgtgtacgaactgacgtcctcgcatagctgcatgcaggatgcaggatgcgtggctttcaccggcatgcttgttacgcctttgattggtcccgcagtaagcagcagcagaaattaaaagccataaaaaaggcacggacccttgcttaacccgtactccatggatcttccctttccaatgttactgtttctcctcctgttctagtactagtactactatgctgggatccacttaagccggcctcaattctcatcaaggatttatgctagagctcaatgagcttaatctccttctattaatataacgtcaagtaacctgtttgaccgttcggaaaaaaatgggcattacgaaaagccgaaattcgtaaaagctttttttgggttggaaaggaactcccggcgtaatgttgctcgtcgtcgtcaattggccatgatcgattagttcgtggtgcttatgatgatactacggtgaacaataatctgatcactcaaaagaaacggaagaagatgacgattaggccccatgcaccgaaagaatgattcaaatgacttcttcatgcaattccattgccaaatcttaaggtttatgctcattgctttcacataaaaacaggcattggtgagtggcgaccagcctctgtagtctttagtctctagtggagctctttttcgcaggcatgtgacctgcacggcagttcacaagtgcatgacaaggagttggtcaaaagggagaggaaaaaaactgcctctgaagtagctggttaccaacgctacaacgcgacgtgcaaatgtcttgttgacacgatcgaatcctcttgagatagcctactacaactgcgagtgaaccagtacctaaccctctccaaatatcgatatttgtcatagttcatttcacttctttttcgggcgactatgtatcatgcaacttcttcagttgcacacttacacgtctcgtggtgttaggctcgacttcactatttcgcaggccgtgtactttttgccggaatctttttctttctttctttgcagcgttctttacagtgttgtaatagtataattatcaattaattaatctctggatcatggagttggcatctgatcagtcaaggaacttaggctgttccccagtgtcattgggtagacactcacctgaaaatggacaccttggcagttggcaccttgcagcctttcaggtttgcgaagcaatgaaaatttcaaacttattaaaaattgaaaagaatccaacttgatctgcatgcaatcgtcggttttattttatgaatcttatcttggaagttaggcagtgtagcagacttgtccctctcctatcagaaatcggcaatctgttgataggtttcaggcgtgtgcggatggtccaagtgcacatatacatgtatcgacatggctaacctttgcacttacatagctaatagcccattggaattaggcacgctaattaaacgacacaagtagatcacttcagatcagatcacctggagtttcacatttaaccggcgcattcaacacgatccaatctaactgatttatttctgaagctgcacgcctgcacctgttgtgaatggctcaaaccttcttcagtttgtagtcatggtgatcataaagagcctatttggtttgaagccaatttgtgccaacaagttttggcataaccaaatttgatggtatagaatttgaattagttttggcacaaataaaccaaacaagacctaacagtcgtttgacactattaaagccgccaacattttggtatggcaaaaaaattgatttcaatagatcacgtcccatgcgtcagatttggcatggacggcccagatcagagttgcacccggttgagttgggtggttactagttaggccgccaaagaagatgatgtacaagtgcgtacggacagggtcgcactagtgctactacggcagatgacgtggcggtgccaaacaatgaacagtcaaatagcacttcagtccccggattgtccaagtggaggcagatcacgcgataatgctgcattcaaacgtaccactcttatcttcttatcttcggttctgtttcttttcttcccttttgaggaagtcaaccatgcaaacatagtgctgcttgctgtacttcaccatgatttatgtaaggaaaccatgatttaaactttgaagaagcctgttgagttttagtttgactgaaattgcaactcgcaagcctgcaacgccactgtagtgggaaccattttaacccatggagagatatctacttattctttacatgtcttctaaaaagttatgaaaaaatcatattatgaaaaaattggtaaggaatattacaatatatgatttcacaaatatgcaagttaaattatatgttgtaaaaaaatattgtgaatatacgtgtagtagtttctccctctgtctatgaatataagggattatatatttacgttaatttagccaaaaaatataatgaatagaacaaatggaggactagaacatctaaaaccatgaaactgtagggggccagagatggattggcacattcatagttaatttgccttttttttataatatatgaatgtcgaatttgatattatatgtttgtgaaatgatatatgatatatcacatattaatctgacttgttaaatatttttaatttttttaagtaagtatggatatctcgaaatatcaatggtatttgccatatagtgaacactatttaactaaccagttccattaaaagcctatttaaccaacatttttagctgaaatttgatatcccgctgtttaattccctgtaaaattaagctagaatttttcacatagcctaaattgcacgggggttatttaggaaaatgatacacgaactaaaagaaatccttacaaaatttttttataaccagcaattgattagatttaatggttgagatatttgtttgtaagattcttttaaaatacgtacactagcaatgtgaattatcgcagtgatgattatttaaaattgccataatcctcctctagattcgccgtctattgactgttgaccagggtttcaaaaaccgccgggggcccggttaccgccacccggcggtacggcggttaccggcggtaaccgcggtaaccgcgcaaaaccgcgacaaatttacaaatcgaaatttgaattcaaaaattcgggcaaaccgcgcggtttggcgcggttaccgcgcggtttgacgcggtaaccacgcggtttggcgcggttaccgcgcgatgtgtaatgggttgcacagtaacgggccggcccatttttttttctttttccaattttcaaatttattctccgttttgctctcaaatttgaataaatattactcttttttgagaaatttcttcaccataaaacactataaatcaagcactaccttcactattttttttgatttttttcttttttttttaaatttttgaatttggacgaattttattaaaccgtaccgcgcggtacgggtaaccgtacccccgcggtacgggcggtaaccgcggtaaccgcgcggttaccggcggtttttcacaccctgctgttgacagcgcagccaaattcaaattccccgagcgattctcaagcgcatgtcgcccacgttcctactaaacccgaaaacgcgacggaatttaaatccccccaaacccaaaaagatcgcgaaagttagtttcgctcccaacccgccgcaccacctcgcgctcgccgccaccgcgcgccgcgccggcgccgccgccgtctcctcccctacaaaatcctccgccgcagatcactctctccacccgcggagcgcctcctttcctcccccaccgccaccgccaccgcctactccttctcccgcttcgatcgaaaccctcgggagctctcgccgcggccgccgcgcgcgagtgcgagcagtatcagatgaagggcggcgcgtggaagcagagcggcgtggccgatcacgttggctacctcggcggcggaggcggggcgctggtcggccgcgcgcgacgggcgaggctgtgcctctacggcctcgcgctcgccttcggcgcgttcgcggcgttcctcgccttcgcgccctcgcttccggcgccgccgccctcctcgccggcggcagcgtggttcgacggcctcctcgcctccgcgtcgccctaccgcgcgcaggtctcgggctacttctcctcgctgttccccgccaactccacctccccggagcctcctggaggagcagcgacgaatcggcgaggatcgagcggtggtggtgggttctccgcgacgggtgggcaagcgggaaccaatggctccagtacagttgttgccggtgagcagggaagaggagttgaagtatcaagcagcaatgcgggaggtgttccgagcggcaactccccatccggcaacgctactgcggcgatgcagagcaacccgccgcccaatgatcaagcgggaggcggtgccgcagccaataactccaccacgggttccgccggcgaggctgcagttccaagccgcagttcagccagaaacggcacgatgaccaaagatggtgcccctgatcggatcaatggcaccgacgtgatcgcgagttcatctggagatgtcaccgcagtgaaagctaatgcaagaaatgctgccgggtctactcaccagctaggtggtgcaagtgcgatcgtagattcaagcaatggaactgctgctccatccatcaataagactgggaatgcagcagtggccacggacggcaatggcgctgcgcctcagagaggaggagccccaggcaagaaccagactgtcccaaatccgccggctgcactcgatcagaacaagagtggaagcagagctgctgcttcaggtggaagcaatagtacaatggatgctacaccacaggggattgctagtaacaccacagaggctgctgtcgatgccggtggtaagaagaagaaaacccattggattgaagcaatggcgagctgcgatatgttctatggaaattgggtccgagatgactcataccctctctatcccgagggatcatgtcctcacatcgatgagtccttcaactgcccgctcaatggccgccctgataatgcttaccagaggctccggtggcagcccagcggatgcagcattccaaggtgagttgagactacttgagcaactctgttttattcagttcttggtgtttcatgtgacacagctgaaaattcagttccatgatgttcataacagattgaacccgagtgacatgttggagaggctgagggggaagaggctggtgtttgtcggtgattcgctcaacaggaacatgtgggaatccctggtttgcatcttgaggaattctgtcaaggacaagagaaaggtctttgaggtgtcaggcaggcaacaattcagagccgagggctcctattctttcttgtttcaggtatattgtgcatttcaatcatgtctcatgctttgcatctgcgctaatttcagcataaggaatgaatgctcatttgcaaatttcctgttgtctaggactacaactgcagcgtggagttcttccgctcccctttccttgttcaggaatgggagttccccgtcaggaagggtttaaccaaggaaactcttaggcttgacatgatcagcaactctttcccgaggtacaaggatgcggatatcatcatcttcaataccgggcactggtggactcatgaaaaaacttctctagggtaagttggaattggtgctttctgattttgctgaagatctgcatgccatgcgttctgcatttcaagtgttgcttaccactgttagtatgttgaacctgtcacaggaaagattactaccaagagggtaaccgtgtatacagtgagctgaatgttgatgatgccttccagaaagctcttattacctgggccaagtgggttgattccagtgtaaatcccaagaaaacaactgtgttcttcagaggctactcatcatcccatttcaggttggcaaaaccttttctgaattctggcaagtttagtttgatcatgtgcaatatcatgttatcggagtagctgctgacatcatgtttattgtgtgtttcgattgtgcagtgggggccaatggaattcaggaggcagttgcgacaaggaaaccgagccaataacaaatgagaagttcctcacaccatacccacggaagatgagcatcctggaggacgtgctcagtgggatgaaaacacctgttgtttacctgaatatcacaaggatgactgactacaggaaggaggcacacccttctgtctaccgcaagcagaagttgactgaggaggagaagaaatcgcctcagatatatcaggactgcagccactggtgcctccctggagtacccgactcctggaatgagcttctctacgcacagattatggttaaacagcatcaaatgttgcaccaataaaggcaagtgtgttgaattacttgttcctgtacatgagctgttgtttgtatgagtgaggttaaggattttggtatcctttcatagagagaagtagtcagttagtcacagtctgacagtcgatatacgaccaacacgtattctgtataggctcataggattttatgatgtaaagttcatgtctagctagaattaatcagaaacagagaacaacaatatagcatacatgagatggtatatataggatcctcttccaagaatccctgccatttttgttatctgaccactaccttttacattcttagcatggtgatgtagtatcatttgagttcttcttggatatattaaagtatagagaaatagttgtattgacacctcaatctcttgaatcctgaatgattggtgtttcgttctgtgtatattcgtacttaagttctttgtaagtaagtttgtcaggtaatatgattgtacaacagatttttcagtactactgaagtttcggttaaatctgtcagatgcaagtacggcagctgttatacctgaatatgatagcagtttcaactttgatgagatcctgcataggtactattttgctgcatggttctgttctggtttcaactcagctgttatctctcttgaatattgagaagtaccccctgttaaacagctcatcattaattcatattccaatttaggcctgtaggctgtagcaatatgactatatgagcttctgcacattgctgctagacgagtcacagattcaggtagaagcttcagaatgcgcttctgcacattgctactagacgagttgcaaattcaggtagaagcctcagaagttgctatcgtaaacaacatttgccgtctgaattttttttcgcctttggggggaaaaatgcttgcagttgatgtgaacgtactagttgctacactgtagtctgtagcaaacgttgtttacgctttggttggggacataaatcagaaagcaggctattgtctgctagtggtgttttaccttgattttgcatggaccatgcatctggcattcttgctggtcctttcccttgtcgtatggcatcgtttaatttctcgcctctttaaatagatggtatgaaattaaatacgcattttatttgggtttatacatggatcatgaggacgaaacatacctttttctggctgattggacaatgaattaatgccgataatttactgaagcttttgtttggtatggactatatatatgggtatactgctagtactaccttgcaagcatgtgatcgacgtggtgtctgattaattagcagtctgctgttggtgagtccatttagctagctgggtttttggagcattatgtgctgcctgtactagcctgtacatgcatgccgacagaggacgtgcgcccaggatctagatgtgcgcattctgtcccaaatgcccatcagatggttgcccatcagctgcatatcgattcacagaaccgaaccatctgatggtccatgtctgaaggccatgccgacctgcctcgtagacgcctgtgtgtttatactttctggtgcatgatgtgagtggtctagatctatatgctctgattatgaatacatcgttgtatttgacttttttttaaaaaaaaaacaagaattcaatatttaggttagacacatggaaatatcatatacgatgttattcctatagaaatgagtatggtcgtgatagcataattttgttgtgtatcacaaataactcataaaatagaagttagtggagttcgaccgttgtgttgaatagcatgtatttcagagaagggggcgagtatcatttattccacatcatggataattccacgattatgggcaaccccgcttcatgcaccaggatcctctaacaagattaggcgataaaccgcctacctggaaagaaaagaaaataacattagcaaactattagatagtaaaaaaaatcccattgaaaacgatgttttcgatccctttatacagagagagagaaatcagtgtaaaaaaaagagagagaaaagttgctattgccatccttttctttgcgtgttttggtttctcttaaatcctaatggctattggactattatggaacattttcttttcaaaaaataatatactaactgtgtatacacatcaaagtaactccaatgtaagactgaaattgaaccttgcaccaaaagttccaaccgcgcatattatgagaatctatagtatatcattaataaaattgacttcaaaagagaagtgatcgtaaccaattaaaaatattttttgtggggtcacacaagagggagggcaaatgtaggtaagattgagattgactttatgtgggtcccacaaatcaattttcacgctgccacgatctaaccgaaaatttgtttgcttggatggaccacacatgtcgaaccaatactagagttaccctcataatcataataagtgtgctaggataaagtgttatttaaggaagataatcaaactcacaatcaacgaacagttttaaacgtaaatacggacacgagttaaggctaaccatgtggatataaaaacgcatgcacaaaattgttttatgcaaacatttatttgtaagacatccatcacaccaattcacacacaagtcttctttcagtctttacctcccccatttggaacctcaaacgaagacatgccaactgaaaaccacaaaccatagatctagaaatgtacacctaccttcttttttcccccacatgtattgttcatttgtacgcatagcaatactgtccactagacaaatctcacctgcctctccatcccatctcctatacaacagttctaatgcacatggcgtattgcatgcaaaaacaaacccatcccaccactcacgccatccatccatccatccatccacctctggagtcttgataagtgcacccatctcatctcatctcctactaggccaaagccaaaccaacccaaacccaaaaggccaaaagccaatcaaggcaacaatgcgcaaatatgcaaagtgtaaaaactgcaccaccaatctactcctattgtgcttactggttcccataaataaatgccatccatgaggcataaaaggccaaccaaaaccaaggaaccaacaccccaaagcccccctcctttaatttgcaccctccccaaatctccattgctccctctctctctctctctctctctctctcctccttctccccttctctctctctttctctctcatccatccatgaggatcaggaggcggcctcagtccctgcaggctctctcctccctgcatccctcctcagatccatccactgctccccagcctccaccaagaaaccatggacgttactggctctcggtagacaaggtggatgaggaggagaagaagtcggagcggttgcacttgcacccaaatgcggatcttgccgacgacgactcgtcggcggcgatgcgcgcggccgcggcattgccgttgttcccgcaggtatacactaccccctttgatcccaatctgctccaacgacagagaaaacaagaaacttgccattatgaatgattcttgttactagttactatcatcataggttgcaccacacccgtttatggcggatgcccagatctatctaactaacccccccccccccccatgttcttggattgatgccattttgccaggacaatgcggttgtggaatgcagcaagatcaggccccgtggtggtgcacagcagggagcagcagatggtcacaggaggtatgtgaagaacaactgaaactggaacaggaacaaaacaagaaagtgcctctgctatgctaacttgtgtcatttgtgtcatttgtgtgggtgtgagtgacagtagtagtggtggtagcggtagtggggggtagtaataaatggaaagggaaagcatccaagggactttttctatcttctgggcttggtttttactgttttatactgggcaatgccagcttgacacatgacacacatcaatccaaccaatttaatacacggccctgctcatgtaggcatgtactactgctactagtgttcttggcttctttactgctaatccatccagcgcactactgctcttgcaccctcgatcttggcatcttcgatcggccacttccatggctgttctatggctgattgtgtgatcgcctctcttacagcctgttttttgcttgtcctcttccatgatcgcattggtgcaaccgtgcaagccatgctgatcgatcggcagacatggaccatgtgcgtcgcgagcgtcgtgaactattcccttgtgtttggcatcataagttgctgcatctctgattgcattgggttggattcattgctgtagctgcttgttcgtcagatggttgacagatgactcgatgatgttcttgcattttgcagcctagagaatggccattacagcaagcctgatccggcgatcaggagtactacaggagagcgtctcgtcaacggcgtcgtccgggcaatgccagtggccgcgaacgcgaaggaagagaccaagaacgacggcggcggcggcggcggagccaagaagcggcgtggcccggcggtgctgatggaggggtcacgttgcagccgcgtgaacgggcgcgggtggcgctgcagccagccgacgctggtcggctactccctctgcgagcaccacctcggcaagggccggatgcggagcgtcaccggcggccgcggcggcgccggccagctcggccgcaccgagccgaggaagaacaccgccgccgccgctgtcgccgcggcgcccaaggcggcggcggcggtggctgagccgccggtcgtgcggccatgctagacgacgcgagatcgatcgatcggttcaactgcaagattcttttgttctatggtgatggtggtgcatatcaggtggtggtggtggtgaatcatgaatgtgaattccatgttccgttttctgtgaattgcaaattccatggcgtcttcgtggaagaactggaagatcacactgcagatgatctgctcttgaccagaatttcccgtgatagattccattgatccccttgcattcccaggatccaaaaccatgcaaaaccgttgtgcactctcgccgggtgcaatgcaaccgcattgatctcactgttcctcatcgatcacccacacgcaaaaaagccacaaaaaaaattcgtgaagtcagaatgcatttagtttgcgtcgtgcaatcgtctccgatccgacatccatggacgtactacagccacacggatcgatcgagcaattacttgcgtcaaaattatcacctggaaagcggaagcaacattccggataaagcctgacgcgacgcaaggctgcctgtccgggacagacaggggaaggatgtcagtgtcaaggcagtacttagccacttaagtactcacagtacattgatcataacctcttctactactgcctccgtcccgaaacaagtgcagccataagtttctgcgtccaactttgattgtccgtcttatttgaaatttttttataattagtatttttattgttatgagatgatacaacatgaatggtactttactcgtgacttatttttttttcaaaaaattttcaaataagacgagcggtcaaagttgggcacgaaaaaccatggctgcatttattttgggagggagggagtaactaacaacatgctctagtctaccaatgtttctaggctcatcaaagcacgctcgccatagcataggattcgtacaaaccgtcttcacattaacgctcacacacacagacacagtgtagggcagcttgtgcatgatcacgagaggcacaaaacgaacacaggagatcaagaagaagaaaaaagaaaatttaaaaaattggccagggcaaaaaaatgatgtgtctgttagatgcttttggatggtagcacgtagaggagatccggatgagctagcagatctcaaagctgcatgtggaggggaagctagctagccactgtagtagagctcgatcgcccagttgcctcttcttgcatggcttctagctggaggcagcaatggaacaactagccagagagagtgcatgagatcgttgcttgggacaaaaaaaccgtgtcagaatggacttggagtgtggggaacctaccttattatcttagcttcatgcatgtgattaatcggtgattatgtcttaatggaaggaaatgcactctgatccgttcgattttgcaggggaattatctgtgccgttgatttcaagggtcaatccctagataggacaatatggtcaggcactggtgggtcgactgggctcgtctgggagtgaacagtaaaaatatagcattaatttagagattgaaagtgtaacattttatagcaaacgtagtagagatagatttgtcttgactccaaaattttcaggaaagcatcattagattgttatgattgtgaggcaacatccagtaaatcattcatttaatttttttttgagcttgccattgtgtgtactacttgttcaaatgacaattcaacttgatgaaataaaattgagacccctatggaacatagaaatggtaaaataagggattttagtaggaataatacacaataaaatactaaaaacacataagaaacatagaaacggtcttttaaatagatggacagacgatgcaaataaaaatagagttagatgagagagaaagactgaaagaaaatttctctagaagtctacatgaaccattccaaatgacttttataggatttcaaaagcttcaaatatctgttttaaagagccaaacaggaaattttcttataggcacaatactttgtttcaaagtcaaagaaggcctgactgtgaagctcacccagtgaccaagccaactgacacatggttaggtcactgcaaagctaagcaaaaaaatatctccacattgctatcccagaaaggtccttttaggataggataacgcatttctcgtcttcacaaacgtacgtacggtctcactcactcactcgcaccaccggacctcacctgccgcggccatggagttgctgctcctcccttctcgaggcgccgccacacgcccgcttcaccaaccgagccggcgacgcgtcgccggcgtgttcaccgcccggccggcggcggtggcaagctccagcaacgtcgaggtcatcgacaccaccgctgcggcggcggcgaggggggacgtcgccaagaaccgccaagaatggcgcgcggcgggcgggctcgggctcgggctcaacctgtcggaggacatgaggcgcgggatgatgtggcggatgctggcgccacccgcggcggcggtcgcggcggaggccgcgttcctgagggtgcttgacggcgcggcgagcgacgcggcgccggcctgggccggctccgcgggctccgccgtgctgttcgccgtggggctgctcggtttccactacgggttcctgtcgtcgaggtggaacgccgcggagaggggctcgctggtggggtgggagctcgccgctagccactggagcgaactgtccatggccaagcattcctccatagacgacgaagtggacgacgacgaggacgaggaggaggaagacgaagatgaggaagaagtagaagatgaagacactgactaattaactcgatttcacagcactttgttcgattaaaccatgaaatactcagtaaagtggtttaagacttgtagtcagatatatatattcagattaatagagattgtagttgtacatgaccgttttatgctaaaagaacattcaactcgcagctgagggctcctttggaacgctgaaacgttacaaaaatcttcacacgagttagttcgtttctaaaatgttcgtaaaattcctctttcccataggtcatttcggatactatcttaacatcaccacacgactctaagtgttaatcaactggaccgaagaacatgacaaacatacttacatggtactcctaattaagatcgtgcacgtctggtgacccgtggcgtgctgcacttgtgagcggtgagcccccgcctaatcattcaagaacctcgtcgacgccggcgtcgccgatgaggcgaccgtgttcggcggcgaggagggcgagttcctgcgggcactcatcgacgcggacacgcgtcgttcctggtcgggacgctgctggtggcggacgcgtcgatcagcgacgaggcgtgggtcgggcggcgggagcgcgacggggagctcgcgttcctcgagtcggaggaggaggtgctgtggcggtggacggcgcggcgcgggtgccggcgaggcggcgctgcgcgcggcggccgcggtgaccggactcgacctgcagcctccgctctgggtggcgttcctgctcttcggcctcctcctcggcgtcccgtacggcgtgttctcggcgagcttcgatccggcggtggagggatcgatcgtggctcggctgggaggagttcgtgcacacaacattcgccacgtcgtgctccgcgccgccgccgccggcgacggccatgtctacgatcaccgcgacaagtagaaagattgttactacatacgtattccaatccagcaaactgtgaatctgtgattgctcagcctaactgtttagtggtatcatcagttgatgagctgttgtgagttgtgactcgatagtgatgttctttttgtgaaaattagtagggtttttggttgcttttcgggtgtccatgaatcatgacccttgttgttaattgagagctgcaatgctgagaaaaaaaatgcactagtgctagcgtgcaatagggtatacactgttatctcacaagctgagtaacttgtgtagcaacggacaagcatctctaacctgatccaggtgctgaggtgcagggtcaccagtttgcacagctaccagcatgtaggcgagcagggatgcaggcaatgcttcaagccaagaatgaaacagtggttcatgaaaatacagtactcctttatttcaaaatatatgatattattgatttttcacataacgtttgaccattcatctgattaaaaatatatataaatattatttattttgttgtaacttattttatcatcaaataaaacataatcttaacttatacttttacatacttatattaaattttttaatgagacaaatggttaaacgttgtatgcaaagtcaatgtatcatacattttgaaaagaaggtagtatctgatttagttcatccagtctagtctctgtcgctacgagattaatagaagggaaaatatgcagctagtgaaaaatccgtatgcgagggagctagttagagatgtaccatgcgcgacccgttgcttaatggcatggcattgtgtatatacaaccgtctgaatacgaccagttgcatattatactcctaaaactctagtcgtagtggtgaggggtgaattcgtcaccacgcacaactgacatgtggggactagaaattgatgaatctgtcatcacttacttccactatcagctgacatgtcgatgccactaataaacagtgaagcacgcagaatattcattcccaagctatgaaaaagaacaaaagaatatattcaacctccttgcaatgtatgggtatttagctagtactatacatgaagggtttgccgcgcatgcatcaattcatgactataccttgaatagttgaatacgaatacgttagcgtttccaaaacgttcctacctccgatccaatacaaactttatccgcgtttccaaaacgttcctacctccgatccaatacaaactttatcctagttcccgtatactccattcgttccaacatataatacgtactatgatatatcacattaatcaaagtatcttatattttggatggaggaaatatacatacacgagagccacaccaagcttaactgtaaggccctgttcttttttccaataaaaactagataaactttttgataaaagtgatatactttttaaactgctaaacggttcgtttcgtgcgaaaactttctatacgaaagttgttctaaaacatgaaattaatccattttttaagtttgtaataattaaaattcaattaatcatatgttattaccacatcgttttgcgtgaaacaattaatatttatgttcatcttcatcttaagtagattcaaacaccaccttaatgtgagcatatatatggaggcgacacagttactggaagctccggtggtggattcagagaatcgtttcgttggtgtcataacgtgtctatcggtatcataggatgctaattatgcttagattatagtgttataacatatggataaacaatttcgctatatgttttgtcgaaagtcatcggtgtcacctgataccagcccttctactttggatccgccccttcagctcccgttgggcagtgcccgcgcccgtgcggcacgttgcgtaaagggagaagggtgttggagatgaagcgggacatgtacacgggacaccatgtacgcgtgcagaatcatggtttacaaccggttcggcgtgtggtcaccgcgacaccaggggtacctcaagttcgccaggctcggcggggcgatctctcgatcctgaaccagaaatttggaggcgctgatagagcagcacgggctgtttgcttgggacgagtacaatgcacggcaaggtggagttgttggctgcgcgtgagtagctgcagcgccagcggctttttttctccgccgcgcgcccgcccgctcggcttgtgattgcgaggagggaagagatgcggcgagccaagcgacagtgtgagcgggacccccggcgtctggtgtcgttgaagaagaaacttcgggctcccaggcaggcccaaccgcagcatccgtccccggcccgtttgcttgcacactttttactgtttctttttcctttttttattgagagagttgtgctcggatgagtttaggctgtcttcggctcttctttttcgcgggcaagcttccccaaactgctaaaacggtatatattttttatataaacattctatagaagaaatgttttaaaaaatcatactaacttatttttaaagtttttttaagttaatacttaattaatcgtgcactaattggttcctaatccttaccccagaacacagcggtttgaggtcgtttcaaaagccaaacgtacgcgtgaaaaaaaaagaaagagaaaagcaaatgcacaattttggtagggaagcaaaactaaaaatgaccctacgatcagtgtgcagcagggcatatcgtaccgttaatctgctccaccgacgacgggaacggcgaaccgacggcctcccaccccgccgcgacgagagcttatccatgagacaagcgtctttaacgcaacagcttgccgagccctgatccagttgcaggcaaccaacaaactaacacaattgcttagcagatacgcaggcaagatttcaggccaagaatgaaacagttattagtgaaaaactagccgtcattatatacatgagatgtagttcctccagtttggtactctagctaccagatctaattgtggggcaaaaaaaaaattatgtagctcacatagaatacattctgccaagtaagatagccacaaggatgtcagggctctagcgcataaaaatgtgaccaaacgttagcaccttgtcgatccaaatcatacccgcccatgctgacgagcatcacattcacgcgcgccacgttccaatgcagaattataagattgatcgttcaacttcgacatcccagctcgcttcaatcgcctattccgatacctccatgcgacttgaatacgcgttgcagcaatggttctccagtagggtgactcatacctgttggatgcagttgcaacagtagcgcaccagcattagtgaacattgtcatacatatcatagaagatagatattcggcaactgacacaactgaatgcatgacctgcatggagcagagtaccgtagtagtttctaattatcccaaatatcccagctaataacaattactgtgatgcatgatgaactcccttagttttttcccaactaacttatggtaaaattaatttaaatcaacagataaaccattcataagcctacacaattctagttgaatcagagaattattctggtgagcatatatgatcatgtgacactaaagaaaaaagtctccacctgattgcaccctgcactcgtggattgcgcaagaatcgtgaaaattgtgaagttacttcttcgagatcgcttgcccttagtacaaaagcttcaacatttgttaaacatcttacagtacgaatagcaaccaaacgcataccatggaatctcattctcccaccatctgaaacaatagaaatatggagacttaccaaatataaatcacagaaaagagaaaacaataaaaacacaaaatgcaaaaactgcagacctctgttagctgaagagtgttccaagtaccatgtcaggagctcctctccacatacatcaccttcatgtaacggagctttgcttccatctgcactgatgctttctagctttcccctcactatgaagaccattttttcaactggaccaccttgataaaggatgtcacttccgctaatatacaagttttgtcttagtttgtcacatatagcgtccaagataggccaatccatcaatgtgaataatcggacctgcaaaataattgtagtcagcatttccttgaaaattgtaggggtaaatcatcagcaacctcaaattttaaatgcatcatgagcatggaaagtaaaaatgtgatagagtaactagttgcagtgcttgctctcccagaacagtcagagtcctcatataaacaaaccttgttaagaaatctaaagaaatgacggcgtatgtccctttgaatatcttctggtaaattacttaaaagctcctcttcattcaccccttgggtagctgcccaggtgaacctttctgcgcgtctaaccctcctggacattcataaaactattaagtattacaatcttccagtccaaaaataaagaggaaatcatttgcttgccaactccaacaaatgtaaaagttcatgttctgcctggggaagtttgtgttctttgcccattataggaatactccagatttaccattccctccctctccaacaaatctttaacttctggtatgattaagattgtggagatgaagaagagaatgcaaagaggaaaagcctatttcgaacatttcacaaactgacactcatttttcttaaagacgacagaatacactgagtagcgattgttggttagttgcacatttagagtggcaaatactcaatatcaatccttggtgtcaaagaaaagataaaattgcacccttttgggcgagttaaaaattgatttccgcacaaataaactagttcgaaataatgatcctaaaagaatgtagcaaaccaaaattcaggtatctcattgacattgccatgagactgttgtgcatcttctgcatatggaaacttggtaactaaattgacaaatttcaatatcaaacaaatgatgtttccactaaatctgtttcctcaaaatatatcatgcattcgttttacccacaaaacaaaatgagatctgtaacacagatcatagcttgcatgagattccacttataagatgatttatcaagaaaagcagcctgataactgttgaatatgtacacgtttttcttcttctgaataataggagccacataaacaataaaaagtaagacaaagcaaaaaaaacaacaacatattaatagtctgaattaataaatggttgcgatttgcaacaagattaaggaatatatgatgttattttttaaagaaaagattagtaaaattttgtttagaagttatgtagatgaaccttcttaaatcttctggcaggcgtctatggctcatccactgttcaacatcacgcctcctaagttgcatttctagtctcctatccaaaaaaagaagaagagagaatcaggactagatattttttctgttagctggtacagcttatatctatatagaggtgtcaattcctgatgtgtattaacacaacaattagaggtccatctcaggattgtaaggtagacaatattgcacaataaacactagcaaattttgcatgtataaccacgtaccgtcttccaagagcttggagaaaattttgcatgttcccaataagtaatgcgaaaagcaacagccccaaaccaataatagccatagtaaacaggacttcccatgcaaaataacttgggacaagattaccagctagcgtacttatttgctgacgtcaaaccaaaataacatcagtaaagggtagtcaaaattgtacagtgttagcatggatgctgtaatcacgtatagaaaccttatacatcaaatggaacaaatgagacacaacttaagtacaagaatataaggaacaaaagtcaaatacctggaaaccccaaaataatgaatatatataacgtttaacagcattgtcctctgtagttagcaaaacagcctgttcataaatcccatagtggaaaccgttgtctccagtgtcgaaacaagctgttgaggctgaatcattaaaccactgctgtctgcttagttgattctgcttcccaatattaatgccacgtccacaatctataaaaccatcacaagatggaatttttgatgcagaacaagcattccgtaggcattggttgaccctctgtcaaatgaaaataaaaggaataataacatcatgaacctctactttagttaacatctcctgagtagcttgatatgatcaagtcctctattaaaaataccaaaggagtcgtgaacaacttaaaaggagcaggtgaatatagcaatttacaatcaccccttttaacacaaggaaatcaaatgtgcatcgttgtaacaatagaggttgtacagctcttagcctccatggcagctgtatctgttgtactagtttgaacctcttctcaatcttaataaactttggccgcgtatcttacgccggcccggcgaaaaacacaaggaaatcagcatgtatacaataaaatgcaatctaaatgaaaacaacaaattaaacagaagatatgttttctccgtatcaataataaagcaataataaagcacacattgtcatggcatagttctccaaatataaggaaacaattaataatatgacattcaatttgttggaatttgtaaaatgccactcgagtcagtgttgcatccataaaatgcatttcttaatttaattccttgttctttgccgattacgagccatatgaaaagaaaagcatgcctaccccactgtctatcaccatttctcttcatcccaaaaatccaacagtttccaaacaattgctctccacctctggtggcctagactctgacaggctccatcagccattgagttataaaacccctctagtctgcaaccaattctgagacctctgacatggctggccacaacagtagcgaggtgaatttttcagattttggtccttttgaaaaacttatttcgcaaatagacccttggaaaaacttatcccagaaatggtccttcttggggcgccagagtggctggcgccgtccccctgccgacgtggcggggcgatgctgaggtagctagggggagcgcgccagagtggctggcgcccccccccccccccaatttttttatttttcttttatttttttgatatttttttttcacgcttagggacacataagaacccaccatagaaaaaatgaactcaaatggacgtaatatgtgacctgtagaatttttcctctcctctcctctctctccgaactagtgcagaggagagagatgtgcaacttttttatttttattttatttttctgatatttttttcacacttaggaactcacaagaaccaaccatataaaaaatgaactcaaatggacaaaatatgtggcctatggaattttccaaagctctaccgagaaacttctctcctcgaaaacacaatcttgcaagcggaatttggaggttttaatatcgccgaacccggcgaagctggggagaatcggatgtaacattttctgtagatgtccatggatatattatttgcctgattccgagtccgtatgagaaaattacgcctattttaataaatgacattttgtccgtttcggtagagttttggaaaattctacaagtcacattttgtccgtttgagtttattttttatatggttggttcctatgttctcctaagtgtgaaaaaaatatcaaaaaaatgaaataaaaattaaaaaattgcatctctctgtactgtttaacttatggctatcatttcatgtggttatattttgaattagattaagtaatttcatatagtgatagagtgcattatgtataacatgctgatcaaagggttttactaaatgagctatggtctaattttagtgaaggtgcaaagtagactaagtggtatgctagctattttcagacttagctaagtggtagttcgagtttaaatttggttgtatcgtgatcctaagtgtgaaaaaacatccgaaaaaataaaacaaaattgacaccgttgcaactccatacagagaaataggaatggaggtgaggggtgggggggggggtgtggcgcccccctccctcgggcgctcctgccacgtcggttcgcgtgtgccacggtggcaggaggacggcgccagagaggctggcgccgtcccgttggatgacggcgccagccactctgacgccccaaaaaggaccatttctgggataagttttttcaggggtctatttgcgaaataagtttttcaaaaggaccaaaatgtgaaaaatccaggcgagtgatgacgatgaagcttgagcaggttgagatagcactacaagtcaaccattgcaatgtgtgtgatgacgatgaagcttgagcaggtggcaacaatgatgagggagagggaacagtcgtactgctgctctttgtgagggggtaaaggagaatggagaaataagaagacaaagggagggcatactggtaagtttcaatatttgagtggatgcaaaggttgatttgagtggtttccctatttcaacatttaagtgacactatcaatttccccagatgaaaaactactggttcaacatgaataaacacaatatttttgtgcagaaaactgaaatagaagctgaactaacctgcaatccaaataggtaccaacatgaaccaacaacatgtcccgccaaaacaaacattagaaggttaatcacaaagttagcccacgctgactcgaatatgaatccattggcagatgagtcagactgaccaccaagcaatggtacaaatctgatgatgcggggaacatactgaagaagaacagtgatacgcagtaaattcttagcatagtttgcagttgataacccaacatatttagggatgaccagcaatatcatcacctttatcaaggaacagaagacaaaaaaaaagtattagccaataagatataaaaaggtgtaaattgtttcgatgaatatcctttattaatagggttagaaaaaaatgcaattctgatttacataagcaactggggcaataaatagataaagggcatcagtgcaatcagatcaaatgatgctcatactgacaatattgatggcaaacagaacagaaagtaacaaagaattgccagcctagctaaggtgttcctctgcatgatcaatttcatgagactcatcctcaatctgctaaggtcacaagtatggaataatcaattagtcattatcatgcccaagatccatagtattttcaatgctaaacagcaacttctttttgacttcttgtcaatttctagttggcttaaatacattggcaaatactctgagaccaacaagaaactaccaaaataaacctgaaaggttcaatagcatatattttcaacggggacttgaaccaatactccttagatgaagcttatgtattttaaagtacatcaatagtggagatcacaagtttatagcttaaaaggataatgtggtctattgtgcacgtgaagagaactgaaagaaatgctcttgatctgttcatgataggtccataacactagctacatagggcaatgaatttgctgtgtgcatgaaaaagatgaacatggatcactagcacttgccaatcgcaagcattcagttgtggccaccggtccacaaagccatggcagatgcaaagtaataagccaagcaaacaagaaaagcaattttcaacagctggatggatagctgggacctcctaactcctatgctgcttgtgccaggtctccaacatactctccaggatgtatagtgcgttcccagtagctaactcttttatttgtttgacctaccctaaaaaataattatcataaccctaagaacaagtttgccttctgctaccgacttgaagaggagtaccaaagcaatataaaaatataaatagaatgataaaggaaaacttcagcctagataataagtcatccatcagggataaagaagaaaaatgaagcttaatgtcaaaatttagccacatcaactcagaaggataaaacaagttacctgagggagtggaagcacaacgaagaagtcgagtaaaaaatatccacgaagataacggacagcaattttctttggctcgtctactaaatctccagctcccactactcgcgattctggagctacataagccagtctgaactgaaagagaaatgcaaaaaataaaacggtcaaaagttgataatatgttttcttggggttaaaactggacaggaacaaatagatgcaaaataaaataaaatacaagatatgataaatcaaactaaaacatgataccagaatggagtcaaagcatgacaaaccattacaattaacaaacaaagggtaaaaagatatcacaactatttgatcatggagatatgataaatcatccgctgaagatcaaacaatgcattactgttagttactaaaacatgataccaggacacaagaatattgaacctgagcggctgagccttttctcacatattgtcaacagataaaaagtgcaagttatactcacaaaaaaccagtatctaatttggcatttttagaagaaaactactgatcactcaacaaatatacttgtcctaatatgcataccaaagaaccaaaatataatcaaactgccttccatctgatgccttagtgaccatgttatttatgaaagaattttataaaatgtggaaccataccctatcatggaacatgaattatagaaccttctatagaatagcaaaagcaatgatgtactgacctgaagaagcatgtgtagaaaataaatagcatcagtcacgcttctcacaactgcaagtgctgtagcaaaatgccagttcaacacaatgcacttgttatcctgcataaaaaaaaagggaacaaaagtaagtgcaggtcagctttgatcttcggagtatctgagattttcggaatttccgaaaagcactgcttctgcatctacttaaaagttttaatcgcctattccttcccccctccccttttaggcttatttgaccctttcaatccattacacaagatatcaacacttagaacagttaaccgataggagaatagaatgctgcaacaggagtaagaaaaattacacaagattagctcacaaactcacaaacaaggtgcaacaacaaatgaagtgtacaagaaagttgtaggcttttgacagatggatatgaactagcatcttcaagtgaactagttaccttttgaactgataataggaagaaaaatagtgggtcaatgaatatggcaaccaggcatgatatcacaaagaactgattccattgctgaacaacttttgcatgtgggttcataactggaatgcgtgaaaggaaacgctcaatttccttcttccatccaccaccatgctcacaaagaaaattatggaacttcaagagagcaaaagaaaacagattagattattcaatacaacaataccacagtcagtaactttaagcgctcttaagaagtgctttgatcattatgttgaagaaatctaactagacaaaaaaaaaactaagaaccaaggtactaaatagcattcacaatggccacaattgcagccgcaataacaatagcggggtacttccgctacagcgctacctccagcaatattggctgttattttccattgaagattgaaatagaaattttgatgcttaaaattgagttatctgtagccaaatgttgattgcttactaggagatttttatataagaagaagataaatatcaactaatattacctctcatctatgtagaggtgcattctatactctgtttttttttttttgccttttatcttttatgtttcttttagacttgtgttctctactttataattcagaagtactaggcttctcgaatccagatcacttatgatgattgtgaagtatgtatcaatactatgctattttactagaaaaatgttgcgcaatccagccacaactatcaggttcagataaaatcatatagttttaatgttttgtgcattcctacaaaaagagggaagtaagaccaccttactgtccaatgtacttgatcctctgtgaaaatgccttttgtttttacaagcaggagggcagttgacacaatcaggatcgtcacattgtcccaaaggtccagacatcatcaaatgttcattctttggaacattcccactataagaccacctgtttcctccaatttcttctggcattatcgcatgtggcttgttgacttgttttccttgtggaggtcgaggaggcatatctggtgtatttgtaaatggaatgcccgctgctgcagtttgtgttggtggctgaacaaacagaggaccagtatggggtacaaatgtgtcttcttcgtattcatcatccctaactggtatgcacattgatgtacttctaggaggaaacgttggtagctcaacatttcttagtagcataggaatatcatctctctcctggtcagacatttcttaaccctgaaatcaacatccattgtaatagaaaatcaagttcaatgacacaagcaagaaagtttgcatacttttgtataaaagaacattatctatcttcagagagtaacgactccaatcaatatcaatactcatgttggaattatatttgtagcacaatgtcagcataacaataacgaaaattttcagaacattttcaggaatgtaaaaacacattactgaatgccagtgtttgaaacaaccaccttagatagaaatataaagttattaacctataatggccactagaatgatacagcatgaaaatacactctgcggtagagaatccacatgtagattggccaaacaaaatcagcccctgttgtgtcagtaacctgctgcatatctaacaatggtgacaagcctatcacaatcaagtgttcacctgattaggtccccaacttacagaaccaattacatctgtaggagtcccccaaagaacagagaacctgaaatgagataaagacattttgcacttgttatagaagggaaacctatagcattactgaatacggactgctgaattggaactaagaagtgcaaaccaataaagacagcaaatacagctgcaacaactttaagactagttgtgtccaatactccaatgtatgagatgaacgaagagagaaaataactaataaatagtttaatataaaaaggggtatatatcacttgaacttgcacattgtgatatataccaatagaaagcctttggttctctcaaaataccactgaaatagtgtgctcttcctcaatctgaatctaccgttctcctctgatggaggttcgattgacccttgaagattgaagccaagcagccagggcaggcgtgtggtagcctccagggcatcgtcagtgccctccttaagcagcttgagcaatggcggcacctggctgcagcgagcaagctacactaggttggcggtggagtcatctaatcaagggaaaaacattggttcattcatcctcgccgccgccactcatttgctacacccccattgcttcagtggaatcatctatcttatcatcaaaatcaccaaacaccagcaaaacattgcacttcaccaaatctaacacccagattcgcatacaaaaaaaacaattcaattacttccaggaaaaccacgaactcatcggcttccaaatcaaagtaggactcgaagcaacgaggcggcgacctcagggaagacagacggcggcgggaggtggctaccctggctgaacgcgagggcacgcaccgccgccaacaaaaaaaaatcccataaaaatcgcctctccgactcctctggaagcatcaaacccctactcccccactctaccacatcgccgcggaaaagcgcagaaaaaaatgaacaaaaaaatgaagagaaatcgaactaacccgacgtgttcttcttcttcctcctcgagacgtcgggagattgcaccgatcaacagcggccaaccacaatcgctttcagaacttgtgcgcgatttggacactggagcgagatagcgaactatttttttttccacttctcctttcctttttcttttctttttgatttttaatcccttcctcttgtggcttccacgccaaggaccaggaggagagaaagcgagtggacacgggggcaaagagtcaaaacgacgtctccttttctctcactgacacggggcacgtgaggaggggcccgctgctcagtagatggcgcgtggggcccaccaggcaccaggtgggttttggactgtagctgctgccccgacgcgctgctcgctgccccactctctccccattcccctccacgccgccgccgccgccgccgcgtggatggccggagtttccgccgcctccgccgccgggaagatcgggagcttcctctccaagaggccgtacgcgccgccgtcctgggcctcgcacctgtcccccgccccctcgcagaccttctcgctcggccatgtgagtttgtttccctaagtccaccgcttgatcgttgatcctaacggccgcacttgttcttatcggtggattcgattcgaagtagttttgaattgattaggaggatcgattccgggaaactcacggtttaatttctaattgaaacagttcccgacgccgatccacaagtggaatctgcccaatttgccgaatggcacggaggtgtggatcaaggttagagataagcaacagtttgctgtatcaatgaatagatatgattcagccccgcaaaaaaagaaagaagaaaagaattgatatgattcagggaatatgttccatttactctatcaatgaatagatatatgattcagggtagagtagtttgtttatggagtttggcttctgacacgagagtttgggggaaattgcagcgagacgacatctcaggcatgcagttgagcgggaacaaggtccggaagctcgagttcctgatggcagatgccgtcgcgcagggcgctgactgcgttataactgtaggtggcatccagagcaatcactgccgtgccaccgcagtggctgcaaagtatataaatcttgattgttatctgatactgcgcacatccaaggtgatctttgtacttatgacttatgaggttattaaatcattaaattgatatgatatcgtgtggtagcatatttgggctaacctagttttggtggggcatgttcacattcagcttcttgtggataaggaccctggtttggttgggaatctccttgttgagagattggtgggagcgcatattgatcttgtttcaaaagaagaatatggaaaaattggcagtgtggtatgctcttttcgatgatgtgctattattgcttttattattattttcataattccatcgggccatgtgtagcaaaggaactttttatattttggtgttatactgatacttgatatccatactcaagtagttattaaaggggctaaaggtccaatcaagtaatgcatcctgcagtatatgtctgcatcatacaattagcatggtcattttttccctattctgaggaaagatcatgattatattgcctattctttgaatatgtatgtagataaactggtaaagtggcattgcctattaaaatatctgagtgatctttttcttgttagaacttctttattcatattgatattgcttaaaagtccctaagcctagtatggatttatttggttcaggctttagcggacttgctgaaaaagaagcttttggaagaaggccgaaaaccatatgttattcctgttggtggatcaaactctctaggaacttggtattgttttctgttcaatcctaactattgaaccatttttgcattttcaatttctttgtgcgtttatagcatactttgaatattcctcagggactattattattcatggattggtgtttgccatcagtctatcagaaaagaagagattagtttgtatttgaataaacattagggcatcacttttttttggcaaatttctattggtcaatatactatgttggacctggaatgttggaattgtctaaggccctaggctctgaatctagtggatctcatgcaacactagaagatccggttctatcttgtgtggtggctaacaagtggagcatagctgaaggacaaatgtagtgtattctatccacatttaatcaacaacattgaatagaatataagattactgtaaagagaaggtttgcacttcaaagttcaaacaggtctcagaatttgtgaaagtgatacccgattgttgaaacttgacctatctttgtaacttgtattgtttcctttttctttttgtaaatcagaacttgttttgtttcttgataggggatatatagaagcaataagggagattgaacatcaaattcagatatcaggtgatgttcagtttgacgacattgttgttgcatgtggcaggtattttgtcaatacgcaccattctttacttttaaggggtacttatgtactcacttgttattgcgtcatgcctagttcctgaaagtagcaattgctgctttatgacttgaatgatttttaaatttatgcagcggtggaaccattgctggtcttgctttaggatcaaaattgagtagcttaaaggcaaaagtatgcactttctttgattgttttctatcctgctgaaattgttcgactaattatccatttttaggataggtccatgctttctctgtttgtgatgatcctggatatttccattcctatgttcaagacctgattgatggacttcattctgatttgcgttcacatgatttagtcaacattgaaaatgtaagtacatttttaaagttctatatttgatatttaaatggtattgaagagtggacttacatcctctaattatgacattgttatgcgcgtatcagtatataacataattgttctgaaactagtttattcatttcattgttccaattttatggtgcaactctaattgatgatatttcctgctaatgtgcattggtagaattttgtgaacatttgacttgattacctgcaactgccgcttcacaggctaagggcttaggttatgccatgaacacagctgaggagcttaagtttgttaaagatatagctacagcaacaggcattgtccttgatccagtctacaggtacaatatattccttttgttgaaacattaatcccaagaaacaccttttgcatgtaactctaattttacaaccagtatacttgccatttgtcgaaaagtataaaaagttttgttctgttagactaatattgaaggtcatcacaagttcatgatagactggccatatcattgcctaaagatatatgcttcatatttctgcagtggaaaggcagcatatggaatgctgaaagacatgggtgctaatccagctaagtgggaagggcgaaaaattctttttgtacatacaggtggtcttcttggtttgtatgataaggttgatgagttatcatctttgagtgggagttggcgcagaatggatcttgaagaatctgttccacgcaaagatggaactggtaagatgttctgattgctatgctccaaaattgcttccattgttgttagaggtttcagacatctcattgtctaaaaagagtattcgcctcaatttgtacgacaaaattcaaagcagatggttaatgtaaaacactgtttgttatatttaaagaataaagcatatatttctgccatttggaaataaaggtttatatacatttgatgtactgccaggcaccttttctattatctttgcttatgtaagattgttttattttataaaaaagaaaatcagatatgccatttctgttacaaagacctgcctaagcaaaaaactgttcttagggcccctgtcgtatacataaagcaagcacaccattggcaatctttaacattcaccattaaacagtagtaatgaactatacataggaagtaacagaaggaaatacaccgaagattcaacttaataacattccaatagcatggaaaagctaagtgcaggagccagagaccaatccttgcaatggcaccaactcagatgaaggttctctgctaaaagatggatgaacagcaaaacaagcccagcattccaatttccagcagtcccatgtagcatagaatcaggcatttgacacggttggtgcacgcaccacagtaaccgggcaggttgcattgttgacaacatagttgctaacacttccaagtagggccctgcattgaggtaaaaaccattgattcacacgcaatttaactgagaagaggtttagatcaaagaatgaaaaaggtttaaatgctaaccttttcaagggtcctagtcccctgcaaccaagaacaaaggtattcaccttgagatcgtctactgcctcacagagtttctcccttgcatcaccccagtaaacttttgccagtacttcaacctgatccagccaatatggaatcagtgttttgctttgaattacatttggatcaacgtttctttttagtttgattacatttgaatcaaccttcccttctagtttttacagtcccatcacaggtaattcatgaagaattcagagaaggctgcagaatcattacctgcttggacttggattcagcttgcaggatctccagtacctccttatcggggttgatcccatacctcgcctgcacgttcatctccataaactccagcagaggaatcaaagctacacaaagtcaaaaaccaacggtaaatcagatgcaaaacctgtcaatcttttctgaaccagaatttgctgaacaagagaagaaactgaaaaggcaaaagaaaaaaaaaatgcaatgcccctacatacgtgagccggtgctcttccagagctccttgtggctggcatctgctcctttgggaaggacatggacgaggatgatccggtcgccggccttcaccaggttatccaccgcccacttcgccgcggccttgctcgacggcgagtagtccatgccgagcccaatggttcgcttctcagccgccatggcaatgggtaaacgaaggtggtgaagctgtcgaagtaaacacctaaagaaaagagaggtatttgtggtgctatctctgggttaggcttgtagcacaagtactcctatttaaggacgtcgttgaacagcaacagaaatagggtgacatatcgcctgttgatagcgaacttgtagactaggttgcctttattccttgtgcaaactgccttttctcctttacatggccgatcggccgttcgccagataggcagccatgatggtgcttctctctccagaaggctctttaatcatctggaaagacgaagaatattttcgtccaagctcagtacaagtatggctttgatctgtggcccagtgtcaattgcgttaattaggagccaataatgtttccaggtctcaattctgacgcagtttcttgttttcctggccaatgacatggaaacaagtacggttccagaacatagagatatttcacttgcctagcagctgtagggggtgtttagatgagaggtgtaaagttttagcatgtcacatcgggtattatatagggtgtcacatgtagtgttcaagcactaataaaaaaacgaattacagaatccgtcagtaaatagcgagatgaatttattaaccctaattaatatattattagtaaatgtttactgtagcactacattatcaaatcatggagcgattagacttaaaagattcgtctcgcaaattagtcgcaatctgtataattaattttttttctatatttaatactttataaaggtgttcaaacgctcaatgcaatagggtgcaaaatttttgttagggaactataaacaggccgtaatttactagtactatgttttgttcattcgtattgagaactggtccatccaagtttatttgtagttgaagattgcaaggttggcacaaaaaaaggtccaaaaccatgggcatgttggcggtttacaaaacgggagcggaatcgtatgctcaaattttattcttcttcacagctataggccctggatggaaacgctcaatgcctctcaatacaataatcccaacaaattattatgcacatatgcttcggtcaacttcagttgaaaagcccctacgtacattcctagtttcctacttttcttcatattaaaataaacaaaaacataatatttgatagaacagatttatagtattaagatatattatatattatttataatattaagagtaatagatttgtttattttagaacagatcgagagtacgctactgcaaaccaactgtgcttgtgaacttctttgatcggtggcgtagcagaccaacagcgaccgacgagctgggccgcgcgagacaaagccctaccactaggcccaagggatggcgaccttcatggttttgggcccgcgcagcccatcaaatcatcagagtctatccgggccatttcgcaacccgtggctgtgtctgaattcttcttagatgaaagattcaatcaacaggacgacgaacagcacactttatgtaacagtagaagcaacccagggaatacgcaatgcttttctttttacatggcatagatcgatgaagttccaaaccattcacttaatccgattaattacgcgcattctaatcgcttgcatctaatatagtgattaaagcagtttgggacgtctaggactcgttctaacaagcagaaaaaaaaaaaactcaaaaattagggaaggacctaatatcaaataattagaaggggttaggttttgaacccaggtcgtctagcccaccatcttgtggagctagccgaaagacccctgagtatttctcgttctaacaagcacctcacctctacttgtctctaacaagcagaggtgaggtgcaattaaacaagggttgaataagctaatcccgggcaaataccaccgaattaagtttgtgcaagtggacagaattcaagttctggactcattcagtccttcttcattgaatattcttgtggattctcgcgaacttttacttgcaaagtccgacaatattcagaagccaaggtatgcagtgtacagttcagtcttgcaacacttataaataggagtagcttctctcattcaccaaatgcaccaagcttgacatcccctgattcctgaagaagttaactggaggttacaatagcattctatttttactctgctggttcctttttgctatttagctgtgtatatttctttcatcttcgcgtaattttgtaggagattttcaattggttcctttgtttacaggagcatttcatttggagcattagagcttgtgcagctcggatattcctggagcaagaatggggaagtccaagcgtaacaacgtcaagaagagcatctggcagctcctctgcggctgctcatcacctcagacgagcgattaactgagactgcaacacacgatattaaggagaataaagttgctcatgctgatggacgttgggctcaggggttgatgtgattacaaggtgtcggaaagttattgattgtttcattaaattgtctgtagatttattcgtgttgaatttagttccgttgtagtaaaggaaattcaagtctcttgtaaccagattctgaaataaaaccgtttcaccttgtatcatggctatggcctaaaatatttctggtttcctccaaactgggtaatacggggaaactattttaaactctcgaggggatgtctccttgttgtttgtatgttactcaaatggttatgaaaaaatttgagaaaatatattaatatgtgatatatcacttcacaaacatacaaagtcaaatttaacttctacatatcgtaacgaaaaaataaatttgactatgaatatactttaattatctgtagtttgtttttttacaacttataaaagttgatttaacttgcatgtttgtggagtaatatatcacatgttaatacatcttctcaaaaaaatttcataaccatttgagtgacatgtaaacaacgatgggtcattcactcgagagttcaaaatccactctccgacgatatattactgtattgcttaaattggtactaattggtaggtagactggtaaggcatgatttttttcccttaatataggtagaagttttatagatttttcacaagaataagataatttctcaaacaaaacaagaaatgagaggacaatatgaatgtggaacttcggtcaggctgtgctcatcgaaaatcggttcctccctacatatggcattagctggttgaaggcattgtctagaattcgaagaatttggtctctagtatgaaaacctatgatttgggttttgttgatcggatcatggcaatgacaatgcaatttttattttggaggtgttgtttttaaggttttctaagtgatgcgtgtatagagtataaagcttgtggttgtagctcactatggcatgatatttgttatcatgtcgttcttctttctaaaaaataattataggttgtggacaacctactatgctggtgccaagagtgatcttagattaattgtatcactttattataattgtttacatccatcaagaaagtttcctttatcttaaaaaaataaaacctctaaatttacttccaaggacacctaaatagtactcacttttggtggaaaaaatatcgtttcaacatcgatatagtcttcaattgaagcttttttttcataaaagataactaaatatccaacaaatcaaaatatatgatttttcatacatgcaattcatatgttaaaaatattgtgacttaaaatatgttcaaacaatgtgtttttgtcctaagaggggttagttttcaagcgggggctgctatataacggaatctcgttttcgaacgggatgataccggttaggtatcaggtcttgatacataacctgtatcatgcgtttctatcacatacgtatcaggtgatacttgagaagtatcagatgatatctatcatgtatcatgcgattcttatcacatagagggtgatacttacgaggtatcatgtcctaatacctaaccggtatcaggtgatacctaccaggtatcatgcgattctaccacgtatcagatgatacttgtgaggtatcagatcctgatacctaaccggtatcaggtgatacctatcaggtatcatgcgattctaccacgtatcagatgatacttgcgaggtatcagatggtacctatcaggtatcaggtgatacttatcaggtatcatgtgattctaccacgtatcaggtgatatttgtgaggtatcagatgatacctatcagatatcatgcgattcttaccacgtagaatgtgatacttgcgaggtatcagacgatacctaccagatatcccaccgtccatgtcccacgctagagctcgttgctggcagccacatcctccaccgtccacgccatgtcagagcttgtcgccggcggccgcgtcctccgtcatccacgccccatgccggagctcgtcgtcgacgaccgcatcctccaccgtctacgccacgttggagctcatcaccggcaaccgcttccttcgtcatccacgtcccacgatggagctcgtcgccgacagccgtgtccttcgtcatccatgtcccacgccggagctcgtcgtagacggccgcatcctgcactgtccacgccacgtcggagctcatcaccggcggacgcttccttcgtcatccacgtcccacgatggagctcgtcgctgacgaccgcgtccttcatcatccatgtcccacgtcggagctcgtcgtagacggccgcatcctccaccgtccacgccgcgtcggagcttgtcgccgacggccacgtccttccccacctcgacgagctagccaagtacgtgctcgttgtgctctgcgccgacggcggtggtgagggcaacaccttcgcactctacttcctcatctgttgccgcgtccgtgttgtcctcctcctcccctgcgccggtgccgacgccgccggcgaggagctcacgatcacggggcagtgcgtcgacagtgcgggtgtgggcgccgctgcctatgtcagccatgcgcgcgcgctggagcggcaccgtgtcctgcagaggttgctgctgctgttcaggacgtgcatggtcaggtatcgctactatttgaataagcaaggggataaaaggatcccgtccggacggaattccggtgcgtagcattcccgttttcaagcacccctttctgagttccgacccatactctgtttactctttttcttccatggtactactgcatcgctactactccacatatcacgattgtacgcttgcacatcgcacgcccgacgttcgaaacgcaagttaacatgcgtgaacttctgaagcatcttattgttttaatcatttgcagtaagcatctgattgctttaatcatctgcagtaatttttaagagtaaatcatttgccatatttagcagcagcaattattgaaccgttccaagctaaccaaggtaaacggtcgtccatgcttcagtcaagggatcgagcttggctgatttggccttcttttttaaggtcgcatttgggcttttttgagaccgaagaaatccaggtttacgcgtaccctttttgcactaccatgttgctgcatacatgccgaccggtgaacgcatcaaacctgctgacaggtcagtttcaggtcaggtcatacacccacactcgatggattgggaacatctgctgacgtgcagtcccaactataactgcacgttagagattgcacgcaatccagtcatccaatttttccgttgaaggtccagattaaatgctacagtagtcttgctacagccctaacggtgtcctgttgaaatttgggcatttgaatttacatcctacagccctaacaactgtttaagttgtagtcacgcaggaaccaaatcgaccatcgatgtatcgtatcaaagacaatttgtaaggccctgtttaggtttcaactttttattctttagactttcaatttttctgtcacatcgaacttttctacacaaacaaactttcaacttttccgttaaatcgttctaatttttttaaacttctaattttagtgtggaactgaacacagccttaagtcaattttactcgtcaagcacaatatacacataaaacgagctactagctactacatgaagcttgaaatataagcaaccttttgttctttaaaaactagtactacttgactagaaaattatagtatatttcagtgaacactccatgtcaagtgcaaactagttaagcgggagttcaaagtgtaggagtacgtgttaactgtaaccaatgacctggtccaggcggcaccttttgcggattccgtatgtacttttcctgcttcgtgcggaccaagcttccttcgtcgtgttactcgagggtgaacgtacaggactcgttattcgctgaattttcatgtggttttttctcatgttgttttcctagtaacgcttgataactacggtgtgtttgctctctggcacggaaaacagaacggtccattagggcacccacaatggttatctataagctatctacaagatatccatgtcagcatattttcctacttggaagatattaaatgaagagagagagagcaaagctatctactagcttagagatagtctatagagaaaaacgaggcaatgcatgagagagctatagatacctatgtagacatactattgaggtggtttactattaatctagtctattgctgagatgtacatgttttatagagagcaccctactttaccattgcgggtgctcttagtacgtgattaattaagtatttgctatttttttaaaaaaatagattagtttaatttttttaagcaacttccgtataaaaactttttttaaaaaacataccgtttaacagtttgaaaaacgtgcgatggaaaacgagggagatgagctgggaaaaaggggtatccgaacacacctactagtgcaaacttacaatttactgtagtagaagttctcatatcaactggtcaccctcagctagcatgagatcgagaagagtcgttcaaaagtgaactgtacatgattcagtcaaacaatccgagtaaagcttgctagtgctgttcacaattactcatgcagaaaccaagtcatagtttcacggggttgtcacggtgtcacaccgtattcgaccacttgttgcttgttgcgtactagcatacataccatgggatgcaacaaattaaggtactatgtgtgcagctaatataacaatattcaaagtgctcacactgatagacactctcaaggattaacttgacgtcttgaccttgatcaattcatcataagtacgttacgagtcgttcgccggtacggttcttggggaacaaggcaatattctacacggtgaaaagtacggaacacaggctaagctaggagaattaaacgtaccattttcacagaacattctaagaaaacagagttaattatacaaaatgaaaccaagttgttgcacaaagtgaaaaatccaagcccaacttcaactgtcacttgctagctaggccgacctgttctacattgtcatcactgaagttctccatggttcttcatgtacttttcctagtatgtgctcggtaagcttccctgatcgtcttacccgcagcactataaaaggacgaaatgggtggcttgttggaggcaccaaacattcagagacatcgagctctctttgatctctcgctgagctaagctagcatttgttcatctgaagtgttattccagttaagttcaggttcagtagcagcagagggcgagctcttttcagagtaatcgaggatgcctgaccacaacggggtgaagaagagcatactgagcgtactgtgcggctgcttttctccaccaaagacgaaaggttgagatgagatcatggcttcatgtacatcgatctgtagtgttattcatcttgttcagatctagaattgttctgtgtacatgagaggtaataagaggccggtgtagtggccgtgcgtcccagtccatcaggtagttttccattgatttgatttgtactcttgtaggttatagttgtttacgccgattgtattgttccatacgtatgtgtggttgtgtgttttgtatgagtcttgagtgataaagaattaccagcttgtttctgaacgttttcactatactcgcaactcgctccactgtcccctgaatatgtctgtatactattactatgaccgagtcaatgcttataggtggttatagggaaaatatagtataaaccatatatacgatggaaatctaaaaattattgttagatgtaaaaatggatgcatgagatttatccacgtcaccaagagtccgagtaaaatttttactcatgatttcatgattgaaactgagagtagaatttttacaattggtgacatggacaaatttcaagcatgcagttttacatccaagaacagttttttactacatattttccttggttagggtctgcctacccgagcttgggctccagccaattccaaacaatcaaagtttcaaacaagctgaaacaaaagaaaagaaaaagaagaatccatggatgtgttccttctaaaccatccatgttaccaagatgactcctgcactaaaagtttccctattattcttggcgatcatcttgtgacctccaccataatcaccaattaaaaagaaattatctaagatctctccctttaccatcatacctctaattagtcggagatgtaataatgtaaatggtagaagagcgtgtgtaattaatactccctccgtttcagattacaagatgttttgactttggtcaaagtcaaattatttcaagtttaactaagttataaatatagtaatatttaaatactaaattagtttcatcaaatcaataattgaatatattttcataataaatttgtcttgggttgaaaatgttactatattttttctataaactttgtcaaacttaaaacagtttgactttaaccaaagttaaaacatcttataacctaaaacggagggagtagcttttagttgtgtagcgcccgttccgtcgtggcgcctagcgggaaaattatctcttaaaaaccctatttgcgaaatttgtttccttgcttgttgtctagtgtccgtgccatctcaagatctcaatccccgatctatcgtcgagttcaaattccgaatccaaatccttccaaaatcatttcctccgcaaaagtctattttgcctcccccgaggtcgatgggccgaatctcgctcggcccatctccccctctcccccggccctctcctctctctcccgggcgctctctctctctctctctctctctcgctttccccggcgcgttccccccccccgactcgctactcgcgcgtgcgagagccgcgccgagcgccccctcctctcgcgcgagctccccgctcgcaaagccggccccgtgcgccgtcgctcgcgcgcgcgcccgcgtggtttcccgcccgagccgcgtcgtctgcgccgtccgcgtcgcccggtcccgctgcccagccgcgccgcccgttgtttcccacgcgcgcgtgccgagtggccgaccgcccggtcgccgccgccgtcaccctctgccgcgccagcccgcgcctgtcgcccgtgtcgtcgcgccgctccaaaccgccccgccatcatcgccgtcgtcatcgcccggcccccgccactccgcgcgctagcctccaaggggcggaggcagagagcccctctccctctgccgagtcgccccgctccctcctccttttcccgaatcggcaaaggggcgagccccctttctctccctccttttcctctttttctcccctttttcccctctcgccggcgtcacctcctgtcgccgctttggacgctagccggagcgccagctcgccggcttgaccgcccatgtcggttcccctctctcaaaccgacattgccgcccttttaaacccgtcttccccctcccttcctttcctctcccattcgtctcctcaccgttgtcgccgctcccgtgctctgcctcgcctccgccgtccatcgccaagcgccgggagagccggtgcgttcgtggacgcggaaggggactccgggcgcgccctcttcttcctcttccccggcccgaggccggagagatcactcccgcgccgtcggcctctcgtcactgcgccccgtcccgcacggtagtgtctctctccgttcttcctcctcgctccatctcctccccctagctttcggtagtagcttgagtagactccccgtagttagccggcgccgccccgaccgttgccgtcgctcgccgtgtgctcgccgccgtcgccgcccgagctccgtaacacccgctcgtcgccggcctcgctcggcgtagttccgcccaatccgacgctagcatcggattcccgtagccgcgtggatgctctcgccgccgggaattggcccctcgtgacctcgtcgccgttttccccttttcccgccgccggttgccgccgccgcgattcgccgccgtcaagctccctccggcgaatccgagccgttggctcgtctcccctcatcacgtgcaaccacccggtgtgctcgctttcgccgatatcgccgtggttcgctccgccgctcgccgctgttgtccgccgtccgttccggccggcgtcgtcgtctacctcccgccggcccgcgtggcagccacgtaggcgccacgtcggcgccagctcagccgaggtcgggacgggccgaccccggtcagcccctcccgtgcgcgcgttccaccgcgagccgtgaggctgcgcatgggcccgccgcatccgttcctccgcgaaccgcgcgcgtgcaccgcgtcccagccccgcccgcgcgcgtacgccgcaaactccctccgcacggtgagccgagccgctaacaagcgggtcccacccgggaccgcgcgcggtgagcccggtccaccggctctctctcccctcccctcccgcgcgcgcgcttgggccgtcttgggccggccggcccgttaagctcggccgagccgctccatttaccttgggcagcgccctagccgcccgaggaaaagtctgatttccatccctcttttcttttcttttcttttcttttcttttccaaaaaggatttaattaaatccttttcctttagaccaaaaatccaataatcttagaaattcaatatcttcccaaccgtaaatctgtttgactccgttcaacttccaaaattcctcaaatctcgagatctatctaatggcacgcttagaggtcattaatagggctttattttcgccgtttgttgagttgttccgtttcgcgtgtagttccggagcccgaagacccgcagtgcgaggatttcgaggatcaagctccagatctctagcaaggcaagccacctttgaacatcttgagcctatatttgaaatttaattatgttgcttgaaaaatattatgcattgataggatcgcacttaatcttttgtcccgtctgcaagacagattggcggacttacctaaattgttgcatttgatcctttccttgttaattgttacagcatgtccccttgtaaccacctagttgcgtcttgatattcgtgcatcctgtgcgagtatcgacggacgccttcaaacttataatctgaataacaacttgggtaaaacttgggttttacgaaagatttggaaaacccgacacctgggtcggtgcttgcgaactaaatgaatttccaaaaccgcggaccggggaacgtaccgggtgtacggtttcccgctctcgcacttaaggaccgttttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggcaaacctgtgtcggctttcgaaatgccttgtcatgaaagcttggaggtctcccgacgtggctgatccccacgggctgggtgacccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtgaaaaggggttcgatgtttgaaaaatctgcagctgatgggatcagctaggcccgggtggctgtttgaaaagttgtaggcccgggtggccgtttgaaaagttgttggcccgggtggccgtttgaaaagctgttggccgggtgccaaccttgttttaattctaaagactgatacattgcacatacttcgaccggacgagacgcactgtctcatccgtgtcgtttgagaagcactcgcttagttgtttttagaaaagagttcaaataaaatcaattgcaaaaacaacagccttcccttgaagcctgcattaaacacttaattcccatggcttgctgagtactcccgtactcacccttgctctatataaatatcccccccagttgctgaagaagatgaagcagatcctgctgatgaggagttcttccaggagcaagccggctacgatgagttttagggtttcggcctagttcccaagtcacgcctgtgtgtttggtccaagtcctggcttccgtttcccttttgtaatgcagttgtgagctcgggatctgtccgcagcccaacatgactgtacttctactctataataaagagacctctgttgctgtgatattctgtctccctgtgataccagcactgtttcctgggactggtatcgattaacaggctaaattggagcgtcacgggctagttccggtcgggactagttcggggcgtgacaagttgcaagcaaatttactggcatgtaagagagaaagaggagaggagagagaaacgctgatgttaaattttacatcaacccttagcttgtacggaatacatgataaaaagtaatttttgctgcataagggtgaggaaaggaaggaatgataattaaaaaaaacttttatagattaatgattagagcatatatttgtcttaactattgtaatagggatagtttttaaataacttgtattgcttaggaaacatactatgttctatctttcggggtggggttaggggtgggtgggtggaggcggaaattattgctctatttttttgcaaggttggaaacttgttaacgcgaaacaacgtgataaactaaacaggacaataaacatcacacgaaatacaaaaatattccattgcatgcaagatgaccgtggtagagtctgttcttaaactttcagcagagctgttaatttcagggtgtacatgcagtatgattcagtttcagtcaatcaagaaaaacacttgcaagctactgtactttcggcgtcatggccggccggctttgcatccaagaagaaacatttccatacacgtacctggtgatctggtcgtgatcgagctgatgagaaatgatgaggtgacgctgaacctgaagccttggacgacgtacgcagtacgcttacctgaagagacaaaaacaaccgcccaagctaagatttggtgggggcaaaccctgtcggccgcaaaggcacatacatatatattccatgtaaattacgtcgaaggctcgtagatgcgttggattttcgaagattccaacatgagacgtgaaactctgctaaggtctggtttagttctcaacttttgcttcaacttttaactttttcatcacatcgaaacttttctacacatacaaacttttaacttttacataacatcgttttaattttaaccaaacttttaattttagcgttaactaaacccaccctaaacatacacgcgcttcctgggacgacgaaattagacgcatcctacatgcagaacgtcgtacaatctcgtcaatgtcgctagcgaatcgtggccctatttttctccgcgcgacaatcagccaacacacgcaagatcgatagtgcgccgccttgcgtggatttagccgttgtgattgtggtgaaaaaacaaaagttcattgagagatgaaaatggaagtgcatttccttcccaaaaaaagaaccgtccgtccgttcgatacggctgcatccgagtcacactttacactagtgcgcatttccctggtttttacccccgaaataggcctgaaatgtccctccattttggagtataagctctcaggggtacggacagaaagcgaccgtgctatctatttatactccacgcattcagggctctgcttattggcagcggttgttgcttgcagagttacagttccaatactcctcttgacagagagcacccgtgttagttcgtagaagttgttccttgttagctgctgatggagaacggacgcggcggcggcggcgacgacacgacgaatcggcgaagcaagccggcgccaaagcgcggcggagccctgaagagcatcctcagattactctgcttctgcggtgctcccgcggaagcatagttatgaattatgatgatccatacacgggcgtaaagcacgtagctgaatctgggccgctcaacacgataaggagtacgtttggtatatgtcactggttccctaattaagtatgggtttgttctttccgtgcttgtgaaactaatgttagtgttgtaaattaggtacgctggtgttggtcggtgtggatgagtcatgtctgtctatgtataattatggtcttagttacattcatttgaacgcatgtaatccaaatactcatatatatatatattctcctcatttaagttgttatatacctacacggcttggagacgaaagcacaaacagcgagggtggcggtatcgctaagacgagcccgcgtgagaaagaaaaacggcccgctcggcacagcccaaccatggatcctcgcgggtgggctgagacggcgagacttggtcactagcacggatgcacgcgcgccattgttccgcgcccgcgaatccgcgacgcggttggcgtcttggttgcgaaccagccgcgcgctgcgcgcaccgcggcaaccgtgccgatttgcgttgcgttgcgcggcggggcggggcggccgaatcttgcggacttgcacagttgcaccgaccgagagcgattgtgccttacggttacgggggaatagaaatcgtcgcgcagcaagcacgcacgaaataggggatgatgctacttgcttaattttactttagattaagtttaaactgatgcgggtggtgtctaagtttgtattaaggggatgcatatatggtgaaaatagattaattatagtttaaaaaattttcttaaccgggttcctgggcactcccctaatgtactctagctccgcccctgtgtgcagccccggcgagcatatgatcatttggacgcccctcggctcgctccgctcaatgtggtgaactaaacattagttaaagattatacttgaaatatatatagttctacttaccaatcaaagttcagtaggctcgaactaagactgtctgttaactaagacttacaaatcaaatatatatatagctcgaactaagactgtctgttagcttaaagatttcgtaggctcggcttgagctttaattgagcttgagtctaggcagatgaacttgcttgaactccgccctactctaggctgatgaagcgaaggctatagtatgagcaaatcatcgttgttcgaacaaacttcggtagctctggttatatactgtagtaaaaatgttacagtataatagtcctcgcaatatatttttcttgtttttaatatttagtttgtcctgaaataaattaaactctcgtagcctaaggtaattttagtggtgctttaatatgcagttcctccatcctaaaataaattaaactcttgcatcccaagataattttagtggtgaggaaagtagtatttgtgggtgggtatgttaagggaattgaaactataaaactttttgattcatttgtaagtctaatccctccgttacattaaaaatcaatctagtactatgaatttagacatacatctgtccagagtcatactaaaatatgccacgtccagtcctaggttcgtttttcgtgggatagaaggagtaggtaagaagatagtattaattgatttatttcatgactttgaactctactagtatatggccatgtttagttcacaaaacaaaaacttttcacccatcacattaaatgtgtggacacatgtgtggagtattaactgtgtttagttccacgccaaaattagaagtttgaagaaaaaagttagaaatttatgtgtgtaggaaagttttgatgtgatgaaaaagttggaagtttgaagaaaaaattggtaactaaacaaggcctaaatgtaaataaaaataaaaactaattatacagtttgcgttaaattgtaatacgaatcttttaagcctaattgtgtcatgatttaacaatgtggtgctacagtaaatatttgctaatgacgaattaactaggcttaataaattcgtcccgcagttttctggcggaatctataatttgttttattattagacaacgtttaatacttcaaatatgtgtccgtatatccaatgtaacacctcgaaataaatttgtttccaactaaaccgggcctaatacggagcatctgcgcctgtgcgttctgaagcatcttattaccttaatcattgccatctatcattgcagtactagtttgcagcaaaaatagttgaaccgttccaagcgagttgctacctttaaccgtcccaagctaggtgcgcttgtgaagggaacgaacttggcttgccttcctttgttttatttttcttctaaattaagactgcccatactccatagctagtcagaatcccagtttacgcgtattatttgcagcgtcgtgttttgttgcatgcatgccgaccatactagaaactgattaaggacttgtttagtttcaaactttttctttaaatttttaactttttcatcacatcaaaatttttctacacacataaacttttaacttttccgtcacatcgttccaattttaaccaaacttctaattctggcgtgaactaaacacaccctatgccaagttcaagtgcatttaactgaaacaatgacctggtccaggttgcgccttttggcgattgcgcatgtactagctacttgcaaaccaagtttcctcaatttcgtcgcgtgaatcgagggtacatgactcgttaattattcgctgaaattttcttatgttttttcacgttcttttcgtagtaaagcttatattgatatggacaattatatcaagatgatacggttaagtaaatgactatacagttgagtaaaaaggaatatgatattttaaaggtaaaattggttctatggcatcgaaagttctcgattttgattctatagcattaaaagtttatggttcactttaatagcactgaaaactacatccgttactatttttagcattctgtcagcagttccgtcggctcaccccatcctacctctatcttcttcctcctgcgctctccctcctatggttgaccactcttcaaggcatcaggcgagctcgaccatgacagtatagcgctgagcgagttggagccttggatggtggcagctggttctggcatgctagaggcggcggctcttgggtcggtagacaacggatccagggcaaggaggagcgggtcggcactcaggcgagcccgcaacgagcgcgagggtggtgcttcggggcgaatttgagggccgatggatgagctcgatcgagggcagcatgtcggagagagctcaagggcgccgacaataatttggagggctttgcttccgtgcggacccgacaatgccggcgacgagctggacaatgacacttcgggcgttcatggattggatgagcttgaggatgacgcatctaggggagaccgagggcagtgcacgcggacgaactcggaagcggcacggccgcggaggaaatggacctggttgagcacgcaagatttgaacaagctctagcatggccatggcggcgcggcagacgagatcgatcgacgattgcgctgtacgggcaaagctagaacgtggatagatcacacctagcaagcgcggatgaacacagcggcttgcggatgagctcgtgagggctcacgtattacatgacgagctcgtggagccagcatactgtgttcgcaccatggctgaccggcctgagctcctgtatgactgctgtttcgagatgagaaggaagtggaagagggccaccattggtgtttgatctaattttttgttgaaaaataataataagaaaagaaaactaactggagtttggatggaatgctaaacagaagtaacggaggtaactttaggtgctatcaaaatgagccgtaaacttttgatgctataaaaccaaaatcgacaactttcgatgctctagaactaattttgtctattttaaactagccaccttacagtgttcaaaagtaaacggtgcttaagtcaaccaatccgagtacgtaggagcaggagtatatattcaccgtccaggtcctagtttatgcgtatttatatcacagtgttcttttgcgaaatactcctaaagtgtactcacacaacatattcgaccacgtgttacataccataccatggaagacaataaattaaggaatataatgcagctagccggaccccggcattcctccaaattaattaagataagtaattagagtactattaattattgaagtgctcatcacactaacatgctcctccattcgcttccctcgcttcaagctcttagtcccggtcacaagtatagggcttgtttggattgaagccaattatcccctaccatatatagaatttcattcctatgatcaatttcataagaaaataactaaaagacatggtcaattccatagaaaaataagtaaaaagataatatttcttagaaaacttttatttggatcaatctttcttgtggtgcattttcttataggattgaattgaaaaacatgaaatttcgattcttgcgtttttcggtcatacgtttcaaacgagagccttaacgttaagacaagattatgtcaaatttctaaattttcgatcatcaacaaaattttcaaatatttagtttaaaaataagagaaataatatatgtaaatttgtctcagaaaatattatcatattatcctaatattataaaactattagactttgtaaagttattttaatatataaaatcgatatttggaattttaaaatattaatccaattttatcctttccaccaccggggagtgatggttggtgcgacctattctacatatattattgtcactgaagttaattttctatgcatggttcttcatgtacttttcctagtttatatacatcgtgtttggaaagcttctggtcgtgttacaatagcgaggcctataaagaggacgacattggagatgctgcctggaggcatcaatcatccaactcttgttctctcgcttagtttctttggccatctgaagcattaattaatttccagtttagttttgggttcatcatattcagtaatcggtatcagagctcttctaacagtagccgacgatgcagcgtcatcccaacagagtgaagaagagcatgctcagagcaatctgcagctgtttttcaccacccaagacaaaagattgagatcggcgcagggtgccgcggcgcgacatagctttctgcagtctgcacgggttagtacacgatcgggattgacggggattatctacaatagtgctcatgcagtggtagctatagtcacgagcatgtggacctaggtcctaacgtttagtgactactactacatgtacatgtacagtagagaatccatatacacattatgttgggtcgaaatgatgatgcttatgtctgatagtatatataaattatgttgggtagaaatgtcgatgtttttgttcttgttttatgtcatatcgatatgtagtgccgcaacaaggccggcgtggtggcagtccagatagtccatcaggtcgtggtcctttatttgatctgtaatgttgtggagtagtatgatattgtgtgctagttctttcatacatgtaacgtgccatgtagggttgtccatcgatcatcttttattcttttgtaaagaatggctatgtgtttgcaaggaatgtgagtgatagaagaattactaatgtattacttcctctgttctaaaatatatatatttctattatttaaattttataccacaatatgaggatttctacattgattcccacgattcacatcacttccataaatccagagccaatgacttcaaagagaatctaatccattcaaaattttaaaatagaaaactgaagtaacttaagagaaatcttttcaactaattaaccttagtacttgctaaacaacctaaaaatattatatgttgaaatgtagtgagtatttacctccactctcttaaaaagaacatatacatatatgttctatttgaaaaaaaaagtcgtaaaataacctcaaccatttcctttaccatttttataacaaaataaaaaatggtaaaacagaaacagaaactaagccggagccgaaccgcaagctataattaaggctttattagtaacgtcctactacatacatgcgcgtgtaatccaaatagcattttcattttttcttaaaaaaaaagtacgaattacccccccggccgcgaactatcacagtcgatcgaattaccccctgaacaacaaaaccagacatcctccacccccaactatgcaaacccgacaaataacccccatgagcactgttctgagcggtttttgacttgagtttgtacacgtggcgccaacatggcaatccagtcagcaaagaaaatttaaaaaactccctggacccacttgtcatctccctccctcgaccaaatctctcccaagtcccaatccccctacactctctctctctctctctctctcgctcgcttgagagctcggggcggccggctagcggcggcatcatggggagagcgcgctacggttagcggaagggtgcgccgaggagggcgctggaggcctggagcctagaggcagcggcgttgctgaacgttgcttttagcaccctgcggcggcggtgcggaggcgagtggagcacgcctgcatggctagtggtggatgtcctctctctcctctactcgcgccgagcaacgctcggcgtgacaagacggggtcggtagtggcagcggtgctcaggttgtggagttcactgttgacctcgccgcctccacagcaaactcgaagccacccgtcgcacagcttccccccaccccctcccccacatcgtagcaccctgagtagaaaaggcgggtggtagtggcagcggcaggagaggcgggcaaaagagacggcggcgacaggatctaccacctctcctccctcacctccgccactggtcgccgcccccattcctagcctcgacccagccgccgctctcatcctgaacaccgcctccgccaccagccatcgccgccattccaaacgctgaagagagggggtcgaaccgagcctccaaacgtctccatcaccagccgacgagcccccttcccgagtcccgcctctagttgcatgcctctgccaccagccgttgtccctatcccggaccccgcctcgagccgcctccgccacctctatcctgagcgacgcctctcctgcctccgccaccggccaccaccccatcccgggccctgcctccagccgcctctgccacccctatcccgagcaacgcctctcccgcctatgccagtctgccacccccatctcgagccccacctctcccgcttcctccgtccagccgacgcctaccccgagctgaagagaatgggaaagagacgggggagaggaaagattaagagagagaagaaatagatgataggtggaccccacaaatttattattattattgctgactggattgatacgttgatgccacgtgtgcaaactcccagtcaaaacagctcaaaacagtgttagggggtaattcgtccggtatgaataatcgagggtgtaaaatatcttgtatttgagtttaagaggataattcggtcggccttaatagttccagggataattcgtactatttctttttttttttttggcaatacatatagcacgtttaccctgcaactgcaattcacacacgttttacctggcacaccctgttctttaacgtttgcgttatttgttgatggtaaactgcgacgcgagccaccccttcctccgttcctcgtctcggaggcggaagctctgcatgcatcgcggctaagcgagacggcccggccaaaccgcgcgcgaaacgcagcgtaaagcccaaccgcgcgtgttgatatctatggcacgagcccacgtgaaaataccgtccctctcgtctcggcacagcaccacggaataacggatcgcatcgcggccgcgtttcgatcgggcggactgcacgagcccccgcagttcggctgttcggcgccaccgagccgaggtggttgcctggttggtgcgttggcacagcccgcgcgcacgcgcacacgcacacgcggctgaatctttcctccgcgcgcggggcgtgcgcgtacaacggcacaagcccaaaccatgccggggtgactgccgccgtgcgttgcacggcgagatgtgtggcgcgagcgacccgatcgtgcacgcggattcgcggcgcggcaagcggagcacacaacgtctccggagtccggatccaaaagaggctttcggggcccatcgcagcgggccgggggagtgtggtggtgacttcctcatgaagccagccgcttttcccaactttagtcttcgccaagaatttctagggatcatacactcgtcatttccatcccccaactctttaccaaaagaagttggcacgccgtgtctcatgtctgtgggggagtaaaagaccgacgattgatttgaatggaagcatgtagcagagaggagatctcgggtccagtccaatacttcggctccgttcttttcagctcagggactaaattttttttaagtctctatcacatgagatgtttgaacactaatttagagtattaaacatagattaattataaaacatattctataaaccttggactaattcgcaagacgaatctattgagcctaattaatacatgattagtccatgtgatgctacagtaaacatttgctaattatggattaactagacttaaaaaattcatctcgtaaattagctctcatttatgcaattatttttattattagtctatgtttaatactctaaattagtgtcaaacaccctatgtgacaaagactaaagtttagtccctacatccaaacaccaccacttggggaaaaattttgggtttggttatcacatcggatatacggacacacatttgaagtattaaacgtagtctaataacaaaacaaaccacagattccgctaggaaacagtgagatgaatttattaagcctaattaatccgtcattggcaaatattcactgtagcaccacattaccaaatcatggcgcaattatacttaaaatattcgtctcgcaatttacacgcaaactgtgtaattgattttttccacatttaatactccatgcatgtgtccaaatatcttcgatgtgatgggtgaaaagtttttgttttgggaactaaacaaggcctcattcataaaattattaaaactgattacttgcttcacgatttgaaaaaaaaatgttttctcaaaaaaaaatcttctactgtagtattatttagaccacttattttaagttattttaagttctttggtaagttacttttcataatatttaatttaccatgcaataaatagataattcacgataaccatcagctcaacaatataattaaagggatatctattgatcttttaatggatttataactttaaatcttgcagaattttttcaagggactatcttgcaaaaattttaaccaatgatatatcccattttaaatgaaataacaaaaataaataatcataaatctagaaaaaatagtgtaaaatctaattttggtgcactgtaactgagtataaatatatgctaactggatataaatgctatctaacaaagtatatatgtaagcttgatatacatgaacatgaattttgatacaaaatcctacgaacgaaagttgaaagacagaaacctaaaaatccattgtaagtaaaatagcaaaaatgtaattcaaagcctttgtgtaatcattaactcggcttctgatcttgtctcggccccatgtccacacttctaagttcgaattaatcgctacaacaaacaacggtcgggccttcacgtagcatccctggccctcgatgttttcttatcgatcgatcctttattggcttccatcaatgcatgcatgttaatacagatttgctacgtacgtagtacgtacgtacatgcaagccatgcatgcatgattaaattcatttttcatcgtcgtgtcagccactcaggcagggccgtcataaacgttaaattgcaggttcagacgtttgcagtaggttgtcaccaccaccagctccagtgaacaaatctgacgcgagatttcagattttcaccgctttcacctcaccaagagatcgaccggccgctcgtgaaatttcgcgcatttcacctcaccaattcaccaatggcttcaataatgtggcgccgcagattgaagcagtttacccatgtgcagctggaaacagatcctgagacgtaaccaaaacgggcgccgattgttgagcaaaattcagtaatgaaaaggatggtactggtacgtacgcgagtcgttgtaaagaatcaagtgcatgcatatatatgctcgatcgccagccggtgtcctcgctcggatgtgtgcaactgtggaatgtggaggctgcatatatagctgagctgctgggccagttgtgtttgtaaaggatatcaatggtgaagaacagcaacaaatcatcacgagctgctttggttatgggtaggtggccgttttaaatccttgcagatggttcaagattcgcaacagttgacttggggttgccatgcaataactgactagctgacagtcttagtacatgtgtttgcccaccattcaattttgccactgcacatgctcggctctaatactccatagctagcgattttcatataaataagttagggtcatgttagatttagaggattatctatttagacagtgtttagttcctttaaactttcaatttttccgtcccattaaatatttagacacatacatgaagcattaaatatggatgaaaaaaccaattacacagtttgcaggtaaattgcgagacgaatcttttgagcctaattacgtcatgatttgacaatgtgatgctgcagtaaatatttactaatgatggattaattaggcttaataaattcgtctcgcagtttacaggtggaatctgtaatttgttttgttattagtctatagttaatactttaaatgtgtatccgtgtacttcaaaaaaattttggcacacgaactaaacatggccttcattataaaaataattaatatataaaaataaacttaacagataatttaaaacaaaatggtctaaacaatatagtaggaaaaagtgttttttaagaaaaaaatatcttttaaagtatggggcagataattcattttcaataatctgaaaaataaaagaacaaaggcctagggccatttgaaacaaagtatttaccggattatggcattttaaattgtgttttaagtagttttatagctaatttgttaaaggtgtggcaaattatataaactgggaccaataaatcgttgatcacaggtgaagtttagctcaaataattaagtgatttgccacaactgtatcaatctaaatgcttgcctaacaaacattgacatgtcgacattcgacgtgataaactatggctgtggacagaacaatgtccttaccgattacattgttttatatcagcggggaatgtgaaacatgccaatgaggttcaaaccttcaattcgttccatctcttcgaatcaaggcagtatataactactactcgaagggatgtaaattttagtggaggatcggattagccgcagctctgaacaacatgcatatactcctagatcgaagaggagagaggaattgaaatagctgtcacaagacaccaagcaagttcatcattgtaccacagtggacaagactagtgatcagtagctagtaggataatccatgtgtctaaattacctagtactgtacctgatagcactggtcagtggagatggtgaaaactagaggcagaggctccgcttaggtcgttaggcgcactgtttctttcggctgatttggtgtgggtgtctcgcacatgcttcgccagttttgccactctcgcagtcgcagctagcaacaggcgccttgcgctgcataatcacaaagtctcgcgcgtacagtttccgatccaggacagaaaagctttgggaggtgatagtcgccaataattacatcttagtacaagattctaccctacaacagacaactcggcaaagcggtaaaaaaaaattagcagctctaatctattggtgtcctaggccatatcatctgttcctactcttgtagtactacggcaattcttaattaacttgttcagtgtacgtagtacagtatcattgttgcttcaatttcgccggcatccttttgagtcgggatttgtgactagtgaccaccaaataaactatagtggtaatctttttctgattgtagctatcaaattagacatggtaaatgcgtcaccaaccaagcaaattaacacgtttaggcagagccgcagaatgcactacatagatcatcaagcaattagcacagggcgcaataaaaatctttcctagccgcgctactgagtcccttctacacgatagtaggacgtacggcatgcatgcactctactagctccaagccctgcaagcatgaatgtttgtcacccaatcattaaccgagtaggtaaaggccacggttaaatatgcaaatcaaactataatagggccttgtttagtttcaaactttttcttcaaactttcaacttttccatcacatacaaactttcctacacacatcatttcaatttcaatcaaactttcaattttaacgtgaactaaacacaccctagcaaaagtacagagaaaaaaaaacaaggctacgtttttctcaagatggacgtgcagctttgggtagagacacggcagtcgagctagccgtagttgcagtaagcacacaggcaagtagatatggtccaattggcttaaccatttttattttcttcttcagaggaatggcttaaccattggtgagtgagcatgatggagtagtaaaactgttggaagctagcattaattcatttgcttttgcattgaccattagcagaaagagtgagtgagagagcaagtaaagaagagaagtagcagagcacgcacctgcaaaagaggccacttccacttccaagtcgatagtttctctgtaaaattaactcatgggtttacaccaaaagtcgaatcagcttatggattcatgtcagggctaagtactcgtaccctttcttgaccccctttggggaactcatttctgttccaggcctgattgatctcccttttggaccatgccttttattgatcaatatgtacgtttctttgcttcattagctggttcagaacttcagattagttacattctttaattggtcatttccttgtgccgttgtgcatatagatgattgatgaacaaaccacaccagcagattaatctgtcaatgatcacaccacatatatattttctctgtctgtttctttaggtttaccaaccatgcatgcatggtaaatttcatattaattattgacatttcatatcatcctctgaaattcgatgtttcacatcatccaatactactagtagcttttaagtactggtagtatcttaaatagtgatattgttgtgtggacccttttggtcattattggtgatatgtgaagccccacacttgggttgggcaaaggagtttctgtaacaagtacacagagctatgataagctcgcagttgtccaaggatggcagtaatggcagaagctcaaaacttatggtacagtaaaaaggagaaatatagcaaacacattttcttggcctcgtccaaagattttcatgaaagaatgctaaagctaccggtgctgtccccgtctggtgcagcagcgatacgaacaaaaacatcaacagtcacgtagtacttgcaactcctttttactctccccacccaacaattttactttaccacccctcggtcacacttgatggcattaattcctctactgcaaatgtcaaatattgcatgtgatggcattggcgtgaaatgttttgtgaatacatagaaatagcttatgatcatgaatataacatatagaaagcctcctccttttggattaaatgattttaccagatttttgtaggataattgagttaagtcacgtgaaaattccgtaaaaattcatgttttagccaattagccctaaaagagcaatgttacacgtacttaaactttttttaacagagctcttataaacattgatctaaatcttttgaattaactagatgacagttacaagaaatctagatatatgacatagcacatcaatattagtaagagtttaattaaaaaaaatagtacgtttaatattttttgttctaaggttgtatacatgtcacacaaactaaactataccacattattaacaaactgtctacattgcttttaagtactaatgtactatccatatctatctattttagatcttttgtatctcggcgagtatatggatggacactgttgatcaatttcacaatgtattgaatgcactgctggcaacattctccgatgatgatagaaagggggagagggcaatcaaacataacgaatcacgagaaaggcctagatgcatggagctatccatccagcaaccgcaactttttcccctttgctcttttgctcttgtttattcgttcttttcccattgaccggttgctggctgcctggctcctcctattgatcaattccgtccattcccatccgcccaattcgacacagcttttgttgccacgaaagttgcctcctatttaagccccagcctcatcagcattcagctgcacagccataatagctagctctctcacacacataaacacacacgaaaggacgtaacagggcaaaggagagtaaggccatggccctagacaactaccactcctactacgtcgacgaccacttcgtgctgcctcctcctcctcctcctcagctggattgggattgggatcagctacagctgcacacacttggaggaggaggaggagacgccgcccaagatggcattcatggcgcctttcttccggccatgcgtaagacacacccactgctactagctaccacctcacacacagtatatacgtagactcatgcatacgcagatacgcttgctttcctcttttgcttgcaagctagctagctagggcatgtttgtgtagtgaactagtgagatagtgtcgttgagcttaggttcgttggtgtgtgtagtaggtttggagtcgccggagtcgtcgtcgtcggaggcgtccagtggctacctgcaagacgccgtcgcgcactggagcgaccgttgcaataagcggcagaggatggcggaggcggcggcgccgcctcgacggccagcggcggcggcggcgaacgaggacctgcactgccttcttcaggtaaatgccatcaacacattcatggacaatgtacccgtcatcgaagatatatgatgcatggttcatcgtagattcattgatgcaagaacttgttgcgttttcaggtagctatagtgggtagctagctcggcgcctagacaatatattcattctttagtagtggttacttattactggagcttttttaaaaaagatgaaagatcatgagatcactgaaacttttttgttgcctgtaaaacttccaagtagcagtagtaattaatctcgagtagaacgaaagtgctaagaacataacagagatcacagcaaagtggaaaggcacaactccattgtcgcaatgtcgcatatatgcagtaacatatacttacgtacaaaagagcagtgcagcgtcgtcgtgtctcctcgcagaaagcaagctgtgcctgattgtcttcttcctcgccttttgctctagctaactcgtagctgctgttgttttgttgcttgctcttgccacacacagagcttctgggattccagcagcagcggcggcgaggggggtctcatgcatgaattgaatatcatgatcccggagagcggcagttttgtctcaggtgattatgaatatcgacacgtccttttcaatcggacagcttttactaccacatctaaacaccagattaatcatatctccgatcgagttcttcctcgtcactgcatggctgaatttcttcaggctaagcaacaacagctagagacaaaatagctgtcggcttctcatcacagtcaattatcagcaaacttagtacatctgatcttagtgtcaaagtagttgcattaaaacaacttaggaccctgtttattgggcaggagatgaggacgacgcatcgggttgggagcaggagcagaggggcccgatcagcgcagcagcagcagcagcaacatcagcagtgcaggtgccagcggcgcagggaggaggaggaggagaggcagctgatcccatcctccacaaccacaactcctcgcccgccacctctcgcaccaccaccgggcaaggcgctgcgcagcaactgcagctgcaaaaggcaactagtgcagcaggcgcgggccacgcagcggcagcggcagggcggccagggcgccgcggcaattactcctgcgaggagcacgtcatcgtgggcaaacagcagcagcagccatcgccgtcctctcgtgccgcctccgcgtcgtcgcctcgtcgctcctcgtcgctgacaggtgaggtgaggtggggtgggggtgggtgggtgaccggtgggcaattatcactcgccgcgcatgtgtggcaactgaggcggtggcagggattggggcggggagcagcagtgcttgcagtcttgcagatgtggtttcgaacgtatttgccttgttaaacagtttcataggcatgcatggatgcatggcaggccgcatctattgattgcccccctcagttgttatttactccttcatagtatagcttctataaatgaagagggtttttaagtaaaatgctacatctgtcccataatagttgtctttctaggattcaaaatttgttccaatatatttatcactagaaagtactagttgtcacatccattcctctatattcaaatttcttccttttctacccctaaactactactccactcctaaccatatataccatttaatgtggggtattatagtcttttttctgaaatcttagtccctgctaaactatctagaatgacaagtattttgggacggacgaagtaaatagtcatgttgttactgttcaaccccccttaataataagaattgcatttgttgatgtttatagaagtgtaaaagaaatttcttggtcattcattcacagggaaggagaagagggacacgggcgtgctgtacccgtttgcagttgtcaagccgctggggttagaaggcggcggcgcggcgacgctgaacgacgtcaaccagaggatcctgaagcggccagccaggccggtccggcacccagtcggccagttcgcgtgcagccctgctgtgtacgctcatggactaggcctgtccggcaaagcagttgttagcctcacaaggatcaggacggcaggaaagggcaccataaccatcatcagaacgagagggtgaagtgaaggaaccaattatatggagaactgaacggacaaatgtcttggtcaggaagttaggataataatgggggagttagtttacccacccttgtaaatacatagccacatcctgtgggtgaggagggttcaaattcaccaggatgcatcaaggtatggtacatatggaagactgcattgtatcgttaccttgtcggggcctcagtactgtattcaattcaaccctcttatcatgccaagcataaaccaagatgtatattggcacagcctttaggtgcctgcgtaggaagtcccttatcccggattctgatgaggaagatcggcaatgaactagcgagtatcagcacataacaatcaataaacctgctacgtgtaactgcaaatggaccgtcgaatacaagaatactcgaaagcgctatagcctatcggcctctctccaccatcgccgtatcgcgtgggcgtttggctaggagtataggacgcaggcatcacagcagcggagcataacaaataaagagtaaacagtatcctacgagaacatggtatacaactatacctactaacatcatttgctgcagcagactcagctaacaagaggtagtatgcacccctcatctagcaaccctcttttgtaattaccgagtcatatttttacggtagtttcttttttttttcaaaaaaaaatgtgtcacttcaagcattgtacacatatataccacaatattagtatattatgttcagaactaagctttccttctttccgttttaaaaaggacaagcatcgtttaatcgcagaaagatgataaatgaagacatactccaggcttttgattgacgctagggtactgcataaatacccccaacctgctttcacaaggagtaccatgagcaagtgcagtaagaaaatgacgaagaaactaaaaaaacatatttgctgtaaaatacagcatcacttgcctgaagacgcagtaattttttatttatcaactcgattctctgccagcttttgatgttccattttggcaagacaatttcaactttatgctgccgctctatgctttcctccatcattacttcatattgacctcttcctgcagttgtgcccttccaagaagcatgagccaaccaaatacaaggattggagtgaccagacacaagccgaacatatgtctccaggaacagaaaataaatcacattaatatgtcacgagattgccaatctaaagatgctttggatgtacatcgtgtccagatcacattccatgcgacataaaggttcctgagcaaccgatcttgagagtccaacaattatgagttaaaagatcacatgcaaccgatcttcagttgcaagatggaaccttgagataatatggagatctcgaattatggacaaaaacagggatagctgcatcacgtatctgtttcatcttgcaggagtatctcataaatgtcagttcgaatgtgcaattccttgtcacgcattacttcttggagatctgacaactctttcagtgtcaaaattgaactcagtttttcaaatccatcaagccataatcgtttagacctgcaaagtgggatgtcttgttatgagtgccaagttccaattgtcattagtttggccatcactcaagttacagtttaaatgtttaatattagaaaacaatagcagctaaaataacatgaaaatagaacttgtgtttcccaaacccacaattaaagatggaactttttgataaaaaaataaaaaagaaaaggcagaagctacaagttccgagttccaagtaacaagttcatagagcaaccatatttgcaagaacaccaatttactgtcaaagcactttcttccaaaaaagtgtggttatttaaactttatactctattgtacatttagctatctgtaagggcaatagcacaacaaagttcaggtgcccattatcctctgatgagatctcttctgtactctagtaatatagtgtaagtataagatacaaatgtaacaaaaaacatataaatgatctttgttccaaattggctacataaaaatagctggatatagatggatgatagaataagcaatcatgtaagtataaccagagaaacatcaaattgcgacaacatatttcagtaccataccatggacaggcatgtatagctctgaagaacacacgccgagctgcagaagcattgcaagctatctctgcctcataagctagataacagcgccacaacagaacggatttctgtaacttatcatcagtcagagctctctcaaacagattgtgtattctattgtctgatccagctttgcacaattcaaaggacaaagcaaagagcaagccaattatggaaggatccctgataaaatcaaaagacaaagagcagtaaatatgcaatgcaataccatgcgcacttcagaagatatttttagaagagtgcatgcacccaaactggctacttaaaggaaaaaaaaatacttgatatatactgtttactgtgtcaggaagttcgcaggttacaaatgtatctctatatactgtgaaaagcatcacaaaaaaatgtattgctaaaggagaccaagagaatcattagcaggatcaattacatttctaccttattacacaatatattccatatttttgtcagagaagaacaccatagcatgtaataaaagcagtgtgttatggattttgtagggaagagaactcacctttgattaaatttgtcgagtgtgagacgtagattattggaaacactgtaaaggcaacctagagttaacatggctgcatatgattttgggttgtacggatatgtttgtattccttgcgatatttttggccaaacccttgagagactcaactgattaagatttttctgaagctgcttgatgtagtgcatccacaattcttcgaattctaagctatggttgttctctgaaaaatcatgataagagtatgcttaatagattgcgaatttgacagatgagaataataatacatatttacagacatagaaaagcaaagtaaatgaaaaggataaataaaatcatgaactatcaagcactgcagaaataaaataaatgtaagatctacagtgaaatgctagttaatttggactatgggtggagacttgtgatccaaataagcttgatacttcatgcaaaatcttggtatcaaaagctgtagttgacacctgagcagccttgggagtactagaaaggagcttgtcacttccagtcagaaaataggtatgtttattgaagattgtaaaatatctaagagtttagcaagatacatgaaaacaatttcaaatgtcaaactaaaaaatacgtctaacagagccctaaagacaggttataattcaatagttagcagatggtagatagccaatatataacaattaaaggaacagaaaatgtaatggcttagcatgtggttgcttttatgatcagtatctattagactatcactagtacttgagaaaaaagtatgggaggacaaacaatggctacaatttgtacaaaagtcaactcgccccgcttatagataaataaacatacacatgagctaaaagtaaaggcatgagtaattatcattcagattatcaagaaaaaggtgctgaaggatgaaatacctgaaggtgtcatataaaaggtctcttctataacttcaagaccagaagcaaaaccagatgtcatactctcaaacaaagatgctgagcagattagagcaacagactcttctttcataccatcacttgcaaatgaagatcgcaagcttctaatctgctctttaaatccttgacgagcctttaacacctgaggtcgtgatatagacccatcaaaagaagcatacttcgccttgtcccctaagcaggacagaacgtggattgcacgatccacagagtcagaattgtttcttgaagcatatattgctagctccatctcagcataccaaaaataaagaataggaaccttcttcctgagatcctgcccaacgaaagcagaagcgagcataaataaatgtgctagaatagaagactatataaggcacattgttgtgctgggaatagagccctgaaatcaataaaactatgtttgacatagctgaccaagtaccgatgtggtgtttcctttccaataacataaactgctcaagacaattaactacgtagtatatgctttcataaagttgcttgaaacctattctaactcaaccacgagattgctgctagaccaatgtgagaaacctgaatggcaaaaatatgttagccaattttcttgcaacaggccacatcaaaatgattgtctattgagaaaaccaagtgtcacaatgtccactctataatagtagctacccctaacataatattgcgaataggttgagtagttatagcatgtgatctaagttggtgaccattggtttgtgtccatggtggaattgaaaataatattgtgaaaacgagtgagtacctctattccaaaatagaggttccctacttgccataggaggtgcgcagtcaaactttcaacactttcaaaaaaaacttttcaaaccttaagcactaatagatatcatgttattgtttctcacagtaactaattccaggcagtacattttataatgcttatcaatgtataatgtaaaagaagggtataattgctagcagtgtgtcagagaaccattgcaatatacagaactacatctatattggaatttggaagggaggtagtgagtgagacccatttgacatactgatctatatttctagcagcattggcacattacaaagacataatgacaacattgattgtatttttggatctgaacatactgattcatttactttatggttttacctctgaagctccttgagaagttgatagtgccaagtcgaatatatgccttgctttgacaaagtccccattcatagcctcaattcgtccatatattccacaaagcaaaagatcctacccgaaaaaggtgacatggttcagtttttttttcttatttcaaaagaaaagagcgtcgtgctccaagtatcactgttaagaatatttactgatacatgtagtgcaggtatataaatattaaaaaaatgcacacatggaactgttggaaaagcaagatccaaaataagatgaacgttgaaatactttgagctagttaaatgaaatggatgttattgaattgaagagacatgtctcaatctctgaagaactcagtttgattttggttcccaaactgcatgatgcatccagtctaccaagagacgcagattaaatacaatgcacgtattcaagaaaacataaaatgcacaactagctagcttaaaacacatgaaaaaactaccggtttctgtatgctcattgcacaactaacgacctagttttcacctgttatgctactcagccaagtgatgccaaaaatacggaacaaggcatacctgtctgtctttcttcaatagatttttggccaaagcccgggatgcggtggctggagtagccagatatttttcttgagctgtatgaatttggggggtaacaagaacagcttcctccaggatatgattacgagggaatacatcaaggaaaagcaatattgcatttttcagaaatttcgcagtgccaggcctttgagaaaattcatgcatagttcctaacaatgacaccattttattatgaactgaagtttggttcttgtctataaggttagacaccgtactaagatcttcctgaatgtcatctgtaatcatctctaggctcaaattcctatcaatccaacttgaactgttggtggatgtcctggaatgtaaaaatatcctgtagttaactcattggtacacaacaatatgaaaatggcaagaaacaaattgtgaaaagtaacaacttattcatagtgcaacccaatgaactgctcataattaatacagatttttaaggcacataaaatgaggacaaggctgatataacacatttcacatctcactgccatcgtctctgttttcatcctacatgtccaaatgtttgcttgcaaggactataaactcctgggcagtaataccattaccatctattttccttaatttctggattcaagtaaaactatcaacatgatcagcacaagtctaaaattaagatgcacttgccatgttgaatcatacacctcattatacagttacagctatcattagtatgttctttcaaaggcccatatagtgatgatcttaaggaatacgttcacatctttaaaaaatgagcaataatatttgctgtttcactgaggtcgaaatgccatttttattgtacaagtgctagtagactttgcgtacagagaatgacaacagcttatctgaaaagaagtagatgaaattaccatctagaaatttttccaccatagaaatcaatgaattggcatatcaaagaaaagcgagcctcttcagaagatagagagaacaggaactcagttatatcctcaaacaaaattactctggaaagctgatcattgtcttctccagttggagcatcatcagaataaagtgatcctgtccatgaaaatggcatccagtgtaagtactgggttagctaaaaaaacaatgtgatttgtcaatctacaaacacaaggagaaaataacgtaccaagtttttcatgaagaggcatccattgttcattatcccttgataactccataaatgaccatctattccacgtttttggatctttaacttcactattgtaatcagcatctccatcaatcccaagctttttcagcaaagattcaacatcttcttgtgcagatgggtcctcatcatctggattttctgcatcatttccatcagatgtcgatggttccactttgcttgtttcactattagtccttagagaaggatcaaaccaaccactccaaccacccctttcagtttcttgggtattttcttgtatatctatattttgtctactctcctcatcttttgccaaccatctggaccatccaagagccccatcttctccgattctagcaccaccattgttccagaagtgctcaaagagtctttgcttactgcttgtggtcagatgaaggggaggggagaataaactaaattctatttgagcctgaaatagtgcagttgctaattcccgatgtccagtatgccattcgaaccgacacaaattcacaaatatatccactagaccgagttcaagatgaattaaggaagaatacttaggttcgagacgatcatattgtgtatcctgtgaaaaaaagaaagaaagaataaacatcagaaaattttaactcgctaacagtgcatacatgccgagagagggatagaaaaaggggagggggagcagataagctgaactatatacaaagaaacactgaagttgaacctgcctacatagcttagtacaagctgcagataaagcctgtactgcataagcgtaagacttccgtaggtcagatactttgaatctggagaattccccttgacacagaagtagatactgtttccacaacttacaactatccgggtgtttcatgagtatctgctcccatttatccaggagattctgggtgctatccctctcaccatatgccttcagaagataaagcaataattcttcattatctggattaagctctacagctttttccaatatactaatttttctttcagttgtttgcaaacgggctgctttctgaggttgagtactggcaactttatcctgtaaaaagtagcagagaaaatttcttcagtggatttataaagagcggacaaggaaaaggttgaatgaagaaacattatattaataaggttgatatcttagaactctctatgtaactactaatgatatcccataaaagtaacaacaatgtggatcacactatgcactgtttcacaaaagaaatattataacatcagacaaattggtaatacctggaatcgggcaaagtccaaccaaattttctcattgtgagggaactcccgagacatcttgttgaattctcgtgtcctccgaagtatttcatcttcccaagattcttcaagttcctgttccccagtagtgttattttcaggaagagatggtatccctagggggataaaatcttctgggagaattgcagagttatcctttttcaatacttttaggtgtttgaaacccttatttctttctacaactgcatatttcgccgagtagtagcgacctccagctcttgctttgctattcagtccatctaaatctgactcatgacccatatgtaccgagacacccaagttatgaaacaaaagccgttttagaccacgtgcctctggcatgttttgagacttgtagcgtgcaatatccattctgcataattttcttgtgtgtcaaatttcagtaaaatgaaaaatgcatctacagtcaaactaaacaaaaatgaagaaagcagaaaaataaagaatcaactcatgaaccaaggaaaaaaatggaaagtcacaaaatcacactaagcattaatattctggccaaagcatgatgtaagctgattcattctatttaaatcagatctcgcttttctcaagacgaaatcaaatcagcccacttaacttcaaaggggactaaacattaatgagcttcgagttcagtaaatttgcctaacagtttcttgcaactcaattagcccagaggcttttatttatttccctcagagatcacaacaaatatgtttaaacaagtagctatgaatctaggaaaacaaacttgatactgagaattctgatgatgccctaaacagaagcaagcctgcacaacatctaacatgccactttagcagctagtctagcacaccttcatggaattgcgcaattaacataaacgcccatggttttcaaatggaacctgataccgcaaaaatggaacaaacccagtgcgtatgcctgattattaacttcagatgacaatgcaagttcagctttgctacacatttcatatgcaaaaacctgacctgtatatcgatccaaacgccaagttatcctggtcgcccttggcgtcgaagtagtaatccttagccaacttcgtctccgacccagcccaagcgcgaacccccggctttcgcgaggcttccgcgctattgtaccgctccttctcccgcctccgcttcctcctcttcctatccttccgtctgtccctcctctcctcgtcggaggccggaggcgacggtgagtagggcagcaggtcatacttagcaggtgcgggccgtggcgcctcctcttcgtccgacgaggcgcttagcggcggcggtacggatgaggaggcagtggcggggatgttgagggaggaggcgtcgaaggagaagctagggtttgagagccactgggaccccgccgcgggggcggaggattcctcgggcgccgagagggggaagagaggaaatagagaggaggaggaggaggagcgggcggcggctgtggtgggagcatgcggatcgccttctccgccggcggcgaaggcgggtggcggcggcggaatctccggcgatggctccatggcggttgcgagccgagggggaggagagagagccgagggggacgaagaggtcgggcccacggtgataatggactctggcttgttgggctaactaaattcagcccataagtttattgggcctccatgagtgtgagagatcgacagataattgggggcataagttcacttcagatcccttaatttgtcgccaaatctaaaattcatgtctaagggcctgttcactttgatgccaaaaatactttaccaaattgccaaaattttggcatagttgccaaaattttggtaacttgccaaaattttggcaggatttcttatatagttaccaaaatttggcaggaaactaaacgtacacatatttttggcaactttaccaaaatttggtaaggttgaaaatggcatcaaaatgaacaggccctaaacctctactccctccgtcccataatatagcaatctagtataggatgtgacatttcatagtacaacgaatctgggcaggccgcatgtctagattcattgtactatgaaatattttatctggtcctaggttgttatattatgggacggagggagtatcagatatgactgtatgacgcgtccctcaactcctaaaatcagtgaaaacaatatctcaagacggttcggatgatggttttcggttgaggttgggtttaaatcgtttccttaatcggtactccctctatctaaaaaaagccaacctgacccctcctagtcctacgaatccgtagtactaggagggtcacatccctttttaggttggctttttttgggacggaggaattactagatataatgtgttgctcaacttttaaaaccagtataagcatgcgttgctcaacttttaaaactagtataagcaagatctaaaggtggctcggacgacggttttaatgtctggtttaacttgatcctcgtcccacgcttactttctgttgctgcgttctggcactgtccattgcgagatgttaaaaacacgaaaggcgcacgcacggacgcacggcaccaaatgggcagcaaccggaaaacccgaacgatgtggctctcgtttctcgcacgaggaaccgagacatatggtttgtcttcatcgtcaggaaacgaaagcaaaacgcccgcacacagggcaaactcatgctttgattcacacgcaacaatcataagacggttcccatggtgctgtgccgccccatgcatgctcaagcattcttcatcccagaaaaacccgagctcttttagacctacaaaaacatggatcgagaggcaatacgatccacatcgaacttagattaatctacagtggagcgggacgatgttgagcacgagcaataggtcgctctcgcttcctttgacccctgtgtgcacgacgttcgccggtggcgaggaggacggcgcgttcacggagaaacagcgcaagtatcccatcaagatgaggcggcgcatatgcgcgagctgcgggctgcgccgcacggagcaccgcgccgacgccggcgtcggggacgagcaccacctgccgccgcgcaagcgtctcctgctcaggcgcggatgtgcaaaagaggaggagccgcagccggagccggaggaggaggtggagacctggagcggcgacgcgatcatcgtcacaagggggaagagagccccgcggaagaagcgcgacaacgcgccttgagcggcttgagctctcggggtcgtatctatgcgtgcctgcgaatttgccatctgccatcctacctgaagtaatattgacgaccatacagcaacagcatgtttcctccaagtaaaattgagaaacgtgcagatgtttttttagataatggaatgaaacattccagcctttgctcatcagagctacagccaattattacaaagtatcgtagttcaaaatgaaattaaacacaccaacaaaataaaagaccaaaccaagataaggagtatacatttattcaagtctatttgtgaatctccatccatagtttgcaaaaagttgcattactgtcgtctcaagcctacgacatgcaaccttcatatgctctccatcgtgcagatgtacatttgcgttttgcaaggaaagaatatgggccagccaatcgtgtttgtttcccaggatggattagcaggatcagcttcattcagacaagaacagtgcaaatgtgcaatacatctgaatgcattgcgataacatggtgtcctgacgatatgcggccgctcaagcatgagctgtagtgctgtaccctgtaaggtgtcaaaactgtagtggagaacaacatccatcatcacatcacattttaacaagattggtcattgcgcagggagttttcagttgccttcctgcaaatattaacaaaaatacatatcaaggacttgttttacatcatattaatgcaaattcaccacattatgcattagtgagtaattggcatatagccaatactaaacaaagaagatttgttactaagaaaaaggatcaacacagccaactcataaagaatttagtgaatgattaatatgcctgtctggcgaatattttttctattcatcagactcaaccatcttagaagttgcaagaaggtagcagtaaatttatgcaacactgaacaacatgctgcatacctctaatttggacttagcttcagattcacatgccttgcacaaaatctcatagtttttttcaagcccaatctgtagacactggaaggatcacgatatgaacatcttaatcaataaaaactatagtttataggcaaaacaataccagtggatctactcgtgatggcgaagtactggatattacatatctgcaggataagagttacattgaaatgtttcaaccagcagtcactgcaatattaacaaaccaacgataaggtataaatttagcataaataaactgtggaggaaatattcaagcctagcacttcacctcaacttcttgtagaaagccatagcaaggttgttagctttctgaacagttagcatcactgctcccatttggctctgcatgtacacgccatcaaaatcagctgatccttcatgctgagatttcagatagcaattttatgctaaaaaatgtacatgataagacagatgaaggaataagaggtatcatagaagaatataagtacgcataatatttctggaaatatgtacacacaaaattgagcaggtcattttagtaaaccatcagtaattgttaaacaagtcacattaccttacaagctataagttcaatcaattccattagaaattttcccagccccttcccctgtgcagaaggcaccatctgtaactcatagacataaacaacaggaacatcttcttccaaaacaaatctgtagtgtacaaaaccaatcaagcgatcttcattacatgcttcatgtgtaaattctagcccggaatcttgcttcataatattttgggtggtaatggcatttgaagattgccggacaaagatatatcgtgcttctggggcaaccatttcccggcgcttaattttctcttctgaaggccattctggcccatattgtccctccatgttaacctatattattgctttctagcattacattcaatatttatggggaaactgtaaaaggaagatatgcaaaatatccagcagcactaagagcaaaatgaaagagaaatatatgtgaccttgagaagattttggatgtacttccttgttgataatggaagttgatttccatgtccagactccaagtagaccaaaagacctaagcataaaaaaggtgagattgatataatgcccacaacacacatataagaaaattgcattgtactgaataggacttgttagggcctagtgttggaattatagaggtaaatttgacattaggagttttttttcctttcgctgggaatattaatagtttctacatcatgatggaacattactagtcctaaggtagtgaattttgttcaccaacagacaatgtaggttaccatttctctgatacttatgaaaatcaggaaattgcgctagatgatccttcacggctacagctttcctgataagttcttcaacagccttctttctccccaatatctaggcaaaggcagaagattatctgaatgagaccctgatattagatacatctccgctattactcctcaaatgctacctcggtgacaggagtgacaaaccacccaccaaataagtttaaaaaaagaacttttgacaaaaatctagaggttgcaacatacgtattcaacagaagaacacatgagtctaataaagttgacactgcagctttcgcagtttatgaaaataaaggaattcgacacacttgtagggtttgaagtgcgcgctaattgaactctgacataaccaagtgccaaacaccatctactaaaaaaatacacaaaatcttatcagctattcggtttcgcggaatataaaacaaatcgtatcagccatgagtaatcgactacgggtagggtgaaacgaacgagctatcgatactggccccatcaacaagaggagaggagagaaatataaagacctgcttcctgctcggcctcttctccacgccgccgccgccgccgccgccgcttctgctccgaggcctctttttctccgccgtcgccattatcccagcgcttgctggccccgtgtcggactctcgctcgggtctctctctactctctcgcaccgtcgcccggccgccggatggagggggagatccctggggaagaaaggggcgccgtgctctacagatgggtttgctaacttttggcccaactcggagagggattgttttaggtgggttgggccgattctagattggttgagaacttgagaatagggttcacattttcgacaaaaacatgtcgaattccatgatatttcgacgtttcgacatgactcggaattaagttttgattgaaatttcgaaggttaaacagtagatttggtcaaaattcagtcgaaatttatcgataaccgatcgaaatttatcgaaaaccgtgataccgatggggctcgaaatttagtggtcaaccggtaatgtaaaccctgagatgcatgaaaatctcaggattaggatgccgtgccataatcctaaattcagaggaactcaaagggactaaatccacgaggtttttgcaaaaaagtgttgtctggtaacattatagaaaagcaagtggacttaggcccccttaattcaaaggaaaatcatatcaattttgaaggatttcatttctatagaattatatgaagaatgtctcattccatgcaagttttggacgaaaattaacatgagtagaatctcatggaaagtttcatttgtatctttatcttttctcaaatctatatggtccaatcaaatgatcattctatgttttgcaattctatgttttatacttgtattattatctgaatcaagtatttttcctattcctccatttttttcatttctataattcaaagagtttttctccaaaattcatatgaaataatcaaatgatttcggagaagccattcatttactccaattctccaaaggaccatgtgggaaatttttctgttgaattttagtcctccaaaattcctccacttttccttcgctccaaagaagccaaacatatattttaattgatgggctggtagcattttgttttcttatgataaaactaaataaagtacggctattcatacaagggtcaaagttctagaataggaacaggcagataaaaaataacactatctttatttgtttctgtctaatctgtaagaatactcaaatttgagtcgtttaaatgggtcggcaatgaatatttgttctcgagtgacgtacagcagaattcccaaacccttgggctccaccaaccgctggtttgtcttgttaggccgaaaccagcgaacgagaaatgaacgagattacagggaaatttcggcgccaccgactaatggtaacaagtttcagaatgattagccggtcacgacctgttctaatgaccctgcatcttgactgaagccacccccatgttttttgccgcgagaaatcatgagcaggtgacgaatgctcatgcgccatgtgtgcatgtacagacgtggagacacctcggattgaagccagccaggtcaggtcactgtcacctgttcgctcgtgaaagcaacgggcggacgccgtgatcccgcgaaggaagctgcgccgaagctgcaggtgcaggtgcccaagggctaggatgcagacaaacagcagccaatatccatcgcacgaaatgtacgggcacacacacccgaactgccataccggccgacagctataaataaggtaatcagagttcgtgcccagaacagaagccatattcggaaagaaaacacctcgtctcgcggcgctcactcagattactcacacatcccacggcggcgtcggccgtcgtggactcgtggtgcattgatccgtcctaatcccatggctccgaacgacgccggcggtgtcgccaaggaggcgccaggaccaaggacggaacgcgcccgccgcaggccgccgatgcagcgggtctacgcgttccagttcatgctgcttggagcgacggccatcattggcgtgtacgccgagccggtgtcgtcattgccgcgcctgttcctggcgcttgtgatttggctcgtcgggtacctggcgctgttcatgggaatcatggcacgggattgacgtaggactgtaaaaaaaaaaaaaaaaaagctcaaggctcatgagctgctcgagcttgactcgtcctaagttcgattcgagctcggctcgagctcctaacgaaccgagctaaagcctattttaaagttcgcgagctttgtcgagccgagcttgagcttctagattttttttattgttatttaataaatttgtagatcaaatatgttatttatataccttgtattggcatcatatatttattttattctttttcctcttctacgatagatcataaattaattatttttaaaaagattatcctttaaaatatatattgttctaattaaaaatcaagctcaagcttaaatcgagcttgtttgaaaggtcgaacattttatagactcggctcgagcttgtatcgagctcaagcctagacaggcgagctcgctcgagcttgcctgttgacagccgccttgacacaccaagctagcggctgctgctgcttttccaacctgaacaatagtataggatagatattgtcggattacactgtaggcgatcaagattattgacccgaaggcacagtcaattccgtgcaagtcccgcggatttaactgtggatataacgagttcgagtccttgatgaactagtcccatcacgtcgagctgagaagtgcccagtggtcaaacagttctgttcgtttctttggactaagtactactactccacctagaatttgaaacggaaggagtaaagcataagagggcagctagcccacaagataccgtggaaaagtgatgtcacgggataattaaaacacacgacaaaataaaaaaatggcgtcccgtgtccctgttgtccacgtgaagaggcacgatacctagctggctcttcctgatatcgcgcgcttcccttgccggcgtcgtgttgcctttgcacctggagaagcacacacctcctcgtcggcgtcgtcgcccctaagcagcgggagcagcagacaactcccccgctaaatcctcctctttgcccccaccgacagcaacaacaacagaaggagaagagaaacgttgaggagaggaactgaggaagggagaacagaagaggaggcaacgaacgtgtggccaccggtcagccaggcggcgacggcgtgctcccccttcccccacctttgaccgtggtaccaggtacaataggtatcaggtgccaggtggtacttgataactataggtatctagtacctgataccatgcacatggtacccatggatggtacctaggtactaggcatctggtacctgataccatgcatatggtactgttgacgagaaaatcgaacacatcggctgagagatttgcttagctcctgtgcaggtccaaatcttgattagatgcgagcgtgccagtcagtttgatcctgcaactgacaagatatgcaaataatagatcaaaacagtcaatcggctgacaagccgatggaatagttccagccgatagccgataatagccgatgccgatactagccgatagcgatagggtgtaagcaatcggctatatgtccaatgtagatgatgatataaaggcaatcggctgttgataataaaatataacaataatatagtccagtataaaccaatcggcagataatgatatgataaataagcatcgatccgaaggttaaagcacacatcaactggaggtccgatgtcatgaaatccacaagattagattaaacagtgaaacctttgttgtcatcggctaaatccaacttatatgtatatgcaatccttatgagccgatgcaacgtccagataactcaccggctgaaaccccgatgaaacccttagtggcaatcaaaagcaggctagagattatggttctaagcacgacttagtagatcaaacttaactgatgtaacactaagtatgaaaagaaacataatatctagacaatcaagctgttgaccgagttttcagggtggtagatgtctaagctaatctaatctagcaacgcgatttagccgataccggcagaaaccctaaaacgagaagcagccgatagagctaaattgatatgctaagactagattaacagagacatatgataaataggtaggcaaatatatcatccaaaccagagcaatccaagaggtcgaatgtactgatgcagccttgaacgacgccgacgtagacgatacaattgcctggaccggcggaacattagacttatcccttcgccggagatcgaagacgatgtagccccgcgccgggtgccaagttccgccggaacgtaaaacaaaagtagaagtaaaaagggtggcgatgcgccgaattgtattgatcgtgaagatagattacatagaccccaggtgtacatatttatacccatgggttgatacaagtccttgtcggacaagaaagaaactttcctaaagataaaaggaaaagataaagtccttataggacactaaacacactttcctaaagataaaaggaaactaacaaactattcctaattaatagataacttgccatgccgcattctctttgaactcggtctcttttggataagcttcctttagtagatcaatttccttaaccgaatatagcaagaatccgacaactgacgacttgacaactctcatcggctaatctcaggacttcgaagccgatgctgactctaagccgatgactactctgggcttaccaaatttcactgttaacagatacccatggatggtacctaggtaccatgcatgataccctcgaggtatcaggtacaataggtatcaggtaccatgtggtacctgataattataggtatctggtacctaataccatgcacatggtacccatggatactggatggtacttaggtaccaggcatgatacccttgaggtaccatacccctagtacttggtaccaagcttgatacctaggtatcagtccgtacctgcacataacactgatgagaggaggatagcgtcgacatcgacgaagagcgcttgacactaagtaatcttgtaccaggcctgatacttgtggataccaggcctaatactgaggtatcacgacgactgatgcctgatggagaaggctgtggcgcagacgctgaaggtggtgaggtccggccggaagtcaacggtgaccatctccaagaacacgcgctgcagcaacttcatcttcaagttgatggcaaagaagaggaggtagaggttctagagcaggttgtcgccggcgttgcggcagccgaggcaccgggaccgccggcttcttctgcttctacagtggcagcggaggatccacctgcgctcaccggcaaggaggcggcaggagcagcgggcaaggacggcggcacaagtggctcatgagaagcaggcgatggagaccttggcgaggagcgcgagggaggagggcagcagccccggcgccggcagtgacggggagcgtgcgcgcggaggcggcgccgcagcgggcggaggacggcgtcgaggaagtgcggcgagatcacccccgacgccccctgacctcaccgacgccgtgccgtcgtcgtcctcctcggccgccgaagacgacgacgacgatcccttccttctggctggcttcttctcagccttctcggccttatccagagagagagagtgagtgagtttgtggaggggaagggaaggagataaggcagagatcttatccagtttatcccgttgtgacaggacaccgtgtagtagattttctgaaagcataaattagtgttgcatctctcggtaatgacttggatacttagtattataaaatacagcctattgtacttttgtttggtcgctattgagtcttgatgtcatcttctcaatttatgtgaaatctctttgcaaaaagttcttccgtttctttctagagtaatgactggtacagcaatctatgtatcgacgacctgatggccaagggcagacaacatcaattgtcaacgatgcagctggcattcgcaacttgttcagtatcatttgtcatttgagacgagagcgtatcctggtatgaatatccagggacaaataggacaccttaaaatacatgtacacctctgactactcgctacactaagatatgaacaagaatttgtctggcttgtaggatcggcctgcctcaggctgctagcttgcccaaaatcgccgtgtctagaattttcgtctgatccgtcgtctctagaccatccaccttcacaatgccatcagatccgtcgactcccagcaatttccccgtgagtccacgccaagacccagacattatctttagcttgtcgttcttcttaggcttgacaacctcaaactcgtttggaaaagcagttatttcatccccgctgcctgacgacccaagtgcgacgcggcaagatccatcctagagtttaaattcaaggatgtgtcagtgtaggaaagtgaaagaagaattaggggggtcatcttgtagatgtaaaaatagtacgcaccgggaggacttccttaaccacaccgcaggtggtatcataaccttccctgagcacattgaccaaaacatctggtaaaagccagttcctaccgccctcctcacctgaaagcagtttgggaattagtacccaaataagtgcatccagagctctagatagtttcgatcaccatccagattgactgtagaatgcattttgctggagaagcaacgaattcgaaggataaaaatattacctatggcaggagacattatatccatttcaatataacccagagtcatgggctgaccaccaggtgtgctcgggagatatgatgcaggatttggggtcattggttgcccactaggtgttggagttgcatatgagcttggattttttccggaggcatcaccgaaactaactccaggtgtaacagcccatcctgacccaggggtgggggcttcgtgtggctggggaactggagttcctggctgcaaaagtgaaatgtagaggctcaaaaacttaccattgattgccaacccaaagctaatctacagaaaataaagagcagtcaagaaatagcataagtgcatgacgaacttggtaagttgggctgctttcccaagtgacagcatcttcccagccattcctgtaataattgaattagtcaacaacaaatctatataaaataaacttatactagaattagctcgcttgcacaacataattcattttcattataaaactaaattgcacataatgtcagcatacaaaccttggtggactcattggtgcccatgctcgactaggcataggagttcgcattccattaggaactggtgttgctgtaaaagacgaacaccttgttaatatgtgtgtgtgcaagagagagagagaaagtaaataccatttatagcatgaactgcataatattttcgtttggccaacgacacaacgccagtcaaattttacatcgttcatctgaattacatctatcacacccatttcgaagtgcttcctgataagcattcaggagaggaaaggctccctccaaaaaacaacaccaatcaagatacaaagaggtgactactcatatagtttaagttgattaaacagtagagaaatgatagccattgattatgctgctaaacagtacagatgcactagcctccatataaatcttccatcaccatctgagtactcaagtactaagtagcaaagtctatccgcattaattttttacatattgagtagatgacataaagaaaacaaaactacaaagtagtgccatggaattagtacttctctccactttacatttatgacattatagataaacctcccagtctcttaggacccaaaatagctacattgggatcataatacaacatttttgttacttcttagtaaacatattctgatatttagcagtcaaagttgcttcggttatgtccaaaactacatatttgtaaacggaaggaacaaataagtgatcttagctgtcttaatttttataataaccataatgcatgtaagatggacacacctccagggtcccgcaatggagtctgaaaaggacgcagtggcgttctagatgggtgcacaggtgtttcgttgccccatgaattatgagattcactgtcgatacaagtagtcattaaatgaaatcaaacagctttccaaatatacggacaaggaggaagaaatttacccgaatggagttgcaacagtagctgtgtcagcaatatcttctctcttaactacatatttgaagcaagatagttttaaaaatcagaagaaatagtggggatttggaaggaatgcagctcaggaatgaaagttgtagtgtgtccgcagcgattgctgcatgaagaggtgtactcgttgatctccttttattggtttttgcttcccttcttaatacaaatgcgcgcaaagttcccaccaaaaatagaacaaatgacaacaaagattcacctgcaacaaccttcataagtgaatcaagctccacgcgtacaagtgctcccgtcatttctttaacacgaccacgatatcctttgtaggggccagatttaatcttgatacatctattcaccagggtatcatgccctttgccaccatgatctctgcctccaaaccgtctgccatctgcattagataggaaggacaattatgaattggtattgctattgcatttagcagagcaatgcagcctaaataaaaaaaaaacaaggagctgtgcagataatattcatacaattagtatgaggtgctttaggggggagccttcctggagattgcaaaatccttgctgaagatctaaaagcaccaaatcgtggatcaactgtacccataccctgtatcagagaagcaaaatggttaggaaaatcttccaagacaaccaacagaggtaaatagcttcaaacatacatttccgcggcggctaccagttgatcccccaacaaggaggcatgattgtgcgcttgcacagataaagcctgaatgttcaaggtggtgacgatcataaataaaaagtactcctctgtgtatatgttccacagacccttgctttccctgttgtgacaaagtgtattagacatatagtataatgggataatgtaataaacatatattctgacagaaaaaaaactaaaacagaatataatatgaaaagctaaaaacaaataaaataaactgtacacactttacaagctccttcaatgaccctaacgacatcctttgttgacacgatattactggaccgatcttttgcagatgttcgccgataaatcttgctttttatttctctgagtttcacaagaactagttcaggtttgtcaggctctcccttgagaatctaaatgcattttgggggttagtacacaaaaaatatgggaacaaaagatcattaggcatacgtgaaatgttctatacaaattttcttgcctgaagtgcttctttttccacctttataataacaccaaaagataagtttctgaaaattgaatgggaggaacattgttattacatagccgttcaatgttgtaagcaacaacaatggctcattagaaattctgagcttacccaagaagtacaagatcatgcaattcataatcaccaattctggtaagcccagtggttacctcagaactctccacaacatgatcagcgaacacacggatctgtaatcatataaacacatcagaaagtcaaaagcataatggaagtttatccaaatagtttcttatacttatgtccacgaaaattccctcacatgctctttagttgtgtccgacaaaatgatcaaaacatggccttcaactttaactaccaagcccgttgcaccttcttgaacaccagacaccacttttacatggtctccaggattgaaacatttgcagagatccccctcattgaagacaagtgtgttctgcaggtacacaaagagatgtataaattcgtaatggctacattgaaaatgacatgaaaattccttttgcaagtaattaccagaagaccaggtaattttgatcggatatgaacagtggcatcctctgctttctcaacatagccctctaagttcttaagatcacctttaataacaataacagaatcacctttcatgaagtgcccttttttcctatttgtaaatagggtggacaagctggccgcatcctcatttatgtcattatcaggttccctgaatttctccagttcatcaaatgatggctgaatattgtgtgcgcttattgactttattgaaaacgttttgtgcaagaaaccatctttgaattttaaaccatcaaccatttcatagtattccccagagtctctattcctcctccggtcaacacgaatgttcatctccttatttacaatcgagttagcagattgcagcaatacaaatatatatgaatacatactgattacaaacggaggaaaaagcaccttgcctcattggcgctaaataactttggtggtggaacaaatgatttcttctccttcacaaccttaagtccatcctgaaaatgggaaatactgatcatgctagcccatcggcactggcaaaggataatagcatgcagatgaccacggactacgtacagatttttaattttcaatttactcaaatggtcacttgttccactataaattaatacatctggcattcagtgaatcacatcagataggaaatcctaacatcataccaaatgatggcagcaacaacctaaaaaggtaatgtattaacagcagatgcatcaccacaaatataacagggcatgttaggctgaaaggtgaacataaaacgtggcaatttataccaagtaacaacttacaaatttgtttgccaaggcttgtaaatctattcttggaatgagtttcacagtaaccttttgatgcacatcatcaacgtcaacaacctgatggaggtcataaaatcaaatagtagcagaaaatgttagcatgaagaaactgtactgccgtggtgatggccataccttggcaagatcccctttatatgcaccaagcttcattcggacccatgtgttaattgaaatatcagtagacttgctctgaacagagagtacatcagccacctctcttataggcaccagagttacttttcttgaagcgaagatattgcgcacacctttgcaagcctgtaataaattttagttcccatcacatagcaggaatattacaatgtcaggtcaagcaccgtacctctttgacatgggcttctttatatgcttccacataaatgtaattcttcaggtgatctaatgcaagaacagatttaatctggagatctggcgtatcaatggacttctgcatcaaacaaatggctgtctcccgttcatgcccaatctgaaaatcataattggatatcagtgagcatcaaattatacagaaaacaaattgtggagcagaacattattcgatagaacctgcaacataccgcacatttcaccatccaaagctttggatccttcaccgatggcagaagagcttgctgttcaacctcagtcacaccatcgtcatcatccacaaaatgtgatgacggaattatatacctgtcgtgtattagcttcacaagtgcatccacgtcctcctcttcatccagcatagaagatggatgccgtctagagcttcttcccacatcttggtcagggtcgtcagctcgagtatcatcaataaagcctaccaaaacatgaaggaccatagctgacagcattaaaacacttgaacttgcttttggatattatataattcaacacaagatatattttgacaatgtgaatctgataataccaaaaggaaggtaacacatgttagtagtcagcacaagtaaacagcttagttagtttatgaattaattggagcatcttccctgtgccgcattcgaaacaaagagtaggagcatcttccaattaggtttcacatttgaaacgaagattttttaacagatctatcacaataacatagaacagccatcaggccatcagcgtattcagacaactttgaacattgataataggtagtagcagcaaattcagtccatcatattggcatgtcgcagagtcctgccattcaaggcaacgtggctttaaatagagatgattgaatgaactacgcccactcgcccagttaacttcttggttggtgaaggcctaattggtgtcgagttagtttgacggaactacttttgtcctagcaaatctgcccaatttatgacaaaaatcccggaatgaatataaacttttgcctccaactgaagttttcacatatcgctaaacagaaatctcgattcttattgccattagatgagactaaaccaccacaaacaaccatagaactgcaacaacatggaatcaatacgaaattgaccaccaaatttaatgaatctacacctggaccatttcgaacagagttgattatccagggtaaccgggaaggaactagcattgaaattgttggttcgctcaacttagcgcttaattaacaaacacaaattctacgtccaatgactcagctagcagaaaccgaaacgaaattgctgatttcgctgtgcttcgtaatttcggatttgggaaatcaatctaacgattctatcacggattcacagttcaaacaccagtgagaccaccaggaagcactcaccgtcctcgaactcgccatcctcctcctcctcctcttcatcgtcgacctgagccatatcgtcgatcaggatggacgccctcttcctcttgcgggcacggccgccgccgccacccacgtagtcctcgtcgtcatcctcctcctcctcctcatcctcatcctcactggccgcgtcgtcgatgaagctctctacgccggaccacttcccgccgccgccgcccccgcgtgaccgctttccgcccctctcctccacctccccctcctcctcctcctcttcctccgagtcgtacacctcctcttcatcctcctcctcgcggctgccgcgcgacattgcggaggctagggttccgcaccctactctcgcgagtcgtggcggcgtgggtgcgcgatgccgcggagcaaccgccgagagtcgagcgcctagtcgcgcgtggtctccctgcgcggactccgcgtgtgtgatgctgtgcgagaatgagggggaagcgtttcgatcgattgctcggaactcggaaggggaggcggggggtatttattggggcggcgagcaaccgcctcgtagccgtaggctcgaggagggcagaggtgctggctgggttgggccgggccgaagtcggtgcgcaaaacgggggaggaataagtctattatgactctctttatctctcttcttgattgaatcgcctctcaacagcaaaactgaatataatgtcttccccatcttgaaaaaccgatacaaatcaaactctttcgatgatttaggaagtggttcctgtagacgtgatatgttaattatagttgactcgctgaatcagctggttaaacccacctatcagccactctcctctctttattttcctctctcctctcctttccatctatctcctgaggtcggcagcacatatcccgccaaggagaccataagtaatcgatgttacacgccccgttggtggcgacgcaactgcagagccctggggtcaaccagccacatcggcagaaatcgttttccaaaccattgaataagtcgatttacactagttttaaaaatgagggagatgttatatgcagttttaggttgagggaggctatttaatcacgagcaagagcttagagaagtcaaatagacatattctgggtggacaggatcgagggattgggcacgatcgcacgagaacagatgcgtaaagagtaaagaccgcaacgggctaaaattattttgggccttctcggaaagtaaagaacgaaaagatgtgattgggcttcgagccttggcccatgtggcctgcatgctgcaacgcgatggcgattccaaagcaaacccatcgtctggtcgttgccgatgtggagatggaagatgctgtcgcaagcggcacgccggatatgcctttcgaacaaacaacggaagcaggcgcacagctagtcagctatctggtgcacaacacgtcaatacacccggtgagcaatttatatatatagttgttattatatgaactacaatatggtgagttgacaaaaagacccaatacattaattggttgatagataattttatcacggcaacgttggtagatcgatcatgaccaccctaaggtccaatacggaacgaaaatatgaaatatgtagttcaatttacatactacaaccagacaagtcaatgtattaatgggttgatgaattataagcattaatatatcaattattgccaaatttcatagaatgttaaagcttgatttcattgttgattttagggcctttttgtttacccctacaagtatgatttaccctcttaaatattttaaaccccgaactattaaatctggatgaatcatggcaacaaaaatatcagctcattatgcctacctaccagcctatctcgttattctttttcttccatgacgcaccaacccctccttggtgatgtcctagttctcgacgccccaacctactttcctaggcaatgccctagttctcaacgctccagcctccctccttggtagcgtgaagccatggagggaccttgataatagcatgtgaagttgtggtgtgaggacggttcaatgttttgccctctagatctataccacccgctcaagtttcacctcattgggtccccgtacaatgatggaggggatgtgtcttatggatgggatggtgaggttggcattgaagcacttgattcggtgaatgagaaggttgacatacttgatgcataggtgagcggacacgatttgatctccttgagcttgagctgtcggtgtcctcccatatgagcttgcccgccaccatccttcatgagcttacgagtcatcctctcactcgccctcccctcctttaaaatagcaccaacgaacttccctttcatcccctcctagacaagcatgtccgccaccgtcctccactaatttgcgccactatgcatcctctgtcactcccatccccataaatggtagatgggcttccccttcattccctcctagccagctcggaacgtggtcctccacaaggtcgtgttgttctttgttgctcccctccttcaaacaacattaggaggttttccctttctcccttttggccctctcgtcgctcgaattacctttctttcattgatcgaaaaaagtaagtggaaagaccaaggtggtggcaggaaacagaaagaggacaacagggaaggaggtcgtagacagcgacggccctatatttgatcgagcgagtaagaaagatagataagagggtaagaaaactaataaaatgcgtgattaggttgccatgtaatgaaatcgatgtcatatgtttgcaacgtaatattaaaactaccacttttttttacgcatgggaaggggtacggttttggttcgtgttgatttaatagctcggggattgtcaaatttccgatactctagtttaaggggatagataatacttttatgataatcgaggagataaatcaaatccttttctttttatcatggtctgttttttagatttggttcatacaaaattatatttttcccataagagcaggtacaatagctggatattagccagctataaacatattttaatgagataaacgatgagagagaagagcagcgggctacagatgtgtagccagctacagcacggactccaagacacaatgtatatatgacatgtgggaccatatattaatagtatagaaagcaactattatatgaattggctattagattgattatagatgaattggagttaatagtgaactatactattaaacttgctctaaactacttcatccgtttcacaatgtaagtgattctaacatttttcacattcataataatgttaattaatttagatagatatatatgtttaaatttattaacatcaatatgagagaaatgctagaataagggagtacttttaattagaccgttcatgtttccacggttagttccttggatcttgtctgaacggagtagctccagcttgttttctccaggaggccacgatcattgatttatctatgatcaatctgggcgtacaggccaataatttcacatgcaataaacccgttacacggtgctcgaggcgtcacgcggacgccgttcctcctttgcatgtggcgcctagaacctagagccctccgtgcacctgtccgaacacgaaacaccacacgtcatcgctgcagtaaacgccatcattgcagcacggtccacgtgtcaccatatcatcggtcgcacaccatcgccgcgtgaccgaacagccgcagttgatcccctgagtgccccactctggatttcgataattacgtatatgggtcactcgccttactccacgtcggatgctgcagatctcaccgacatatgggtccaatcttagtgggccccacacgtcacttgcataccagtggcgtcgggtaggccggcacgtagtatttgtctcccctttgcttcgacgcggggaaaccagaaatgcccgaagcggatgacgcggcacgctggcttgtgggagcacacaatctccgggcccacctgtcagccaccccccgggtttcgtgaaagtccgcgccatcaacgtcacccccacgccgaccgcacccgcctccggagaacaaatccgggcacgctgacaggtgggccctgctcgtgctcgggctccacatgtcatcgggatataaatatccgaaccgtctcatctcacctcggaagcaaagcccccgtaccggccgttcggatggttggttggcttgtggcgcggggccccgccgcgatccggtcgccgcctccaccaccacgccgcgtcaccggcggcggagcggcggagagctagccgcgcctctcgccggagcagcgcgaggcagggtggggggggggggaggctcgtggtggtggtatttgaggaggagccattggtgattgagcgccgcgtggtggtggagagggggaggtaggcggcgtatttaccccaccgggggtggccattaactctggccaccttggcatgcggataggcatcaccatgggatgcctctgacctctgcgcaggtattcgacgagatacctctgcaaatttttgcttgcgcctttgcctggattttgtggtggcctctgatctcccgtttgatgtggaattttttgcgtgttttcgcgtatgtggttcagggaggtggtggagtcggcgtgatggagagcggcgggaagcggcatttcttcccccttacgagcttgcaaatcgggtaagtctccttctgtgtgcgggggctctgttttgatctcgcggtggaaacgttcttttcattgcttttggtggaatgttccagtctcgtataatttgggtgctaatttgtgtggtccacaatgcaatgtagtcccgttgtgatataagtgaaaaaaacgagaagttacgagaaagttaactggataacttcgatgaacacggttgaagttagttacgcttgtttcccaaagggcagtggaaattgatcaaaactacaacagtcgtttattcgtttgtgttacttggtggaggaagttccagcatactgtttatgagaaaaagacaggaaagctcacttgtgggagtgggtagctgaattgtcttgtattgcttcattctagtagcatttattttgttacagaatactgtatatcttgatgagagatatgactaaagttagtaggagtagaaaggaaagctgttcttggaaatctttccaatttaaggtagtagatgtttccagtgtaaaggcacaggatcgatactatactggaacggttcaataattcagggtttgtcatttctccctacatattcatgcagagatgataaaacaaacttactataccatcacgttgttgtttgcaaaacaatctaggttttattcctaggtttagttgcctatcgtaggttgataattttgtgttttgtgcacattcatcataccttatcgactggaaatctggaattgtggctttactttacttctaggttcagtaggctgcaatacatgactccgtccgtacactggaggaaagaaaatgttaaatactgtgttcctgattaattttattttgatctgctattgtccacctggatcatatgatatcaaacagtgaacaatgtggcggttattttatcctttttctgtacatccattggactgcatttgttgtgcaaagtcgtatgaccttaagttgtattgcaattatcttaatttctgaggtgggcaattgtgttaagaattcttgcaaactgcaagttttgttttactcctcacagttttgcttgcatttactaacctcatgatcttaaagtgcaatgtaaatttggattttcatctatattacagttagttagtctgatataattattatatgcagggatttacaatcatatcttgctgaacttactatatttttgtgccctcatacgaagaagtttctcatattgcttgataaccggccatggctgcaagaccaggacacaaaacctgctcacctgtggcaattgatggtcacaaaggtatgctttactgttttacgagccacttgtaagcacacaaacgagtacttatgaatatttgttcattgcttacactttcatgtattgcccttgttacatcgattctggctcgtcttacttgttgacttcttgtcattttttgctccagtcaagactttcaccttttgcaaacactagaactaggagaaagggagatgaaactgggaagaaacttgtattctctaaagatcctagacatggttctcatttgtggaatccatcatccagatggtataccttaattgatgatgccatgcggaataaaaagcttcatgtgaataggctgaaggattctcgcctgctgaacaaggaactgcaccgaaccttatatggctttataatttttgaggtagactgggctgatgtgcgcggcatgaactatttcaatgaacttcaggtattgttttagactgaacatgatattcatagctattaatggatggtacatgcttattttgtttttatgttgttgtagactgatacttctatggcagtggaagctaaaacaatgaagagatgggaatttgagagtgtcaaccaagcttcatcattaatcacttcatggttttctggaaattactctgaatgccagctcctacaggattatttgaacagcatctctcctaaaggtaaaggcatgaatgtgctctccattcttctctgctgcatgtgcagaccacttatatgcttgctgtacaggaaatgtgttttatgacgctcagaattatttctcaacacctgaaggggacagtgagaatgtacagagtgatgatgacgattctggacctagtcaatgcatgagagagtcgtcaagttttacaagctcctcatacacaccacctccttgctctggaccttacaagagaagaaagataataagatctgatgctggaaataatatgtctgaagaatcatattctgaagttgtgacctcaccaacacattcatcatctccatcttcctcgtgctgcagtgatgatgattgtggcaagactctgctcgagcctagcacatataaggatgtgttgatcttattccggttcgatgaccacgatctccctttcagactaaaagaagtaatactttctgatgtgaggctgttaacattgctagagtatggccttccttcatgggtcatttttctccagtcatatccagtgttctgcaagacatatcgcccatggatgtgtcctcttgccagggcattgtatgtcttgatgtcaatagttactgttctcataggattttatgacctctacaagaatgtccccatgttgaaggcaactgcatcaagattgtttggccctttctttgactggatagagacgtgggaaatgatttcacgactgaagtatcttggaaccatgctttttctacataacttccagcaggcttttacatggtctcttaagattgtaactgctactaaatctgctctaagtgttttgacaaagccaatcatgggaccaattttggaggttcttgaatttaccctgccgctatggaacctttgtgctgaaacagtaggacatctgagctcagttatcatgttggcgatggagacttcatgcagtgtagttatcagtacaatgcagatgattatatggcctttttggctggtcttcagtgttgtgcttaatgttggtatgttttctgcaacctctgagacgatatgtctgctactctgctcttcaatttgtattgacctcactatgataaactttttgtgttgattctgatatctttctcttttgtattaacttcagcaaattcagtcctgtaccctttcgtttggcttcttggagaaattctagctgcacctttccggcttgttgttgcgatagcaagttttgtggcagactcttttgtggacattgttggagttctgagggagacctggtctacattgagttccttatatcaagttggttctgcatccggatcgaccggacttgcatctgaaactaccatctgggggtcactatggaaagatcttctgtaccaggtaacaaaaatatgttgatgcggccagtaattatattaggaaataggatatatggaacttactttgactttctttttcagattttccgtgcgattcgaagcattctgtatggttttgttgccttcttttcaacatgcaacaggcatcggcttaggtaaccttccttctcatccgtatgtggtagtattttcaaggtcacatgaacattaaatatgaaatcaggtatatacagaaaacatctcgtattgactgtcgaattagaattttacctgattaatgcctcatctaacatgtcattctgttgtgaacttcactggtactctggtagtgatttagtaacatggtcgagtggttcaaaataaataacaggattatatagtgtttcaaagtttacattatcacttcatgtgtgctgtgtgttaactactacttcatgctgcagcatttacaaccacattcaagtatttctccgacgcctatctcgtgttttaactggtgcacagcataccacctcttgtgaaggcacacggaggtattctagtcaaaatcatcctgtaagtccttacttttttaaaaaagttacagtctatcatgattttttttcatgaagtttaggggtaaaaatgacccttggaattgaaatcactagttcatataacagtctgttatgacaatctgagttatgcttcattgctgtttgtgcctatgcttttcccactaaaaaagtgcaaagtagtctttacaatcttggttgtttttcctagatgttaagctatgttgaactacgaaatgtctacagaatcaagtatgaaactatgattgcattttaacccacaagtggtgataactgtgaatatggctgcttttcttttcactgcacgaactgctgtaacttggattatcaaaatcatgcttatatcatcttttgcattccacatatattctacagagagtccaacatgaagtaacagttcaaaactaacttttctatattatagtttcaactaacttgtctatattatagtttcaactccttacataaacatgtctggtgtatgtacttctgtagcaaaggaaaactcacacgagataacagtgggcctggcaacttgacttgccaggtaacaacctcattcagggagcctatgcgcgggataaatagagatagccagtcgtgagctgaaaaaagtgtgaacaggaaacatttactaacacagaagcatacccggtcgactggacagaccttcaaaacaacttgcttggaattggaagagtcatgtacaggtttataccgaatgtttcatcacatagctttaatcatgtatcctatctgtaccagcgggcaagtagtgaaacaaaacgccgcaattgtacatacgcagaatctgttgtttgttcattctaatggcttgtatagcagcctagtaggtttgtgcatatcctcccgaaatgttcctctgaacaacaattttgtaattacatccgagtattagctaaatagctaagcatcaatttccataacacggttgtccaatcttttgtcttaactgtgtgtggtactcagtttcacattttaaaaacatcgttgataatcggtttcccatccagcatcacaaaggaatcgaaagtcaatactaatgggcctctacacagtaaattcagcatatatacgtttggtgggtcctcatatgtgtttgttgggtcctccagttttatcattccaaacttagatcaatcctcatcagttggaagggagagaataatctgatgtagcaagacgttttaaaaccgaattcttcagccagggtcacctttttatattcacctctctttcatcagatctcatctattcttcgccgttgtcatttcctgctgctgcacatggaggtggtgtagcatactagtagcatgcaattcaccctgccgcgtcaccaacggcacgtggggttggtgaaccggtccatgtgtgcaatagtgcaagatccaggcttgattccccatcctagccgaacggtgaaatggagcaaaaaaagaagataaggaaaacaaattgcagaaccagtgtcaccactgggggtgtgtttagtttactccaaaattagaaatttagttgaaattgaaacgatgtgacgtaaaagttaaaagtttatgtatgtaggaaagttttgatgtgatggaaaagttagaagtttgaagaaatagtttggaactaaacttggcctgagacggataatactaaggccgagtttagttccaaattttttcttctaaattccaacttttccattacattaaaacttttctatatacacaaacttctaacttttccattacatcattctaattttaaccaaactttcagttttaacgtgaaataaacgttactgccatttgtggccgtgaaattgttctgaactctgaaggtgggcactgaatcagcagcagtatcaatagtatcatatcggatgtatttgatgtcctcttccgtctgaatctattgactcttttgaagcgccgtgatctaaagtaggcagctcagagattactccctccgtctaaaaaaagacaaacactgggtttccgtgtctaaatttaactgttcgtcttatatgaaattttttatagttcgtatttttattgttgttagatgataaaacatgattaatattttatgcgtaacttatctttttaatttttttcataatttttttaaataagatggacggtcaaatgttgagcatgaaaaccagggtttgtcttttttttttagggcggagggagtatgtgatatgaatggtccatgagtgagctatagctcactggctcactgcaatcagtgtgaaaataaacgtttggttcacatgagcgcactctgtggtttcccagtcttggcctttggctgttgtcgccgcactactgtctactgctgcccgagctgcaggtgcagtacaaatccaagccccaatcatgaaccggttcatggtggtccagggatgacgtccagtgacgtagggtagccaagcatgttcatcattctgcccttcccggcctaatctttcgtgcgatgagtgaattccccagccacaccgacagaaatgcctctgggactcggatgcatgatgctccaagatccacatggctgacactgatcatagcgtgggagttcatcagatcaccatgctactctcgtctgcagcaatggccactcagtggttctcaagaggcagagagaaaaatattaatgctaatgataaaaaccttcgtgcaatgatgcaggatcccatgcatgcgcaggagcgataattctctatctgaaccagattaatcagcctgctttgaatgcaagcttctgccggtctggaatctactactgctattataggagagaagattgcagtgccacccttgccacatggtcgaagcgagaacgaagctgctagtagggaacatgaacacaactaacctgaaaattcttgacaaaaaataaaaaaactaacctgaaaatggtactagtgcagatccaaaggcctactactgcctctcctctcctttgcattatcgcgatggcacgatctcttatgtcaggtatcggaagcagaaaaatcctgtgtctttctgggtgtgttcagttgacgttaaaattgaaagtttgattgaaattgaaacaatgtgatgaaaaagttgaaagtttatgtgtgtaggaaagttttgatatgagggaaaaataaagagtttaaagaaaaggttgataactaaaccaggcctatgtctctaggacatttagcattgggccacgtttaagatgtggcaattaattatttgtcacttgctgtctatgatatatgggtccttatgtctctatgacatgtgggcccttatgcgtctatcacatatgggtctaggggcagattatttatcaccatccgtaagagtggcaaataattaattaatcctctgtctgttgggccacattcgggagcattggcactttggcagccagtgagtcaagcctgtgtgtttactactgtggccaccgacgagagagtgaggcagtgagacgggtggagacgagcggtggacgccgcgcgccgcggccggggagcaacgggcgttacggcgcacatggcgcgccccggtggaggacaagccggacgcagcagaggccgcttttccccccgttgcacagctgggatgtacgtcccctttaccaccagtcttcccccatcatttctcgccgcgcgggccctgatgcgttttcctgctggatttctatccgtttaccacttgatcgctcgctcgctcgatctgctctcctctgttcatcaccacgtccacttcatctgcaactgtgcctgcacgatcgaattggttgtttgccagaaactggctggctaatctaggggagaacgctacatgtgaagtgtggaacagctgagcgagcaagaacgacgaatcgacgacaccatgcgtgacagatgtactgaccgatctacgacgatcacggagaagaccgtgagtacacgccctgaggaattttcctaatcgtgtcgagctcaacaatagctgtgccgcagcacatctactgactactgttattactggtcttctcgtcttctgctgcaatgtgagctggggcaaacactgtagtttggacctagcgaggacatgctgcttccatccatcgagtagtagtagttgcagtatgtcttcgtctcgagcatgagcacgctagctcgactctacctactctaaccagcatgcgcggctgtccgttgttattagcggcttaaaaggcgtccaggcctttttccccactcgatccccatgtgtattcttgtccggacctcaaacataattaaccgaaggtgaagcttgaaaaaggctaacctgtcctcctgtccatttcttgcataatttacctctaaccatttcggctaccttcagatctagccatcaatcaatcaattaataagggcatttccaccccaataactagaatggtgttcatagcattaaataagttgctatctaggacaaaaaaataatatggcaagtgaataaaatgagaaaagagaaggaaaacatgtcttgcatgagacatggttcctacacaacatccaagacattatgtgagataagtagcattaaattaaagtatgaaatagtggtgtttgcattgtaagagtagtgtctagtattagtttcttgataatgtggagtttataaaaaccatatctagtgttatgggttgggactgtcctagctcatctaatcacagcaaacacggttacagctaattaatgaaccaacgtcaccaaagtaccaaaccgagctaaagcgttcaactgcagtgcaaatgtgcaaatgcaacggatgagttggtacactagtgctgtctcgcactggacactggtcatccgctccaaaaagatcctgtggtagctagtgtacctggctgcctttgtgtgcagtcatgcgttgctcgcctcatcgcctgtgtggccgagagactttactgaccaagcaattcaggtcggcagagtttgttacgtcctccaaggagaggaccatgcaattgcatgttgcgaaagcagaaaactggagagaccggggcacgctgtcggcgtcatgctacaagcgttcccttgcgtgtatgcatcgtccacctagtcacttggatgagagatttgaggggaacaaggctacaaaagtacaggtttgttatcgacaattatttggtctaagtgtagctgaaaacagtcgcgcgtatagcacgtttgattaatgctcagtcaccattttgtttcggtttacatgctaacaaaagtagggtatatcacgtcgttgaagtttacattttgtaacactcaatccagtagtccagtcaataaagaattttttttcattaaaaaggtgttttttttaacttattgtagtcacaggtggtgtttggatccagggacttaactttagtccatatatttagacactaatttagagtattaaatataaattacttacaaaactaattcaataaatgaaagctaatttgcgagacaaattttttatgtttaattaatccataattagagaatgtttactgtagcatcacatagactaatcatggattaattaggctcaatagattcgtctcgtgaattagtccaagattatggatggattttattaatagtctacgtttaatatttataattagtgttcaaacatccgatgtgatagggacttaaaaagtttagtcccatctaaacagggccacagtctatgtggagcatgttcaccgaacaccgataaatattgcaaagcccagaatgattttggtcccacatgccagaaactaccacacccacatttcggttcattttcagctcaggaaaatcgtccaacaatttcagctcaggaaattaaatcgtccgagaaaggaacaagtttggagccgttgggatgagagcaattaggtcacgcttaactacaagtacagtctcattcatcgacattgattagccagcaactaaccacttaaccccgagccagcccaagcgctccgtacgttcgttgggcccccgccgcgcaggcggagacaacggtcatccggcgcgccggtcgctctccctcgctcgcacggccgcaccacccacttcgccacgaacccgacgcgagcgcgacgtgcatctcccaacatccccgccatttcctccccacccaaaaccaacccgcccgcgtgcggctggcccactttacagcgcctcacctcccccaaccataaatccccgcccttttccccccctctccaccactcaccacgctctccactacacgactcgtcgccgtcttgctctgctgcctctcgcgcccgcgcagcagtgagcagcagcaagagcagcaaaatggctctacccgggcgcctccgcgccctcatcctcgccgtcgcattgccgctgctcttcctgtccgcttcaggtaacgagagatttggcaatgcaggtggtttagtggagagtagtgtggttgattgttgggttggtttggttacagaggcgggcacggtggggatcaactatgggagggtggcgaacgacctgcccaacccggcggcggtggtgcagctgatgaagcagcagggcatcgcgcaggtgaagctgtacgacaccgagccgaccgtgctgcgggcgctggccaacaccggcatcaaggtggtggtcgcgctgcccaacgagcagctgctcgccgcggcgtcgcgcccgtcgtacgcgctcgcctgggtgcgccgcaacgtcgcagcgtactacccggccacgcagatccagggcatcgccgtcgggaacgaggtgttcgcctcggccaagaacctcacggcgcagctcgtcccggcgatgaccaacgtgcacgccgcgctggcgaggctcagccttgacaagcccgtcaaggtgtcgtcccccatcgcgctcaccgcgctcgccggctcgtacccgccgtcggccggcgtgttccgggaggacctcgcccaggcggtcatgaagcccatgctcgacttcctcgcgcagaccggctcgtacctcatggtgaacgcgtacccgttcttcgcgtactctggcaatgccgacgtcatctccctcgactacgcgctgttccgccccaacgccggcgtgctcgactccgggagcggcctcaagtactacagcctcctcgacgcccagctcgacgccgtgttcaccgcggtgagcaagcttgggaactacaatgccgtgcgcgtcgtggtgtcggagaccgggtggccgtccaagggtgacgccaaggagaccggcgccgcggcggccaacgccgcggcctacaacggcaacctggtgcgccgcgtcctctccggcaacgccggaacgccgcgccgccccgacgccgacatggacgtgtacctcttcgctctcttcaacgagaaccagaagcccggaccgacctccgagcgcaactacggcgtgttctacccgaaccagcagaaggtctacgacgtcgagttcgtcctcggcggcaactccgctggcggcggcggcagcagcggcaaggacaacggcgggctcggctggcaggacaacggcggggtaaacgccggcaatgcgccggccggcgcaggcggcggcgtgaaggcgacgtcgaccggtgaggcgtggtgcgtggcgaacgccatggccggggaggagcggctgcagaaggcgctggactacgcgtgcgggccgggcggcgcggactgcaaggccatccagcccggcgcggcgtgcttcgagccgaacaccatggtcgcccacgcctcctacgccttcaacgactactaccagcgaaagggccgcaccattggcacctgcgacttcgccggcgccgcctacgtcgtcaaccaagcgccaagtgagtagtcttcgcgctcgtttgctcgtacaattacctcattgcattcgtactacttctacatgattccttgcgtttcgtagcgaaatgtacgtgttatacgaacgggtgtagggcttggtacacgctagtacacgttacacaacctggattgggccatcgtgttccggtaaaagtttgcgtaggaactactactacttgtacatggtgattcacagatgggtgggtcacagtacgggtgcaaatgaaaggcgctttgcatcggcatcgtacgggaatgattctcgcttcactgtagtcttcgcagccacacactggcatgtgccacacgattcacacccatggcttcctgcctgggttaaacacaccttggaaagacgcagccggcggttgcaacttgcaaaattgcgactgcaagcagccgctactgtgtctctgtgaccaacaaatcttcactgcggttttgaggtctcgttgcattggattcgagctgtaggtgttctgcttcttctgcattgcactgcggtagttaatgagtggctcagcaagttgtaaacccgcacaagtgcaattatgactgcgatgagatggggtcagcgtggctcgcagctcgacgtgatatgactcgtcctgtattctttactcccttcattcatggtgatgcgtgccgtggctggatgtcgcaggctcgcaacgtgtgactgattgccactatcgtgtcgtgtaccttttgcagttcgtactcctactacctgcatcaatttttttacagtattcctccacttgttattccctcggttaccgccagtatacgcgtctcctcctttggaccagcactacaattggtctcttgttcacatgatagcagcgatttaccagttttttaatcgcgtaataccaccctgttgtatgattctttctttttgaaccgtgatcttactgggtgattgtctattccattgtttgcagagatgggcaagtgtgagctcccgtcgacggtctgaaccgaagcaacagtagcgaaagactgaagaagagcagcggcagcagccatctcgggatgcgaggatttatgaaagaaaatcgaacgccggacagaggaaggagggaaaagaggcagagatgttggaatctttgcttttcttttccagttttcctccctttctttacctgtggtgctgtgcccgctgcttgactcctgctgcatgtttgctgcggcgtagaaacagattactgtagtagctgtacctctttctttttgcagctttggctaatggtgggggatatctttgtttagtccatgtaactacgctggagtatggagtattactatatgattaacctaaatcactactattatagactgatttgtactagccattggttggccatgtgagtgacccactatggcttgtctcgagggccttgttgcctggtttgactcttcctcctccatcgtctggtggatttataccggaaatggtgctttgctttgaagccaattcgaccggcattagagtttcaaacccatgatagcgttgtgccctcgtctcgtctcgtgctttgcaattgtttcgctttcaggctacgcttttgtgaacgtccgtgagtttgttaaaaatcagttagtagtaggttggtttgaaatccgtcgttgggatttctgcgtacttctcctttacaaggagaaatttcgtgccaaactgctctggaaagatccacatagtaacgtccctttttacagtagtatttcctgatcaggcccactcacaaagttgacaggccgttgatcccaacttctcacgacaatcaccagatcaccactagtgtttgtgaccagctaatctaaaatgtcgcgttgacacgcacttgcgacgtacgacgctgatctaactagaaaaggctcgcgttgccaccggctccccacccgaccacggcacacgttgtctcgaggcctttcggcaaccagccaaccacgcgacgtaccggccggggttgtgggcgtcgtgatgtcgtgcacggccacggctgcggcctccgggagtccggatcacatggagcttcgccttcgcgggacgtggcctcccttcggtacaaaaccgatctctgcctcgcctggctgcctcccccgcgacccgcgtgcgcgcgcatgtgagggaagctgccaagcggagccggcaggcgaggttgagctggaccaccgaatggaggaggagacgggagaatatcgggggtttcatcggtggttccccgtgaaaatccgtgccccgccggctggagggccacacgctgatatgcatgcagaggatacagttttttgtgactcgtactcccgtggtggattcgttttgtacctttggttcgttgtctcgtagcatcgcgtaggcggtacaaatcgtctttagcgaggcccggagcttaacatgctcggccgaaagagggcccgtttagttatcaattttttttccaaaaacatcacatcgatctttgaacacatgcatgaagcataaatctatctattatattattaaaacagctcgaaaagaagccaccacgttcgctgtggaagctaaaaattcctacattaatcgaagaaaaagaaaagaagagtccaaatagaaatacaaactaaaaaataactgaaattcggaattaaaaataagcaatactgaaataggagtccatataagaacccaatacgagattaattaaaacctttggtaattctagattttaactgtttacagtagaaaagataagtctatagatctgtactacgttacatactaggagtctttgtccttttctatttctttggcggtgtacacaatacacgtataatctaattcaattacaaacctatacggagaagagttgtgctgccaaataaacaaagcttgcactgctgcacctatatattctgtagatttcaagcatcaacgattgggctggagcggcagaacccaatgatagcgggagccaaccatagtaaaaagacatgatatttacatagacattacaacaaacagatcaatacttgcagccggcaatgcatcaaacaccaaaagtttctttgatgtttatgaaagtacaaatgatatcaacatattgtaattagtgtatatttttcacaggagatgagttagtgcaagccgctataaactgacagtcagattaaacgtttagattatagtggattcataatttaacgttcataatttaacggttgagatataacacctatatataaatataggaattagagttgtagtgctaatacaggtgtacaaagcgccttgctcgatggaataatcgagatccaattctaaaactgttatctaaacctatttgattccagtggaaaaaaaaagcaaaacaggaactaggtaggcagaaagccgtgtatatacgtgtgcacatgtaagtattattttttcagtctaatcacttcaaaactatttagaacatactgtgatatatttgttgccagtaaaaatgaagcgactgcctctttatctattcgatcctttttaatcaccaaatatacaaccagcaattcagatgttttataagtaactaattttgaaataataataataatgaagactatgaaaagaaaaaaccatctacaacacaacatgtgattaattaattttttttaaaaattatgaaattagaaaaataaaaacaaaagtttaagaaagaatacgatttatgaataacaaaagttcaaaacaaaaaaaaaagtattaaaagaacaacccgtaacacaacaatggtaaataacaataaagagggagggataacgggtgagccgtaaataaataaatagggtgtagcggttgatgggacattttaaaacaataaaaatataaatgacgattagattcaattttaaaaatctcaatgacgattaagagaaacagcagcgggcaagccatcaaggagcgcagtcgtgacgtttgaatggacttctaaaaagaaaaaaaaacaacgataatcataatatcatatttgactttttaaattccaatgacaactaagaggagacatcgggtggattgtagaacagtacaatgatgacatttgatgtaacttctaaaaatataaatatgtcaatcgacaagacaatgaattaaaaaactataagatctaaatatgaaagtttcaaagaggatgaataaaagttatgacaggtcgggcaatcaaataaatgagaggtaaaaaagtaaggggtgacgacttattgacttttaaaaactaacccgatgataataagattcaatcttttaagatcggctagatggctatttaacaaatttaaataaaaccatgcttaaaaatatataatcctggatgggtgctagccgcgcaacaaataaaggggttacaaaggagtaagggtagcaacaggtgtgacttttaaaaattataaaattataaacccggggatgataatgttcgatctttgaaagtcataaaacaacgagatagatatttaataaattttaagtagaatcatgtgaaaaattagataattttgtgggtgctagccgcgcaattgcgcgggccacccagctagttatataattaaaggaatagaaaaaggagcctccacgttcgctctcgtggcctagaaattctcacattaatcggagaaaaggaaaaggcatagtacatatagaaatacaatttagaaatagctgaaattcggaattaaaaaataaggaatactagaagaggagactagagtccatatagaaatacaatttagaaatagctgaaattcggaattaaaaaataagaaatattagaagaggagactagagtccatatagaaatacaattaagaaatagttaaaatttggaattaaaaaataagaaatattagaagaggagactagagtccatatagaaatacaattaagaaatagttgaaatttggaattaaaaaataaggaatgttagaagaggagactagagtctatataaaaatataattaggaaataattgaaattcggaattaaaaataaggaatattagaggtagagtatggagtccatatagaaatacaattagaaaataaccgaaattcagaattaaaaataagaaatattagaagtagactatagagtccatatagaaatacaattaagaaaaaaaatagaaatttggaattaaaaaataaggaatattagaagtagagtatagagttcatattggaatttaaatccaactaaaattcagaataaaaaggagcctccatgttcgctctcatggcctagaaattctcacattaatcagagaacaagaaaaagcagagtccatataaaaatacaatctagaaatagctgaaattcagaattaaaaaataaggaatattagaagaggagactagagtagttattacacattagtagttttgaaaagttattgcaaaatttaaaattatgttgtcattgtaatatattttaataatataatgagaaaacatatgtgctattatatgagagaaaatataatgatgctagccgcacaatctgcgcgggcccccatgctagtatagataaaaagaaaaattaattgcacagttatgggggaaatcgcgagatgaatcttttaagcctaattagttcatgattagccataagtgctactgtaacctacatgtgctaatgacggcttaattagtctcaaaaaattcgtctcgcggtttccaggtgagttctgaaattagttttttcattcgtgtccaaaaaccccttccgatattcgatcaaacgttcgatgtgacagccaagaatttcattttccccaactaaacacacccagaaaagcacagatgtgtcgacgagacattatacaacaaggcccatctaaggcgacagcggaagtagcataaaacaacattagcacaaggcccatctaacgtggtagccattgaagcacagaacaatacgattagagcgcccgttacacacacttgagtacttgacgcgatacttacatccccaggttacgtacacacactagtagtagtctagtacgtaaaaacattacgcagaaaaacacgggacggcatgtacagcaccacgtacactaccgtacacatcccatatatctggatcatggcacgcgcagccgtagctagtgaagtctgatccttatcaagcggtggcgatgggcgccgcgtggacgacctcggcggcggacttcatggcctcgaagcgtggctccttggcctcgaacttgtggcgcacgtacaggttcatgtagtcctcgaacacgaacctcgggtaggcggccgccgccgcgtcggcggcggcgagcgcgggcgccgggaagatgacggcgtcggcgccggggttgtagaaggaggcgatggacatgcggttgccgtcggggcgcgtgaggacgcggtgcatgacgctcttgtacctgccgttggtgatcacctccagctggtcgccgatgttggcgacgatggcgtggcgcatgggcggcacgtccacccactccccgtccttgagcagctggaggccgctcacctggtcgtcctggaacagcaggatgatgccaccggcgtcggtgtgggcgcggaggccgtcgacgagatcggggcgcgggcacggcgggtagctgctcaccttggtgccgaacgttgggccgttcgacccggcgaaggccttcttcaggtaacccttctccaggcccagattctcgcacagcaggtccagcaccctctccgagagcttctcgatctccgacgcaaattgcttcatcacctgcctacacaaacgcgacacatgggcttctgttaggcctcgcgaatattcacaagtcacttgccatttgccaaaagcgaatccagttagtgtgagttctgattgattgatagttactgcacgttgtatgatgtatactcctctccgggggaaaacagaaaaaaaatggtgtattcctacacttgttactatctcatagtaggaaagggtgcagagatgcgccactacgtccgttcaagagtaatcgacgctgtggataagccgcagtaaaaaagtaagcatctccttttggtcgataatcctgtcacctttggttgcagtagctgtttacagaagtgggcatttctatagtagagcgcgtcgtgtcaggtgtaactttgttgaggttttggtcaggcctacactctacagtagctaggatactttgtaagcctttgctttgtgagtgtactacttccgattaaaatactgacgatcatttaggcgagtttgcaacttaagcttttctttcagaagcatgcagataaattaacaaagactaaattgagtttgttaatgatgattgatgatgacgcatgcatgcagggtaagtatacctgtagtggtcgtcgacgtcggggaggtcggcgaggttggagacggggcggtggcggacgaagaaggtgctctcccagtcgatgcccttcacgtcggcgcccttctcgccggcctccagcatccgccgcgcgaactccttgaacttctcctcccggcagttggcgtagtgcgccttgctcacccgctccacctcgtccatcagctcgtgcgcgatgccatggttcagcatctgcattcacacatgttaatttcgacatgcaaagttaatactttgacaagcatgacaaatcaaagctaattagtaggcgttctagccggcgagcctactgagatgataagattgaattggtgggtcgactgactaagatggagaataagaatatgtttccatcctttcggccagaaagaacgatgtacgtataggtggctcgatgaacaaaaaaaaatcgaaacatatcaataagttgtgcggccacttaggaattagctagaatcatattaacatttttttgctggttagtacatgctagtgcttggcatgcatatgcacctcgaagaagccccagttctcgcaggcgtcgcggatgacctccattgctgcgcccctctcctcggtctccaggttctccatgttgatcaccgggaaggaggcaacactcgccatctctgtctctctctctcgttcactcgctcgctcgcttaagctgagtgtgtgagtgcgtctgtgtgtctgtgtgtgcactctgaggccggcggcgagcgcccaatttataggcgcgagagcgagaagctagcttgcacagttatctttttcactaggctgactgcctgacccccaggacgtggtgtgcggtatgccttacttcctacatctcaaaataagtgcagccatggttttccgcatctaactttaaccgttcgtcttatttgaaaatttttttaaaaaaattaaaaacataagtcacgagtaaagtactattcatgttttatcatctcataacaacaaaaatactaattataaaaaagtttcaaataagacggacgatcaaagttggacgcggaaacttatggctacacttattatggcacggaggtagtacgagtttacgacaaagtttagtgatttggtccaacggagagtaaagtagtgtggacgtaagcaagctaagctaagctaagctgctaatctgattatctgatctgatcacactgtgtcctgtgcacgccgcaggttgagttcatgccggttacccgacacagtcacaaaaaggttctccacaagatttgctcttactcctaattaatgtctaatgcctttgtgatgtagtagtactatagtgtaatactataatggtagtggtggttactattctatatacctaacctaagtgatcaactctattaagtagagaactacagatcgataagagactgttccttgctttttggatttgatgatgacagaattttgggcatagtacacctggcccagacctgatcaatttgatttgtcaaatgtagacttcacatggctaggtcctatggacacatatcaggttttttaaaaagggtgtggcaatttattatattaaagaagatataacattttaagaaaaaaaatatcaaaccatacattatgcaaaaaaaacatacagtgcttagtttgttaggaaaaaaccgtacattgtgtccggccaataccacctctataaccacctactaaaccgaacaagccaacctcctctaaaggcttccctgcttcacgttgattagtccacgttcaaaacaaaccgaccaacctcatcctatcaaatcagctctctaggcaccaaccgatgcccacatggagcaagagtgtcgtctgtgatggctcgctcttgccgtcagtgtttatggatcgagaaaatatgaattgaattcatagaagaaaaatatctgtattaggcagagagagaaagaaaaagaatgtgagaggagaggagagggcaggcatcggaagtgggtgggtgacgttgccgatggtggcaaggtggtgagctaggaaggtggttcagacctggtggagtcgcctcctggattgctcatgtacatattgtactatgtatttacaagccgtcgctcatcgtcgttgtcaacctgtgcagtagcagctcgacgacggccacctcgacccgtccgcagtggtggcccgacgaaggccgcctcgatccacatctgcctcaacctccttgtcgtgtcgatctggtcgacgttgtccgattcgaggctccaccgaggagaggaccgccggatggggggagaggtgaggccgccagccatcggaggagagaagaggaagaggagctcaagctcgaggccgccggatggggagaggcaggaccgccgactgtgggaggagaggagatgtggagccccggcgaagtgtgggcgaggtgggaggcgaccggatagggtttggataagcatatctatgtggctgtttttcgaaaaaaaaaaattcgtattttttatgtttacagcgctacccctaaaagcgaaattttctcatcttagcgttgtacttgtctgaaacacgaagggttttccgtaagaaacacaacagcatgtttgcgatacgtgaattacaaataaactggaggacatttttgccgattcccactcgaggagtcctgtatactagaaaaacatgtgtcgcctaaagagaagagcaaaaaaaatattgaaaaaacagagaaaaacggagccctacgaactgctaatatctatagatgtaccaactgataccatgaggttgcatgagatttaacaccaaacaggcacacgctttcttgttgattatttgataccaaattattttttggttatccagtgtatttttttcttaaactaattgatatcttccagtaaaattcagttgaaaactcttgaggcttaaacagatctcatttcagtcagtacacaagcattacatgatgcttaattacttgcatcaatggaaccaattactcttttttgctgttgctggactggaccccgagaccccagtcccaacgattggttgattgtcctgtcgttcctgttcatctctgatcatgtcccttcttcctcatctctgctttctccatcatgtaggggccggaagaactcctatatccacccatcgctgcgatctccacttgacttttctggacccatctcattgcctcgctggtgtacatgcatcaatgcatgcatggtgacggtgcgcactgatcggccggcgcccgttcaacttgtcgcgccgcaaggaccaatatgtctcctgcccggccgtgagtgcgctctgctttccttggtcgcgccggttttggggatcgcccgaacaaacgtgccctggcctatactgggctcaccggcactccggtaggttcagtgcattcgtccggaaaagaaaaataaaaacgtgtacatacaaaaagttgtcctcaaaatatagttagtgtttattccctagaaatatagaaaccggttctgatgaaccctaattagttattttccgtaagcacttctacgatatgaatgaatgataatgtcactatttgtttatatggcaaaaactgttgttggccgaagcactcccttcgtcatttctgtttcctactgacgatctccggaccaactgctagcgtatgttctttttctttttcaaaccgtcccactaatcaaaatgtacttagctaatttgatgtatatatatcaccatcctcgtcattagcggcaaaaccaccgtacggacaggttggacggtcgccgagcttcgtcacttcgatttcaatgacgactaacgttgatatcttaaagaagtggtcgaccactataacgccggccctggtttgacaatgccgtcgactctctcactgctcatcatggtttattgggcatacatcttactagattatttggacctgttttaatttcatatttagagggtacaatatccgggccatttctatattcaaggttttaggaaaatcaaccatagtactttagagtttagagtgacggtagtctgtttctaaaaaaaaaagaaagaaaaataaggtgcaagtggtgatgtctaagtggttcaatcattcttgacgtatgacatagggaatgtttggtcggatatgtagaaatctttttcattatcacagtagatcttcaaaaaaagaagactttgtatcgactaaagtatatacttcgactttcatgcgctagaactttagctcgtaaacataaaagtacggtacgagcttttaagcaatggttgggttcggtattttaagaagtttgggatacaatgataaatgtagcggcaatattataggggttttgccgttgtgctgcagtggggagctcatggaacagtatcttttgcaacagtctcgggagaatgatcagtgtagaactgtagatgtgcaagttgccaaatatactcgaattgtgcccgaccgacacaataatagagggcagaataatattcagaacaagtctcctgcatactttggggttttgatctttcacaaattaattttttcataacataaatacgtactaccttataggaaacctcaaaatattctagcttagcagctgtcatacagagacatatctagagtatagttaggggtgttaactttagtcccagccacatcggatatttagatactaatttagagtattaaacatagactatttataaaacaaattacataaataagagctaattcgcgtgacatattttttaagcctaattaatccataattagcacatgtttattgtagcatcacatgggttaattatgaattaattaggctcaataggtttatctcacaaattagtccagggttatggaatgtgttttatcaatagtctacgttcaatacttctaattattgtctaaacattcgatgtgacaggggctaaaaattttatcccatccaaacccctcctaagcagagatcttaaacctcagttaattttatactatctgggggcaaatgactaccttacaatttttacttttttaatctttctacgtggtagtagatattttgctcctactcatgctacggattgagatcctctgagttactgacatgtgggccttctttgctatggacccacatgttagtgactgttaagtcacttgacttaagtagaggatctcaatcgagctacttcttaccttcatccttgttgtcatggcttttaatcgtactagtaggttacgcgtctaggagtaccatgtattatgtactactaacatacttcttcttttcatattataagatgctttaacttttttttcctaaattaaatttatctaagtttaactaagtttatatgaaaaaatttcaaaccataccaatatactattaaactatatttaatgttagatttaatgtgactaatttagtgttgtagaagttgctatatattttcataaaaaaattggaataatatattttcataaattcgacccaatctattcaaatttaactaataaaattaaagcatcttgtaatataaacggaggacatgatatagggcatgtttagtttgcgaaatgaaaatttttgggtgtcacattggatgtttgaccgaatgtcggaaggggttttcggacacaaatgaaaaaactaatttcataactcgcatggaaaccgcgagacgaatcttttgagcctaattaatccgtcattagcacatatgggttactgtagcacttatggctaatcatggactaattaggctcagaagattcgtctcgcgatttcccccttaactgtgtaactagtttctcttttaatctatatttaatgctctatacatacatccaaaaaattcgatgtgatatttttgggaaaaatttttggggaactaaacagagcagaaagggatcctctgacttaactgctgtgcagttgagtcacagttaagtcagaggatctgcttccaaacggggccataatatgaaacggaggaactatagtatttgggaccccggctggccaaggcagtaatcataagagcaccgtcacgtcgcgctccgccacgacagtacgacggatcacctgtgcagcggccctacgaaatgaacgggagctaattagctagctaggcacgggtgatgggtcgccggcctccatcgcaatcgcgacggggtcgcgtgaccggcggcccccgtgaagacgacgtgggcgcgcgcgcgcgcgcgtccgtctcgcgtgcaccagctagcagctgcgcgcgaccaagatcgggttacaacagtcgaccagaaactggtggacgacaactcggcaactggcttgcatgcgccgttgcgtcggcgtctgcgtccaaaagagaaatcgctgtaggatgatttgtatatatataaacgagttgtagctagatgatatgatccataagttgccattggtgattggtcacactcttccggaatatgatatatcattatatttactgtcacgaagagtacgtacgtaccaccgaactctatcacatccactttctgaactacaaaacggcgtagttttttttttaaaaaaaaatctatgcatgaatattttgtaatactattttaaatatgtttttaactttataataagttaatggagaggtatacctatagccctaccaaacggtctgagcttcaccttaaaaacagaaagttgagctagttcccgctctacaattctacttaagattttaaaaatggagatgagattaggctgctccacaattctacttaagttttaaaaattatggtcacttttattatcccttggatgatagacaatgtttctcataactattatatcacttatcgctttccaatgattcaacaataaattatgataacatacaaaaaaaattgtaaaattatatgtaataagcttatatatggttaaaataaacagaaacttacaaattttaagacctcgatatctaggagaacctctatgttttaggcggaacactagtagtcctttgggtgggacgttgcgaaacccataggggctagttttcttttaaatttcactatggttgtgttctcttaagtcctggatcaccgaacagatttagatttcttataattattcgaggatagaaatgaatgaattaactagaaagtatctacatactatatttaaggtaattatttttttataagaaaacagtcattttttcctgatagcaattaatttaatggttttcatatctctcactattccttatccaaaataaagttgccgcattcttagctaggtaaaaggatgacaacggattactctaagctacacataaagtaaatttaccatccataattattttataaaattagatgcaaaaatattcagacttataaaaaaaggtaaaccatatataataagaaaaacaatgaaattgcagttaaaatgaactaaaacaacatattgcacatattataactctagacatagcaatatataaattttacgtgactaagatctatcaattcccttttgttacatcaggaaaacatatatatatagttagtacccactaattcgtaaagctcaacataaagtatgctacatcatcatccactagcaattattatctacagtattttagatctcatacaaacatgatatatcatttgtaatttagttttatttttagaacttagcatgcaagcaatataaaattaccatcttcacattatttaaacatatacacctatcatttttataatgtataacatacattcatccacatatcccgcagcaaagcgcggggtatcaactagtatcaaggaaaaggtggaccataggattattcgcgcgtacacccatccaagtaacagtgtttggctttgcaaagccaccggccggcaaaaagatcacaggcatgcatggcttctgttattgatatttgtccgagtgtctggaatctaattctaggtgtgtttagttcacgttaaaattggaagtttggttgaaattggaacgatgtgatggagaagttaaaagtttatgtgtaaaaaagttttgatgtgatggaaaagttggaagtttaaagaaaaaatttagatctaaactcggcctctatgtacgcgcacgaagtgcagtaaaaaaaacacatagctagtggctatggagattttattccgttatacccgctatatatgatatggagaattgcgcaagtcaagattcagagaattacgaagtgcaccaaaatgcttcaacgaagcggcagacattgaaaacgttctcaagctgcagtcactgaaaactcagaatatataattgcgagagtgcgagactttcatgcaatggacaagatcaagaacggggtgcctggatatataccgatcatcgttcgctgtagcctatccagatgccgtgtgatcgtgccaagacgtttctctgctttcgcaactttcaaacttcagtaccggcctagatttcgatcttgcatatagccatgcaactccagtgcgaaaaacaaaaagggagatctaattgcgacgccggaaagatcctctcccatcgaggccacggcaccgagagcgtttgcaagatcgcgggtgaaagagatggagatcgatcggtgacgcgcgacgcgccgtccatccccgctgactgaccagtcggccgatcgctcgcgccgctgcgcttcgtcatcctgtcgctgctgtgaaacagagacgacctgaagctacgtgccgtcgccattaattccacgatagcgatacgactacgaggcggcgaaagacccagcaaaattttacactccggtagctgaatcctcagcaaaattccacgatagctgaacacgtttggccggaatcaccattcaccagtaggcagtaattaactagctagagtaccaattttttggaagcatgagccgacctccattgctccacgcgtgggacgctcgaaacactgctgctttccagctcgcacgctgcggtgttgcgtgcatttcatggcgtatcagcgtggtgtatagcctagggaatctggggatgttaacgtcaccggacgagccgtagaaacgagatctgtttttgtttggtgcgttgtcggcaatgcgtagctgatggaatgttggattaaagtaaagtctctcaccttacatggactctgcttgttcaagtggacctccctgttagctgcatactagtgttgttttttcatcttattatactttgtctcatcaaaattggtcagtgtcaacaagtggacagttaatgacatttgcatatatactagagttctatgtttatcactagtgtgtagagactatagtagcccataaactaatcaaggacttctttcagagaccaagtcagaatttagactctcgtttcaaagaaatatttcaaataaatttcacaaaacaacatatatatttgaactaaattattacaaaatggaagatttaagacggtagatcacaattataaatttactagtaaagttatcactaaaactacaaatttcagacggagtatcacaaaactataaatttaatgaaaaagttgtcataaacctatatattctagaattcagatccatagaactattggattttagttacaaaagatatagtttgtgatgaaacttgatgtttaatcgatacaataccttaaacacatagtttcatgataaattaggtttgaatttatagtttttttatatatctttttaaaattttaataaactagcatggtggcccgcacagattgtgtggctagcatcattatatttttctctcatataatagtatatatatttttctaatttattgttaaaatatattaaaatgataatataattttaagagtatagtgtaccagcggttcttaaacttgtaggggtgtgtcatctaggtctttaaaatctcaaaatgcatatccaaatcccaaaatttgtcatagtgtgtcatctaggtcccaaatcgtcacaacctcttcaggatcctacgtggcgttgatgtggcatcattttaattgacaaataggacccatttaaaattgttcctttttatttttttttcttctcttttttccctttcttctcctttctctctgacccacgcggacgaacggatacctagaggattgagctgggaaccaagtacaaagggaatggtacacggaagggatgaatgcctggatgacacgtcacgtccatgtggcatgccacattagtgccacgtagatcctataggggatgtgtcgatttgggacctagatgatatactttgacaagttctggaatctggatatgcattttgagagtttaaggacctatatgacacaaccctacaagtttaagtaccgccaatgcactttactctaattttaaattttgtactaactttaccaaattaccagtttgtaatattcatattgtattgtatatatgtgatagttattaatttttttaatatcaaattttagttatttctaaattatattcttatatggactctagagtcgtcttctaatattcattttttaattccgaattttcgttatttgtaaattgtatttctatatagactctaggctcttcttccaatattatttattttcaattctaaattttgaaaatttctttattgtatttatatgtggactctaaaatcatctttcaatattctttatttttatattttgaatttcagttacttctaaattgtatatctgtatggactttagattcttcttcctatttttaaaattttgaattttagttatttgtaaattatatttctatatggactccaaactctacttttaattttattatttttattccgaattttagctaattctaaattcctatatggactctatactatttttctaatattaaattcctatatggactctatgctatttttctaatttcagctatttaatatttaatcgatacaataccttaaacacatgttttcatgataaatttggtttaaatttatagttttgtaatatatcttttaaaattttaactgaattttgatctaagtatcagttgtttgtgaaattaatcaaacatttcagacccaggcaatgcagtcaatctgcctccaaaaacatgaattgcttttatttttacagccagccagatggtccacagacttgaaaacacatcgtaccttcagttgcagggcttgccggctatgaaagtagtactatgaaataagcacgtgagatacttgggattgtgatctcgggacatgctttcgtctagctgcttttccgaaaaaaaaaaattttgcccaacacgggaatctcaatctaatccgtcctgcagccaatgtttttccagatcacacacgacacgaccttaattagccaacgttggtagacgcgaattttccttcctctttccgaagcaaagcgctttacaaaagctacgaaatactgcgattccatcgggataaaattgttctctttcatgaacatgttgggcagcttcatctatgcagttcgagtgagaattggatgttgccacttgttacttgttagtgcacgaatatatttgcatatgtgctcctagctgttaacctctaatgcggaattccagacaggaagaaagattgctgctcgatgaagacatgcaaactttcgatcggaatcaggttaactatactatcacgaagaaagtctagcatctgttctgttgcttgccaatctgtatttaaggtgacagggacgagggctaagcacttgagacctcatatctttaccactttagccacacaatttcttcagcatttcctgcatatctgcatcctttctctaccactgacgaactaattaagcaaattagaagccagaatctgaactctgtcgtgtcaactgcaacatcacaaaagaaaagtaactaatactattccatttcatcgtaacattagttgtttttgacttctttttctaatcaaatctttttatgtttaattatgtttatattaaatatatttaatattatgcttgtctcgtgttagaattgttgttatattttctataaactttatcaaacttagataagtttgactagggcaaaagttaaaacgatttatgataaaaacaaaagcagcagtagctactgcaccagtacacacaactaggcgtaggaaggtggccaatcttattgtcctatccttgcacgaaccagcctaacttgcgatatctgaactgggcagatcgaaaatattcgatgtttcatccggttctccgggaaagctggaaaaaggacgaaaggaggagtgaacgataagggatagatagcgaatctgcggcccatgcggctgtttacgtgcagtaggcccgagccatcgcgtatccggggcatatgggcatggctcgcctgatccaaatatccagtgaatgatggatgaaattatatgcattatgggctctgcaaacgaaaccatagccatagcgatacatatttctgatgagttattccaaaagaatcaagatggtgcttaattaatttcaaatgtccttgcatggtaacatacactagggcagaactggcatccactagcttaggcactttgatacgaagtagagtatatcgtacagtacatataatgatatactccatataaactggccagtggcaggctcaggccgatgaggagaatgtcgacatggtactattcccaggagtacttcccatacttttgtgtgtgcatgcgaagtgaaagaaaagatcaatccgcactttgctctcctatcatagaaagcccatatggctttcactagtcacgcacgctcgcttcctgcaaatagcagccgcatgcgtatatagtactagctgccattggcaaagtccaccaccggtgcactatcgcgctgtctactcctgtgtcgtgacgacgaggagaccctaccactgattcacgagtagaggagagtgtggtaaattattggcctcgctcgccggcatccccgtggcgtttcgcgaagcggcggacttggctctttggctggcaccctgaacagataagcggataacgcgacgggactcttgatagttgatacggagtacgtcacgtctcgatcgatcgatcgatcgatcggtcgattccccggtgtactgttgttgcaaacagctgtgcttgtgcggtacagatcggagacgagacggcacgtcgtagcaggccggaacacactagttagccgagaccgcgacgtgattggacttggacacgatcgacgcgaacgcacgcacgccgcgctcgcccggggagtgcacggcagacgggctgagcaccacgcacgcacgaacgcacgcagcggcgtcgacgagaacacgagattcacccggccgcgctcgtgaagggccgagccaacggacgacgtcccctgactaccaggccgcaccgctgcacgggccgctgctgtttccgcgtttcggttttgcagggaataagttcacttttggtctctctatttgtcgtccagtctgattttcgtccctgaaccacaaaaccgggtacaacccgtcccccaacttacgaaagaggtccctcagcgattttgatagcggttttggttgacgtggcgcttacgtggctcatttgactcagtctttatctgacatggtactgacgtggcgcttacgtggcaatttgatctggaaaacaaactcgtgggacccacatatcagttgcacatacaaaataataaaaataatgatgggccccatatgtcaccctatttctcccctcttactgtatctgttatctctatcctctctctcagtccctggtgggagaggaccacgtgaggtccgccgtgccaaggctcgggaaggccgaaggctgacggcgctcaggaggcggacctcgccgtcgacgccgccgcatgctccgtgcactgccacgcctacgccggggatggtcgccgccggcagcaaggagctcctccgcaacgaggactgattcaccacggaggacgccgtggccatggacttccccaacatcgtcgccctcgctgagacgccgacggccaggacatcgccgccgccgccgctgccgaccacctcaaggccatctgagcgagctagctgctctcctcaaggccatccgtgcagcgccggcgtgccgcccagagatccttggcgtcgaggcggctgcagcggagacggcttcccgctcccgctgccgccgcggctccttgtggtgctcggtggcgtacgcttgcgggtgaaggtggcagagcagcaccccggacgtgtccgcctccaccctggccgacagctgcctcaaccgcgactccacccagccctgtgagctttggcccagagaaacaacaaaacacacgcgaggtcacacacgcacgaaggaatacacaagtgatgcaaatacttcaggggacaaacacgagcttgcggcgaactagctacacttccactcttatttctcagactcagtgatttgttagtcaagctacaacacatgcagttaccgatcattaagactaagcagtacttaactaatcaccacccacatggcgccggccttgacgatctcctggcagacgtcgtcgccgacggcgagctgctcggtggtgacgcgcagggtggcgtctgaggccgagctcgccgtcgtcgtgctcgatggcgcgcagcatcaccgggctgggccacttctaccgcgcaaagacgcggaagaagcgcgggagcagcatgctggggaggtgttggggtagagctggcacacgcgcgccacgaggatagcccagccgatgccgccgaggaagcctgcgacgttggagtagacgccccgcgccttagcccagtgcttcacgcaccgcagcatggtgcggaacgccgcggtgtccgggacaagccgcaggatctcgtcggccacgcggatgccgtgaggctgcgcgccgtggcgaggtcgtcaaggccgcggagcaccgaccggtcgcgctgaggtccactccaggttgtcgggcaccacgggaggcacacgccggcgtacacgagatccacctgtacaccgcggaacctcatctggatcaccggcaagggatgtggcggtggcgggagcggcggcggagtccgtggtggtggcgctgctggagagaggagagagagaggaaatgggatagagatgaagatgccgagagaagaggaggaaatgaggagtgaggatgacatgtgggacccatgtgggtcccactattttttatattattttatgtgtgcaactgacatgtgggtcccacgggttttattatttacccggatcaaattgccacataagcgccacgtcagtgccacgtcatatgaagaccaagtcaaattagccacgtcagccaaaaccgctatcaaaaccgtcgagggatctcgtttgccggttttcgtaagttgggggacgggtcgtacccggttttgcggttagggacgaaaatcagactggtcaacaaatagagagacctaaagtgaacttattccgttttgcagcgggggccgcgtccgtaggagtcgcggtgcccacggcccacagcttcgtaatgccatccagagttttgccatgtgggcctcggtgaatacgggctttatttcgactgttccacggccgatcgaatgaacttttcggttttcaaccttgcgagttgcgaagttgcgatacaccagcttttgtgtgatgaaatgaaacccggatcagccgaaagtgaccgacaaatttatgaacaagtgtgttgctttattatcagctaggagaaggccatatatatgtagcaaaagcaaccaaacatctcgatcggggccctgcagctttgcgatccgaacaggacactggatgcggatggatttggtaatcaaaaggaaaaggggtacctgaccggcgccaatcttggagaggatgttcgtttcgtgcgtgcaccgtgcgcctttgtaaagtgcccgaggttgctgtaccattggaggatgaaggatgaggtttgttggaaatgccgtggcagtcgtcagataatatataagataacgaacggacgggccactctgacagtgcatttgcttgttcatttgggagtttattaggagtagtccgaatgtttggttgctcgagcgtctatttttggaaattgaatttcatgttcttcgtcccggtatgtttcgtaatctcttttaccaatcattatattctctcatggactagccttcataatttgctctgtagcctttgcatatcgtgacatttttttcccaacccaaacgcgcccgatttgccccgtccggccacttgggagtagtatatcgaatcgctttcgcaaaggagacaactctgcagcaacgtcgcgtcccatccattggcccgcccggcattttgcatgctgtagatcgcctgtagctgagcgattgggcaacggcatgctattcaccggcaattaccactttacaaccaactcaaagtcttttttgctaaaattaaagtaaaaaggttgcaaacggataaacgatactctgaaaatgcacggttagtctgaaacttttgtgtttctgaatataaatcagggttggatacagtatcttttacccccaataagaagctagagttcatacgcaatgggacttcgtgttttttatcgtcaaaaggaaccatggtttctctgttcgacgactttgtgtaacgaacgccgcatgcatttctagttttcagaaccttgttaattgtgttcttttgtccaaaattgtaccagcatttggagtctatacggagcaaaccacttgataacttgcacttgcagcttacggcgatgatgactagtgaagccttctgcggcaaagcggcagtagtgactgttacagtgtgcccttcattgtctggagtgcagaaaatgatatctgcagggttccaaagtactgaaaatagttcagaacattgcacccaaatttgatttgttttctctttccggtaatccacagccaccgttttaggtaggatgatccactgttaaatgagagccacacacattgcaaaagcaaaacactacgacaggaggacaaatcgggtttcagagaatcggggggggggggggggggatccctttcccctttgtttattagtggcctgatgatgcagccttgcgcccttgcatatatagtttgcatgttgcatgcaggttttatctgatctgatctgctgcactatactggaatgcgactggagagccacgcgcgcgataatgcatcctgactaggcttgcagatggggagttttcgttggtcgtgcgagagcttaagggctaagggtgcgctcgtttcagtagttaggataggctgattagccgtacgtaaaacgagaaatatgattaacatataattaattaagtattaatatataaatttttgatgaataaatttcttggatttttttaaataacttctttatagaaagttttcgtacgaaatataccgtttagcagtttgaaaaacgtgctaacggaaaacgaggagaatctaatcctataagctgaaatgagcgtaccctaaggcctgtgtattgtgtaaataatgctgccttttgccattttggaatttcaaaatccccttttttttaaaaaagtgtttgtaaatacagtaagaaaacacaaactaaccgtgccttgtagactttgtagtggattctgtgctcagacaactttggtcaaaatccatacttacctataatcttctaggacgtctgaatttcttgacatggatctagatctgtcgcgacaatgaaactgatcaagattctaacattgaccttctgatccaatacggattatctggttgggtccaaatgtgtactgtaacttcttttccagattcaaagaggatggcgcttgctgccgtcgaccaagccacctggctgcggacttgcatgtggctcgatcaatcgttcacagcgtcaacgaacgatcaaaccacaatgcaattcgtagcgtgcacaccacgaacaccaagatagaagattgacctgacccgatcgatcgattgattgaccatgtttgctgctgctctttgatgctctgctcccgcttgtggtgttatctccacgagggttgctttcttgtcggtaccaaaccgcagatcagtggtcaaggacgggttaggaaaataagaactgtacaatgaaatggcccatagtccagtgaactgggcagtccttcagacgagtcatgctacgacagcaatacaatatgctgatggttttatgcatttctgctggattttacggttagagagctcagaccaaaagtcacctttcatggaagacaaaattttctaagagtagatgcagcttgtctgactttgtgtaacttataatcgtgctactgatatatgtatcatagtaaagtataatctgtatattagtaatttaattatagactgcacaaagtcatatgatctaagtttcgaaaacaattgcacataagagcgcgtattgaatttgcaggaattggtaaatcttccatatatgtgtctcatgaaactctcacgtgaccttggtccttgtacaagaggtcaagagcatgcggcgttaggctttgagcacggataaaacgccgcacttcgccagagctatcacatgaccaaacctgcgcatttacaagctaagtgtttcaacactaggtgaaatggatcgtcgcatcactctcgcctaaaaatttcctctctcagagccgtgccaacccacatcggtcacgctcatccacgaatttacaacttacaacgggacgcgtactgtcacgtacttgacgtacatagtgcccctctttatcctcccccaacttccgcctcccctctataagtaaccgtcactctcgccgagagtctctcatcccaccacacgacacgacacgagcgcgcgcgaacaccgtttctactaagcacaaacgcgacgaacacgcgcccaagaggaggatatgcagctggagatttcgccgagacagaggagccagcagcagaaggaggaggaaggcgagcaccagcagcgcgccggcgaggaggcggtgggcgccgtcttcagcattgagccgtgggtggacgccgcggcggtgctggtgccgccgcttaacttcgccgaggtgaacgacggcatcttccgctccgggttccccgccgccgacaacttcgcgttcctcctctccctcaagctacgctcgatcgtgtgagtcctatacctaggatctctttctcggccacggcgaccgtggcggcgagctcgtcgattacgtgttctgacggcggcggcgacgccttggcgtggttgatcggtgcaggtacctgtgcccggagccgtacccggaggagaacacgcggtttctggagcagaacggcatcaagcttcaccagttcggtattgacggcagcaaggtaaatgaacaagtcaaaaatcatatgcgttgagtcctttgattttctgctttattttccacggatggcaaagtcgatcttcgcatcgaattgttttttggtttttcggtcgatttggtgcgttctgcttgtggagataaataatttgcacacataatttgcaccgagaaatagcaactggtatcgcattacagtggatgcgagggttactttaggtagaacgcgctgtttacctgtttgacatgagcacgcacttgcgttttctgcgcgttgcctcgtgtcgtatggccatgagctcgttcgactactttccgttaaaaaaacatgggaactgacaactgatattgctgcttgcttcggcaaaacacttgggggcaacgcaactagggcaaacaacaactcaactagaacaaacaaaagtccctttcttgctttatctttgcccctttcagttagggcatttgcttgagtctttcaggctgaaaatgtttatcgtttttgggttttgttaacctaaattgacaaggttacgtggtgcatggtgactataaaacaccctgtttgagcaaaatgcatctagtgcgctactatttttatgttcttatttcactaattcgttttcccttctcacaaaatagtgtagaaaatctcattatggtaggagttattttttttacaatgcaaaacaacagtgtcagttaagcgggttcttgcgtcagcccagcacccatagaagattagaagttgtttacaatgctgcaaaagcgtatcttgctactggcctactgccattagcaacagtaaagcttatctttgttatgattattctggtagcgttgtgctacttttctagaagctagttcaaactgattggtagactcatggctaaggaaaatattttctatttcagcatcacgcatttcagggttaggagatttttgtctgcattatgccagtctggttctgagttttactgaatactgcaagctttaagggtaaaaaaaaaaaaagaaaacaccttaagcttaagtgatcagtgatgcagtacagcacaagttctactccctctatcaaaaaaaaaactaatcctaaatttgaatctagaaagacggagggagtagctgagaaatgatgggcttgtggagtctcctctgtgaattgggtgcctaaacaaagatcaagttgacttatgcccattattttttttaagagaacttatgtgaaaaaaaaagaggatcaagttgacttatagtataatcgcacctgtcttttaactgtcgagtgacgtctgaccagcgtaattctttcataaatttgttggccatgactttaattccgttattaaccagccacccaagattaccatttctctgtgtgccatgccatatttattctcattttactagtccttcactgaaagccattagtacggttttgtcaagctgtccatattaaaagttcatttaggcatagacgcatagtagccttggagtatgtcggtatattactccatctcgcaactttagtactcgtgtcatcgcgtggtagcatccaccgcaagtctgcaacaatgagaacatattccactgtcagttctgggttcatgaaggcatgaactgccacggcaaatggtcaaagttggtcagcgtcggcgacttaaggctgaggtcgttgcttgggttaggtattcatccctagttcatgcaaaatgacataactcattaacgtatgattaattaagttttagtttttttaaaaaaataaaattaatatgaatataaaatttaaattaactttcatatagatttcatatagatttttgttaaaaaaaacaccgttcagtaattaaaaaaatgtgcatgtgaaaatcgagtgagttaagttgggaccttcaaacaaaaaaaaactttcatcgttcattggcgattgttgctgtcgatgataaacaacacagatgtgctgaccaactttagcattcccagcaaaaaagaaatatatcgctgagtgaaaagacactgatcaggtggctgaccttactacaagtgtgtgaatggaaattagtgctcactttgacattgtctggagatgatgcttctttttcgccggactcaagctaggtgtctgaaaccactgaattacgagggtcaccggtaataattgtgtcactgctagatggattctaggatggtcactgctagatggattgtacggtggtgtttggatcaaggactaaactttagctcctgtcatatcggatgaatttagagtattaaacatagactacttataaaactaattacataaatgagagctaattcgcgtgacaaaatttttaagcctaattaatccataattagcgcatgtttactgtagcatcacataggctaattatgaattaattaggtttaatagattcgtctcgcgaattagtccggggtcatataataggttttattaatagtctatgtttaatatttataattagtgtccaaacatacgatgtgatatggactaaaaagttttagtcccatctaaacagggtctaagcttgtttctttgttaactagaaccaataatgtagtacatacttgagtggcatgacgatatctttgcatctgaactttcgataaaggtgaaccttatcagttaccgcattagcctgaaactgtgaaacaaattaaaacatccttctattgctataccatatcatcagtaattcagtatgcatccaactgaccattctcttcaatcctgttgactcttaaagttgatgcatagcctgacaataatctgaaccttgctgttacaggagctgcttgtaaacatccctgaagaaaaaatccgagaagcactcaaagttattcttggtatctgcctctacaaagatatatccaatgtctcaaaatttcatcacactatctgtatctaactcttatcgttttgatcaattcagacgtaaggaatcaaccggtgctcatccactgcaagagaggcaaggtagctatatctatttagcattgcacatccctgatatcccattttcttgaaaccttttgctacatgggaattcgacggtttcctgatattccacatgtttcagcaccggactggctgcgtcgttgggtgcctgagaaagttgcagaaatggtgcctaacttcagttttcgacgagtaccagcattttgcagcggcgaaggcgagaagtactgatcagagattcatggagctgtttgacacatccagcttgatgcacctgacggcctcacagtgttaaccgaaccgaatgttttttcatatccggtcccgatctgtaaccatgctgtctacctagcaacatattgtaatgttgctattgaaacaattcatcagagaataatgttagaaccatcattatcctcataaaagtatccatcaaaatacaaggccttcctcttttttttttgtactgcagagatacagtagtcgcagtctcgcagattctgacaaaatttggaagctggatacgtgaaattactgcatcgctaacatattacttcctagatgctgaaatttaggatcttgtactcgttttgaaatctgacaggaatgtgcttatgtgcaacaacaaaagatcttcttttggtgcaaaaattacctgttaacaggatggattgcactgaatactcgctaccccagtctcctgtgtcctgacttctgagccctagccaaaaggagcatcaaatttaggaggagaaaaaaggaaaaattatccatcgagtccagatgaatcctggggaaatcttaacaagaaggaataaaaacatgaagtgaagggcatcattggactgcatcctcagacttcaagataagatcttcatggagttcaagtcgatagggcgacaaacaattcagattcaaatttgcagattatttggatcaaagcctgaacagagaataggcccaacggccacctgtctggttcgcgcgttctcccgtcggatcccgcgatcgtccacgccagggtttacgattccgatgaaatcctgtcggatttcgcgaaattgtgacgtttcgatgaggctcaaaagtagaaaccgtctgagatttcgaagagtttcatccaaatttaaatttgaattgataaaaaaggaaaaaatcaaataaaatcttataaataatatgatattcatagaacctattgggatataatttttttgaaaaaaaatgatatattgtgtgtatttactgaaacttacatcaggaaagaaaagaataaagaattaaaaaaggaaaacacttagatgggccggattacttatcgaaattttgatgatttcgatcggaatttcaccaaaaccgatcggttttcaagaacttgtcggcaaactcagggaatttgtattcaaattttggtttatgaaatttgttcggaatttaccagttttccaccggatttcgcgaaattccgaattccaccggtgcccgaaacggaagcgtctgtcggaattgtaaaccctggtccacacactcccagctcagaccatgtttagatgggctttaatcccggcccacgtacatgtgtaggcctcgattttgaactaaaatgccggcccataaaatctttagcccaataagccatccgatcacgatcaaaaaatggacgatcggaaaatgaacggtggatgcgggctacgcaccgaaatccaacggtcgatgtaacccccaagaccccaacaagccctacaagctaatccaatatcacgccgcacggagaagtcccgagaccggcgccgccaggaccgccacccacctctgcctccgccctccaaaccctagctccggcgatggccccgaagcgccccactccgccgccgccgccgcctccggttgcctcctcagaggaaaccgcctccggctcggactcggacgagtcggaggaggaggaggaggagagtccccttgctcagcccgcacccgtggtctctaacaagggcgcggagtccgattcttccggggaggaggaatcggaggaggaggaggaggaggacttggtgcgctcctccgctaccaagagcagggatccaccgcaggagaatcgcgaggaggatgattcgtccgatgaggaagaggacgagtcgtccgaatccgagaaggcggaggcgccgccgccgccgccgccgaatccggctccgaagcagggggcggaggggaatggcccgaaggtctcgtcgcccaagaggcaggccttccaccgcatctggtcgaccgaggacgaggtgcgcatcctcgaggcgctcgcggcgcaccgccgggagcacgggtcgctgccacagaccgacgcgctcatcgccaccctcgccggcagcctcgacaacactggctacggccgcaaggagctccaggggaaggtcagcactctcaagcgccgttacgaatccaccgctaagaagaagggcgatctcccaagcaagggccatgaccgccggctctatgacctctccaagagcgtctggggcagcgaggcggcagcggcggcggtgaacggcaccaccaccgcgccgagggagttcggcgagatgtgcgagctgtacccgcacctcgctgaggaggtcaagttgctggaggcggcacaccctggcttgttcaagagggacttcgggaagctcgatgacgacaaggcgcatgcgctggacatgaagatcaagaagcagaggattgccgagatttcggtggtgctgcgccgtggcgacctgaccaaggaggtgaccaaggtgctcgctgagctggtcgagtgactaggtgagctgaactgaagtgaacagtagtagctcggcgttccttaccatggcataagaaagtgtacctggtcattacctgcaaactatatcgtgaacaggcattacctgcaaaattttgcttcttagtgatggagttggatgttctatgttcttgtctaggcaattcagtcagcgtctcttctcagttcagatagatcgataggatgtagtataaaacattgaaatttcgtttttggtttgtcttatcattccagacagtgatagaatgtagcaagactgaaatcggtcatcgaatcagtcctgaactcttgactcctttataaactgaaccccagtcctcgttaagtatgggttagtgctggcagtgtgttgccctagcctgaggtctctgatatggcaacttgtcgcgtgatcagtgatcgtctctgtctagctgacatctctcctggatgaaatcaatccaaaaaaaaagaaggctttgatcagatagattagggttcacacttcacaactctgacgtttcaacgcagcgcgaaagcaaattctgttggaatttttgaatcgtttcagaatttttcaaatttgaattgaaaatttatgaagaatattttaaaaataacttgtaaatagtcctacatttgtagtaaatacatgcatatgaaatgtcaaaaaatataggcgtagaatgaaaatgctctttggacaacaactgaattggtaaattgaaaaaagacatctagaagggtttacaatatgtgttgattgtgtatgcactttatattatggactttgtattgttgttatactatgttgtttatgcactttacagtatgtattgattgtgggtgtactttgtattgtgttgatgtactttatattatgcgtgttgatgttaatggcgtaacatatatttggttatgcatatttaattgtcaatgatatggacttcaaattatcttgtatttgtgttcatgaatatacattgcgcttattctcaatgtgaggttgtcaaattgtaggaaaggtcatgctgaatttctttattaatttcttacattttcccacgtttccacggtttccccattttgatatccttttagtttgcaatgttcctatcatctccatgaattttctcatatttcaaacattttcccctattatccaaatattcagaaaacacaattaattcccacgctactctttggcttttcagcaaatccaatgagttttagatgcttttgtttggtttccaaaacactggaacggtggtttcctgttcgaatcaactgaaatcctggtagttccggttggaattcggtgattttgatcatttttcattgacgggcaaatggaacttgagaatttggcttcttaattttgtttgaaatttgacggttttcgtgaaaaccgttatactgacagggtcaggagcgggacctcgattggaaatataaacccttgcctgtaatacggtacagccgtacagaattcgtgtggtggccacgggctcacgcaccgggtcagtgatagcatccagtggccaatttggccatggagatgatgcattttttacacggagaatgatcccagaaacacgcatgatcttctcttacaagaattttctaacagaacatccatttcaccacacccacttgttcaatgcagcgctgttttgtaacccacataacaaccggacccagcacgtctgaaactaaggttactcatcggttacctaaattaaagtactccctccgtattgtattttaatgtatggtgccgttgactttttttatcaatatttgactattcgttttattcaaattttttgtgataatgtgaaaatatttatgtcatgcttaaaaaacatttgatgatggatcaagtcacaataaaataaacgataattacataaactttgtgaataagacgaatgatcaaacgttagataaaaagtcaacagcgtcatatattaaaatatgaaggtagtagtaatttacagagatgttttagcgacctaaaattctcaagtttgaaattttaatttttggttttcatttatgaggacaattgggactctaaccactcccccggtcgcttcgcgacgcgtccgtcccgacctgccaaattcctcgcacggattaagcaaaccaaactactcggattaaatgcgcaaatcgaaagcacgcgttccattgggagaccggcaaacttcgttttttccttcgagaggaacggagacggagtttgccgtcgtcgtgtgcgtgcctcctcgcgtacgcacatttgcccgcagcgccgcggcgcgcgaggctaccccgaccccgacgtggtctcctcccacccatacacccttccgcttccacgcccacacacagaacccaattcccctccctcctcctccacccgcccctccctcccacacacaccacaccaccaccaccaccacccacccctcgtatgcaattattcacgcccagtcgccgcctccaccgccgccgcctgctcgactcaccaccgcagggcggcctcctcctgccgcatgggtgactcgacggtggccggcgcgctggtgccatcggtgccgaagcaggagcaggcgccgtcgggggacgcgtccacggcggcgttggcggtggcgggggagggggaggaggatgcgggggcgcgcgcctccgcggggggcaacggggaggccgcggccgacagggacctcctctgcccgatctgcatggcggtcatcaaggacgccttcctcaccgcctgcggccacagcttctgctacatgtgcatcgtcacgcatctcagccacaagagcgactgcccctgctgcggcaactacctcaccaaggcgcagctctaccccaacttcctcctcgacaaggtttgcttgctcgttctgcttacacagccgagatggataatggattggccgtggcttccatattccgccgatcgattgggaattttggatgcctatcctaatttcaaacgcagggctttgtaattgaaatgtcactgccccgcaaaaaaaaaaaattgaaatgtcactgaatgtacctttggatgtggcttgggataggtatccggtataaccaattttaacaaatgtagcaactattcaacagtatgcctttcgattcgtttgtagcaactattcaacagtattcagcgcttgagctgcgatttattgtactactgtttgtggtagcttctgaagtagtagcaggtgttctgattggatagctcagttttatttgacttgcacggtacattacagtttgttgttaatgtaagttttgtttagaatcaccagcagtggacagtattagttctatgtctgctctggttatcagtacctattatataatttgttcatcactagagttcttctctagttctgttaaaacttaaaacaagctgtaattactggttacttgatactgggattgtataaatgtatctctaagcatgtttatcacatttatgtctgcataggtcttgaagaaaatgtcagctcgccaaattgcgaagacagcatcaccgatagaccaatttcgatatgcactgcaacaggtcagtcacttcacatgttttacttttgaaaatgtctactttcaatagctccttaaacatagtggtatgttcctaaatggttttatgtactgtgaaaattttgcttccgtaccttagctgtgcttgtgatcttcagttcagaactaagtagtacagagtagtaattaagttctacactgaacatgcttatctcttgcatcaattgtagaatctaagctactgtgaccgatatcaaagtatcttttgttccttcgctcttacagccacatgatctctatcgtcctcttaactgttacaaggattgtccatatgataaaccaagtataccacagaagatagatttgcactaccttgctgactttatatctgtttcaaaattcaaacataaaactgacgttctctaaataagtaatagatgaatgatgaccaaacactatcatatgttttagtttaattcttctttctttttctagggaaacgatatggcggttaaagaactagatagtcttatgactttgatcgcggagaagaagcggcatatggaacagcaagagtcagaaacaaatatgcaaatattgctggtcttcttgcattgcctcagaaagcaaaagttggaagagctgaatgaggtttgtctatatgtatttttcagtatgcaggttttttttcttgctacctacaacaataaataatcttttactgatgtctattgttgttaatcatgttaacctcttttttacacagattcaaactgacctacagtacatcaaagaagatataagtgctgtggagagacataggttagaattatatcgaacaaaagaaaggtactcaatgaagctccgcatgcttttggatgaacctgctgcatcaaagatgtggccctcacctatggataaacctagtggtctctttcctcccaactctcggggaccacttagtacatcaaatccagggggtttacagaataagaagcttgacttgaaaggtcaaattagtcatcaaggatttcaaaggagagatgttctcacttgctcggatcctcctagtgcccctattcaatcaggcaacgttattgctcggaagaggcgagttcaagctcaggtttgtttctcccattgcgcgcttgatagtttggtactatcatattgcaagcatgtagacagcttagattaggaacttatatgtttattttgttttgatgtaagatgaaatgctaatgtgctatggggcatattgcagtttaacgagcttcaagaatactatcttcaaagacggcgtaccggagcacaatcacgtaggctggaggaaagagacatagtaacaataaataaagaaggttatcatgcaggacttgaggatttccagtctgtgctaacaacattcacacgatataggtccgctgattatttgtcctttttagcacattatgatcatggtagtggttatgcctattcatttggcttatcattcttttgttctctgtcatttatgcttcagtcgcttgcgtgtaattgcggagctaagacatggagatctgtttcactctgcaaatatcgtatcaaggttagtgcttttacaaaatatgtgccttatttcatgtgcatcaacatgctattggcaatgtggatgttgtcatagctgaatcctcaagccagcagtgagctgaggagaggttttggttggaggggggatggtctattgctcctatgagtcaaacttcaactatgttcaattagcaaacaaatccactaatcttgaatgctgatgtttatcatgtattataaggaacaaaatatgactataagtttgtgcctgtttttttggtgcataattttcatttccatgtctatctgtaatctcatatgtttttcagtcgcctaccttacatgagaatagggaatcacattgatatttcttaaatgcagtatcgaatttgaccgtgatgatgagctatttgctactgctggagtctcaaagcgcatcaaagtcttcgagttttctacagtaagttttttttcaggaatcttatgttggccatagctatatgcctgtatagtatttgaaaatactcaaatttggcctatcttatgtcgtaggttgttaatgaaccatcagatgtgcattgtccagttgttgaaatggctactagatctaaactcagctgccttagctggaacaagtactcaaaaaatgttatagcaagcagcgactatgagggtatagtaactgtttgggatgtccaaacccgccaggtatttcttgctctgttccacagttcattttgcacacttgtgttattttctgaacttggattcatgatatttatgtattcaatcttctttagagtgtgatggagtatgaagaacatgaaaagagagcatggagtgttgatttttctcgaacagaaccctcgatgctagtatctgggagtgatgattgcaaggtatttgcaaatttcaatggtacaactacttttgttattcccgaaagcaagaaaactttgcgtagttctcaaaatacagtaaaacataacttggatatatcgcatgttatgcaacatactaggattttattttatttatcagtttttcatgtccctttttctataatggtgcatttttctacctaggctatcccaacctcattgaatgcatagatggaagtatctgtattgcagtataccttatggaacctactgctgtttgtgctaggtcaaagtgtggtgcacaaagcaagaagcaagtgccatcaatattgatatgaaggccaatatttgctctgtcaaatataatcctgggtcgagccactatgttgcagtatgttcctttgattttcttggctcatatcaaatataagtttttttttccttaccagatgttacattattgcaggtgggttctgctgatcaccatattcattattttgatttgcgaaatccaagtgcgcctgtccatgtttttggtgggcacaagaaagctgtttcttatgtgaagttcctgtccaccaatgagcttgcgtctgcatcaactgatagcacattacggttatgggatgtcaaagaaaattgccctgtatgtgtcattgagatttttcttgcactgcaattatgaaattatgtttttgccttttaagcagctatgacttattagtaaaaagtgatgttttaggatatactctatttcatatcgataaaaattggagctatagtgtttctttatttcctgggaaaaaactatttgagaagcttcgcttttttttcgaagaattctggtccttgaaaaacctttggttaggtccgaaattcttggataagcatttgttttcacctttgtttcttttttagctcatctattagtctggcttggtttagtagttacgtcatgctaggcttctcagaaaacagattgttgaccttttgtttaaaatggttacctttttcaggtaaggacattcagagggcacaagaatgaaaagaactttgttgggctgtctgtaaataacgagtacattgcctgcgggagtgaaacgaatgaggtttttgtttaccacaaggtaattgcaagcttattgcctgctcttgtttccgtatctgtgattcagcattatgtgccatgcttaactgtacaggttggtctcctgtggcaccatataccattctaacttcaagtaactctgtaccaattgcaggctatctcaaaacctgctgccaaccacagatttgtatcatctgatctcgatgatgcagatgatgatcctggctcttattttattagcgcagtctgctggaagagcgatagccctaccatgttaactgctaacagtcagggcaccattaaagttcttgtacttgctccttgatgaaatcagtggttttcatgagatccctagatagcttgtatatttgatgtatacagttgtttccttttcgtgccattataccccaaatgggagtggaggtattactgatctccaacatagggcgcaaagttttgaaggtaatcagctgacatagggtttcgagggctcgaaatgtgcatagtccagaattctcatgtataggtttaaagcagtcaagtaattgattatacatatgtaacgtgagaattgagaaatgaacatcaaataagcttgtttggttgcatatattggattggattttgggaactgggaagacaagctgtactgggctgatttcagcaacacaagccagtttgtcacacatctgctacctaacagaaatagttaacttatatatctcattgatcttacgcagggctaaaagtacagtatattacacccccaagccttcttattgtttttactgatttaaaattttccaggatacgcaattgccgtttcatcgcttaaatttcaaacccaataccttcatttctttttttctcttttactgaaaagaacagttttttgaactctcgcagtgaaaatgttggtcgctgcctgtaaaccctgttaccacgttcacagtgcatgaaaatatctattactaccggccaagccactatctttgtcacagtgcataaaacatactccctatgtcccataatataagggattaatattttgttacattttatttttactgtttgatcattcgttttgttcaaaaaaaatttagagttattatttatttatttattgatttactttattatctaaaatactttaagcataactttttgttttttatatttgtacaaattttttttaataagacgagtggttaaacagtgtaaaatgttaatatattatgggatggagggagtagcctagttctcgctctctgcttccacccacagatctgatcatctgaatcgctctctgcgaagcacccacagacgccgcggcttggctaggccggctgccgcatcgcagcttttgtatcggctgccgagtcgcgggagagaaaaaaggagcaaaactgcaagaggcgggtggcctttcgaacgcgcaaggggtttgcgcttgcgcgcccgaaccaacggagctgcaagccaagccaccaccaccccaccccacccacccaccagcgtccagccagaccaccgccccgcgccgcctgcgctgcgtcgccgtgggccgctggtttcagcgacaccgcgccgctgcacgtgcccccgccggcgcctctccttccaacattggctaatggctagccccatgccgttcaggttcacggctctctttgatcctgctcgaagaagaactgagtggataccaaagttaccaacgtcaaaatctacccatagctgttcagcttcatgttatactctagcagatttaggcgcattcggccgactcaagcgacggtaacgtcgtagtctagtgtctctagtgtctaggtggagagggactgaagagcatgtgctgcgctgtggctttcacggcgccctgccacaggaatcagcggtgaatccgccgaacaaggggggcagcacaagaatatctctggacaagagtagattgtcatctactcgatttggccggtcgtgttccatttccagccatgggttggctggtttacaattcccaaatttaactacccagaattgcacttgtgctctgaccttattcgtgcatctcattttcttactttgacacaaggatatatcaacacatgaaagatccactgaagaaagatctaaacaagccaggtgatgtcacgaaaaaggtccccaaaatatatcatgttgtttgaatccccattattaaagctgcacttttatcactttttatgttctctttgtgggttgcattagagtgtagccattagctcttccaaagagccgactgaattcgatacggcgctttcgctgcactacagttccatctcgcgattcgttttggatgtgatcgtatccttaattccttattcatcatatattttctattctgaattgtgaaaaagcgcagaatattctagctctttctcggagtaaaagatcggcaacttgcgcaagtttttggcatgtactaaagttttctttctttatgagatgaatccggtatagatgctatcatgctatgcatacggttgcagctttgatcttgattgaatcattgaatggattcttattggaagacatttttcttaagcagctcttgctttctcggagctagctggtattctgatggggatctttctcttattctggttcaagtggagtaacctagttcgtattagacattcatgtatacaagcagtgatgtatcctgcacaaaacaagaatatcatcgagtgcagtggttgattgaattatcttgcgatcaatgtccttagtgtgtttgctctgcgtggtgcacgcactgtgagtctgtgaaatggtcatctccttgtctggaatcgatcgatgttgagcatgaaaacagcttgaaccgtaacaagcaagagatggtacactaaaaaatgcagagagatgttctaattctacagaatgaatatactgttcaaaatgcagaaggaaaaataatatctgaacagacaggccaccactctgtaaactgttctaatgatctgcttcgaactaaacagaattaatagaggtgagcatttccctcactgacagtagtatgctcttttcttagaaaaggacttctgggtcgttctttttctctgtgggggatactgaatccacaagaatcagcatgattgtgtcaaaaaagaggaaatatcacaatttgtcgtttcagaaacagttaatctgaattctgaaaagtaccctggaggaaacatgaggtgcatgcgagtgttaaaaatactttcccggtgtagcagcttagtacgattgagctagggataaataacacattaaaactcagtttgtgttcacttcttttttattttcaaagagaaaatatgcacttgtagcgcccgttccgtcgtggcgccttgcgggaaaattatctcttaaaaaccctaattgcgatattgtttctttgtttgtcgtctagtgtccgtgccatctcaagatctcaatccccgatctatcgtcgagttcatttccgaatccaaatccttccaaatcaatttcctccgcaaaagtctattttgcctccccggggtcgatgggccgaatccctctcggcccatctcccccggggtggccggcgagcccttctctgtggctctctctccctccggtccctgcccctgcgctgcgcccgtgcgctgcgcgtgcgtgcgcgggaaccgcgccgggcgcccctccccctccgctctgcccccgcgcgtgcgcgtgggccgcccgcgccggccgggccctcctctccggtccctcgctgccgctccccgcgcgtcgttcgcgcgcgcgcgcccg

SEQ ID NO: 72925 - DNA, 683 bp, Oryza sativa
tttgctgcaatgaaaatcaaatgggcatgggaacagcaagaagttagaactgaattttgctgatatgttgctactgtttttttttaaagccagcgggcaatagtgcaataggcaaatatataccaactaacatctcatagatggagtaggatctataaagaatagaaaaaacaactccgcaacagtctggaagcaagtggacaggacttttaaaggaaaatatataaccagctaacatccaatggacagaaccaagcatatatgtactctgaagccaatatgttgaacctagaggcaatgtactttgaggcatgcatatctaaaggatggcaagaacatccaagggatcggttggttgcaaattatgagaactttttcctgatgttttatcaagaatatcacaaataggcatagtagcatactaatattgacagactaactagtaaactaaggatatagttggttaaggttgatatgaagacttacgccatagacaatgttgcagaaccctttccagcctttgcttcaacaacttccgtcccaccatcttgtgtcctcttggtcagagccttaatgtcctcatgcgacaatgcattacttgcaggggttgcctacatcacacaaaaaattactccgttaggaggtaggccacacgccataaatgcactttgattttttgaaaa

SEQ ID NO: 72926 - DNA, 730 bp, Oryza sativa
caagcatacttggtgatataaataggtgcaaactgtaacaacttaagtataaatacaagcttaatttgagctatgttagcaatggacttctcttaagaaacagaatgaggtgatgttcctacaaagtaaaatatagtgttagtttgagtgatcacgcaacacgttataacttgttctctttcttttttttttttttttgcaaaacaattcataacttccaaatgtttctgaatcatccttctggtttggaaatttattacctcctagcaattgtagttagtgctaaaggggacatcatcattagctctccatgaatcggtgcttgtaaagagtatgtcccatcttttcaaatgaactcctatggagggaagaaattcaagccactggagtaatggaatgccctctcagaacaaggattgcttggtaaaaactagggacacaaggcatatcgcttgctgtctgctagattggcattttaaaatggtcagtttgatgaccgaagctgaatttgaggaatgatgtccatttttacgactatgcaacatgttctctgttaccttatctgtctgaattgccaagtttcagaagtattcgacgcttaaacatctgcattcccagtccttgtatattcagaagtttgagttgtcagctatacttgatgtgctcctttggttttgtttttcacatcagtcacaggaaggttcaggatggaatactgggctgcaggaat

SEQ ID NO: 72927 - DNA, 647 bp, Oryza sativa
ttagaggctggcattgcgacagctgagcctctctgaagaacacacggttcttcggattcagaaagatggatgagattacacggttcatggcgattggagatgatcatgttttcaattgttttcaattaatttctagaatcagattcgcagtaggaaacaggcctaaaagctgctgccatagcatggtgcttaaatcatcgtagacaattaggtcaaccagcgaatatgatttttagctttctgcacttgatgaaagccttgattctctggtgaaattaacgaatgatagtgagcaaagaggaatatggcatttcttgataatgcccgacagccaaaacgagagactttcacattagacctgcaggactggatggactgaacagaactgattctgaagaaaaagaaaaaaagttagccaggtcttccaatagtcaatctcgagacatggaagcttcgtactgaaatggaggcatgaatctttaccagtgccagcagctgatcttggtacagcttttatataaagaaaaagagagaacgaatttctgtcttcttcttaggctgtgtttagatccaaagtttggatccaaacttcagtcattttcagtcacatcaacctgtcatacatacaacttttcagtcacatcatc

SEQ ID NO: 72928 - DNA, 1103 bp, Oryza sativa
cccatccataatcttggactaattcacgagacgaatctattgagcctaattaatccatgattagcctatgtgatgctacagtaaacattctttaattatagattaattaggcttaaaaaaaggggctgctatataacgggatcccgttttcgaacgggatgatcccgagtaggtatcaggtctgatacctatcaggtatcagacaattctacacaacaggatgatcccgagtaggtatcaggtgtgatacctatcaggtatcacacgattctacacacgtttcaggtgatacttgtaagtatcatgtgatacttatcaggtatcatgcgatttctaccacgtatcacgtgatactcgcgatgtatcatgtgaaacctatcaggtatcagatgatttcaactacgtatcgcgtgatactcacgaggtatcatgcgatacctgtcatgtatcagacgatttctaccacgtatcgtatcatgtgatacttgtcaggtatcagacgatttctaccatgtatcatgtgatacttgcgaggtatcgaatgatacctaccaggtatcaggtgattcctactagatatagctgggcattccgttaggggaggagcaccccgacacgtgcggtcggcccctgcagccgttccttgtagacgaggacagcgacggcggctgcaggggacgggtgcagcggcggcggcgggggacgggcacgatggcggcggggtacagcgacggcggtggtgggggatgggcgcggcgtcgatgggggacgggcgtggcggcggcaggggatagcgacggcggcggcgacggaggcgacgggggacgggcgcagcagcggcgggggacggcgacggcgacgagtgagcagtcctggtgcgtgtatggataagaattgcgttgtggagaaggagctatcctattgggggacggtatcccgtcccctagcattcccgtaaaaaaattgtctcacgaattagctttcatttatataattagttttgtaagtagtttatatttaatactctatattagtgtctaaatatagggatgcatccaaacaccaacttatagatatgcacaggaggaaatgggctgcaggaa

SEQ ID NO: 72929 - DNA, 679 bp, Oryza sativa
agtatgacttataagctccaacccgagggaatactaacggttgcctagtatcagttatggaattgagtgaaacctaactgcacaagactgacaattcaaggcatagtccattgttcagttgtggtcaggtgtagctccttttctaggtgaaagttcaacttaacagtcttcaccgaaatactggtatataaaagctgctatggaatagagagcattctcatgagccttgaaatttggtggggattgatagatttaattggataattgatccatttaaatcaattaaatcaaataaattccaaggctcattatgctaggaattcatgtgtattcatttttttatgggatatcaatgggatgaagagttttgagaattaatccatttgattagggaattggtaacttatatcaattagttctaattgatggatggttgatggttgtgtagtggaggatggttcatggctagttgatgacaattagttgctctattcctcttcctattccattggtaacttacatcaattactcttaattgattgttggttgatggttgtgtagtggaggatggtttatggctagttgatgataattagttgctctattcctcttcctattccatgactcttactcgtcatcttccattcctcttataaaatgagaatggatttgatctccc

SEQ ID NO: 72930 - DNA, 707 bp, Oryza sativa
ctcgccgccggcagatcgtccacccttgctttttttccccgggccgatcgatcgatacaaccaaaaccggcaacgtatacctgctagccagccgtgcgtgtggtgtgttcgtccatatgcgtgcaaaagctcaacgatcgaacggagaaatggagcaaaaaggcgcttttttacgcccgtctttaatcggaaagaaccgcccaaattgcgacgtgcttcaacacgcttatgtactggatctatgctgttcttttttttaatgcaataatttctaatacacgttaaccacattcttctgattaaaaaatatgttattaacatttattttgttgtcgtctgtttctattattaaagttacttttaaacatgatatttttttaaaaaatctatatcttgactttgaaggcaaagtcttgttcaaaaacatggttcaaacaatgataggatagcagtgacattggtattgggaggacgcggagggtccctacttgacacataaaaaatgatataattaatcgtataatatttatctcctgttggtgaattctacccgatattagagtttggtggtatgatttttaaaatgtaccgagatatattatatttatgcttagagactgtaaaatttctcaatccggtcggttgtccggcaggaagactgaatgaatagtttggtccagagtccaacaacagtactcaacatgtgc

SEQ ID NO: 72931 - DNA, 680 bp, Oryza sativa
tcttatatatgcatgatttcgatcaaatatagtttaactctgtcgtacataaccacacatacatgtgcatgatactactaaattaacgtactaattaaactgatcatgcatttttggctttgtctggcgtccggtactccggtttgcacgagctggactccgatcaaacgtcacagccggtgttagctaggcgtgtgcgtacgcggtctttctatctaacaagcgatatatcctacgtgcactcgtttgccacactggctaagaattacgcgtgttcctctgccagatcgcactgtgtttatttcagtttatgatccactgtcatcgtggataaacataacaggggatacacactgaattttaatttgtaaataaccaatgcaaatagagtcgtcgatggctactagctgttctcggtcaaggaatatatcggtttgattcttgtcgtcgctcataggttgtgatgctagtagcaacctgactttgattttgtggttggcaagtgttgcaatcatgtgccccttttattagtatttactttcttgatgaacttaactttgcagttctctggtttcagtaagaagaggcaaaaaccgatggtaattcgaggcatatcccagctagcaactaggcaactggccatggccagcattggtgtgtacatggtcagtgagtttgtc

SEQ ID NO: 72932 - DNA, 1093 bp, Oryza sativa
gtggtgttacaaaccgggaataaaaatcaacacgtactatataatccctattacttatgctcttctctcgtccacgcaacaaactctatctctttctttctttcttcctctctaactcctgccttatctctttctttcttcctctcttttttcttttggatcgagcgagatcgagggccggccgggcggcgggcggcacggccgacgtggcggcggccggcgcggtggcggcctgcgcggcggtggccggctggcgcagagaggaggcgacagcggccggccgagcggcgcctctgtggtttttttctcttttttttagaatttgtgatttattgcatgattctgtgatgtatttgatttgtgtgcgatgtgaatttgtgatgtatttgcgatgaattttgtagaacttgtgatgtaatttgatttgtgtaattttttttttaggatttgcgatgtatttgatttatgtgtataagtaacttaaagatttgtgatgtggatttgagatgttaatttgatttgggatttggggatatgcataccacttgattggggagaaaataaaaaagaaaaaaaagaaaagaggactatttgtactgctattattccctctttagtcccggttggtaactccaaccgggatctttagtcccggttggtgttaccgggactaaagatcgatctttagtcctggtaacaccaatcgggactaaagatagcgatttttagtcccggattcgtagtccaggttgaacaaccggaactaaagggggttacgaactgggacttaaaaaagcacttctccagcactgctggtagcgatggccttcacttgcgtcaatgccgtgttcatcgtcgtcacactcgtgctctgggcattcctcgtcggaaggtacagccggccggcgccggaacatcgatcacactccacgtccacatccagatccgccgaagaaatcacatggcgtgacatacattgtgttatatatatatatatatatatatatatatatatatatatatatatatatatatatatatatatatatatatatatatatatatatatatatatatataaacaaagagatat

SEQ ID NO: 72933 - DNA, 676 bp, Oryza sativa
tgcggaaatatgaactgaaatagttgctattgttagggctatgttcatcagggtaacctgaattttgtggagtgtagtgatggtggcacctcagtgcagctaagtagaaactggagaagatattattttactattggaaaaagtacgaattaacccaccccaccccccaccccaaaaaaaaaactatcacggtcgatcgaattatccctcagaaccgcaaaaccggacatcctttacccccgaactatgtaaatcggacaaataaccccctggctcaatccgcagtggttttggtcctacgtggcaatccagtcagaaatttctttttttttaaaaaaaaatcaatgggccaaacatgtcatttcaccctctctacctctctctatcctatctctttcccaaatcccccctctcttctccctcccctcagctccatcgctcactggtggcggcgacgaagaggggccgaggacggcaacagccgaggacagagccggctgggtgcagcggaggggagccaaggacggcggtgggcgggggcgaacgccgcgcggacgacgcgctccgcctctgcctccaccgtcggtcaccgcctttgcctccactattggtcgctcgagctcgttgcctccatcgtgaccactcgagctcgctctgccgctggcggcggcctccc

SEQ ID NO: 72934 - DNA, 635 bp, Oryza sativa
tattctttgtgccctaaaatactctctgaaatttcccgtgaattttcggagcttagaaataattttaatagcacaaatttcatttatcaattaaaataaaaagaaaacaaataaaatttcccctctttgtctttgggccgcttttggcccaagatcttttccccctccttggcccactcgcccctctccttcccttctccctctcaggccgacccctcccttctcggcccgatcaatttcccctcgcgcaaagtctaaataaccccctggctctcctccctctctccctccccgacaggtgggcccgacgaccccacctgtcaggtccttcctctaccttcggcctccaaagccgaaaccaccattgctgccattgctgccattgccgcccacgtcgccgccgattccggctcctcccgctcacgccctcgcgcccaaaccgcataaaatcggtttccctccacctcctccacaaaatcccccacttttccccaatttttggcgccaaatcaatccccacttcgcccacgatgtcgcccacgtcgccggccgttgccgcttcaaatccgtcacgtccggccacgatttctcctccccgagcctattaaaaagcaccctcgtgctctcctcttcca

SEQ ID NO: 72935 - DNA, 2534 bp, Oryza sativa
gctgctaatgttgatgcacatccatcaagagcaactgtgttgattgaactattaatttgcgctttgtatgctatttgtagtcttgcgctttattacacacaaatttttttttggggggagccttaaatcgcttcgtcaactatagcagagttggagaggatggccatggaatggactgcaactgcactaatactagtattatattgctattttcttaaaaaaatccttaatattttgtatttctaatatatataaaaatatataagcgtatccccgtatccttgttttttgaaaatgccgtatccctgtatcgacgtatcgcgtatccgtatccgtatcaccgtatcgaggtaacataggtcactagccctaatctccacccttcccaacgtcgagtgccttgcccgtgtcccccccgcctccctccctccgctccccgcggtctaccacagtccacagctttgccatgccccacctctgtcgcgcccacgcctacctccaccccctccctcctcgctctctccatcttcgaggacggttgcatcgtgcaagcactgctctaattcgacgcctccgtgcccatgatcgaggtcgccatgctgctgttgcccctgaccccgctgcattgcgacggcttctgttcatgcatgcccgcgcagtgtgataggccaggatgtcttcctcatcggccgcggggccgacgcgctcaccggcgtgactcgagagtgcgtgcccaccggagccggaagctgacgcgtggcacgtggtcggcgaggcgctgcggcggagggacgggtgcaccggtgcaagtgtgggaggggtgttgtacgtcgctaggggcatcgtggtgtctggcctagagatggccgagaaagagagagaagggagagagagagagagaggaggaagaaggagagagtgggccctacatttttttttgtgtgtataaatgacaaatgggtttcacatatatgttttcaatcctagcgccacgtcaacatcacatattaggtcacacactgtcatgtagatgtcacgttagcaaaactgtcctccaaaatcgtcaaggtagtcaaattgtaccggttgtaatagttgagggatcgagatatccgatattgtgatttaaggatacgaatcagattcgatcactagttaagggagtcaagatgaacttattccttcttcagatccacttacgaaggcggtaaggcccatgaaaagaatgggctagtagcttaacttccataattcttttctccagcccaaaacctccccttcggctcttcgcccctcgctacctccgatttccaatggccctagccggagcccctcgccgccggcgagctacacgttcgcgtctcccccccactctcctcctcatcgtcctcctcctcctcggcggggctcctcgtgcttccgcgctccgcgtcccgcttcgcgaggtcgccaccctcctcaacctctcccgctccctcctcaaccgcgtcgccgcagcccgcgcggccagtggagacgactttgcggcgtcccgcgcgcgcaggatcgcctcccatctctccctcttctcatcccgcggcgcgtgggcactctcttgggactacctccgccactacgccttctcgtcggctgccgggtgcggcctctcatgcgccaccgccgctgctcgcctcctcgctgctgctgcggaggtctcgcgcctgcattccgccaccgacgccgcccagtggctgcgccgcaattacggggacgtccgcgacgcggccgcgcagctcctcaacggtctccttgttgccttctccgagcaggtatatgacttgacttggtactcgtgattcatgaatcattggcatccaaattgcagcaatgttcagtttatggagatctgtgttgtggtttaggggcctttacgagaggtggtgatggatgtgaagtgggaagtggaggaaggggagctgctgaaggattgcctcaaggtgggagctaaggacttggaggggttgcttgtcattgccaaagatctcttatttggggccacaaggacttcttcgcgccacaacgaactttgaggtttggtacattggagactcgctgtgctcctgttctttcatttgaactaatgaaattaaacttaagttcagtattagaaatccagaacttcggttaacattacatcctgcagaccacctagtaactaccggtgtgatattatacccagcgtttcatacccgagaaaatttttgtgtgaagatgcatagttgaaatatactccctccgtcccaaaatacttgtcgttttgagtttttgtttgtaacgtttgacgactagtcgtattcaaaagattatggaattattatttattttgtttgtgacttgctttattattaaaagtactttaagtatgacatttttttttaatatttgcactaattttttaaataagacgaatggtcaaacgttgcaagcaaaaagtcaaaacaacatctaatttgggacggaggtagtatcttctagtggttagggctgcaggaatt

SEQ ID NO: 72936 - DNA, 1371 bp, Oryza sativa
agatagacctaaagtgaactttatttctcaaacaagaaggtgcgaataaaggccccccatcttttagcccaataacaacggggtcatcttttttcttatgggccgtgcaaagtttcagcccatgatgcccgtgggcccggtaaactcccgtttccgtgcatgccaagaagcctctccccctataaaaaaaaaacgcccccgacaaagagggggacccaaacgagtcacctctcgcaccaccaccgcgtcagtatacaaacggcggcgaccaaccaaattccggcgagtcgtcgtcgtcgtcgccgtcgtcgagagagagtcaaaccccccacacgcaaagagagcgaaaccccacccccctcctcttcctcatccaccccacgcacgcctcgtcgcggccgcgcgaggtgagctggagcgaacggcggcgatggcggcggcgaaggaggcggtggtgccggtggaggggcggaggaacgtgctggtgacgagcgcgctgccgtacgtgaacaacgtgccgcacctggggaacatcatcggctgcgtgctctccgcgagccttcgcgcgctactgccgcctccgggggcaaacgtgctctacgtctgcggcaccgacgagtacggcaccgccaccgagaccaaggccatggaggaaggctgctcccccagggagatctgcgacaagtcagcctctctctctctcctgcttgttcttgttgaggttttggttgctcttcttcttttcaagtgaaccactctgctccgattatttgatcgattgagcaaaattgtggcatggcatgaattttcccctaaattttgaggcgatttcatatcgaatattaggaacagacgagttgtgtaattttgtaatggggatccagttcgggttaggaacgaagggaattgtcagcttcagctgtcttatccttttggaagcaaattgtcaaattgcgcaactctcaattggtccaagtccccaacgaaacaaaaatcttcctgtcccactagttaatccttttttaaaaaaatttggattagcgcttactagtacagctttaacaactgagtcctctctcatgccatgtgcgtaatgaaggtaccatgccatccacaaggaagtgtacgagtggttcgacatcagcttcgacatcttcggtagaacatcgtcgccgcaacagaccgaggtctgccaagacatcttcctcaagctactggacaacaattggctgtcagagaacacaatgcagcaggtaaagttatagtgtcagtgcagggattattactttattggcatcttgtttcaatagaagttttaatttccattgtttcttctgtgatgtttttttgctaacaaagggctgcaggaat

SEQ ID NO: 72937 - DNA, 2393 bp, Oryza sativa
ccaactggagatcatatggccttaatataatacaacacaataccaaatgacaaaccaaattaaatcacattaattaatctccttcagacacatgactggtttcttagaatattgtcccatgtacccaacacgtgatgttctctcggactgaatcatgtattttgtcgatcggtttcaaattattttaggtttattttaaattaaatgtatctacttttagtcattaaattttaaaaatcggtatatagtttaataacatgtgaattatatgttatagaagtatttctaaaagtgaatcaaaatataaattttatgatactacactatataagttagtagaattaatagtcaaatattaaagtgtttgagacttaggacaaacttaggaaaattaaagtaatgtaaacgctggacacgtacgtctcaactgtctgtcattttctcgtgggctggtcggtcggcgggatcgtgatctacttaattggttctttcttggtaagaagtaattcacttttgctaatcagttctcgttaattaaatcgtgccctcttttcagctacggaaacacgaaagtttagacatcgacacgatctttaaatggcaactttggcccaacgatatgtattgtggtagttgtaggatcgacaacaactaagccaaccagagagggggtgaattgttagtatacctaaaaaccgaaaacttttagcggaaataaaagtttaccctcaaattcgacggattacggtttgaccgaagtttattgccggtctgaccacctgaagaacgtcggtctgaccgagatcaaactctggtcgaaccgctgatatcacctgctgtcgcctgcctgtcaccgccgtgtccccaccggtctgactgccgcgatgccgctggtctgaccgccggtgcgccgccggttagaccgccgaaacccggtgaaatacatatagaatcttcaccaaccacgtgtattgaactctagccttagtatcccgcatgatctctgactaccatggacgtcgtctcttatccccaagccgactcccgatccatcaccgcaaatactctcccgaggcatcgagtcacctacacatgaaataaacaaagaaacatattccgagaccaagctatctccaacttgactcattagtagcaaacaatagtattacatacgtatagtattcatctagaagtcataatcatgaaataatcacagatatccaaacaaacaacccgaaaccgaaaccgacacagtgtcggccggtcagaccgcgttctggccggtccgactgctcgatcaccgccggtctgaccggctaccagagcccggtctgaccggtcacatgaaataatgaatcctgcaatcacctgtaaatccaatcatctccaaaaccacttcgtaaataaattccaaataacaaaaccagtaatctccaatgcccaattgttcatcacagaataataataaaaaaacacctttgattttacataaacgacttaggccctgtttagttcccaaacaaaaatttttcaccctatcacattaaatatttggacatattcatggagtattaatatagacaaaaaaactaattacacagattccatgtaaattgcgagtcgaatcttttaagcctaattgcgtcatgatttgacaatgtggtgctacagtaaacatttgttaatgatggatcaattaggcttaacaaattcacgttgcagtttccaggtgtaatctgtaatttgttttgttattaatctatgtttaatactttaaatgtgtgtccgtatatccgatgtgatacggttaaaattttcgtttgcgaactaaacaggcccttataatatgaaacagagggagtacatataaagccatttggatgggcgtagattcttattgcttacttcctttattcctaaattcttctatcaccagacgctatttatatttaaaacttgaccaaatgaatttttataaaatatacttcctctgtcattttatgtttaacgttagttagttcaaaccgtcaaatatttgtggaagaaggtagaatatatataaaaagttaaaagaaattgtattatcaaagtgtgttttcaccctaaacagcattaaacttttatcaaagtgtgttgcatcctaaacataagcattatgcttttattcattgtagtctaaccatttaaaatgctttatattagtagtcaaagttgaaacaacatcgatcgatagtgatagtatttggaacagatggagtatgatctctgaagcccaaaccatcgtatcgggtgacttaatagtgacaaatattttggctaggccggcgtaaggtaagcccaacgcaaactaacagcctgagcttgttaagatgtcaaagaggaataagtttgct

SEQ ID NO: 72938 - DNA, 1534 bp, Oryza sativa
tgctaccacatactagccttttctgcctctttaggaatagggacatactgtagtagccaccatatgaaagattcagtcttactactatcttctatgggcccttggtctttaagaaaaacttctgctaggaaaaggaagaagacatgcccatacatttagtgcgtgtattggtatctaaactaactagctagattttgcatctacctcagcattgcatagaactgctatatggattactacgttttggtaggtgcgctatcttaatctcttttttaagagataatatgaatctctgtttgagcaggtactatctttagtctttctattaattctgaactatttgaaaaacgtgatcagctgaatcaagaaaataagcacagagtagcttatggcctactgaaaccgttatatatcctataaatttgaactctctttattctttcatgtctactttgtgactacgtcctattctacttttagttagtacggtttatcgatattttaggtttgttggttcaacaactgaattggaaggaatcaccggatacgtacgtacacgaggtcccaataactaaactctagcttaattgtgtattcagtttttctatatagttcagttgtaatcctcatgataggatcgagttggagtggtcctgtttattcccattctaaattcaagttgcccggccggagtggcatggccatgctaccacacaaagtgggcaaatctaattgaatctctttaaacgattaggcttttaagcttttctatacgtttctaaagcactgcaatttgcaactcatgcatgcatgaaaggaaaaaaaaaagcagtacatgtacagattcagagcaactggatatcaaatagtatatgttctgcccttttaaagctgttatgtctacgtacagctcgttttcgttccgtcctgaattccgtgcttttacaccagatacgtactcttattcagagcatgtttgccatgttgcttaatttatgctctgttgcatcataaagcacaaatcactttgattatctttgtctatgttggctatcgaagaaatttcgtagttgttcgtatactggtatcataaacatatacataaatatcgtacagctactgacctcaacaatgacttgtgatcgctttagtctagcttttgctggctattttctgcactgtggcatgctgctctttgccttggttggaaggaatgcgcatggttcatgcatacaacgttgttcaagagtccatctcactttattttttctttggaacgaccgagactattcagatcagttcattgctgaatgggtttgagaatttaataatttgtttgcaacggaagaatttgaaggaattatgaaggatttgcgttgttttttttttttgctactacaaaaagtatcagtattgcaaattggcaacgccattcaaatggttgagatgtgttcaagaaagggtatctgacatgatggacacgcatttgtgtgtgcaagactgatgaacatatgaagtaatttggtttgttagg

SEQ ID NO: 72939 - DNA, 5820 bp, Oryza sativa
  unsure (1)..(5820): unsure at all n locations
gcaccgcctcggctccggctgcctcctcttgtacgtgctgcgggtcagccatgcttgcacggacgtgcatggattttggtcagtggccgccagtgtggtgtcaaacatgcgcgacaaaacccgcgtttggttacaacatgccggcaggttaaatagcctggagctagccatttgtctcctttgatgtggatggatcacaaggaattttgcaagggttagtttagtgtctggctctcctaactgaaatgcagtgccgaaactgagtgatatgttcaagaacatgaagttggcacatagttatttttggcatttttgcttgacagctctgatacaccagtgcacgcacggacgcacccagtgaactctgaagcttagaatacttgtgctgcgttcagtgagattcttcgaagggaacaaacgagtgcaagaaagccaaatggtaaggcctaagcatcttggcataatcgcggagaaatattccagagtctcatctcggtgtcatcactgaattcctggctgattggagcattccctctgaagctttcaacgcattggatgaaacatttagcatgtataagcggccggcatgcgtatgtaagcctgatcggcgacaaaagagaatcagatggagcagcctgaaacaatattccctatatctgttggagagtgcggactactaggtaagaagtgtggcaccgtgcttccctcctccctcctcgtcaatgctccggcgccggctgtgaacgccgtgcccgtgacgcctttctccatgatgccggcgacccgcgcttcgcgctgcacctccgatccgcgccaccccggccggatctggacggctggcgtcatggtggcggctggacggtggtggctggacgggggtgtccgtggcggtggcggtggcggtggcgatggtggctgacggtggcggctggcgacggtggtggctgtgatagtggcggtggtggctgtcgacgatggtacctatggcggcgatggttgaaggccatcatccggctgacggtgcgtcgtcgtcagcggcggtatgtggaggctgggaaggggtctggcggcggggaaggaggagtccaggtgcgggcacgccgtcgacggtgggaacaactgtgggcggtggccttggccgaatcgctgaagggacaatgttgttgaccgacgacgatccttcttgtgcggattggtggtgtaggtttggacagggaattgcgggcgaaagccttgccgagccatttggctggctgacaacggcgacgccgtttggcgtcgttcccctccttggaggagttgttttagcatacccctttcctttccctaccatattctccaggtgaaaaccttgcttcggttgtgaacgagcggtggcggcgatccacgtcgcatcctccttgggggcactgctttggagaaacctcttcgtgcaaggatattgtcattggtctatgcattggcttcgaacttcagtcctaggccttgacgaggccttctagctccacattttgttttacttttctcagtttgggtcctctcttctcttgtttggtgtgttcaacttgtcttgaactacactctcttctagagtggatttttgtaataattggctgtagttctttttgagcaaaggccaggatattatattccattatcttaaaagagaagtgtggcacagctgtggcatgataatgattttgatcgtgcattgaactaccccacaacagcacccctaccccacaaacagcacacacagttacaataatggataatttcgtttctacccctgttttaatgtcaaatattgattttgctcctactttttagggttttcgttttttcctcacttttttgaaccgaaagaggcgtttacccctagtttagatagaagtgagtgagaccgggcttatggaattaaataaatagagaaaaaaaggaaataaacatttttcatattgttgattgactcttttacccctaggaaatatccaataggggaaactattccagcctctcatgaaaaccccatccgacgacattcggtagcgcggtaggcaacggcgagtaggcgtcgacgggtggcggtgagcgggcatcggcaggtggtgcttcggcgcagacccctcccgccggcgagcaggagtggccctacgcgggataggtgactgggagagggcgcgacaacggggtgaggaggcttggaggcggcggtggggagggggttaggtggtgaccgagagggagcttgaaggcggcggcgggcagagagattagaggcggcggcaacggctctgcgtgagtgaggaggcgacgacagcagtcaggcgacagcggctcagcgcggagaggaggcgatggtggcgacaacggcggcggcaacggctcgacgttgggaggaggcggtggtggcgacgcggcgtggggaggaggcgacggcgacggcccagctagggggctacgacggcggctcaacacggggaggaggtggcggtggcgacttggcatggagagcaggtgacagcggcagcccgaccaggggtgacggcagcggtggccaagatgcagagaggaggaggcggtggcagcgaccaagaggcggcgacttgtagcaatatgacattttgttttgccaaattttgtttttttttcaacatttgtccagatttatcacatttgaatgtcaaattttgaaacaatatttttacatttgtccagatttatcaaattttggaacaatattttttttgatattatgtcaaaattgtcatatttgtaaaaaaaaattgatttacgaaaatcgccagatacgctatagggtaaatacagaactaatgaactaaaatagggaaaaatgtgtaacaacacagtgaggctatggatgtctttttgtcaaagatttaatatgtccatccaaagtagggggcaaaacttagtttcgtttttttttttaaaaaggcaaaaacgaaaatattaaaaagtagtggcaaaaccaatattagacatgaaagtaggggtaagaatgaaattgcccttacaataaagtgttgagttcgagttctcagcttcgcaataatgtccgtacctgagaaacaatgaatgaaaacgaaaaatacacctgagaatgaaaaatgtaaaattcatcgatcaattgcaaacctgagaaacaatgaatgaaaacgaaatatacacctcctgagaatggaaaacgtaaatttcagagattaattgcaaacctgagaatcttgtataaattcaaattcagagatcaattgcaaacctgagatggaaaacgtaaatttcagagattaataacctgatagtcttatgtaaattcaaattcagagatcaattgcaaacctgacagtgaaaattatataaattcagacagagatcaattgcaaacctgagatggaaaacgtaaatttcagagattaattgcaaacctgagtcttatgtaaattcaaattcagagatcaattgcaaacctgagagtgaaaattatataaattcagacatcaaatcgcaaaaaggaaataaagtgcggtgagcgtggatcgaacacgcgaccttcagatcttcagtctgacnnnnnnnnnnnnnnnnnnnnnnnnnnnntgttcaaaaggttcaaacacatttaatcaaaatggcgtgcaagcctactatttggcaaagttttgacatttttttcttgctcttcgaatacccgttaaactaatctaacaaaaaaatccattttattccttcaaaatatttatttggatcacttaggcccctttggactcagaatttggaccgagcttatcttcggcacgcaaaaaaagacatgtcattagcaagtgattaattaaagcattaacaacaataaacttaaaaacataatttatttgatttttaaagaaaattattttttttcataaaacgtaccattagcaattcaggaaacacgctaacggaaaatgaggaagttgttggtttgagttggtgaaaagaactcagtcttaacctgtattttttttgagtcattttactctttaaactattgaaattgtccactttttactccttcatactatctccgtcccaaaataagtgtagccgtagatatccgtgcccaatgtttgaccatccatcttatttaaaacatttgtgaaaaatttaaaaatatttagtcacgcataaattactattcatgttttatcatctaatagcaataaaaatactaatcataaaaaattttcaaataagacgaacggtcaaatgttgaacgtgaatagtgcaaaactgcacttattttgggacggagggagtagtatttcattccttttatttatacaagtcacattttaagatgatatttttttaagccgtggatgttaccattatcaaagttcaaaacggtttcttcctttttcatgaaggtttgcttaaactttaaaatctcgatgtttaagtcaatcttagatgctttcccaaacctacaatcagtgataaaaaaattcaaaaaatgttgagacataagctataattcatctaccagctataatcctagcaaattccaatgcaaactatgactaatatagaggaaaaaaagaactgaaataccattagggagttaagtaaaccttttaggtctaaaatgagtaaaaaatagtttagaggttaagggctccaacaaaatagtttgatggagtaacaagtgatttattttctaatctaaaacaattaaaataagaaatagaatttcgcttgaattcaatatcctgcaacggaaattttagggggaagcgtgaaaagcgtcatttctaaggggtcgtctagattaatatcatttcaaaccatatcatttttgataaagttaacaaagatatacatttatttagttttttatcaaactttaataaatatataaaaaaatcatgctaaaacttggtaattttgatattgtcaaaatttggtaaagcttattttggctagcagccttttaagtcagcaggatgctgaaggcctctgtgcaattcgaccgcagaagcacggcctacaaaaagcccaaaagaccgagagaccagaagacttcttcggttaatccactacatccggcccaacaattgccacggactcacactcacccgtccgccgaaagcctaatcctcgctcccgccgtcgcgcggcgtccgcttgacggcggttttaatttgcgcacgtaccacggcagccgccgcgcggccgcggcagatatccggggaccgtggccgtgtccttggccaccgggatcacgcgcggtctcgcggagatcgtcgcggactcgcggtgcgcggtgacgccgggatcgcgacgacaccgggccgcccgtagtacgcggcggcggctgaggcatgcagcgagggggacggcgccgtggcgtatgattcatcctcccgcaaacctgccacgcactacgcaaaaggtaaggagctctaaaccaatcgctattaacgcactgatggttctcgtgccttcgtgcgtgcgaacgtgccagttttatacattagttaaatttaatgtttacgcacgagtttaatctgcgccgatggggagatatctggtgtcttaaggctcatgtacctgtagtcaactagtcactctactgcttttctttttaatctacttcgagaaaggtggtctgaccccagatagtagctaggtagtatatttgtaagcagttttacctttattttgtttgaatgggtagggattagggagcatcaggggcactactcattcatccactttagttctatgaaaagtggggaaatgatatgatagtatcaaggtgga

SEQ ID NO: 72940 - DNA, 152062 bp, Oryza sativa
  unsure (1)..(152062): unsure at all n locations
cccttatattatgggacgaagggagtagagcctaatgctgcattaacacctgaacacaacagaacatacacagcagtaagatacagcacaatgcagatgcaagtattccttacgcattttcgtgacgcttgtaatagttgagtaaatgagagcagctaaagcaggaatcaggaacatgggcagcacccgggttgctctcatctgccagctgaggtccggtgatcttgtagtcataatcgcatatccaacagccgcaatctgttccaaaaaggagaaataagcatttccttacacatacaaccctgtgaaaaaacacagttcgccctgatctaatctaacaacaggcatatgcctaatggtgtcactagaactagagcaatgcaatgcatcatacaatctctgacacgacatgaaaattgcagaataatacggcataatttatcttagcaggctgtatgtcatgataatcgatgcctaattagcttcccaaagctgtatcacatcaggattttcatatggaactggattttatcaatcctcgattttatcgacccaacctacaagcgatcgattcgtctggacgaacatgacatttatatttgctacaataaaggaagcagagcggaatgggattagccggatggggaacggcgggggagttgggaactagggatacctcgagcgcggcggcgatggcgaggacgttgtgggcggactggcgggaggcgcgggcgcggcggcggaggcgggagcgcacggcctcctcctccttggagagcgcctggagcagcttctcgacgtcctcgcgccgcccgaatatccccttccacacccgcgacacgagcccgcgctgcctcctcttctgcgtcgacggcgtctccggcggcgcgggggtccgcggcgacgccgcggaggccgcggccgaggcggcgtaggcgtcgccttctgccatggcagctcccgcgatcgggggcaggggaatccgatcggatcggagaagaagaaaacgctaagctgccctgcggatttcgtacgtgtttcttcgtggcgaattttcggaaacaaggaaggaaggatcgcttcgtgccgcgtttttggggaggaaaggcgagcggaaaggcgtcgtggtgaggtggtcggcgggcgtgcggacgtgttgcctttgcctctctctctccccccgtttttattctctttctcctcaccatctgcaaatgcaaatgttacgcgttcgtgtgtgttaccctatggctccacgacgacctggcccccggcagcctagttttgaattgcaatgggcggccagctcgtcggagttgacggccgcggtgccgcctacgacgttcgaatacggtgatggcgcctgaatttgcttactgcaaaagggttagcttagcttgtaagcaaaaatgttagcttggcttggaaccattcaacatgagagcagtttagggtgtgttattttcggatcaggatcctctgcaatcaactgcatcacgcctttgtgagatatagatcagatctggacccacatgtcatgcagcggatcttaatcctcacctcctctttaccgacttctatggttctaaagataaaacaatatagccctcatatgtattctatggagtacataccccgttagagagttgacataatacattagaaaacaacacaatagatttttcgacatttacaacaaatttctataagttgctttaaagtttaaaattttatattaatactttatcaagtttttgctaataattaattagtcatatgctaatccaccacttcattgcgttaaggattagttcctaacccacaataacaaaacacagcacaacttaatttcctcagcttgaggagcaatttccatccagcattcagtcgaaagtaaaccggattaccggaatcatcagctacagttgcttctattgcgatagaggtactagttcgctcgtcatggaatgaaagctacagaaactaataaacccaaaaaaaaaaagacttgtggcattcaatttacattttacaacaccattagatggccatgaactgcactcatccaacttatagttctcgctatctatgaggctaagatacagctatgagaaagatgggaacaacaggcacaacatagcacacaacatatgtgccaaccgcatatgcctccattatgtacctgaggattctactactagattggtgtcacagaatcacatgacaccttcaaagcttgaaacacgtgctgctgtagtcgccacgtttagatacgaacccccattatgctctggtttcatgagaagaactgctcaaggcttggagagttaaatacattacccgcaagttgtcctccttctattgaggaaacaaagagttggcaccgaatgaaccgctggtagcaaagaaacgaagataaacatgtagaacatgactatcagaaggcacctggtccaagaaaaaagaaatgaagatgcaagagtacatacagatagttgggaaattatatcgaggcttgtgtcaatgtgaaaatctgcctctaactgtcgaacaaatgaagttcgcccaacttcagagctgcagaagagtacctgcaatacccacctttttcactcaattatagatgtaggtgacagaagtaaataaattatttaacacctagatatttcagggttctgaatatacaggagaaatacttcttttctcagccagaacttggactgaaactcagctgggtatgcagaactgatatgagtgccagacaaagtcagctccatatgcagaactgatatgcaagcgccaatagcatttccatgcacatgtatcaattagtatcagttgcctctaccaaaagttcaatcatgtgaaacgtttactgtaactgctaacatctgtatcctcctatgaatttggtgaaaacaggccattcatgttctaccatccataaataaaatgagaataattactcaatgcagcattgaaatgacgtggggaatggagggaacatgagaggaacaaaaaaacaaacgcagtacaataactaaaagtaacgcaaacatttcaccttttctttcatcaagccaccagtcttgaaaagtccagcactctccagggccaatagagcattctcctactcaaaatcaaattccagaactattaatacggtatatatcaatatttccctcgataattctcataaaaaatctcacatgataaaactgcaaagaaatgaaaggatgcactatgaaattcatacctcactcttatcatcaagtacagtttccatcagatacaaatcacagtatttggctatttcgagtagtagttccaccactgaaggtctaacagtggcatgtgtctgcatcaagaagagtgcagatgattttagcatttcagcaattattggaggggcacataaccattggaagaggcattgctaaacaaacctgaagctcctgaggagttatctcctcaaagacaacaccaagcagttggcaagtcacctggataaaaaaaaaattatgaacttctgcaaattttaagaaaccaaatatgtatttcatttatttcaagtctgccagtatttatgattacaatttacagtgtcaagttaaatcactaaagcatttgctctttgtaactaagagtattatgtcagatcactatagccagaaagcacctaacagtttgatcttcgctctctagtggtaaacttatatcacaataaaattgtcctcattttttaattccttataccatttgctatggtcatcctcaaacaaagagaaactgacttgtttaggagtatatgtaagcctacaggcttaaatttcaaataaggtctgctctagatccttaaaatcaatcatggaaacacaggataaaattatgtttagggaattatttggtacagacaaagcatttaaaaaaacaaaataacccatcaaatcaccattcttcgtagctagagcagtttgagtgaacaattgaccccggggttacagtagaggctctacaagtttctttgtatcccggcaatttacaaatatttcaaagaaaataaaataataagcctcagatatttcaggtcagtgctttcttaataccacccagctgcagggaccgaccaccttctgaacatgccactaggctgaacttttctgcatgcatgcgataaccttagactcaacagccttaccttttgtcccgtcatagtacaggtagtaatgcatcataagttaatgcggctttctgtagtaattagtgatcaataggtggaaccagtgcattttaagccattgtcttctcattgatccaagattttacacgtgtggttgtacatttatggaagctaaattccaaaagttctcaaatataatttatctcaacattagacaatcaggcatgccaaacccaagcaatgagctgccacataggcaaattaaacatttatttcttaaacgcgtaattgatatcacatcatcgaagtttcatcaacccgctgatgacaaggcgcaaggagaaaccatacctttctacacccgcccagtcgcttcaccacgatttgccgtgtcgtcagctgccatacacacaaaccccaatccaatcaagggttgaaaaacccacaaacaaatagaacctagaataaatattatccaaaaatcatcacaccaatcagaggatcagaccaaccttcccaggattggcaggctcggccgcatcgcgagcggcggaatcgggggcagcagggccgacgagcggccgcttcggtccgggggggcggcgcggcctggccggcgacgaccgcaggaacttccacgcgaacacgacagcgatggcgaacccggcgacggccccgagggatccggcgctctggtgggggcacacacacgatacgagacgagacggggaagcccatctagggttagggttcgcgcgacgcgcgtgtaaaaccgaaactacgacgcgatgtttaccttgtggtggaagaggaggccgacgaggtcggtgaggcggcggttgagggcgcgggagacgcggcgcaccagcgagacggtgtcctggtcggcggcgaggcccggcattgcgcggggtgggggtggggtgccgtacggcttggcttgacttgcttctgccgcgtggttgggcgaggtgggggaggtggtcgtcgggggggtgggtgaggaggtggtggaggattggggaatcgccggattgggaggtggagacgaggggaggaggaggaggaggagaccgcgaaattgcgggggcgacgagaggaagcgaggcggggcgtgatgagactgatgtgcttatcttcttggcacaggaagccacgaaaggactaatccaagaatttcttttttgtttatttggccttggccgtatttagatccaaacttcagtcctttttcatcatatcaacatatcatgcacacacaactttttagtcacatcatctctaattttaactaaaatccaaactttacgctgaactaaacacagcctagatccaaagtttttcttcaaactttcaactttttcatcacatcaaaactttcctacacacataaacttccaactttccatcacatcgttccaattccatttttgatatgaactaaacacactcgttccatgatgtttctttaataaatgttactttaaaagaaactattttcttcgttaatattatagcatcctatactacgtgtctacgtagaacacatcatactacaatctgaacggccgagtattagtttttttatattttgtgtcgggatagtattatttttttttctttggaaattcagaataaataaatacggtattgttttcatgatcaataagtgccgattcagatttttttttagtttgataaatattagctgtgtgctctgaagttgcatcaatgatgtagactttccggtttaactctgccctcttttagttgctggccaaaaacaaatctacattttagtgctcgtcagatcgaaactacgacgtatttgctgtacaaaaccagcttcagctgctttgaataaagtaagctgattgcttgacaatacctccaactcaagtgtggagttagcgtagaccacctggtagagtgtatgcaaataacatgaccattacaagctaagcacccaggctgaactgaaccaaccaacgaattgacctgtttttcattttaaaccagagctaccgatgggtttctgaacctgaatactcgctatgggtgactgaaatgagtgaaaacaaaacaatttatatttgttcatcagaaaagaaaatcattcccaaacaaaaaaaatccaactagaagaatgaaaacagtaacgtactacattaactgcgtaggcatatccgtcgaaacatgaaagtgaaactcagattgtaatacaatttcatttttttagataatgtgtaatcaattttctatttcacaaacatgataaacatccgattttaaactcaccaatcagtagaggactagaggaactgaactgaaacctttattaataccataccagcaggctcaatagtgtgactaataaacaagatgaacaagaacgtcttcagttttgcagtctctaaaatgaaactgggtcaagcatgtacgacagaacgatattgttgttagcagaggttactgctagttgcatcagtatagcacattcctctctgatcgtttgttcaattatttgataagataagccctaagaaaattaaccaaagcaaccaaatttaatatataagtaacatttttatatttgatttattaaagaactaaaagacacgtccaagtctagaaaccataggtttattttaaggatgaaataaatagtgctgaaaaataagctatgataaaaacaatcatcataatttatttaaaattgaattccgttgagcgagcaattgttgggaggcttgaaccatggtttaccaaaccattaagggtggtatatcatgattttaaaaactaaaatgtttaccacacgtgacaaccacgataaccctgtggttttgtaaatactgctcagccattagcaaagcgttcaagagggagagaggagcgtacactggttcgttgcatgcgagcgtgatcacgaatgccaccggactggtcgcgcctcggactggaggaggcgctcgccgcggcggcgctgctgctccgatcgtgctcccctcgccgcgctgtcctccgccgcgcgcgcgcggtccacgcgctcctcgtggtctcctccacgccctcgtcgcccgcgctgaccaccttcctcgccaaccagctgctctccctctacgcccgcctctccgccgtccccgacgccctcgcgctcctccgctccacgccgcgcccctccgtcgtctcctacaacaccgtcctctccgcgctctcccgcgccccgcgccacgcgcccgagggtctccgcctcttccgccgcctgcacgcgtcgggcctccgccccaccgcacctagcctctgcgccctcctgcgcaccgccggcgaactgcgcgaccgtcgcgcgggggccgccgcgcactcgcaggccgcgacgctcggcttcctcgcgagcgacatcgtgcccactgcgctgctgcagatgtactcccagtgcggcgcgccgagggacgccaaccaggtgttcgacgaaatggcgacgcgggatggggtggcgtggaactgcgtgatgcactgcaatgtgcggtatggctaccttgaccgcgctctaggtcagttttgccggatggtgaggggtggattgccacccaccgagagcacgctctcgtcagtgctgagtggttgtggacgagctggggattgcctccgagggcgtgtgctccatggatgggtggtgaagttggaggagcttgatcctgacatgccactacagaacgcgctgctcgacatgtactcaagctgtggtgatctggatactgcactgcgcgtgtttgagagaattgagacgccggacttggtgtcatggaatactctgattgctgggttttctggagttggggatgggtgcagcgctgtgcatgcctttgtgcagctgaaggctgtacagttcgatgaacgagttgtccctgatgagtacacgcttgcagctgtggtgtctgcttctgctactttgcctgcaatgtttggtgggaagccgcttcatgccgaagtgatcaaagctggactggagaacagcgtgtttgtagggaacacactgctcaacatgtattttacaaacgatgatccccattctgcacggattttgtttgattccattacccaggaggatgtaatcatgtggactgagatggttgcaggccactcctcattgggtgagggagaattggccttaaggtactttgttagcatgcttcaggaaggttacaaggtcgacagcttctctttgagcagtgctttaaactccacgaccgagcttgcaggccttaaacaaggagagatgctccatgctcaagtggtaaaaagtggttatgaaggcaatatttgtgcctccggaagcctagttgacatgtatgcaaaaaatggtgctctcccaggggcttatttggtgtttcgtaacatacaaagaccagatttgaagtgctggaattctataattggaggatacggtaaccatgggaattctgaaatggcatttaagttatttggtgagatgattcgggatgggctgcaacctgaccatgtaacttacatctccatcctctctgcatgtagccactgcggactagttgagaaaggaaaattctattggttctgtatgatgactgatggtattgtgcctgggttcaagcactacactagcatggtcagtttgttgggtagggcaggtttgttggatgaagcagttgatttaatgatgaaatcccctttcgccaagaaatgccctgaactatggagaattctgctaagctcctgtataacatttagaaatttatccattggtgttcatgctgctgaacaggcgctagagcaggacccagatgatatttcaacacacatattgctttcaaacctttacgcctctttaggtaaatgggactttgttgctgaaattaggaaaagaatgagagggctaatggctgataaggagcctgggctgagctgggtcgagatgaaaaatgtggttcatgtcttctctgcagacgatgaatgccactctcatatagatgattgccacagcgaattgcttagacttaaaggaaacatggaattattggatacttgtgaaaatgagttcatgtcaagtggctaagttgcatgaacagattagaggatttcatttgcttcctttggtcctatgacttatggcaacaaaatagacttatacaagattttgagcataagaaaggtattatctgtgaagggacaacctatcgatttaatggttccaactttcaaattagcgctcccggcagcattggaggcaggaaagagacactaaaggtatcaagctccatcaaacaagatatagatgtgcaaataacccaaaaaagggacagaattctgggtcagtgctctagtgtctttctccgttacatcaatgcaactgcttgctccttttttgtgtatatatgtgatcagcagcagcatttcttgctatggatatgttttgagtaaatttcagaaaaccctctgttttatggtcacagttacagaaaaccacaggtattatgacatgcggcacctaaccatataggtataacagttctaaagtttgacaaaaccctacccttatgcattttgagcacagattacttacaattctaaatcatagtgtgtacatgaaaattttaatttttaagttcttgactaaggttgataattaaaatttttactaattcaaaagaattgttcaagatatgcaaaattaggcctagttctatttttcaacttcaaacttcaactttctcgttttccgttagcacgcttttcaaaccgttaaatggtgcgttttttaaaaaagtttttatacataagttgtttaaaaaagcaaataaattcatttttgaaatttataatacttaatacttaattaatcatgtgctaatgagatttctcgttttgcgtcaaaaatctatctgccaaacggatgatcaaacggggccttaatcaagatttcaataaatgtggggttttatgaaatatttagaccataatacatgtggttgtgtgccacacatcataatatatgtggttttctgcaactttgatcataaaatgtgagattttctgagttagctaaatttccatgttgccctttttaatggtctcaataattttgttgttgcttgttgagtactatctgatattgtttctgacaagagcttcctcagtatatgggttacacatttttcagtcttgatatttgcttctatgggacattatgtcaaagttatctcggtaaatgttcagttttaactaacggcataaggaccccggacttcagagcaacctgtctcaatcaagccgttcataccatgcaaggtgcctgaaatctgaatcaatacttcctttgttggtgaagcatagcactttagagtttgatttattaattcattttcttttgtttcagaactttagacagctgatactccatcaatctgaagtttgaatatctcaagtttctctgattcggcaatcatccagatccatcattaatctcttaatatgcatagttaacttcgtctgctgctcatttttcaccatcaaattcctagccagtgcttcgtaaagatagtaagatggacagtgaagttcagggcatattgcttcttattaaaagcttgttttagtgtgatatggcaaatgaactaccctgaattctggtttcatgaatagattttacacaattatttttcttctagcctgcatatagtagttgtagcttcattaggcggttaaaagaaattttagaagcttgaactctgggtccttcacgtttatgatttgttcagatttagttattgcagtatatctctttttaaacttcgttagctaacgcctgtctaaattgcactgttcagtgtaccagttcagggttctgccgaaatcattctagggccgtgtttagttccaaaataattcttcaaacttcaacttttccatcatatcaaaactttcctacacacaaacttccaacttttctatcacatcattctaatttcaaccaaattttcaattttgatgtgaactaaacacatgcaagtcttacagtagcttctgggtgtattatagaaaactgtattgtttgatactagcacaatagctcaagtaaagtaacggctgtgcgaaagtgcgaaaccaaaaatccagtccacgctgcaaaacaggtcaatgccacctactagtacttatttttcccatgcaaccaccgtgattcaagaataggcagacaacccacgctgcgaccggcaaggttgtactagaatttaggctactcaacattcatcatgactactcgccgttgtttgtgcggtgccctgcaggaaatgagcctcctttcccatttctgcctctgcctccagcggaaggcgggaagctgctgccgttgcatccgcttcttacatgtgttcgtcttcgtgctccacatccatggcggccactcccagatgtgcgaccccgccgacctggcgtcgcttctggccttctccgatggcttggacaggatgggcgccgggctggtcggatggggtcccaacgacacctcctgctgctcgtggacgggcatttcatgcgatctcgggagggtggtggagctggatctctccaaccggagcctctcccggaactcttttcggggcgtggcggtggcgcagctcggccgcctgccgtgcctgcggcgcctcgacctcagcacgaacggcctcgttggcgcgttcccggcgagcggcttcccggcgatcgaggtggtgaacgtctcctccaacggattcaccgggccgcaccccgcgttccccggtgcgccgaacctgacggttcttgatatcaccggcaacgccttctccggcggcatcaacgtcaccgcgctctgcgcttcgccggtcaaggtcctgcggttctcggcgaatgccttctctggtgatgtgccggccggctttggtcagtgcaagctgctcaacgacctcttccttgatggcaatggccttactgggagcctccccaaggacttgtacacgattccagagttgaggtggctaagcttacaggaaaatcagctctctggcagcctcgataaggccctcggtaacctctccaagcttaccctgattgacttgtcatataacatgttcaatggcaatatccctgatgtgtttgggaaattgaggagcttggagtccttaaacttggcttccaaccaattgaatggcacattgcctctatccctgtcgagctgcccgatgcttagagtggtcagcctgaggaacaattcgctgtccggtgagattaccattgactgcagattgctcacgaggctgaacaactttgatgctgggaccaacacgctgcgtggtgctataccgcctcgccttgcctcgtgcactgagttgaggacgctgaaccttgcaaggaacaagcttcagggggagctaccggagagcttcaagaatttgacatcactgtcatacctttctcttacggggaatggttttaccaacttgtcatcagcattgcaagtcttgcagcacctgcccaacttaactagcttggtgctcaccaataacttccgtggtggtgaaaccatgccaatggacggcatcgaagggttcaagagaatgcaggttcttgtcctggcgaactgtgcactcttgggcacggttccaccttggctgcagagcttgaagagcctcagtgtgctggatatttcatggaacaatttgcatggggagatcccgccatggttaggcaacctcgacagtcttttctacatcgatctgtccaacaactcattcagtggggagcttcctgcaacctttacacagatgaagagtttaatttcaagtaatggctcaagtgggcaggcgtcaacaggagacctcccattatccttcgtcaagaagaattcgacttccactggtaaaggcttgcagtacaaccaactcagtagcttcccgtcatcactgatcctctcaaataacaagcttgttgggtcaatattgccatcctttggccgtctagtgaagcttcatgtgctggacttgggctttaacaatttttctgggccaattcctgatgagttatcaaatatgtcgagcttggaagtactggatttagctcacaatgatctcagtgggagcataccatcatctctaacgaagctgaactttctgtccaagtttgatgtttcgtacaacaatttgtctggagatgtcccggcaggaggccaattctccacgttcacagaagaggagttcgcgggcaatcctgcgctgtgtcgtagtcagagccagtcatgctacaagcgggcggtcacgactgaaatgagttctgagacacgttttacttttgggctttttttgaccgtggaagctggatttgcctttggactgttaaccgtctggaacgtactgttctttgcaagttcttggagggccgcgtattttcagatggttgataatttctttgataggttttatgtgataacaatggtgaacttgaacagactcagaaggaaatgggaacataaagatcatccttaaaacaaagtcagacggggttctccactagttctaactaggctcttcaatcgaattatgtactctgtatattgtatttctccagcttttggtgtcttgattgttttcaactcaggtgtcatttagcagtgctgctttcacatcgtattgtagacatgatttccatttggtacagatgtgccagtgttgatagctgcgtggtggatacttaagcttcaagttgttctctctctctgtaataactgtagctgaacaaagccgttttgttaatagagatgggagagctcttcttctcttttatatgactagtataatgtcggtgcgctgtaacggaattgaaattatgatgttcagttttttttgtctatgcgttttgtaggttcattttcatgttgaaatactggttttttggtggggtggtctactactctactcttggggatgctcttttagtaggaggacgacgactccgttggctctccgcaggcttgggccgtaaccttcaggcctcgttttgggcagttcttttctcggcctatctacgcctatgggccaatgagggccctattcaaacgaagtctgaaatggcctaataattctttgcttggttgggctgggacctggggagtctaggagtggactacttgaagccaggtgagtgaacggtaagcccgtgagaacgaaacacatgctcaagtatggttgcagctctggacggagaaggcacatgcgaatgcgattatacaggagtcaaaacctcatcaacttgcaggattattctgtccaatctttatttaatcatcacgacaggccagctgtagattagtgctgctaagtgctaactaaccgatcagcttgtactctagctcagcttcacatgaaaatatacacagactgcatgcaaatcaggcgaggtacgcacgcgacagataaacaatcagagaaacacatgcatataaatagccgcaagttgggacttcggctgcaacaatccaacgcagctgtttttatactagtatttctgtgtgccatcacagtagacaacaacctttgctttctgctccgccgaatttttccagttcacatgaacatactacttcgactgcagcagcatcgatacactgcacaagaaatttcctgcgtctataagcggtgcatgcatgatcagaaattcagaattcagagatgcagagaagaccaaaatggagcaggcccgtgagtgggagactggagagtacgagtaatgggcgtagctcaatcagccggaaatttaggttaggtcccactataatgaaccgactcattgagacaaaaacagaataatagaatggattattatactagtacagaacaattattcacatcggaagcaattatgcaatgcattttgtgatcttaagttcttaagttatgttgatttcggcgatttcagtgacccatctcacagctgagacagtgagcagcaaggtgattactgtagataacaggcagcttcatatctcgatcggttggctggctggttggctccagatcgacggcgatctcattaaagaaagtaatggtcacgcgttgctccaaactccatggctggcacgtacaggtgcacgaaaactgcaaacacacctacctgctacagtacgtacgcggtggacacacaagtgcagtacagacgatcgacgtgagctgagctctcccaagtccccaactataatcttttttataccgacaaattaaagcgtcggattagcggcgagtttgaacgtggtagccgcatgtagtagtagaatccaggcaaggacaacgccatctgatgggaggacccggaggagttggtgacgcgcacgcggctggagtcggacagccggagccggtggccattttttgctcggttggcgccgcgagcgcgcaaggcggatgcgtatgcgcggcgcgcgggaggagacgggacgggatgtggtggtaggggtaggtggatgaggtcggttggtggggcgcagacggctcggccatctcgtgcccgtggaagactgcagtgtgcaaccagtagggggtcgatagctacttaggccatccctaacctagaaaccatctgttagatttcatacttgtagaaactatctatcaaatggatggtgtcttcaaattaaattctcatccaatcatctatattctctctccttttatgcatctatcatcttgtttttattcttggttcctgtgtatagatgttttcttgtatgagaaatggtttcttcatctttttacatctctcctcattaactcttttgccacatcacatttttgcttatgtggcaatgtattaaatgctatggacactagatgatatagagggttggggatagccttaaccggaggcgactacgatccgaacatccgacaaaagacaaaacatcggacgacgtttttaccatctgtaatgtaaagaaatgttgttttattgttaggcaaaacatgttttgacaaaaaaaatgttaatatattgtatcacccagtcgaaaacatttcatcgttccataaaaaaatgtttcaatcaaatgcaacactaaaaaacaatgacgttaacacaaaaaatcaaataatgtaacgtctaaggaaaaatgactgctccattaagaactcatcgtaccatttacagaacaaaagagactgtgtttgtaatattgtaaacattatgtgtaacatcgaagaccatggtgtgatgtgcaacatcctcgcatatctagttgctcccatcggcctcacctttatctacatcagtgtcgctttttcaccttcttcttggtgacggtgagggacatgttagctataagaagtctcctacgcgaaaccatctctactgccttcctttgtctctccatggtagcctcattagggaaaatgagggatggtagaggatatagagggctagaaaagtagaaggatagagaggagccttgggaggagggggcgatagcggtggcttgatgacgaggggaaagcagatgttgactagacataagcttcattgcagtaagaatgagttcatcatggaggagagttagtgaaatatatggatgagtaatttacagatttttttactctcgtattggacgaccggttcgaagcatttttcgtaactaaccttattaatactcaactcatttgaacttattttcctaattgttgagttgtgatccaaattcatttgcacttaataaaggccagcttctgccgtagtggagcggaggtccgtcgccgggaggcccttttagggttccaccatatatatacctcttgtaaaccaccgtgcggcgttgtaaccttacctcagatataatgaagatattttgctggctggtgcccgtggttttttctctcctgttttgggagggttttctacgttaaatctcgtgtctttgatgattgatctattgttttttatcgtttgttcgcctatcgttttctaacactaataagccaacttggctcggctcgtgagcttgatcgataacaaagctatatttcattcactaaccaccaaagaattcaataaatacatataatttgaatataattaaatatcacatgctacctatatatacgatgatcttttgtactaaggctgactgacttgggaagctcaccaactaaaacctcagtatacataactcgactcgagtccgagttgaaatgagccaagtttgatgcgagcctttgtttttctcccccacaccctactgtgcaatgcaagtgcaaccgacgatcgctgtagttgtacgtgccagagggatctaaagcaaagatccatgcatgatacacgtacgacatggccgcttttctcgcgcacctttaccgtgcacccccagcaaacaccggtcacatccattccatgattctagcgctttagattgaatagaggtcaatggggtcatcctaacgtactccctccctcccaaaaagagacaaacactaatttatttgcccaacgtttgaccgttcgtcttatttgaaaaaaatatgaaaaaaattaaaaaaacaagtcacgcataaaatattaattatattttatcatctaacaacaatgaaaatacgaattataaactcagggtttgactttttttttgggacggatggagtagtatgaactgtcaaatccatgatcccccgttgttgggtaattccactgtagcctgtgacccggaccgacgcaaatttactccacaacaacggaggcgaccgagcgcgacgcggccgtgagccgtgacgagcttgttcccccacacggccacggctgccgctccccgtgacgacaacgagtgtagcggccgcgagagcgagagcgagaccgtggcgcggccgcgtcgtggcgctctcggcttgcagacgagacgacgtggggcgcgcagcgcaggtggtggacggacgcagccgcggaccatggactacgctgccgcggccacagcccacaggagaaagccgagcgctcctcgtctgaccgttcgtcaccgtctcggttaccgcgcacgcttggccccacctgtcaggcacacaccagttaccgatggctggacgctgtccatggcagtatgtaccaccggccgaggcaactggggtttctggctctgtggaccaggttcacgcctcttttggcttcaactgtggtgaggtacaggacaggtgggtcccggatcccccaaagcgcaacgacgcctcgtgaactaaacccacggaaaccaaaccagattaccagaaccgcttcttcttcttttgcttcctccggtatcattccagttttgctacctcctcacttcactcctctcatctcatcacatctcatctcaatcttttgcgccattccatcggagctagcacccagcaactcacgagcaagcaaatcaggtaataaagcagcatcctcattctctctctctctctctctcttgtgctttgttgtttgattgcatcttcttttgggggcggagaatcatacgcattccacgggccctttgattccagggctcggatccggctgttgtgcatggccaagctgggggcttgtgttcgtcgtgtgtgattgggctgcttgggttgtttgctgcaaaatctgtcactcgttttgtttgggttcttggcaatgtagctgctggttttctatgactggtctcaagttccgagtttaatgcaatgcgggagggatttgtgaaattacagcaatttcttaagctttttttccttcttggtaggcggtacatgccgtggttaacattcttgttagctgcaggctgcggctgatcggtgaggcgagcactaagagtatttttgacgtgtttaccggaatgtatttccgctattgctccgaaatggttggggttttcagtgttatctgtgagaaaagattagtcttttcttttatattttctaaaaaaaaggatcagtattttattgctcgcgtgaactgcatttgcatcagttctgctttttatttaaaaaatcgttgttagtcctgctctgccaaactaaagttttagttgctttgtacagagtattggtccaaattgcattgagcattttcagcacaaattgatactgataaactgctgcgacctacttctgcaggtttagatagcaaggaggccgcagagaagtggagaggactcacgaatcacgatccatttctatcttgagggaattggggatagcaaaagtcagtgaaaaggtactttttagttctgacccatttcttacatcgtcacttttattaagtgtgtgcttcagattcctagtggtaggaatgacccaacaaagaccatttccaactaggttatgcactgctttagttttagcattatgtgtggtgtagcttgagagcatgtgggccaattgggatgcatttgctgttgttaattttacctatccgtttgtcttatctgctttgcaacattgcatacatatggggatcttgcacggttggaaaagacttcacaatcttggcacggccctctcagatcctacttattggctgcaatattcgtatgaaatgctagcttgatgcttgttcttgtgtttcttactcctacctatctgttttttcccctttagtttgcatcagttagtcagtttcattcatttcatttgtcatttgcttgttttcctgtctgtagttggcgtgttgcacgtttcacattcgctgtggggtaagcttttcttatggaagaaggtttactgcaggttagtagcgctattgtatctgtgcatttttctttttggaagtatggctactttacttaatcgtattgcttagacattgaaaggttggattagcttgaggagattgtataagaaactaatgatagtgcgatactgaattgtgcgtgtactgcatcatgattgctgcagtaagataggtgcagcctttataattagttggtttggtctcaaagcttacaaatgaaagcttgtaagaaatcattatgttccgtacaattgttctggtgctttaataatgttgttttgttgtgctttgccaaatgatggtttgcttaccgttactaatagagagtatggagacgtcctactagtggttggtaaagcatgttagcacacttttccatttggtgctgtataagatgatagtacaataatataatcatattggcagatggggcatgttattagtactttgagatcttatggctactaaacgtgattttgcacatggcattgaagtgagagatttcttgcagggccagatgacaagcatggacaaggcagcaaatgtggtattggatattgaagggctgcctcagcaacctgataaatgctgcactggaagtccaaaaatgactgtatgttcaatgactcacataagaccaaaaagaaaaggatagtggttatctcactctcccacccttccattttttatgtgcagagagccctatctcgcaagggctcaaatcgcatggaaaggaggagcggtgaagagcaggaacaagatgacttggtgaagaaacttattattaagggtaacaagctactgttcttctctgaattctttttttcttaaaaaagttgtagtctctgtaattctaaatttttcattttgcatacttaaaaccaaacagcttatattttgtttggatcaactcaaaccataatctttgtgaagttccatttgatcttagccatcatcacattgtgtccgtgagctgtatgtagatgagaaaaaggtcaaaagcggctagctttcttttgtgtgattgcttgtatttccatccagcggattttttctatcatgttcctacgatatgtggcctgcagatcgaggagccttgtttctccaattccaactttacatttagctaaataagtattggcttggtattctcggactttagtagcttgtacttctgtttacatccaagcctaataatcttaattttagcatcatttttataagtaaggatatttgttttccttttttattgtactacactcatctggtatgccacagcatcaacactgacagctgtttttttttttgcccttttgttggatatttatctccacagttgtgccatctcagttggagcagcttagatgcccctggtgcagaacaaagccttggtcactccacaatcacaatgtgctgcctgtgcacctattctaactgactctggggaaggaaggaacaagaagtttaatcgacttacttcggttcacccccggaaatcctactgttctttgcaactctgtaagtcacttgcctttctgaaattgtaatatgtctatgctgttgaagcaactggtctgagacactgagtttggtttccaattggtaccatgccccccacaagtggtccatgttctggtgtgtgcttctctgtactgttcaactgcacttgaatagtgtggcgtggttttcttgtcagtcattatcatagtaatctgctacacaatttcctgaacatactgtactctatcccttgcttgcccatttgtctaggtttgaggccctagtcagtatgcacgttcacacattaactgtattgcatgctccaagagattatttgtgtattcatagcagaaacactgattgatggtacgcatttatgccattgatggtacaaatatcatttgcttgtgtttttagctgcttgttttctaagccacatcttccttctcttttacaaacctattatacccattttgatttctcttccttgtttctcgtcgcaggtcgagcgtgggcacaatgatactgatatacttcacgctcgcaatcaacggtggcaaagcggaggcgtagtcgtcaccggagcgaaacacgacaacggtttcagaagtgcatttcatagctggaattttcgcttctcgttatcagattttggtttgtttgggaggagagaactggaggaggaagcaacagtagcagcagcaatgatgcagccaggctctcatgcctgacacacaatgctgggagtgttgctcgatcagtgctccattgtcacctttgcctgacctgatctccctgaattcttttgatctgtacatgtaaattgctgtgaggcctttgttgagaggtagagagagagagaaagagagatccatggattgttgttggtgtaaatgagctggggcgaagctatccatttctgccatgcgagtcccagcttagctgtaaaagatctgaagcgaataattatgcctttgtggagttgcagtgcatctggggttcggttcttgaatgctcgttttctgctagtggcactggcaccgccaacgactcccatttacgatatgcgcgcaggctctgcattttctctgcactctgcattacacacgtgctatttgtcagtcagctatagcataaacctgtggaatactctgtatattgcaaattcaaggtaattagtttacatttatatttgcgtagtttcagccagatactgttttttttttctcctctgaactacccctccgtttcaggatataagactttctagcattgtccacatccatatatatatatatatatatatatatatatatatatatatatatatatatatatatatatatatatatattaatgaatctagacatacatgtgtgcctgaattcattaacatctatatgaatatgggcaatgctagaaagtcttataatatgaaagagaaagtagtatataattttgttcatatcaataggatgcatcaaacacattttaggttggtttcgtgaactgagcggctcagacggaattgaaagttttagagttggcataggaaattgtattttttttcctgggatttttaatgtggatgcgctcagcatggtttgataaacaaggactacaatgttttatagtaactctaaaattaagttttaaaatttaaattctggctgcagctcataagctcaagagcgaactatggagctttgggattagggagttggcacagcctatttttcactttcatttgtcatttgctcgttttcactgctttcatgcaccattcttcccttggttttcaggattagcatgaacttattttatgttactagccaaacaatacctatgagttacaacaggttattcaaaatagctaaaataatatttcattcttattggaaaaaaaatattagcttctacttgagaaacaagattcttcatcttaaaaaataaaaagaaaatcaatggctccatctgctttaacaaaatgcccttttcatacttcttaccgtaaaaaatcgtcggtggtgtttccttttcacaaaccgaaatcgcaatgtaggccgaaattatctcgaggccgaggcccaacaaaagtttgtgtccgtggccgtggccgtggcctgcttcatccgggcggcgtgcggcgcgtgcagttgcgggcctcgcgagcgagcgagcgagcgatctccatccccaacctcaacaatccccttcccttcccccatcgcgcgatgctggtggagtgtggcgtcgcgacctagccctagccctagcgccaccgccaccgccaccgccaccgcctgctcgctcgctcgattccccggctccccgtcgctacctcgctacctcgccgcgccgccacagccgccggcgccgtctctcaccgggatcgggacaacaagcgccgcgccgttcagtcaggcgacgggggcgtgcgtctccgctctctggggggcctcgacgtcgcctcgccggtgtttcggaagaccgtcggcctggttggtatctctgattgcttgattactgctagggaatggatgggtggatgtcgtcgacggggtgggtttagctttagcggattagcgcgtatcacatcccctgattccagtcgagtagacaggataatagcaggtggagggtttgaattttttagttatataaaaggataccttacgttggtgctgtttgatggattggtagaggtggtgctattcttcccttcatcagaatgtcaagcggcttgcttcgtgtgtagattactactagtatttttagggtttgggtgcctgctaatgtcaccgaataggtttcgttagcttcttattaatgtttttaatgcactttgtcgcgatatggatagcgagaactgctatttgtgccgttttgagatggtgtgtgtaatttactatgtcgttatgggatgtttttttttttgtctattcctttggctcacgtgtccctcctgctgcaatactcatttttgtttgttggatgatcagttgtttgaaccgcttaccttttttataggcgcatataaaagtgatttggtggtcctggagtattcatttggtcatgtattctatattttggaaacttaagttttaatggattaatctagtggaggatgtagtcaagaattttcttttgttggttcctaagagatttcttggctcgcaagttgcaacgcgaattgggctctcatgtattttactattttagaaagcttttaattatcacagatatagtagccgaacagattggatatagctgtgtattcgagacatctgtttgttatcttatacagggcatgctccgccactgaagtcaaaatgtagggagatctgttaagttgtataccatattaggcttagtttattcttttatctttctccatttgttctgctaggaactgagctatcccatggcatcaccacaagaatccaattccttgtgcttgaagcgcaagcttgttgatgactgcctgtcaaaagagtgcaagtctcgtcgcatcaaaactgagaagggaccatcatctgattcatctgccaagcgctgcaaatgctgttgcactcgacctaaccttgccagtgattgtgtcaattacctaaaaagtggagtgcccagccgtgttatgttttacaaacagggttcttggcacaattttcctgagcagataatgaagtctctcattgaagaatttagaagcaataaatctagtgttgttgctgtgatggacgatgagcctgttcttgttgatttcttgtcgatgaccctggtcaacctaaaatctagaaagcagcggtctgtggcatggtttgatgacactgggaagtgcttttatccttctctattctttgatgaggaagctgatgaagtggctaaagtaggcggtgattttgagggcgccacacagggaataatgttggataaggttgcaaattctccaccagaagtggtgaagcaagttgtccttgaatctagtcctccagttccacagaagcctgccactgcagacatattacgcaaaaagatcgcatctgtggaacgaggcagtgaaggctttctttttgcgcaggaccttttcctctctggcatgggtccatttgcaacgccaaataatatactgcacatccaccgctactctccgaatgatatcactgcacagtgtagacttcaagcttttgaaaaacaaatgatgtccaccaaggaagaacgtggtgatgcaaatgtaaggtatggatggctgggatctaggaagaatgacatagttaggatcctaattaatggttttggtaacaatggaaaacctgctgagaaggcaggcttgagtgctggtgtttatctttcaccagaagaccgagcattttccaggtactttttataaacttaaaaaaatgtattgaccattccattttaattgtttatgtatttacattatatcttgcttgacagtgttggtctttgtgatgttgacgaaaaaggagtgcaatatatgttgctctgccggttgattttggggaacatggaggctgtcatgcctggatcacaagattcttttccaagcagtgacatatatgattctggtgttgatgattgctcaaatccaaagtgctacgtcatgtggccatctcatcttagcacccatattcgtttagaatatcttgttagtttcaggctttcctcgaaagttcgaagtaagatgataaataatagttaaaggtttttatcatgttttgttgatataggtggagtgatatattttttggttcacttgttttcagattatttacttggtttgaagggtttatggtttcacccatcaccaaaggaagttgcggtggatatttctactcttgtacctgtgaggcaacctagttttcttcgtttcttcttttccattgacactctggttttccagctagatgtgcatgtactgctaacagtggtagaatagaagtctgatctgagagcaatccaatttcactacagattgttcctcccttctttaaatgacaaatgatcttggctttgttgtacatttttatgcagataatgagtggaaatgctgagggaccaacttccccttggatatccttcagagttctttttgccatgattcaagaaaatatatcatcggtagcaagggaattgctcttccatcattatgaagagctgaaggtactaactaaccaacaagttacactgtgtttatttattagcattggctgtgtggttggttggtgtgatgggtactaaaatgttttaattgtttatttgacaggaaaacaaaataactcgtgaggagatggtaaagcaaatgataatattagttggagagaagttgcttttggaaaccttgaagaggcttcattactgtgtaagtcggctgtcccctgctgttatccttcgaaacaatttctggtgacatatgcttgttttctcagttcacatccatactaaggatacttttaatgctcatatacttttaatacattatggacaagtttgcatacgacaacaggcacaattttaggaagtttttgttcaggtgttgcaatttttataagatggtttattatcacattgtttatcaaatcacacatatttgtcaaataaagaaatatctgctaaattttttaaacgagtaataagaaaattggtaggggctaggaaactagcaaggccttgaaaaaaatatagggaactctcaaagcagccaaacatgcctaaaacaggcacaggccttttgaattcatgtttggataaattatttggaaattttcctcacttgtttcaggcatcctcttatttttactgtaccagtttatctgtactcatatttcacatagctgttgctgcatctgtactggtgtgattaactgcacctttcttctgatgccattgtgtccttggcttctgttgcagccatcattatggtataaatctgctggcaaaatagcatcttctgatcctgcgaggacagctgcagaagacaggtctttggatcaaactgggaattgttcattaattgttagtgttgcgcatggtgattctcatgccccaaatgcagtagctgaaaacagcaccagtctttgcaccaaaggatgtgatactcctgcaacaggcatgatttccaagggctatgattctctggcaccaaaaggtgtgccggaaacttctacttctgtcggccccgtacatggggcttctccaagtgtggaacccaaagtgagggattctcctatacaaaccgttttatcaggaaacattgctactgattgtgccaaaaggcaagatccattggtatcaagagtggcacctgtagctcataatggccttttaaggatgccatctggaaaatcagcatctctcgcagcgcaagtttgcaattctgttagaccaagcacaggaccttcaggtcgtgcttctacagaaccaaataatgcctctaaaagttgtgggatttttgctccgggtatcaggccaaagggtggtgaatctcttgttcctagtttggcattaggaaattccaaatatgcaggtgtagaaggtctcaattctgcaccaagagcgacacctccgggtattaggccaaagggcggtgaatctcttgttcatggtttggcattgggaaattccaaatgtgcaggagcagaaggtatcaattctgcaccaagagtgactccactgggtatcaggccaaagggcggtgaatctattgctcctagtttggcattgggaaattccaaatgtgcaggtgcagaaggtatcaattctgcaccaagagtgactcctccgggtatcaggccaaagggcggtgaatctattgctcctagtttggcactggggaattccaaatgtgcaggtgcagaaggtctcaattctgcaccaagagtgacacctcccggtatcaggccaaagggcggtgaatcttttgttcctagtttggcattgggaaattccaaatgtgcaggtgcagaaggtctcaattctgcaccaagagtgacacctaaagacaaggagtttctttcattgagtatttcatcacaacaaagcccagttcttaattcaggtaaaggccatgatgggacatcaggtgccgcacgtccagtacatgcaccaggtttaccctcttccaactgcagatcatctgtagcacttcaagggttattcttgtgtacaaaatgtagataatcaatgctttcattaacgtgcagggcatggaaatcctaaagctttggccactgaggcccgtggttctctatctctgagtattgcaccgaatgtccatgaccctccagcatcaagtaaggagcctaaggacgatgcatctccaatagcaggcatggtctcagaaagccagcactctcaagcacctaatgcagtcaccaaggggtataatgctcccacacccagtacggtgcttggaaactcttgccatggaacaacattgttggtaacatcacttgtttttttgctaactctcatgcttccttggtgactgcagtacctaaggagtcaaaaggccagcatttacagagtggagtgcacagtcaatcgtctgggccagacgatgctagcagcagcaatgtcgctcgggcagctgataccatcgtcgccctatcaactcttcgagagaagggcaggtagatgttgcagccccttgtgctgatcgctctttgctttttgctgggccgttctctagtgctgtacatgtgatgtgaatgttatacaccgtcctgcccaaaaagcgtttaccgtcgtaccatggtccatgggtcggtccgtttaacttataggtggtgtaaaccggttggatggattcgtttgttgtaggttacctgtcaccttgtcgacttgaacgtgaatcgttgcacatccctggcagtaaactttgtcatggctggtatcttcggtgtccgtatgggttgtgttgcctcggtgtccgtatgggttgtgttgcttcggtgtccatatgggttgtgttgccggttttccagttagctatacatacctgcctagttcccatgtcaaatttaatctttcgtttactctagtgtacatttagtgttcctggaatatatgggtagtgctagatagtagttttgagatgccaatatgcaagcttggttggcatagattgatagataggcttgtgttgggctgtttttgcctgggatccagtctattctctatgtagactatgggcaggatttccatctaaatttcggcccaagtactatttttcacagttttagcggagggcattctctatagtctatacatacccatccagaatttaatcatataaaagcctagtagtttgagaaatgattcgattgagcaaaaggctagtcgagcctagcaacaaatggaatggacaaaaggcttgagcatttagcatgtagccattatataccatctcgtgctgcttgccacgtcggatcatgatggcttgcactggaaaggccagtctagcctttaggccatttgagtgccaagcagcacacacacatggcactttgatgagtctttcctcctttcgctgcctggcaatcgtggcactttgaggtgatgtctcccttgcttaattagtaggcacactgacctgcctgtcaaagaatgatatgattactcgatcgtagtagactttttttgttaactaggatgcctgcaccattaacctccactaatcggggtgtaaagattcatcagacatctgagtcccagttcagatagcattaacctccactgatgatgctagtggtgtcgcctcatgtcagtgtatgtcaccctgcaatttggtcttccctggataaaagctttgtggaagatgaatggataaaataagcataaaaaaatgaaacaagaggagcaccagatgaaaactcaaaactatactgtcagtctgtcatgattgatcagcattgattaaagatttttttctggaaaatgtctatcataataaccaacagaaatactttgtgatgaattgagcagtcacaatgtgcactatagattcttttgtgataagccccaaaaaagaaaaaaaaaggagaacgatgctatcaggagaaccatgtcgtggtctgcactccaacaaagtagaaatgctgtgttctttcagaaagaagtagaaatgctgtgcaagtggaggaacagaatcacatactccattttctccccggcatttctagtccaaagtcaaaacaagaacaagaacctttggatggtccaactaaaactttcttggaaacgtacggttgattttgatcgatggcccagcacccagaatctgaacttctgaagcttgaaagaacacgcataattttcagctggaattggtttgcatcattatttcaaaccttgaacagctgcaactgtaaaacattgaccagcggcttaattacagtttgaacatatagcaaatcactaaacagtaaaaaaaaagaaacacttgcctgtggcaaattaaagaaaattagcaacgaatcaaggaacccacgtgaagtgaaagtgaaatgcaggcatgaataaatgcacggcactagaagtggaaatggcacaatttggaatcaacacacaagtggtaacctatgcttgcattagcagtggtggtcgcctgggcatgcacgtcaaaattaatccctggcgattaagcgatcctaatgatgatcattgacgcgaaaacagtcgccatggccggccggtttctcgtgttcatcgaacaggatcatcactggtactgtgctactaggcaccacaccaaggcaggcatgcatgcttagctttgcgaaaaagttgaaaggctgacacttaaccaccaccaccacctgcagctaatagctagtacgccaaatgcagaggcccatctcattcatgctcctagctatatatatccatccagttctttttttttcatggacccatatctaaaatcactctggtttccttcttttcccttgtgagattcggtctcgaatcaacaaattaggagggtagattcgtcatatattccgcgcaatattaggcttcctttggaatggagaaattttagagattccttttatgaaaattgaagtaattcgtgtaaaaatcctgaaatttttgtatatgttctgaaggagccctgctgctagctaggcccttaactgtgcaatttgtgaaatatgtttcttcccaaacatgctttaaattgagagatgaacctaatgtaatacatgattccaccttgaatttgataagttcaaaaaatggacggctttaatttttcacctaagtaatatatttagtttctaaatttcatgcgatttaaattagaggtagttaaatgcagttaaatttgcacggagttggtttaaaaaatatcactccatgtccattgataaaaaaaaaacttgtgttaagaaatgacctatggtgaacaacatcatatatgagacagggagctcaaagcacgagttagagcggattctgcatgtcgagaggctaggcttcgtgacctttttttttttaactgaatttggtcgaggtctttcttactacccatcaaaaaacataaaaacctggaactggataggactgtcgagtggtctactccttcttgttttcttttttctttaaagaaatacatccctttaaaaaaacaaatatgttttattataataatagaagcttcacttatctcagtcaagtatacatcgaggtgatccaattacaccgagagcactcccaaactcggcatcactaaaatgcacacagccaaacacacactcaaacgctaaaagagagatcatagagagtattaaggaccatcaatcataaattgcataaacattattctttctccaaacctataattaacaaatttcttagataatgttttgacagaagagagcttaggtacggacatataggtgagcggctcaacgcgtttcaagccttcaacgtacagccggtccaacgtacgattctcatatataccttccttgaaataaactcagaccttattaatcaaattttcttctttccctctcaacatcaagttcaaaatccagctaaatttgcaatactaaaacctgtacttgttcgacaatgactggtattttaatgaacgattaagcagcagctgtctgatcgatctggtgatctcatcattttttccccctaattaagactcgctggagaccacaacatcgttagatcgccgactacgactgctgccactgaccagctgccaagtgcatatgcagatcagacaaacaagttttggtcaaaattttcgcgtaagcttccgtttgtccgagagattattctcctaatcttgatgcgtacgtacgtggctacgttagctccagcggcagtgtggctggcgatcgaaatgacgagcaaattaaccatccatcgcatgcagcgtgcgacgactgtccacgtgcgccgccggcatgtgttgactgaacttgctgccgtcttgcagatctaaacttaaattcatctcgctttcagatgtaaacgtttcaatgtagcgtttacttcaagctcttcttgcttctagattatttataacctgttcgtaataggagaatgcaaatggcagcatgctttttctgagcttctaaatggtatgttatttttttaaaggggcaattgcaaatttaccactactttaaatcattattgcaagactgtcactagaaaattgcaaaaatgccactagaactatcattcgagtggcatccttgtaatattgaaaaaaccggtggcaaatttgcaaattccccttttttaaaagaacttttaatatatgttcttttatacttatatgttttaaatccacctttcagtttcataacagttaatttatttatttatattctcgaataattatcacatatcattcatgtattggccgttccagtccattcattaaaaaaataaatattattagaaagcaagttgaaccgctttaaataatttagggtgtaaaataagctgaaaaaaattgcttaggggttaagtgttcaacagaaatagtttggaagtaaaatgaacctttttttcaaaaagagaaaaaaagacgctttcaactgtatgatactgcaagcaacagaaattaatgatgtagtattatgcatatatatatatatatggagtaaattaaagattccatgtatgaaaaatgcaggtttaactaactggcgctgaagtcaaagttatctgatttttttgtcgtcctgttttcttggttagagtcctatgggcatatagaaacctaagttttgtatgaatcgaatcttgttttggttttgacaattttgtgggtttgcacctaacggatcaacctaccctaattgttaatgggtgagaactgagcttaaatattagctgtaaccagttctacttagttttaataagttattaattagcagctaatgtctcatctagctagctcaaagtgcctgccttggcgtcacatactcacatgcaatgcaaagcttaattcagctagcatgcattggcatgtttctctgcatagactggcttagtgcgtacgtgatcgatccacccatatgaattaatttcttaccgtaatcaagggcatgatttaggggatttaattaatcgatctcttctgccactgttacactctgaactgatgaattccttgcaagcctcgtccttagttaatcttgcctctttatttgttcttgacaaattaaggaaaatcgaaaaatgtaatagccttttccatcctatattgatttgcaatatatcatgccataataattggattcctgctcatcaacaaaacaagttgggaagttgacttgtattgtgtgggggcagaacaaggtgactaggtgaggagttggtggtcatgtgtgtcgaccaaaacttggataatctattcggtttctttttcaggatcaacgcttgcactatcttcttggcatgcagttctggtctgacatgatctagcaactccactgaccactgtatgatcccagcccttttctcactgtcatcaccatatgggaacaggacacgatctgcatgcaaatcgacagccaggttgttcttcgaatcgatactattggggtagtagtagaagaagaaggttaattaattaaattaatcaactgcatgtgattctgcatttctgaactttctgaaccgtgatcccaggcaaagctagtcgattatattagtaatgtagtatagtattatcggagctagcacaacggttacaccacgttcgagatattgacttggcgacgtcaacgcagcagcagcaccaagctgccatttttaacacaccatccagtgagcttagagatagctaactgcgattgattatactaatactagtagctagatagtgcagtaattaacctttcgtggaaagctgaaggaaacatgcttgccatggaagcaatgcagcaatgcacatatatctctcttttctgcaattggagaatgcaaagttctctgtacttgttcagtctatatgatctatactccatattctagtatcagatgcataaacgttaaacacacgtctcgttcccagcaaccagtaggctcttgcttttggctgaattctgcagattttctgggtcaaaattgcagaaaatgtcatgatcatgtgtccccgacgtggccgtcacggacgccgcggatgttaagctgcgtcaacgtgttattaatattcacctcggtgtaagaaacacctagcttgattacctatgtataacttgagcagtaagcatggctttgcttcaattcttcaatgtttcagcatttgaggcatagtagcatatatgttcagactgcagttcagttcagttgttcatagaaaaaggggcatagatgtttgcttacacagcaagcacagcatataggatgttggctgctatagctactagtaggacacaactttaatttgaggtgtcacttgtgactcgctacacaattggttactactaatattgagacactagttagtatactttggcacaaagcgataacaaagtttaatggtcaaattgccatctaattggctttgaaaaatgccacacaagctttttttttaacgaaccaaggtaagagtcaaacagaaacgatggccttttctgggctacactcaagatatcaagggccccaaatataactttccaaaagtgtgaacaaagctaccttgccaaccgcattgaggactctactgctctttcatatatagccacttggccaaattctaatgctttgctctctttttaaaaaagaagaggaaggattttctctaaaaaaaataagaagaggaagaaaaaccaaaaatgcatgctcaccattgatcctccctatagctagctgtttgattagattattaggtaaattattgctacgaattatatatctactcgattatagtgataaattaaatatattaaatattttaagaaataaatttaatagatagttaaaataaatggtctaagctaaagggaagtttttaaagaaaacataatatttgaaatatgagcaaacaatccgtttcaatattctggtgaataagatgcaaagaaatgaagaaccgggtcgaccctgagtcctcactaatttaatcgctttcatatacagtcgtcttaatttgttgtgaatatatagtgtcaaaccgtgtaatactaaatattagtattagctagcaacgtcgtccatgcatgtgtttcttagtttcagaccgagtaaaaataggacggcccgaatcgcagtcgccgtttctagagaaattcgctgaaaataacggacgagagaatcggtccaaaaacgggtcgcgaaaacgtgcccggtctagtggaaacagatgcatgagcaatttgcgtaggagaaggtccagtggaaacggatgcatgggcaatttgagaagccgctttgcttgcagggcggagcaaagaatataggcggaaaaagcaaagccaagccagccaccgaggtaggtgtggacaaaaaaaaacttaaaagctcgtgattcggattgatttgaactcatagtcttcatatatacttagaggtatagctcgatagcctaacgaatttatctagctactctctctgttttatattataagttatttgactttttcatagtcaatattctttatgtttcatcaaatttataaaaaaaatagtaacatgtataataccaaattagttttattaaagttaatattaaatatattgataatatgtttcttttgaattgaaaatattagtatattttttataaacttgatcaaacttaaaaaaaattgatcaaaagatgtaaaataatttataatgtgaaaaaaaagagtagcttccaaaccaacctaatcttttatagcttgttagcgctaacgaaccgagcagagtcgttaagataatgagctcaaacaaccgagccctatgggttgagctgactcatgtaaaaccctagaagatgaatataggactcgagaggaggagtatgaaaccctagaaaatgaatatgggattccagagaacgaatatgaaaccctagaagatgaatatggaatcctagaggacgaatataggactcgagaggaggaatccgaggacgaatatgggagtcagagaacaaatataggccccgagatccacccctccaccgaggcgagctgcgagcggtggcgcggaaagaaaccgacgaggtggcgtgcgcgcgcgcaacgcgcgcgtcgaactgaacatacgtagcatacgcgcccgcgacgcgcgacgcgcgccggctgctcgctcgcctcgcctcggcgcgcggcgcggcggccgcggcgcacgagcgagcgtttcgttcgcacgcggaaaacgccctccacgcgtcggcacgcgcacgccacgccacggcgtctcgcgccatgcgtacgtccaactgttcaccacagcgaaggcgtttaagcccatgcgccaagtagacgagcgtgcttgaccaaagtaggaatgcgttttttccccttttttttttctccaaaggaaaaaaaaatgattatcaacgaactgttgccacaaagatggttgagaaaatccaacaaccggtagagtaacaaccaagtctgtctccgtgactgacagagtgatcacctagcagcatcggttaggtctacagttcgtttgttgcacggacagctagctagccaaatgcagatgataatttgtcctccgcttatcgtccacaacaacatcgacaaacacacaacctgaataggctgttgctgtttttgtttccacgttacaacaagttgaatagtggagtagcatatgttttcaggacaatttttcgcgtactgtaccagaatctacaactttgatactcctatctagcgttgttacctggagtaccagctggagtaaaatctttgcatcgccagcaaggtaattggtaggcctaaccagcgtttacattaccgttggtaaccgcccttaccgcgaggtacggtaatagaaatatcatggtaacctccttaaatttaaataaatttaaaaaataatttaaatttttgataaattttacacggttttatacggttaccgcgcggtaaccgtgcttaatcccggtttcggtggtttggaaaaccctgagcctaacactgcctagcttggaccttcccgctttactttccttttgccatttcattccttctcatcttttcaatttcacgacccgtcttttaatcttttttttttcgctggacacagctctgactttgcctttggatgctttactcttggatgtcccaagcagctgaactagccagccattcacctaaaattctgcacattcataaagacgagcattacctacacgcagacaaaattcagcggatggaaaagagaattcagtgatgcatgcaaaggtccatatcaaaaccaaaagaggagcagcagtacgtaccaggggtactagaagtgtacccctccataaaaaaaaaaccaatactagcagcgaacctagacacatatgtgttcagattcattactaggattggattctttttaggatagagtagtaggagtattctgcaaatgaccatagcgtttaacgtagtactagtatctcatcaattcgtcaatgtaggattaatctggcagccattaactaagacagcgtgaaacaggttagattgtgtttagtttcacaccaaaattggaagtatgaagagattagaacgatgtgactctaaagttgaaaatttgtgtgtaggaaagttcgatgtgacggaaaagttgaaagtttatatgtagaaaattttgatatgacggaaaagttggaagtttgaaaaaaaagttggaatctaaacatggccttattcgtcatagtgataaattaaatattttaaaaatatacttagtatatggaatattccctccatcataaaatataaaaagttttggttggattggacacatactagcactacgaatttggacatattacttgtcgagattcatagtatcaggatatatctcatccaacaaaaacttttagtaatattttggaacggaaggagtagcttagaacatgtagtccaaacatacagcattaggaaaaaattatccagtgaagaaaatgaaaagaactagcacaattgtcaatccaaaaaaaaaaatacgattcccccaaaagaagaaaaactgatcggaagtgtggcaaaatttagcatcaaaccaggtctaaaaccacagtaaattttgtgcatacatgtagtgaacattttcagcaactacataaaaaattgcatattttccaacaacaatggtggtcttctttaaaacacaggaatttgtatcatgacattttcttaaaaaaaaaagatggacattatactccactgttcttggttctcccagcgtaagcaaaagctcatattaatactgagcaagtgaacagttactaccacttagttcatcgcttcatagtaaattcatttttctcccatttatccaaaaataagtttatttttaaatagttattacattggagtctatgaaaacagagaataattacattgaaaatagataaataaagaatagttacaatataatttgataaagagtgtgttgagttcacgtcaaaattagaaatttgattgaaattggaacgatgtgacggaaaagttgaaagtttgtgtttgtaagaaagttttgatgtaatggaaaaattgaaagtttgaagaaataattgggaactaaaccaggccaaaatacatatattgtagtctttttattactatgtattaatatgtgtgaaatgatcggggaaaaataatcctctactgtctccacagttctaccaccaccagcagcagcatcggatccatccatccacgcattgatgttgcagcgcagacccgtcgttactcgtagcttagtggtaacagtaacccgtccaccaattgctccacccgttgcagtcgccatcgacttgactctgacctgcccctttctctttctcttattcttcaagagtgtgtttaggtacttccaaagttactagtttggattaaaattgatacgatgtgactaaaaagttatgtatgatagattaacgtgatggaaaaagttggaagtttggatctaaacacggcccaagagagggtgtttagatcaaggtgtaaagtttaacgtgtcatataaggtattatataaggtgttatatggggagttcatacactacaaagaaaaccaattacataattcgtcagtaaaccatgagataaatttattaaacataattaatccatcattagtaaaattgtcaaaacatgaaacaagtagacttaaaatattcgtctcgtaaattagtcgcattctgtacaactagttattttttaacctatatttaatattttatacgggtgttgacatgaagcaagtagacttaaaatattcgtctcataaattagtcgtattttatacaactagttattttttaacctatatttaatattttatactggtgttgaaacgtttcgatgtaaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggcctaacaccccctcagtctatctctcttcaaagtccaagcagcccacgaagtacccggcatttattttcctcacccattttctccactaaaatacgcgccgcttattaaatttcccccgcctttgctttgcgtcaccatatcaaatgcgcaactagcactggtgcggcctaccagtgagcgagtctgcgagtgagagaaaagaggacacgagaaagctttagagagagagagagaggaaattgattttttttaagtttgcgatgaatgaataaacaaatctggtgaagaggttgggaggaagaagaacggctgctgatgagagccgcattggagtcaaaaccaaccgtctctttctctcctctgactttcccccactctcctcctcttcttcttcttcctcctgtgatgccatcctcctctttcggcgcctcacaatcttgcgatccagctcatgtggcggacggaatgagagggaatttcccgttcttgcgctcctggatttcttgcccagaggaggagtcttgactcttgcgagcgtgttcgttcttggtgattagattcatgctgcctcgttgcaaggtggtgtgagttgttttcctggattcttgaagttgttcatgccctgcaggaagaaggggttcattttctgattccgtcgacggcggagatgagaggttactactgcttcttccatttcttggtggtgtccgttctgctccacgtccatggcggccgctccgagagccagacgtgcgaccccaccgacctggcggcgctcctggccttctccgatggcctggacacgaaggccgccgggatggtcgggtggggccccggcgacgccgcctgctgctcgtggacgggcgtgtcctgtgatctcgggagggtggtggcgctggatctctccaaccggagcctctcccggaactcgcttcgcggcggcgaggcggtggcgcggctcggccggctgccgagcctgcggcgcctcgacctcagcgcgaacggcctcgccggcgcgttcccggcgggcggcttcccggcgatcgaggtggtgaacgtctcctccaacgggttcaccgggccgcaccccgcgttccccggcgcgccgaacctgacggttcttgatatcaccggcaacgccttctccggcggcatcaacgtcaccgcgctctgcgcttcgccggtcaaggtcctgcggttctcggcgaatgccttctctggtgatgtgccggccggctttggtcagtgcaagctgctcaacgacctcttccttgatggcaatggccttactgggagcctccccaaagatctgtacatgatgccagcgctgagaaaactaagtttgcaggagaataagctctccggcagcctcgacgacgacctcggtaacctcactgagattacgcagattgacttgtcatataacatgttcaatggcaatatccctgatgtgtttgggaaattgaggagcttggagtccttaaacttggcttccaaccaattgaatggcacattgcctctatccctgtcgagctgcccgatgcttagagtggtcagcctgaggaacaattcgctgtccggtgagattaccattgactgcagattgctcacgaggctgaacaactttgatgctgggaccaacaagctgcgtggtgctataccgcctcgccttgcctcgtgcactgagttgaggacgctgaaccttgcaaggaacaagcttcagggggagctaccggagagcttcaagaatttgacatcactgtcatacctttctcttacggggaatggttttaccaacttgtcatcagcattgcaagtcttgcagcacctgcccaacttaactagcttggtgctcaccaataacttccgtggtggtgaaaccatgccaatggacggcatcgaagggttcaagagaatgcaggttcttgtcctggcgaactgtgcactcttgggcacggttccaccttggctgcagagcttgaagagcctcagtgtgctggatatttcatggaacaatttgcatggggagatcccgccatggttaggcaacctcgacagtcttttctacatcgatctgtccaacaactcattcagtggggagcttcctgcaacctttacacagatgaagagtttaatttcaagtaatggctcaagtgggcaggcgtcaacaggagacctcccattatccttcgtcaagaagaattcgacttccactggtaaaggcttgcagtacaaccaactcagtagcttcccgtcatcactgatcctctcaaataacaagcttgttgggccaatattgccagcctttggccgtctagtgaagcttcatgtgctggacttgagctttaacaatttttctgggccaattcctgatgagttatcaaatatgtcgagcttggaaatattggatttagcccacaatgatctcagtgggagcataccatcatctctaacgaagctgaactttctgtccaagtttgatgtttcgtacaacaatttgtctggagatatcccggcaggaggccaattctccacgttcactagtgaggattttgcaggcaatcacgcactacactttcctcggaattcctccagcacaaagaattctcctgatacggaagcaccacatcgtaagaagaacaaagcaacccttgtggcccttggacttggtactgcagtgggggttatttttgtcttgtgtattgcttctgtggttatatcaaggattattcattcaagaatgcaggagcataatccaaaggcagtagcgaatgctgatgactgctcagagtctccgaactcaagcttggtgctgcttttccagaacaacaaggatcttggtattgaagatatattgaagtcaaccaacaactttgatcaagcctatatagttggttgtggtggttttggacttgtttacaagtcaacactaccagatgggaggagagttgcaatcaagcggctttcaggcgattactctcagattgagcgggagtttcaagctgaagtggaaacactatcacgtgcccagcatgacaaccttgttctgctagaaggctattgcaagataggcaatgacagactactgatctatgcatacatggagaatggcagcttggattactggcttcatgagagggctgatggtggtgccctgctggattggcagaagaggctacggattgcacagggatcggcaagggggctggcatacttgcacctgtcgtgtgagccccatatattgcaccgagatatcaagtcaagcaatatcctcttggatgagaactttgaagctcatttggctgatttcgggttggcaaggctcatatgcgcatacgagacgcatgtcacaacagatgtagtgggaaccttgggctacattccacctgaatatgggcagtcacctgtggctacttacaagggtgatgtgtacagctttggaattgttcttctggagctactcactgggcggcggcctgtggacatgtgcaggccaaaagggagcagagatgtagtgtcctgggtgcttcagatgaagaaggaagacagggaaactgaagtatttgatccaaccatatatgacaaggagaatgaaagccagttgatcagaatcctggagatagcactgctttgtgtgactgctgctcctaagtcaagaccaacatcgcagcagctagtcgaatggcttgaccatatcgctgaaggttaaggttcagtcaagttcttaaatggtttcagtttgatcgatcaagatccatcctgatagtttcttaagatgattagttctgtaaataatatttacatagcgtgaaatgccaagagttcaatttccttctcatgccacccttcaagtaatagttcatatcatcctctttcctttcttcataaggtggttgcaagatcaccacaatgtaaaaaatgcattgtaggtttaaaccctcaggataacaccctagcagttacataaccggcttttctacagatttattgtatgttctgtaatttcagctactgctatggtatgaatgaacttttgtggggcatttgttttcagtgatttgctccagctagtgctatcttatatgtccattttccatttttcacatctgatccttctcactgcatgtaaaatatgagaaatcaaggtcttatgcagcgctgcagaatgcgagcaccgccatatcagagtcagatacagatggtatggccagttacattgttctggaattcattcagcctatactggtaaattgctgtatggttttatcttttatgatcttgtagtagctccattgtcttcatttggctgatggtttgaccttgccagcattcagtactggcactgcagtgctttggcaggggtgatttcttccacgttgcatgctgttctctcatatttgttcgaaagatttaggttgggaactctttttcgtgtaggtaaaacaggatacttattagaacaggaataaataagtattatagctaaaataaatttgaaaaatggattaatttgatttttgaaacaattttcctataggtttttttttaaaaaaaatatttttgaagcgagtagaagtttagaagggaacttgtagtacccaagcctttttttttctttttttaaaaaaagctatgacctattctggataggcctctcctttgctcatgcacaaaattgtcgaccgttctacagtgcagaggaaaaacacggaaggagcagagaacggcgtggtacagcgtaccagatcaaccaccacccgtgaatcgacggcgcgtgcaggggattagccggcgaggccgcccgtcgcgcgcgcggctccatggttaatggtttcttccggcctcgctccctcaagttgaacccgagcacatcacaggcaaaggcaagccctcggcgtaggcggcgtaaagagggggagaggagatagagccggacgaatccgaacggcaaagcccgcgtggctggctggcggcctttcggcctattctcacgcgagcggctcggcccaaaataagcctattcgcattctcttctcttggtattttccactggttgggccaaaaaacgggaactacaagcagatgcagataagctcaacaacagcaacacctgaccaatgctggtcgtacgactacagctgctcgctgtagcctgctgccctgctgtttcgagtatcacacgacacttcttcacttgtgtagtgtacgtatatatggttgctttttttgataactatatatatgtgcttggttggaccgctaaatcttaatcttagcaacgggcatccttacctacgtggagtggattaggcctgtaaagttattagatctcgatccagcactgtggagcctatttagccaaagctcttctctcctgtcccataaaacttaagcagtgcagactctcgctcctctctcctctttttcacctctgcaatctgtacagactgtacttgcccccacgtagtctgaatccatcggtttacacacaaactcctagttgtacaagatggtggtggtcgcacctcataaaaatcaaccagaacacagcgtgcagtaagccaaacagaggcaataacacgcactaaacactgacagcgtggggtttcgccttcgaggcttcgagctagtcgatcgtgtaaggccctgtttacttcccaaaagaaaaaaaattccacccatcacatcgaatgttcaggtacatgcattaagtactaaatgtagaaaaaaaaacaattacacagttcacgtgtaaattacgagatgaatcgattaagcctaattgcgccatgatttaataatgtagtgctacagtaaacatttgctagtgatggattaattagacttaataaattcttctcgcagttttctgacgaattctgtaatttattttgttattagactacgtttaatacttcaaatgtgtgttcgtatatctaatgtgacaatcaaacctaaatttttttcccaactaaacaaggcctaaggccaagtttagatccaaagtttttcttcaaacttctaacttttccatcacatcaaaactttcctacgcacataaactttcaacttttccgtcacattgttccaatttaaaccaagggtgtgtttagttcatgaaaaaagttaaaagtttgaagaaagttgggagtttaaaaaaaaagttagaagtttatgtatgtaggaaagtttttgatgtgatatgatgtgatagaaagttgagaatagggagaaactaaacacggcccaaacttctaattttaatgtgaactaaacacaccctaagtaaatttctctatatcgagtaaatcggaaaaagggagccatgggaataatttcatctcccatccacataggagaaggcaatgcaacacggaagcaggggcaggctgcaggctggctgggtgggggaccccggtagcagcagcagcagcagcagcagcagcagtagcagtagtacttggcggcaatggcattggcattgcattgtcatctcacgatgcagggggccagaggggatgcagtgcaacatctctctctggtcctctccggccaccattattaccaccaaggactctcgaccgcaacaatggtggtggtgcccctcggcccggctacgcgcacgcacagcgcaagcggcaagcggaagccgatcgccgccacgccagcgggtgacccacacctcgatcacgttggtacaacatttggtccgctgatagtatgtgctcggggcacatccgacggtgccctggaatccaaagcttggacgatccatcatccatgtatagagttgtactacttctactatagtagtagtgatatgaaaaaaaaattgatttgttctttctttttgagaggtaaatgatttgttctttagccaccatttccatctctccttctctctctacaaggaccagcatgtagttgcgacttgcaagttgcaaacgcagtgcgtcattggatggactgcattgcggtgcagacgagggagcagatctcagagggcgggtttatagtgatggtggattggtgggtggctacttttgctttctacttactccgtctcatgatactcgtcgctttgaatttttatttataaattttgatcatttgtcttattaaaaatattttaaaattattatttattttatttgtgacttactttattataaaaagtattctaagtatgatttatcattttttatatttacactaattttttaaataagacgaatggtcaaacgttacaattaaaaagtcaaagcgacatctacgatatgacggaggtagcgctaatcccaaaactcaagccaaggcgaagccaaggcaagtcctctcctcccccaggcaagccaagcagcagcagtgggcgcagtggcgcagcgcaggcgagaggaggcccatgcacccatgcatgcgatgcgttgccatgttggggtctcacactcgcagcagccaaagcctgtgtgtgcctgcagcccgcggtgccgcttccccccactgcgccgcgcacctggccaaaagttggccgatcgatcaccacgccgcccccaccgcaccaccaccatactacacatactccagttgcacgcacgcacgcacgcacgcacgcacgcacggcatcgacccatcagccaccactgatcgatttgagagcgttttcttttcggttttcccccatcccccctcttctttttctcaaagacaaccacactgatcaatggcgtgcctgcccaagcacgcagtaggcggtgcatgtggttcaacacacacccccaaaaggaaaaaaaaatccataaattaagagaaaaacatttgtaaaattctagttttgatgcacttttaactgagtgtaaatgtgctgtaactaagcgtaattgctatgtaggagtaattaagtgtaagtgtaagtgcatcatacgaaatataaaaacctaaaagtctatcgtaagtgaaatagcaaaaccgaagaaaaaagaaagaaggaaaaatcgagagagatataaaaagtgttatcgttgattcgtttgttgcttattggcttataaaccgcagcaaaattttaaattttcaaactttattttaaattttttaggtgttttttcatcgcattttttcttggttttctagatcaaccacgaagagccgacgccaaccaatgccactgcattatcaaatcatgttcatgttcgggaaggcaaggaaagggacaccaggagggagaggaaacggaagatgccccgagcacagatcaggtttgcaaagcgatcgagtctacgagatagttgtggttttggacgggttaacgggacatctccactgaacttgccctttcctttcccttggggatgctggctgactcgcttgttgggtggtgtgtgacgagcactttctgggattgcataaggtgttggttctcaagtatgcagcaattatttagcgaggctattgctgtagatccacaattcgtgatcgtgcctcttcatggggatgccatgttattggctcattgcatcttaagctcccaagcacaaaagttgtcctcagccattcctagtaggatcaaggatgcatacatgcatgctcggtaagtattaattatccccttcaaacttaaattatcaagacctcgaattttttttaatagaagacatgtgaccaaaacagctaaacatatatggtagtaatatttaggcaaaaactttacaccctttttagtggtccaaatgttaaagctaagtcatgaaacttcaaaattaagttctaaactttaaatttatcatcttaaaagtggccagtaaacatgcatttttttcccctttgaaggactattacatgtcatatcatctaggagtagtagcaaactaatcacttgtattgatctaactcctagactaccaatactgctactgtagaagtagtgctagtatataggagtactccgtatactcctgtactacttgtacaatcaatacaaaggctactggggcttgcgtcaccgagcaaactaggcttacgttccctgttgggcagatcctagtactagcagaccaacgcaagctactccctccgtcccataatagatgacgtttttgactttttatttgtaacgtttgaccatttattttatttaaaaaattagtacaaatataaaaaaataagtcatatgtaaagtacttttgataataaagcaaatgacaaacaaaataaataataattttaaaactttttaaataaaacgaatgatcaaacattgacaaacaaaaacttaaaaagtaatatggaatggaggtagtacaccaacaatgttattgagacgtactccttcctgggagtagtaatggcgatccacaggagattcctgggatagctcgaattattgttttcgctgctcctaaatcagagcaacgcgagcggaaacattgttatttggtgactgggagttattccctctgttccaaattataatacttcatctgtcccaaaatataataacatatccgttaacattccattcccaaccaatcacaaccctccaccatcactactggagaagtgatctttgctgggtcggccgatttccacaatagccccggttgcttgaaaagccgggactaaaaatgatctctggtccaggtttatttgtgcaaggggactatgtgatctttaatccaggttcacctcgtgtcagaggctatcaggtcctcaaagatctttagtcctagttggtagatcttaactttagtcctggttgttgttcctaaccggaactaaagtttatagagatctttaatcccgattggtattcggttggtaaaaccaacctggagtaaaaatcaatataccgtatataatccctttgcacgtatcctcaaaaatttctatctactcttcctcctcgctcttatcctctccttatcttcctattcctcctcctcctcccctctctctctctctcacagttttatcctcttttctcatagagccggcgaggagctggcgacagcggaggcggcggcccgcgcgcgcggaggaggccgggagggcggcaggcggcgggtcagcgattttttctatataatttgtgattggagatctgagatgcatttgatttgtgtgtgatgtattcatgtgatgtatttgtgatgatttttgtagaacttgtgatgtaattttttagaatttgtgttgtatttggagatgatcgatttgaggatttggagataatttttgttatgtgatttggatttgtaatctgtgatgatttatttggggtgatttggggatggagtgaaatcaatattcaatgttaaaggcaataaaaaaaagtagcgatcgatgctggcctggcatctttagtcccggttatttgaacagggattaaaaaccgacatctttagtcccggattctccctcccggttcgctacccgggagtaaagggggttgcgaaccgggagatatgaggagttctccagtagtgcattcacttttcccacctacctccactactcatccaatcataaccctccactattcacttctaactactttattaataattgtgtccaactctaaaacttcttatattttaggacggagggagtaacttatagacttcaacatttatctaaaaaatataacaacttattttttttctcacccaataacaaacttccacctcttaatatccccacctaccttctcttttaaccaatcacaacaattacacgtttagttttacctacttttttaatacctagtatgtcaaatctaaaactcatattttgggtattttggggcggaggttgtaagaagaaagagaccaacagccgtatgtgttgtggcaataggagaattttgactattattattattctggaggatgcatggctagctggagtagctaggatcagtaccactaatgttgcagctgctgcctccaggagcaaaagagcaaaacgggacgtagacggagatctatgctgcctcctggagcagcaggctaagctatagcttctcactgatgtgtgctgggtgaattatggacgaatcattcagagttttgccgctaaagttgggggatggtgcacggcaacttgcctcgaccgccccggggggggggggggtggggggggggggttcaacaatacggggaccatactaaaaaaccacacaagcttttccctctcatctcatcgatggatcaccattttgtgatctgttggtgttggtgtttgcgactgcgcgagtggccggtggggcctcgtgggctctcgatgagtagtgatcgatcgatctttttttttttcaattttttttcttggagacacgggccgactgctgatctgatccagtgtgccgcccaacattgtgggtagctttttccagatcgtgcttctcccttttgtggctgtgaacctgcccaactttgggctgccaactttcttcgccctttgctcgaaaacattatctactggcatatatttgctcgatctatcatgcatcggcttggacttgagaaacccgggatcgatcaattgtggggttactacaagctttcttcataagataatcaaactgaatttgatgccactccgtgtagacaaccaaacaggaggctactatgtgctccgtgcagcagacacgtgcatgtaacagttaacgccgtggccggaagtagtagtagcactagtacgtgtggtaccaccggttacaaaggcacaggtaaattcaaggcgatcctccacagaaaccctgatgattggccatccgaatccctagctttgtgaggacacgctcgggggtatgtgcaccgcaaacagatcgcacacgtgcacgggcgccccagtcgcacatgccgcccacgtatgcacgcacgcacgcgcgagtgcggcatggaacgaaccgatcgaacgggaggaataaggctgtagctgtaggagacggacgcgacgagatgagcatgactcgtcgtcagtcatgcccctgcacgcgcgggtacagaaggaacagaagcgagtggtagctagtctagtcaagcaatagctaagaggcttgccgctccgctgctgtgtgcctgtgcgtgctgcgaattcatcagccacgccagcgcgcggtggccagccatgggcggcgagttgaagttgaacgggtgcaagctggtggcttggcgcagcgcaggggatggccaggaggggcgcacgtacggtggtcgtcggcagagagcgagagggtggagaggaggaggagcccgcagcttttggcgcagcggggtgggccagcgcgctgctcccccggctctgttgagcgtggaaaattcagaagggggtggtgctgttcctgcgctgtcccgcccgccggcgccgggttccttcctggacgccgtccaccgcctccacctgatggaccgccacctagctacatataccattgatctgttcagaaaaaataatttttttggatgatttcgatcgtatgaaaatctttgtaacaaatgatttaatcatatcttattctttaaaatttttatgaaataagtaatcctataaagattttgaacaaaagttagcaggaggttcaaccacttaaaaaaaattctttgagtctatccctcttatctgattcatacatttttcatgtggtttaatcaaacgatcattcctatattttttccatgtttttcatttctttattttacacttacattcatgttagaatcccgtgttttttctattactttgtttttcaatcatgctattcaactggaacctaaacgataatttccttggcacgtttcacatgcatcttgctaaatgatatattttctaaatatttctatatagaatttattttaaattttaaataaattatttttttagtttatatagttgttaatacttaattaatcatatgttaatgagttttcatgggtgtcttaccaaactcagaaacgaataagcccttagtattagaggtagaaaaatatggattttgaaataataactacagtagtcttgtacaaaactcctattatacgttctcagtgagccatatgcatgtagcagacatgtgactcggattttggtgttataaaactgatgttaattatattaactcatctaccaaaatttgacatgagatggtcaatctgtcttcggctacaaatatttgatgtttgacctatcaaaaagaaaaaaaaggggtacaggacaagatttaatttaacttttattgttaattttatattagttatagtgtataaattcttataatttcttaatattgtgtggtggtagtttttaagacgaatctacacatcattttttaaaactaaatatttaagagattattaatagttaaaagttgaaagagtttgattaaattttatcaaaaacatcaaatactatctgtgattaaaaagagtactatcgcaaatagtaaagagtaaagaggactaatcaaacgtataccatggcacgacatgcatgccatgctataaccgtgaaacacgtcgagacacaaatagtcaagcttgtctaaagtttagttcggctaagtgtgacaggaaaccacattttcaagcccatgttccccgtttaagctcggtccacgcgacaggaatcgtggacgcaggccagtgatgggaaacagaaaatcatcctctgatagtaggcgctggatatgtttgctagctgatgaaatccagctaccatgctccatgtcttaggatatttgttgcaactgtacttactcattaaaatagggagattccatctaaacaacttccttctgtccctaatctcagtcttgatcctccaaatttttaataagaaaaatacggctacacaacaaaatatagctgtatagagtgtacacagactggtccatatcttaattagtagaacttctgctgataatttactgttcatctgcacttctgggaacaaacataggagtattgatcaatagagcagctagctggtacaaagtctactatcctaataaacccaaggtaaataaaagcatatactcccactctttatcattctcaacaaataaacccaacttgctcgcgtacagtacatacagtacataggagtactgtagtgcaggccggagcaccagtacactgaactgctgcacccaattcatactagtactccttgtcaagctcatttaagttgatacgcacggtcaaaagctcatttgtacggatggctccggagcctctcgtttggcagctgagatgatcttttctcttttaatttttgggttaacataacacaaaagattaacctgaatatgccataaactttaccagtttggacccaggtaagtaggatataaagcatgagcctcacttgtcatcaacttttcaggtcacatttcctttggaaggttaatttacactttacacccccccattaccaccataattaacatgactcatcttttttgcagacgttggaagctatagctagcacaacaacatcaagaaattaagactcccatccatatatattgacgtcaatctacagatatagggatgtcgacagtcttggcaatgaagactatgatcacgtcgaagcaatttcagtgttactatcggtacagcgatcgaacaggcttgtacagctatggagaaagcgagagatcatcaagagggccaatccgaaattcttagaaagtacttatgcactaatccgatgcacagcacgagtacgaaactacgggcaaaatattcactcgatcagtagataggggcaaatgcatgcaacgtacactggtcgactagtaccattcttctttttttttttaaaaaaaaggtttttacccaacacatagaatgttttaacatatgcattgagtattaaacgtgaaaaaaaatcaattacatattttacgtgtaaattgcaagacaaatcttttaaacataattgcgctatgatttgataatgtggtgttacattaaacattttctaaatatggattcattaggcttaataaatttgtctcacagttttctggcaaaatctttaatttattttgttattagataatatatatttaatactttaaatgtgtttctgtattccacttgtgttttttcttacgacgagttaaaagattttttttcccctcctgcgacgtaacgtcaagtcatccatgtagtacgagtcaaacgtgttttccatgtctatgtcgcgtcttctttttttaatcggcgaaagaggacgaggacgccatggacatggcatgcagtggtcgacaagagcaaaaaaataaaaaaattaaaaaatctcgagttctttttttttctttttctttcacggttggattggtcacgtcacggtacgaccggcatgtcgcgcacactagggttgggttgatgtgacaagattgctccgtacgtacacacccccatccctttcctccttttttaaaaaatgaccccctgtttgtgcgctgtcacgtaggggacgttacgttgctgttgttggggatggtaaaaaccggccggactcgtggaatcaaaggctctaggacaggttgcccgtttggggtgtggatgatgatgatgatgatgacgacgacgacatgggttaaggaggcaaggttagctgtaatcaaacatatgtgtacgtaggaggacaagcatacaaggactgattatataagcatcacaagtggctcccagttaattaagtactactagtcgctaatccgcaggcagctctttaagtggaaaaaaaaagatagtacttgattagtcttgtcatgattatggtatttttgactaattgtgatttccaactcataaaatagaagcatcaagtacataattttttatacctataatatatgtctcttattaacatagaaagtaatgtctcgagatatttatgtactaactcgatggacccgttcctacttttaccatggcttttattagacagactgtaagcactatagtcagcgcatcgagaaagtatgtcccaagatacctaatgctcccctctctgttcaccggagctctacgtatataaaatattgcctacacctggttgaatatattctgttgagcgattaacattctatgtagtaggagtactccctccgtcccacataaaacccattcctatcatgctaaggtgagactagtgaagagtaaaaatgactaaaatacccttttattattgaaaaaaatagtaatgttgaaaggtaggtaaagggtttttaagggagaaaacttttcgttttatgtgccaaggttaggtaggatggtagaagttgattttttatgggacaaaatttaaactatagaagttgattttatttaggacgaagggaacatataacaaaattagcaccataagaccatattgttaacccaaataatgaaatcaatacttcatgataccggtagaatctggaggacgggactggacaaacacgtaggaggagcagtactagctgtaacacagacggggaggagttcacaaaccaacacgggctacaggttacaaggaacggtagtagtactccagtgatacaacagtggtgccccacgggaacaccagtctgcgctgcgtgcgatggagagctgcatatgccgggatggtggatggatctctctcatcaccattagagcatatataatagcagactattagccagatataaacatattttaataagataagtgatcgcgggctatagatatgtagccagctgcagcacgaacttcaagacacaatatatgtaatatgtgagaccatatattaataatatattaaataattattgtacgaattagctattaaattggttatagatgaattaaagctagtagtgaactatactattatactattaaacttgctcttacggccgtggttacaccgacccgacagccgcttacatgagcccataaaatacggctttttcaaaaccccctcgcttcccaactttttaaaaactcttcagacactgtgcgggagctcacgctactgtacggccccctgcgctgcgccccccctcgtcgcgcacacgcacacacgcactcgcactactcgaaccacgcgaacccctctctttctctctctctctctctctcgcttaaatgccacaaacctaatcatttccacccctcttgcgctctctctctctctctccaaccccaccctttctccccaccatggtggcgatctccgagctcgggtgagcggaagagaaaggttggttggtcccttgccggcggggtgggggttggattgattttgctttgctttgctctgtggtttgttgatgcttgttgttggtgttggtgttggtggtggtggtgcagaatgcggccgatttgaggagggggatggggttttcgggtggatttgtgaggggatagattaagagtttgtgcttctctggtttggtcggaggaggaggagatgagctcgtcgtcggcggccagcatcgggccgccgcagccgccgccgccccccgcgccgcccgaggaaggtgggtggctaggtttgtttccgccgcttcgcttcgcggttcgctttacttcccttctcgtttggttgatgactcgatctgctgctgctgctgctgctgcagagaagaagtgcctcaactcggagctatggcacgcctgcgccggcccgctcgtctgcctccccaccgtcggcacgcgcgtcgtctacttcccgcaaggccacagcgagcaggtgaggctgagctcacctcctcagccgtctcgtgggcgcgcttgctttgcttctctctctctatctctgctggtttctcttgtttctgacgcgggtgagctttgcatacgtgaaggtggcggcgtcgacgaacaaggaggtggagggtcacatcccgaactaccccaacctgccggcgcagctgatctgccagctccacgatgtcacaatgcatgtacgtggttccttgccctaatttctcggggcatttctcagatcgatgcggcgtcacctccactccactcctccggtttatctccatggctgtcggtgctgacttgggctggcaatttttttgcaggcggatgtggagactgacgaggtgtacgcgcagatgacgctccagccactgaacccagtaaggcgcctggggtttttgcatgatgtttgcagtgctgaggttttgatggtttgaaggcgtgaaatattctaagcggttaatttgatggtttttttggatgtgttcattcgtgcagcaggagcagaacgatgcgtaccttcccgcggagatggggataatgagcaagcagccgacgaattacttctgcaagacattgacggcgagcgacaccagcacgcacggggggttctccgtgccccgccgtgctgctgagcgcgtcttccctcctttggtgtgatgagtggtgtaatttggggctgtgctcctttcttgtacttcttgggtggttgggttttgctgttgccaataacaggtggtatagtgtggtttgtaggatttcacacagcagcctccagcccaggagctaattgcacgggatattcatgacatcgagtggaagttcaggcacatctttcgaggtaacttcttaaaaatctgtagagcttatggcagtcttgaattcttcataacggtgaattatgatattcttaaagggaatttcctaataatcatctctgccccttttccattcgataagttcaccctttgtaatcatggcttaaaaccttcctaataaaaacgttttcaagtgttctgagaaaaacttcaaccattctcacacaatgtgatgtaagcgtctttttcacttaaaaatcagttggtgtgaatggagcaagagatacttgattgaattagggttatgcatagaaatgaagttacgagatcattaattggataagcacataaaaaatatcaaattttaatatgttaggatagttagcagtggatcaagttacaattgacatatgaatacatgatactttcagaggcgtactgaaatatttactagagttcgcaggtcttacaaaattgcacaatgagcaatcactgtactggacagtataattctcggtgtaggcttctttttgtatgccttgaattcccatctttctgcagggttgaacttattgttagtgtgttttctgacacagaatgtactttgtattgatcacaataactaaaaaaatgttgtcttaacataaatgttgatagtacatatgcttgaggtacttgtgctgtattgattatgaaatgggatctgctcaacactaatgatgttgttagtaattgtgtttagtagttttatatttttgaacatgccatgttactatcttttgtagtaatatgctgtttttgacaggccaacccaaacgacacctgctaaccactggctggagcgtttttgtcagtgctaagagacttgttgctggagattctgtgcttttcatatggtttgttttccatctctcttgcatttgtgattttcttttttacctgtgctaatgagtagggcgcattgttgattctctgactcaggaacgagaaaaaccagcttttacttggaataagacgtgccagtcggccacagactgtgatgccttcctctgttctttcaagcgatagcatgcacataggtctccttgcagcagcagctcatgctgctgctacaaacagccgtttcactattttctacaacccccggtaagttggacttttaaattagtatatatgcattgttgtttttcctccccatgtacaccgttaatagaaagagtgtttgtagggcaagtccatcagaatttgtcataccactgtcaaaatacatcaaggctgtttttcacacccggatatcggttgggatgcggttcaggatgttgtttgagactgaggaatcaagcgttcgcaggtgacctagcaaatgtcaatgctcagtccttattctataatctaggccaaatatataaatgatggtactttttttagataatacttggttacctagcaccaggagatcctatacatgtttgtaggatgtatgtgactatgccagtggctgaaattgccattatctgtactttttatgctttcacgcgttgatgttcttgaaaaatctgcgcatctgtcaggacatcaccccattatttatgggaattttataattgggcctctataaaaatccataatatactaatgcgcccaatgcacactttaatgaaacacaggtatatggggactataactgaagttagtgatgcagacccagtccgttggcctagttcctattggagatctgtgaaggtaatttttatattacttgaggttgttctaaagagctgtgggggtttaaacgtgatttgtgttgtctttcctgattatcttcatcttctttagttgcattttcttatgatctgtacctctggttttcattataacaatcatggaactgccttcagatgttattgcactagtgcttgcttccacagttccactaactagtgtgatattttcaggttggttgggatgaatcaactgcaggggaaagaccaccaagagtttctttatgggaaattgaaccattgacaacctttccaatgtatccatctctgttcccactgagagttaagcatccttggtattcaggagttgcttccctgcatggtacgcttaagattcttgttactgtgtgtcaggcataaactagttttgaagctattttgctgtatgcttgctatgtgtgtgcgcctatcatgtggaagtttatttggtgcatttacatagtgttttagccatcacactcaaattactgaagccacagccttaataaatttctgaacctgccacatcaaccagctgatgattctaactaaaataacctgaagttgagattgtggtgcaagagcaagaggctatagttcaagtcagtgttctctactgtgaacaatatgcctcaaatgatggttctggatacagagattgatcagggaactttataaaatgctcatataggctaaaagtaaaacaagttatggtgtaagtgaaaagttgatctcttccttccatttcttaagcacccaaggtggatcaatgttatttgataaggctcttccgtagcaaatgtaacgttctataatatgcattctttttattcattgtctttctgtgcattcttgttatggagaatgcattgatctgcctgacataattccattttctagtatctctcattcatatttctgttcttttattaactgctgtatcacacttaagatgacagcaatgctttaatgtggctgagaggagttgctggtgagggaggttttcagtctctgaactttcagtcacctggtattggctcctggggacaacagaggctccatccatccttactgagcagcgatcacgatcagtaccaagcagtagttgctgctgctgctgcttcccaatctggtggttacttaaaacagcaattcttgcaccttcagcaacctatgcagtcccctcaagaacactgcaacctcaacccattattgcagcaacaaattctgcagcaagcaagccagcaacagataattaatcctgatgcccaaaatatccaaacgatgttgagcccaagtgctatacaacagcaactccagcaactacagcaaatgcagcaagttcagaatgatcagaagcagaagattcaaccagatcaaagctaccaagttcctacaagtgcagttctcccaagtccaacatcattaccgagtcatttgcgagaaaaatttggcttctctgatcctaatgcgaattcttcaagcttcatcacctctagcagtagtgataacatgttggattcgagcttccttcagggaagttcgaaagctgtggacttatctcgatttaatcagcctgtagctagtgagcagcagcagcagcagcaacaggcatggaagcagaagtttatgggttcacagtcagtgtcttttgggggctcggttttgcataactcacccacaagcaaagatggttctgttgaaaacaaaattggtcgtgatgtgcaaaaccagtccctttttagtccacaagttgactcttcatccctcctgtacaacatggttcctaatctgacttcgaatgtttcggatggcaacttatcaacgatcccttctggatcaacttatctgcagaatgcaatgtatggttgcttggacgactcttctggtttattgcaaaatacaggagagaacgatccagcaaccagaacatttgtgaaggtaactagtataatttgcattgttgctaggtcaaatatgagctcctctttttcctccaaaaaatatatattcttcttttcatggaaccattgtaaaattgcaggtttacaagtcaggttcggttgggaggtcgttggacataacccggttctctaattatgctgaacttcgagaagaactgggtcagatgttcggcattaagggtcaattggacgaccctgatagatcaggctggcagcttgtattcgtcgacagggagaatgatgtgcttctccttggagacgacccttgggagtaagaaatattctcagaattctgatttatttattagttttagtaatcaatatccatgcatgcgcactacaaattcaagttttagtaagcaatataaatttaagtttcatcttaccgttctatgatttggttgcaaaaaaatctgcttaaattttagtactacacttggcataccctgtccatgtgtgcacactacaaactgaatctcttaattgatgttggcctcaaaacggccaagttaacatgctaagtaaaaatttcaaatctacatcaggcattgtaacttcattgtatatctaaataatttaaagatattaaacgtgcctaagatcaacaaaatttggcttgactagcaagtgcaaaagtggctgtcttatacttcctccgtttcataatgtaagactttctagcattgcccacattcatatagatgttaatgaatctagaaatatatgtgtgtctagattcattaacatctatatgaatgtgagcaatgctaaaaagtcttacattatgaaacggagggagtacaatactttggtttcctggtttccacaactaatagcttatcgaggaaaggtatgtacaatgtgaatggatatcccttcttcattcactgaaagacatgttgacagctcatggacagtatctaatgaatatgtttaaaagtactagtgttatatggagtatatttttgcaatgttcggtgcctaattgtgatctcaaacagaattcatgtgcattcagtcatacatctttaatgtgtattaatatgttaaatttttttactagactgttcttccttcaataatatgtgttggtcagtcactatatgttgatgctcagttacccaagacccttcgtgagagtaaacatcagacatgattcttcttgaaactgaccttcctcatatgatgtaggtcctttgtgaatagtgtatggtacatcaagatactttcacctgaggatgtgcataagatgggaaagcaaggaaatgatccacggtatctgtcctgaagtgagagaacatggtgccatttctggtaagatgtcataattatatttattgtaacgattaccaaatcccacactaatccttaaaaacctatgactggatagagatgttcttttctgagtaaatctgttatcatgttgtgtacttcgatagttgttgacatattggcatcatgtgttttttgtcccttattgaatgtaaaatggtctcattgtgcgggttgaagaatgtctgtttgctctaatttttattgctcggaataactcacatcttaattgacgactcaaatttaatttagagtctttttatgcatattcatctctgcatactaacatgtcctggtatactatcacagggcttccaggaggattctgcagtgcatggtggcactcttgctctcgacaatgcacgtcgtcagaagtcccaaatttgtatcttgcatgtacgccgtacatgtttccagaactctctgttacctattcggtgcaggccaccggaaccacgaaacctgatattttgtaggttccacttaggaatcagtatcggtttaactcttatcctagatgatttgtaactcgcacggcagtccactgttttcatgtttcatcgagtcttcctagacattaaacttagttgatattgtatcaggatttatgtgtattgagattcctctacatgctttcaaccaaaaaaaactgcaataatcgaagcgcacgaggattgtttcaattcgtgttgtaggatctggattttcaccgattgtccggttatgtcagtttcgagaggagctgtcaatctgaagttttttctgtagtgcctaatattttgcttttattattaatgctaatcatatactgttgtgatattttctgttgttgaatatccaaatctaaagaacagaattcccgatggttcactctacagaatacatagatcgacgaactggcaagagagtaagatttgaggcagagtgagcaaataccgttttgcgtgggctcgtttgtgtttgcctttctccttgcgccgcctgccaccgtcgtgtgcgccgagtttcttatccgggacgacggcgagggaatcaactggtggtggaggaagctgtaatttgtgggagctttcgcgtggagtgagatgggatccatgatccaacacaggctccatggcggcgtatgccgttataaaggattggaatgtacgatctgtcgcagttgttttcgcacctcctttctgacgaggaaacctggattgcccccgattgggattatgtgatattcccccgtgacacgagaatgtcatggggaatgtcaccgaatcccaatccgattgcccccccctccttatttttcctgaccacatagtactaaactgttcccgatcaaaaaaggagaaaaaaaagagggagcaatttctttttcaccaaagccgtttaaaaaactttttgatcccgacaaaatctgattaatttttatataaaaaaataaaaatctactttgaactttttttgaatttgattgttaaactaagcggtttatgtcctcgaaccagcccgagaaatcgagtttttgtcaccatccggttttcactagttttgtaaatcctagttctttggggcaattctatcagaagagtgatgtggctcgagcctctactattgatgcgaggattatggacaactcacataatctctacaattttttttttgccatacatagatggaaatggagctgctgttcctttgtctaatttcttagacatcctgctatttttttctggatacgtcattgctggccctgttatagttggagacaataacatcacattaggcaagggctaccataaaagatgtttgagaagtgtagataataaattcttttacaagggtgttgtgatgagttaacggatttgttcggtagacttttgctacagcgttttaagctgtgttgcacagcttagccgttcggctgcacaaacacatggcgcaggaagctgctgcttgctgctagatgcctggttgtagtgcaaccacagctaggccgtatgaacaaatccaataattgaacaagtgaattcaaatgtaaaacgtattccctagagagaaaaaaaggaaaatgtaaaatagagttgttctactagtagtggtgtactactcccctcttctcaaaataaatttatatttcactcattatgcacgtacgaacaaaaataaaaatagtataatatcccactttattaaatcctaatataattattgttgtttttatctattttcaatgtatttatgtcttactatacaaactttgatatgatgaataaataattaaataaaaaattattttgagttaaatagatggaaaaagtcactaacatcaccgagcagtgagtcaaagacatcacagaggtactcaaaccggagtagcactgtgctattcaacggtcaacctattgcatagacagagaggcgcaagcgcaacccaaatcggatttacagaaaaaccctcccgttgccgttgcctataataccgaccttttcccaattattttatctatttatttatttttttaaaaaaaacctgcggcgtccaccaacccaaccctttttccccaagtcgacacgcgcagccaagagaggcgaagggcgcaacgcaacgcgaacccctccttcccccgtcgcgcccaaccctaacccgcctcccctccacgtagatccaatcccgccgccaccgccgaaccctagcccgccccacctccctccccgccgccgccggaggcgcgcgcgcgcgcgatcggcgtcctcccgccgccgcgttcgtgcggggtggggttgggaggaggaggaggaggaggagggcccgacggcggctcctctcgagacgggggccatggaggcggacggtgccgcggctgcggcggcggcgggggaggcgagcacggaggccggcgcgaggcccctggcgccagaggaggaggcgctgcggcgcaacaccgactgcgtctacttcctcgcctcgcccctcacatgcaagaaggtgtgtgctcgttctctctcgacgattcgtcgtctcttttccctcgtatataagctggtttggtttttggggcggggtggtaattcgtcttttctcgattggagcttagaatttgaattccgcacctcgtttcgggaatcttgatttctgagctaagtaaacacgaatttctttggttcaagatggaatcttttcatatggctattccccctcatccaagatgtgatgcttaatgtagataacgtaataatataagttcgtagtgccttcaggttcggggtatttgttgcctcttggtgttagcccctgaatttttcagggtttctatgctaggtcaaattctgaatcggctctataatttaaaatttgaatggtatggttgtcctgaattgatgctccttcgggtgaaaagtgaaaacaatgtaatttactatcgcatttgttcccaatatatcgctattgcagtggctacatggcttttagtagtacggtaaggtaggaattgtaatgcttcccttgtcaccaggagcactataacaatatgttagtatccttattagtctagttattcaagatcattgcttcacaatttttttgtttctctttgggaatccttgctcggctcagaattccatttgcttttagcccctctattattttggaatacgtatgatgctgtactgatttagttctggagctgttctgatgaactatggttaaattagagagaggcaaaacgcttgccataaatcaaatctgtcacacaatctgatgtgttgtaactttgtaatcttgtttgataatactatcaaaattatgctacattaatgcaaatatgtgcaattctctatatataaacattaatgtaacactaaaaaaatgctacattaatccttatgggcttttgtgtcttatttaccatgaatattttgtccatcatggatttgttactaacttctagcttgaatattttaattgataatgattctttttgttccttacatcaggggaacgaatgtgattttcgtcacagtgataatgctcgtatgaaccctagagactgctggtactggttaaatagcaattgcttgaatccaaaatgtccgtttcgccatccggtatgtccctttccttcctttttccccttatgcactggtattatgtttttttatcaatacttgccagcaagcagcattgtctaagactagtaaatttgctgttatgtttctgttcatcagaaactaacagggtgtttgctcctagttattaagcttaatattatttggtcattttgtccagtgaagttatttggagtctaattctgtcttctacttttacccagccaattgatggtatgtttggtgctccaactactggaatgcctgcagtttcttcacactacgctccatttaactctggaaagcagttggttccatgctattactttaaaaagggaaactgcttgaaaggtgacagatgcgcattttatcatggaccacaatcagtgggaaataatccatcagaacaggtggtaaaagtttcttccttacctttggagcagcttcagactcaaaagaatgatttgttgggcattaaagattctgtgcagtctactaattccattcagcatggtgctccaataactaatgagaggggcaaaacagccgttgatcggtcaacggttaattctgccaggacagctacagttgcaataccggttgcttccaatgcaatgtcttgtcctaagtcagagaaggtaaaaagtagtacgccagcagcacttaaggaaagcttcactacttcttcaggtggggatcatcctgagtgctaccagaaccattttccaatggatagtgatcctgtgcgagattggaaccaaagttatgaaatgccccctgcagatgatctgccccagaacagtagggaggctgatgaacttttgggtgaatcttcaccaggttttgatgttctcgtggacaatgatgcagatggtgctgcttatttacatgatgaagattttggaggagatatgtatccagtggaagattatgaatatgctccagctgattttgatgttcgtgcacatcatgaaagagagcggttcaatggtatggatgagcaagaccagatgggacatatgtatgatggctacgagagaaaacggcgtagatcatctgagaggagcatggaacggcctttccactcagaaagaaggtttctgcaaagagatagagaccgtgtcgagatggatggatcggatttacgtcatcggctccgtaggagaagaataaatgagtcttcattggcaattagtccagaacgcaatggagagcaacggcggagggatgagcgctacagggaaagggcacatggtcaccgttcacacagggatcatcaccagagctctcgaggaagcactcttagctctcgtctgcaaggcagaataaagcttcctggaagatctcctgacagagttgatactcgctccgagaaagagcgagatagaagaagactccgggacaggctgtctccagttaggcgcacggaatttcagggtaccaggcatagggaggcaggacaacatgaagagcagacccagcggagatcaagtgaacttgctttaggttccaggaatgcagatggccagcatttgacaaaggatgtgcctgactcacacaacttccctcatcgcaaaaactcgagggactccagtaaggccaatggaagtgttgagcctgaagcatcgcttgattttgagggcccaaagccccttagtgtcatcttacagcggaaaagagaggcagcatgggccaatggcacatctgcctgtagccccaaacaagataaatctgccgaggtctcacacaggcaagcttctctggctgaagctgagaaggaaggtgacaacataattagttctgatgaatacaaaagtggatctggcgatgaagaattcagagacgaaggccacatccctgtggagggccatgggcaatcttcatctcatggtgacaaacttgaggctgaagatattattgaggtggatcccgtggaaaatcaagatgctgataattatgaccagagggagggggagtcctactatgagcctatcgaaggccaggactacaaatccgatgacgagaatgcttatgaagatgatgatgaagagtatgatgacgatgatgattttgctcggaaagtaggggttgttttctcttgagctctgtgggccttctcctggttttgttgcatgcagcaaagctgaaaatgcttgccttagtgaatctatttggataaattcctctggtgctttgtgttttgttcttgaagttcatagtgccaaagcctttatttataaggctgataactgataagtataggtcaggtatgaagcgggggtaggattcataaattaaaagggctttacgtgtaaaaactgctgcactcgttgtgttcagcatatatctgatctatcctgaaactattgtattgtattagtttcctaactaacagacaagatatttctttgataaattttttgcctgatatgggtaatataatcagccccattttggaggggttcttttcttcacgaaagagtaatgtgtgattgtacatatgtggttcctcagttttcctaagattcttaagatggcatcagcctctgaacgagggaaggaactattttatcaggtcaactaatttggccgtctgggactctgtaaaattttgctgcttcattcaaatataatcatcttataatcataacgaactattttatcaggttaacggagtgtgattctcaactcacgatcatctctatctctactaattgaaaatgtttttgctagtactttaatatatcatccgtgtatgagtcggtttttaagtttgtttgattttggaaatacacatccgttcagtcgggttttaaattcgtttgcttttaaaaatatcgaaggagtcatataagatatctctttaaaaatctcacatgctaacttgagatgatcaaactcctaattgcaactcatgattttctagaaaaatatatatccaagccgcgaattcctagagtgaatatcatcttaactaataaatcgtataacaacaataaattaaagagtaacgtgtacgaacattccttaaacttgtaggggtgtgtcatctaggtccctgaactctcaaaatacatatccaaatcctagaacttgtcataatgtgttatctaggtctcaaatcgtcataaccccttcaaaaatctacgaggcattgatgtgacatgccacacagacatgacatggcattattttttctttttctttttttcttctcttttttcccatttattctcttttctctatgacccgtgtagaaaaaaagaaaaaaaagaatgggaagaaaccgaaaaagaaaaataaaagaagaaaaaaaaagagaaaaagacatgtcacgtccatgtggcattgccacatcagcgtcacgtaggattctagaggggatgtatcaatttgggacatagatgatacactttgacaagttatgggacctggatatgtattttgagattttagagacctttataacataaccttacgagtttaaggactgccaatgcactttactctaaattaaaataaccttcacccgttgtaacgcgcgagcttatttttttctctagtcttaattagtatcttttaaatatactcgtgatcgtgccgcgcctactggatctctgcttctgaccaaaatgttccgcattgaatcatcacaggactgaaaatcaatcctcgcaaaccacgagattatcagtatattaagtctcctgggaagctcacatgtatacccttgcaaactgtactgctatatgctaaattatctgcctgcatgatcattgaacgcaatcgtgagattctatggccttcttaagagcaacaaatgcacacctttctggacggggaaaccaacaaccaaatgcatatattgttgcacatcatcaaatgcccttcaaaattgtattagggcgcatgtgtatttcttccgttagatcaaaaattacaattcaaattaaaattcaaaaagagagagagagagagagagagaggattgagagagtaatcctgaaatgcaatgttttctgtaaaatacaatcggcttgtggtttttccccaaagaaacaacattggatgttactcctaattaagaatttcggcatttagcaagtactaaaaaataccagtaacaatttcattataaaaaaagataggataaatcacgatcgcaaaaactgaaaaagaaattctcaaaagaatgaaacagtttgcatcatgagaagaagaagacaagaagaggatgagccttcagtggcatatataaaaactggattactactgtactactctcagtctctcggcttctagactagggaagctcaccaacccaagaacaagaagtgatcggagatggctcccaagaaggtgctcctgctctgcggagactacatggaggactacgaggtgaggcaaatcttcctcttgttccgtgtcttgtgtgttcgattcgtgtcctcgcgattccaatggggttttcttggaatcttgtggatcaggccatggttccgttccaagcgctgcaagcgtacggggtgtccgtggatgctgcctgccccggcaagaaggccggcgactcgtgccgcaccgccgtccatcaggggattggccaccaggtacttggaatgattcgattccgctcgatttggatagggtttagtataactagttagggcttggtctgatgaattgaacatggcggattcccattctagagtggtcaggaatatcttcgctttcttgcctttgagtaattttaggatgtaatttctaggattaatacacatctgctcatcgcaattggcagaagggggaaagaaaaggagagtacacacagtcacacaacgggacagggaaaacatatgtgcaactaggtttatttttgagagctcataatgaaatgacagatttcttggtatgattgatccattagctttatctgttattctttctattctccaaatatctggtttagcattgcgagataagtttgacggaataatcagtcatgagcagaaatattccttaactgtctacaaaatgggatagctcttctgcatgattgaatggaaaaatcatttgaacattttggatactgaatatacttagacagccattcttatttctttcgtcacttaagtgaactgttgattggttcatgatttgggggttaactgttgctgtagagatttcttataaattcatatccttgtctgtttcccatattattgcattagttcctgcttctctttagatggtgttgcttctttcaaaactaatttgggggtcctctttgtctactggactactactccctttagtaatggaatctttgttttctctgaagcactcgattataaggatcgtctgtattgttggttcttttaggtgtgatagtatggtggtacttttcgtctttctaacataagtttgctttgacaaattaaattagattcattttgattcatcatgcagacatatgctgagtcaaggggccacaatttcgcacttaatgcttcgtttgatgaggttaatatcaatgaatatgatggcttggtaattcctggaggccgtgcaccagagtatctcgccatggatgaaaaggttcttgatttagtaaggaaattctctgatgcgaagaaacctattgcatcagtttgccatggacagttgattttggcagcagctggagtagtccagaaccgtaaatgcaccgcatatcctgctgttaaaccagttttggttgctgctggtgctaagtgggaagaagctgatactatggacaaatgcacagttgatggaaatcttgtcactgcagtggcttacgatgcacatcctgaattcatcagcctttttgtgaaagcgcttggaggctctgtaactggctcaaacaaacggatattgttcctttgtggggtatgtttagggaaatttcattcaattgaattcgtatgactactttcttattttcttcatttttcataagtcataccatctctgctgaacctctttgcttaactacatgcttataacaggattacatggaagattatgaggttatggtaccatttcagtctcttcaagcccttggttgccatgttgatgcagtttgccctgacaagggtgctggggagaaatgcccaactgccatacatgactttgaaggtgaccaaacatacagcgagaagcctggtcacgattttgctttgacagcatcatttgacaatgtggatgcatcaagctatgatgcacttgtaattcctggtggacgggctcctgagtaccttgcactgaacgataaagtcattagccttgtgaagggcttcatggataaagcaaagccagtcgcctcaatttgccatggccaacagattttatctgctgctggagtccttcaggtacatgataatgattaattttctaccattgctctacattaatcgtacttacttgattacttctatacctagtgttggaatataaagtgaattgtccgtctttcctcatcagcttaagcttttggattgaactggtcggtgcatgcaactcaatacctagcgataggaaaatttaccttgaacaaaacaaaaataatgcaacaatatctattcttgattaatggataattaaatgattaaatcattcctgcaaagtaaaagcattttcatagtgtggtaaggtaggcaacaagacgtactattacagtatcagtatgtcactatccttcttagcgtagttattcaggatcactgaattgcttccgaaaatctcacacaaatggacacaaacctgtttgatgcacgcagcgatgctccccagtctccctaattgtggatgataatatgatatgcagggaaggaaatgcacggcgtatcctgcggtgaagctgaacgtggtgcttggcggggcgacatggctggagcccaatcccattgaccgctgcttcaccgacggcaaccttgtgaccggcgcggcatggcctggccacccggagttcatctcccagctcatggcattgcttggcatcaaggtctccttctgaagcaacgagaggtcaggtcccagcgtttttgcacgcgatatagcaagacacagctttgggctttcgtctaagatatatacagtcttaccgatactgtaccagtctgctgtcgttttttgtgcttgaaataataagataattactaaaagggtttgcgtgtttatagtattatgtctgtacgagcagaaggagctgcacctggggattgcctgtgtatgatatgaactgcagttgaatttcatgagctctcgcctctcgccgacctgggcagtacttcttgggccgtgcttcaccgtgcggcccactaaagtcagcccatcaccgcgagagcgatcggagaaggaaaaagtccaacgctactccctaagactgagtttgaggagaagaggattgagaagattggaaagatacgtaaaacggggtgagccattagcgcatgattaattgagtataaattattataaatttcaaaaatagattaatatgatttttttaaagcaacttttctatattttttttaaaaaacacaccgtttagtagtttgggacgtgtgcgcgaggaaaacgatgtgatttctcactcaatgtcacttgaacgaacgcagccatataggttgaatttaatttgtatcccttgaacgcagctatgacgacttcttaaaccggtataaaataacttcaaagtagtattgaaggtggtattcactgacggcatattgcccttggtcaaaccacctgagttggctgttctcctctcctctgatctccatctctcagggcctattcatttttttttaaaaaataacacataagaataggagaagtgaaggaataggaatgcatgcgaacttcaatccataggaattttccaattggtcagagcggatgaatttttttatgttttctttttataacttgtaggaaagaatttttttgttttcctatatctagatttcttcgaaccaaatggatttcatagaaattaatccttagaaatccaagtcctttgaaattccccttagaggctatggcgccgggtccttctccctcttgctttttgtaccttccttctcgacagacgtccaccaccctttcccatccctcctctttctgcaggctacagagcttgcagagcttcttcgatcgatttgctctttataccatttcctccgtttcgtaacgtaagactttctaaaattatccacatttatatagatgttaatgaatctatacacatatatgtgtcttacattgtaaaacggatggagtagtcattctagcatttcccatattaatattgatgttaataaatctagactgtgagaaatgctagaatgacttatattgtgaaacgaatgaagtaaaagattttgggtggatgtgatacattctagtccaaattagtacaaatgaatttggattatttttagcagggagggagtaacagagtaataatagtcacacctatgtataaattaatcgtctgaaactctgaatcttcctttcatttcatctccaatattgcaaaaattaggtacggcgctgttaaggtttgggtaaagcgcatggcaccagcgccacctgccgatcgatggaaccaaaagcggcaggaaatgagataagcagagaaaggtcaccacgcaagcacgcactacatcacgtatgtgtgcctgctccaagctaagctactctttctagctaagctttgggcttaatttgccggcttttcgctttttcgtgaacgcgcaaaaagattgcacctcaatatattatgccggcttttcgctcatgcgcggcaacgaaataaacactgaattgatgatgatgatgatgatgatctgaggctgctaatcttgccacctaattttgcctcaagaaaagctcgccacttacgctaaagatggcgacgaaacggcagctccgagccctttaatcctagcgtgcccttggcctttctgcgctaccgcttcttctaccttatccttctcacacgccattcttccagaaaacataatgctattcttaggtcgtgatgttcagttatgtttttgaaaaaaaaaacaaaaaacataagtgatcttcagttacgttattacgtcccctgtaactgtaagctgatgaagcctgaagaacctctcgccaaaagatcgaatatggtgtgtaaccgcttattgtactttctgaagttttggagcattcaccgacgaatctgtttcactgctcctaactgttactgacattgatgttacactgagactggactgaagacgtggaggctaattacctaaaaacgcaaatattagaaaatgacctaatatcaaataaatataagatgtgagatttcgaacccaagccgactagccctccttatgaagttagccggaagactgatgggcgtttctccgatctggaggcttactaaagctacacataagacatagctctagctggctctgaggctggccctaaagatggatgatctaatcccacacacgcaaacagctttcatcagagggagaaaccttcatgaaaacttcatttttgtcaaaggtttggcgcagcaatttcacagaaggaagaaagacatgatcttgctcaagctggatatatctaaggcattcgacaccgtttcctggagtttccttttggagatgttagaattcaggggatttggtgctggttggagaagatgcctgtctgctctgcttctaacggctgagacaagtattctgatcaatgggatcacttctgatccggtgaagctggcgagggggttgaggcaaggtgacccgctgtcaccccttctttttgtgttggttatggatacgcctgaggctatcatgacccaagccaggacgacgggattgctctctcctctcaatgctgcgagatttttgcccagcacttcagtgtcttcttccgcccggtgactcaggaagcgttggttattcaggctgtgctggatctgtttggggaggccactggattgaaaacaaatctcgcaaagagtgccatcacgccaattgtgaaaccatgtgtggttatagttcttttgtgatgggaaattgacaagtaccggatgtgcaagaagtgtgtgtgtggactaacgttggtcaggttgcgacatctgtgccaagacaacggttgtttggttcatgtgtgtgcaggtgatcggggtcgatcttggtcaacggcggatcgggactagactcagggaggagttgaggtccaaagcgatcaaggatgccgggtgacaagattggacacaaggttgcacacggtggacgaacaccgtgtgaaaaggtctttgcaacaggcttcacaaggccaagtgtgcaagcatcggattcgcgaagaaatcagaagggactgtgcaagtgcattgctgctacagtacttgctgtaggtagcatacatgcatgtacacgtactgtacttgtgcaaggaggagcttgcactgtactggttgctactagcatggctcggtggaaaagtcaagctagctagctgtgcatgtgcgctgtgattggttggcagggaggccaagccaatccagccgttccacgtggcccaagatggtgaatggctcggctcggcaggcctgcatcgtccaagcagcgacggcccaagacggcggcccatggcgcatgggctcaggaggtgcaggcagcttgcatgcgcaaggacgcgcgcggaaaaaccgtacgcggcaacccccgtttcgcgtgactcgatcggaggcgggtgcaggagcgcgggacccacacgcgattttgcaagcgcgcgcgggagcggctcagcgggacgcgtggcggcttcgggctggttgggcgctggcgagcgcgcgctgaggaaaaggagacggaacgcgcacgacgcggctgggcaacgtggcaagtttggattcgtcaagacggagagcacgcggattcatcagcaagaagaccatgtgagggttcggatcgatgaggtggcaatcatctggagcttttcctttgagtagaaggaacaatggatggaccagatctgttctgagttagggtttcgccctaggggtatttgagacaatgtcttaggggtcttaggctataaatagagagatggatgcaagggtggaggttgctccttttggtaatcattttgagatgctcggtgagagagtttccgtgtgagtttggagtgtgtttgcccgagaggcttttgtattaggattagtttggagtgtgtttgtccgagagattttaagtttgtgttaatgttcctctgaaggtgtatgtttgctcctagttgagcggttattttgcatcacctataaatgaaatgatttgaaggatttcatttttgccttgtccatttaaattccgcaatttaaattccgcttgcaatttgaactttgcgatgatgagttttgctctctctttctcacctcacttctagtttcgggaattccttttctcttcctcctctagtttcgggaattccttttctcttctttttctctcttcttttctagatccggcttctctaatagccgcgattctagtaaggattttgagaaatccggcttgatgagtattttcgggggcaagatttgaattgctatattcaccccccccccccctctatagctgttcttggtctttcaattggtatcagagcccggttaagttcgttgtaacctaaccgtggcaacgaacgcagctatggaggaaaaatactctgcgaaaccatttgttttcgatggacacaattttgtcatttggaaggcacgaatggaggcctacctccagtcgcaagggcataatgtgtggaataaggttaaatctccttatactgtgcccgatgatgctgacatcacgcctgcaaatatggctcaggttgattttaattatcgtgcaagaaatgcaatcattggtggaatttcttctggtgaatttaatcgtgttcaacaccacaagtccgctcatgacatgtggactgctctgtgcaatttccatgagggaaacaatgatattcaattggttcgtcagaatcaatttcataaagaatatcaaagatttgagatgcacccaggagagtccattgattcttatttcaaacgttttggagaaattatttcgaagttgagatctgttggaaaagaattttctgataatgataatgctcgccatcttttgaattgtcttgattatggtgtttgggaaatgaaagttacttccatcacagagagtgcacctctgagtgaccttaccatggacaagctttactcaaagctaaaaacccatgagatggatgttttccatcggaaaggcctcaaacactcgatggctttggtagctgatccctctggtagtacttcttctaatgactcagcctttgtgtatggtggcttctctcttgccgctttacactcagtcactgaggagcaattagagaagatccctgaagatgatcttgctctttttgctagaaaattctcaagagcttacaaaaatgtgagagatagaaaaagaggaaaaaccaatgaaccatttgtgtgttttgagtgtggagagcctaaccacaaaagagtgaattgtcccaagttgaagaagaagagtgacaagacgaccaagaagcccgagggacaagggcgaaaggggaagaaggatttgatgaagaaggcgatccacaaggtcttggcggctcttgaggaggtgcagcttagcgacatcgactccgacgacgatgatcaagaaaagggggacaaggacttctccgggatgtgctgtctcgccaacaacgaggacttcatcaacctgtgtctcatggcgcttgaggataaggatgactcatcggagcatcctgaggtatgtcttgatgatatcccttccttggatggttctctttgtgatgattcttgctcagataatgactctgttgatgatgaactaagcaaagaaagaatggcacacttgatgattgaaattagtgataagtataggtcttctaagtataaaattgagaaactaaaatctgaaaatgatggaatggcgctagaaattgctaggcttcgatccatgattcctgaggaggatacctgttctacttgtgcttcatatctttctgaaattaatctcctcaaggataagttgaaatcatgtgctttaggagctgggaatccttctagtgctagtgctgcttgctctacttgctatgaaatgaaagttgatatgggtttgcttgagatggaattgaaagaactaaaagaaaaatttgttcatgataggattggtaggtgtgaaaattgtcccattctcactagtgacaatgatgaattaagacaacaagttgccatgcttaggaccaagaatgatttgttagaatcttttgctactaaggaacctattcattcttcatgtgctaattgtgctatcctggaaactgaactaaaagatgctaaaactgtcattgattctatcaaatctattgattcttgttcttcatgcatttctctgaaagttgatcttgagtctgctaagaaagagaactcatacctacaacaatctttagagaggtttgctcaaggaaagaaaaagttgaacatgatcctagaccaatccaaagtgtccataaacaatcaaggtataggctatgattttgctgagtctttgaggataggtacccatgagattttaggtgtcacagatgggatgatagaactagctcaaaaacctataaccttcaagtctgcaggtttcattggaaacactagttctagtacacccaaaacctcagaaccaaagatggtacctatgactagcaagtctaagcctgtagagttacctagacccaaaaatccaaaacaagttgagcacaagcaaaaccagagacaaaccaagcctgtagagaaaaccaagtatgagtgcacctattgtgggaaagctggtcatttggtaggtttctgctttagaaaggctagaaaagagcgacaagaacgtcttaggactagaagagctactagagtccctgagaggttcgagtgtgcgtatcattgtcgttcaagtggtgtatctcgctttcctcgccgagatgtgcaccctcgacgtgacctagcagggttggggcaaaacagacatggtcatcttgcatataattctgctcataacactaaagatgcttgtacttctcgcatgattcagtactggattcctaagtcatttttcactaaccccagtactgaatcatcgagatctgctgtgtctttcttgtaggattttggagtagggagaagtaattcttggcttgtggactccggttgctcacgccacatgaccggtgaagccaagtggtttacttctctcactcgtgcatccagtgatgagaccatcacttttggggatgcgagcagtggacgcgtgatggctaaaggaacaatcaaggtcaatgacaaattcatgctgaaagatgtggcactagtaagtaagcttaagtacaatttgctctctgtttcacaactctgtgatgaaaatctggaagttcgtttcaaaaaggacaggtctcgagttcttgatgcttctgaatctcctgtttttgacatttctcgagttggtcgagttttctttgctaacttcgactcttctgctcctggtccttctcgttgtctcattgcctcagagaatagggatttgtttttctggcatcgacgtcttggtcatattggctttgaccacttgtctcgcattagtggtatggatttgattcggggtttgcctaagttgaaagttccgaaagatcttgtgtgtgcaccatgtcgtcatgggaaaatgacatcttcttcccacaagcctgttacaatggttatgacagatggaccgggacaactgcttcacatggatacggttggtcctgctcgggtccagtcagttggggggaagtggtatgtcttggttgttgtggatgatttctctcgctactcttgggtctattttcttgaatcaaaggaggaaacatttggcttctttcagtctcttgctcgtagtttggctttggagtttcctggtgctcttcgagccattcgcagtgataatggctctgaattcaaaaattctgcatttgaatctttctgtgattcttctggagtcgaacaccagttttcttcgccatatgtcccacaacagaatggggtggttgagaggaagaaccgcacccttgtggagatggcacgaactatgcttgatgagtttacgactccaagaaaattctggactgaagctatttctgctgcttgttttatctccaatcgtgtgtttttgagaactatcttgcacaagacgccatatgagctcagatttggtcgtcgaccaaaagtttcacatctcagggtcttcggttgcaaatgctttgttcttaaatctggaaatttggacaagtttgaatctcgatcattggatggcattttccttggctatgctactcattctcgggcttatcgagtttatgttctttcaaccaacaaaattgtggagacttgtgaagtcacttttgatgaggctagcccaggagctagaccagaaatttcaggtgttccagatgaaagcatctttgtggatgaggattcagatgatgatgacgatgattctattcctccacctctagacagtacaccaccagtgcaagaaaccggttctccttcgactacatcaccttcaggagatgcaccaactacatcatcttcagcagctgaggagattgatggtggcacatcaggaccgacagctccccgacacatccagaaccgacatccgcctgactcgatgatcggaggcctgggtgaaagggtaactagaaatcggtcttatgaacttgtcaattcagcttttgttgcctcttttgagcccaaaaatgtttgtcatgctttatctgatgagaattgggttaatgccatgcatgaagagttagaaaattttgaaagaaacaaagtttggtctttggtagaacctcccttgggttttaatgtgattggaacaaaatgggttttcaaaaacaaactaggtgaagatggttcaattgttcgaaacaaagccagactggttgcacagggtttcacccaagttgagggcttggactttgaagaaacttttgcaccagttgctagattagaagctattcgaattcttttggcttttgctgcttcaaaaggtttcaagctttttcaaatggatgtgaaaagtgcttttctgaatggagttattgaggaagaggtctatgtcaaacaacctcctggttttgaaaatccaaaatttccaaatcatgtgttcaaacttgaaaaagctctttatggtttaaaacaagctcccagagcctggtatgaaagattgaaaacctttttgcttcaaaatggttttgaaatgggggctgttgataaaactctttttactcttcatagtggtattgattttcttcttgtccagatatatgttgatgacatcatatttggtggctcctctcatgcacttgttgcccagttttctgatgtgatgagcagggaatttgaaatgagcatgatgggagagctgactttcttccttggacttcaaatcaagcaaaccaaggaaggaatctttgtacatcagaccaagtactccaaagagctcctgaagaagttcgacatggccgactgcaagccaatcgccactcccatggcaactacttcatcgcttggtcctgatgaggacggtgaagaagttgaccagcgcgagtacagaagcatgatcggctccctcctctacctgactgcgtcaaggccggacatccacttctccgtgtgcctgtgcgcgaggtttcaggcttctccaagaacatcacatcgccaagcagtcaagcgcatgttccgctacatcaagtctacacttgagtacggtatttggtactcctgctcttctgccctttcagttcgagctttttcagatgctgattttgctgggtgtaagattgatcgcaaaagtacttctggcacttgtcattttcttggcacttctttggtctcttggtcctctcgtaagcagtcttctgttgctcaatcaacagctgaggctgagtacgtagctgctgctagtgcatgtagtcaagttctttggatgatttcaactctgaaagattatggtctgtctttctctggtgttcctctgctttgtgataatacaagtgcaatcaatattgcaaaaaatccagttcaacactccaggaccaagcacattgagatacggtaccactttctccgagacaatgttgagaaaggtaccattgtgctagaatttgttgaatctgaaaaacaattggcagacatttttacaaaaccacttgatcgctctcgttttgagttcttgcggagtgagttaggggtgatccacccctatggcttgatttgagggggagttgtttttcttttgcatgcatttgtaacatattgcatcatgtttactttatgcattgtattatacactcttcaattgagctttgcttgttatctcttggtcatcactatgctatggatgtatcactcttatgctagtttgatctcttgtctagctttcatttgcttaagtagcttgtgtgatcatgttatgctgttcaagcgtgttgaaacctgcttaaattaactattcatttgaactcaatcaatgtgcaatgcttgctctagaagtttgtttaaattgaagtatccttctcatactcatgccatgtttacattcttttcgcaataactgtcagtacatgcttatgaatgctcatgcttatgcgtccatactttgtatcaatcatgctttacaagttttatctctgtttttgtccgggctactgagtgcgtttacgcatgagtagtgccgaagatagcactgagacagcctgtaatgggaactctagctggaaaacttgattgaggtcagacggcagtgtttggcacaaccatcacttgctgactgataagatcaggtggaccgtcgtgattgtgctattgtctttaaagaaattaaaaaaaaaatcataaaaataaaagtcatgagaaaagattaaaagctcatgttctatgctttgttatcatgttgatactctttatgaactgggcattagcacattagcatgggttcattgctttgtttatgtaaatcttgcatgattatgagctggtttgcttccttttaagcttcttctagaaatagctttgcacactaaatcactaattcacttgaaagctttttgcttgctggcgatactaacttgatattcatgacttgtttcatacttcttatgcacatgcttagctaggcttgagcacatgcttgtatctgtgtgatccatgtctaccttttgatgcctttagataactctcaaagctctcaaaacctaaaatttgcaagtttcatctcatttttatcttgcatttttgtctcttttgatcttgatggcatcattgacaaagggggagagaaatttgcacttattgaaaattaaaacttgctttaaatcttggtgaaagggggagtttggcacatagggggagcattcttgcatttgcatttgcatcccttttttcttcttgtcacttggtcttgatttttcgcgatttcaaaatgaccaaagttcgcttttgcaaaatggtttgctttgtgaatcaaaaatcaaattttcaaaattttgcttgagattgtcaatgttcccatcaagggggagattgtgaaaccatgtgtggttatagttcttttgtgatgggaaattgacaagtaccggatgtgcaagaagtgtgtgtgtggactaacgttggtcaggttgcgacatctgtgccaagacaacggttgtttggttcatgtgtgtgcaggtgatcggggtcgatcttggtcaacggcggatcgggactagactcagggaggagttgaggtccaaagcgatcaaggatgccgggtgacaagattggacacaaggttgcacacggtggacgaacaccgtgtgaaaaggtctttgcaacaggcttcacaaggccaagtgtgcaagcatcggattcgcgaagaaatcagaagggactgtgcaagtgcattgctgctacagtacttgctgtaggtagcatacatgcatgtacacgtactgtacttgtgcaaggaggagcttgcactgtactggttgctactagcatggctcggtggaaaagtcaagctagctagctgtgcatgtgcgctgtgattggttggcagggaggccaagccaatccagccgttccacgtggcccaagatggtgaatggctcggctcggcaggcctgcatcgtccaagcagcgacggcccaagacggcggcccatggcgcatgggctcaggaggtgcaggcagcttgcatgcgcaaggacgcgcgcggaaaaaccgtacgcggcaacccccgtttcgcgtgactcgatcggaggcgggtgcaggagcgcgggacccacacgcgattttgcaagcgcgcgcgggagcggctcagcgggacgcgtggcggcttcgggctggttgggcgctggcgagcgcgcgctgaggaaaaggagacggaacgcgcacgacgcggctgggcaacgtggcaagtttggattcgtcaagacggagagcacgcggattcatcagcaagaagaccatgtgagggttcggatcgatgaggtggcaatcatctggagcttttcctttgagtagaaggaacaatggatggaccagatctgttctgagttagggtttcgccctaggggtatttgagaaaatgtcttaggggtcttaggctataaatagagagatggatgcaagggtggaggttgctccttttggtaatcattttgagatgctcggtgagagagtttccgtgtgagtttggagtgtgtttgcccgagaggcttttgtattaggattagtttggagtgtgtttgtccgagagattttaagtttgtgttaatgttcctctgaaggtgtatgtttgctcctagttgagcggttattttgcatcacctataaatgaaatgatttgaaggatttcatttttgccttgtccatttaaattccgcaatttaaattccgcttgcaatttgaactttgcgatgatgagttttgctctctctttctcacctcacttctagtttcgggaattccttttctcttcctcctctagtttcgggaattccttttctcttctttttctctcttcttttctagatccggcttctctaatagccgcgattctagtaaggattttgagaaatccggcttgatgagtattttcgggggcaagatttgaattgctatattcaccccccccccccccccctctatagctgttcttggtctttcaccaatacagtgcaacccgtcgcagatacaagctgtggaggctattttgcattgtcaggttcagcattttccaattacctacctaggcctccctctttcaaccagaaagccgactaaggcggagattcaaccgattcttgatagattggctaaaaaggttgctggctggaaacctaaactcctctccattgatggacgcctctgtctcgtgaactctgttcttcaggctttgccggtgcacttcatgacagttcttcaattgcctaagtgggcggtgaaagacatagagcgtaagtgtcgcggtttcctttggaaaggccaagaaaaagtcaatggtggtcactgtctggtctcctggcgcaagctctgtatgcccattgagaaaggcggcctcggggtgatggacctagatctgttcgggcaagcgttgaggttgaaatggcatgccaagagccttgagcagaaaggaaggccgtggactctggtttcctaccatctgggtagcgacgtcaatgctatcttcaattgagtggcggatttcgtcatcggcaatggaactgacactaacttctggacgtcgaattggacgggaaagggaggtttcgcttggagatggcccatcctgttttcttatgttgggagatcacgtctgacggtggctcaggcgatgatcaatcacaggtgggttcgttgtctgctgcggccctatgcgagttctttcagctctgggacgaggtcagaaacaccacgctgcagaatggtgatgactctatccgatggaaggtctctcccgacgggcaattctcagcatcggcaacttacaacttctttttcacgaccaaagaggactgtcctgtgggcgacctcttgtggcactcaagagcaccttccagggttcgattcttcatgtggctagctctcaaaggaaaatgcttaacggccgacaatcttgctaaaagaaattggccccacgaggatcactgcgttctttgccaaagagaagaggaagattgccagcacctgtttgctgactgcagctttacctctgcggtctggggattgatcaggagcagagtgaatttcaacttcccgattcccaccgaggaaaactgcccactaatgtgctggtggcttcagccgagagcccgttgccgggtaagctacaggacagattttgacagtctagtccttcttacttgctgatcaatttggaaggaaagaaacgctaggatctttgagcatcgttttgaacggcgaaccatctagtggaagacataaaagaagaagcgttgatgtggaaggaagccgggattttttcccaagagtgcgagtagtcagtgtcccgtttgtttgttcccctaggctgaactctgtttcggctttcttccccctcgacatcctcatgtcgatgtaaatcttgtaatttgtaacttattttttctcctatcttaatgaaattggccggccatcctttggccgtcccggcaaaaaaaaagacacagctctagcttgaaattaatattcagggattctgaaggtacgcacaacacatgcaggatcacagatcgaattgcaagtgggttattggtgccggacatggtccaagatggacctctggctagctagccaaattatatgccatcaatcagaccatgcattcacgggcatattaagcaccaaaatatcctactcctatcatcatccattttatgcagatccaatccaccggcctacggaatattgcattattggtaataaagatgcagtcaacatctagctgctgattgatcattgctgatgagacatccagcctctagaaaactgcaggtttatcaatcaatgaatatacattttgattgcttagaatctatgataatatactgtacaattgacaaatccaacacataactaccctacggttcaagatcccagcgacaattgactgaggacatataagtttcgatacatttatcgtacacatcaacttaaaaaactgacacaagaaattctaaaaaaaacatatatgtacttctaatagtattgcacatatatgtataaagtctaaacttcatattacaaatgacagcagctagccaacagaacggtttacacttcagctgcacaaattacagttattcgaagtaagtgttacatagaggtaaattgagcagaagagttgcacacatagtaaatcattcagagtaactgcgataattggtagttgcaggaggatctatcacctatggcatctgtcaacagagttacctgggcgtcgtcatgctggatgctacccgtgcagatcagacaaacaacaagaacaggctacaagatacgcaacatgtccatacatatgagtaatgcaggccccagaagggcccttttcgttacaaataaactaatccaggcacctaccctatgaatgggatgtaattcggtatatgcaatcttttgaaacttccttattcattcccctgatatctttagattagaaaagccacaccatatcgttgtcatctcatacatgtctgattgttccccttgctgaaaagatatttggaaagttaacaaccgagaatgatgaacctaatctttggtagctaccctttctgtgtttttcttcaggcacatggtaaattgcctagaatattcagtgttagtactccacccagtccaactgatcttttaaaaccaacttatccataggaaacatgttctttggatgtggtaaaatacgcagaaaagcaaaagaccttcattaacatcctcatctgagcatctaaaagcaaggaaagagagaggttgcatggtcgtcatttcatgcgttgcacatcttacaccactaaatcttttgtgagcctttgctatcgcagttcacatttctcattgatgagctgaaaggtatggaaaccgaataatgctcttcaccggccgtcaactgggccaggatgaatcattcattcacatcattcttctcaggtttttatcataaggattgttactgcactggagtacccttcctccctgataaaagcagggaagatccagatggaatggaacagatgatagctgatcccaaaacaaaacagaagctgccaagttgatcagatacacactacataccctgttgtcggttttaacagataaaactctgaattcagtggaaatttccgctgttagacacagaaaaataggaaacagggtcgaaggaatatcgtccgtcacataaacgtagggatattttcgtctacaccttataaaaactcttgtaagtagtgtaccaggttcctccacccaatacattgatcccattcttgaactttaagatttactaaaacataaatttgtggcacagaatttcgcataagcaattgaatccgtgtgatgatcatgcgaggaagttaatgggtccaaacctgaaaacctgcatctctccggtgaaaccggccgcgggattgtcagctcaagaactcgttaacagcaaatgctctctgtcccgggacctgaactgagctaagcttgctgctgaattgtgacaaccaaaacaggtgtatacagttcgtggtgggcccactttgcagtgatatttttgcagcttgattgacgtggagagaatccggggaaggacgtgggccctacacagaaccaacggacaaccgaaaccagcttccctttgccttccttcctactagctttgtctgaattttctgatgctgctctttcgtctctcacgctgcaagcctgcaactgcagtatggagttgcacaatttgcatttgcacaccctccatcttggaatttggaaaactattgctgataacatgaatcatttcgtcttcatgtgagcgacgctgatgcattctatcttctactgcagtgactgcctcactgcaggtacagtcaccgagagaatcatctcgcaacagctaagctaatctctgaacgtgccgagaaaacacttagagactattcttaccttacgtggcattcatttttctatccagtttctttccctgctaaaactacatcaccatctaaattgaaagcagctgtgttgattcatgaatcagctaaaaaatatcatcgatctcgcgcgtgggccatgacaatcaatccaataattttgatggtggtggggtccggaggcctgcactttgcgcctcctcctcgacaaaacagctcgatcgatccatcaagagccagatgcgatcaatcatacctgcaattaacgtacaacctaattcccctttatatatggctataatcagctgcatcaactgccctggcatggcaatcgctgtagccgatcgccgttgctactgcgattgcctttcttgtttcctctactcttctgaagctcatcgcattttttttttcagtcggatgtgtacagatcacctaatgctaagttaaagatcacagtaaaatcactttttggaaactagctaactaattacttcatccgttctcgaataattgacactagcagtactattcaagctcaaatttgttttttcctgaaatttataaacacctaagggtgttatattagtcaaagtaagatgatcgtagtcatcagtggcagtaattcgagaaacgagggagtaaacaattggctcatatgattggagaatcattgtcatacatgtagcaatgaacgcatggattatacaagaactgaaagaggcagtaacatgctgcatggcacactaactgaaagtctgaaactctccaagagaatacactaccacatcgagtccagaaagcctggctgtccttttctctcccctagaatataccagctaatagatagcacaatttatcaaggaaaagcaggggaatataccctaaatatggagatccccatggaccatgcatgtctggtctacttgccgaatgtggagttgtccgtgtacgtctcggccaaccaccgggtctctcggctactctggagggccattttcttctgcagcttatggtgtctttgaaaccctctattaaacagcgcgttagccacgtggaacgggatgattcattaacatgtaattaattaagtatatattattataaacttaaaaatagatttatttaattttttaagaaaacttatatattaaaaaaaacatatcatttattagttcagaaaacgtgctaatgaaaaataataaagctgtagtttggagttgaagtttagaattcagctgacacaaataaggcggtatgtgaaaattactccagaaacccttgtgattaacaggcagtataatctagatttgacaggccttacattgctcgtggttgatgttaaatacagtactgaagaagtgttctctgtttgtagtgcattcgtttcatactggaccatcagattggctattctgtcactggtgtttgtctgctctgcagcttgattcttcttctcgtccggagaaaaaaaaactgtcacaatacaatactgtgctcttcaattttttttaaaaggaaatgctgtgctcttcatggtacagtatcagactatctacgctgttgctgacagtaacaaaggagcacatgcaccatgcattgagcccagaaaccaaagcacacgtgtcatggtcagttagaagctttcagaaaaagctgtgcgcagccttcgtaaaaaaaatgcgatgtgaagtctttcattctgacatggtcctacacaacactgatgataatgcacgcgtaaatttcataaaattaaaattatgagaaaactatatatttaaatcaatgtatcataaagtatataattagaactaaatttatcaccaaacaacaaatttagcaataaaattatcataaaaattttatgtcttccaccaagtacaaaactacaacttttataattaactttatcataacggtactgctagatatttaaacaatgtgataacttcaatattaaatttgtagttttgaaatacttgatcttaaatatataggtttacgataaattttgaaatacttgatcttaaatatataggtttacaataaattttgtataaagcatacctataattttataatacaacatattaaatatatacttttacgataacttaatcaacttccacacagttttgtaaagtttacccgtaaatcacaatgcatgcaacattgcaacactccaacacacaggattttcagcatcacattttttttaacaatgccgttgtattttggtttggttgtgagaattcacaagagccaagaactctgcatcgttctaaaaataattacaaaaaaactctgcatcgacggagagagtgagagtggatggaccacatggacaggtgcccatccagctcggctgttcaagccggctcgatctacgagccggccgtgtttcgaaataacccaaaaaaaagaggggtcaaaacgcaaaaggggcatcgctataaaaccgcggctccgcgggcgccaatccaccgcatcatcggcttccctccggctcgagccaatctctcgctgtgtctctctcgcgctctccactagcaccggctcggctcggctcgcgcggcggcggcggcggggcggcgtggcgccgagggaggggaacgccggtgtggggagggcggcggcgaggggactcgccggcgacgagctggtttgggtatgagaggggttacccatgcggcgccgaccacgagcgtcccccgccgcggctccatggacggcctcctcatcttcgtcttctacctctcgcttcctatacgtggtggccgcgaccactcgttaatctcctcctctaattgttagccgatctcgcctctcccccacactctctgatcccgctctctctctctgcttcgattcgattcgattcgatcttctccacctcgtcgccgtcgaacgcaactcggatcgggaggataatggaccagccttctaatggcttcgccgccggaggtgcgtctccgatcagaatactcccctgttcttttttttccatttttaggtagagaagtcattttttattttattatttttttgcaaattgatatgttcatcagtgctattcaatttcaaccatgcatacaaatcccacacgcaactttagattactatccaagtataaaatccaagttgattgtgttacggcaaatattgctgtcgacctgtcgtggactggcgtcccaatcgcaatcgattgtgtgagtatgacagtgcagtgctttagtgtcacaaatcgtaggggtcagaatgtttcgattcagtaaatgctgatatggagccatccttttttttctttttttttttggttccggtgaatacgcaaaaggggttgcgtagccatggattaaggtggtgaaagcaaagctaaaatcctatcgaatatgaaatgtgtacatatctttaactttataccttttttgttctatgtaataattatataaatacataaagtaggacccttcattactgttttcttttttaaaaaacgaaatgttgtaaaacgatcctttaattgattggggaccatcccccattgttttaaatcttgcaatatcagatgagtcacagtagtgtagataccatcaatcagcaagaatctagaggaaaggaagggattgtgatggcaatttgctagcaaaactgtgaaagagatgtggaacaaggttccaaaaattgaggtctctaaaagagtaaaaggtcaataggaaaaaaatggtatcccttgtccagaagaagtagcatccgaggccgaattgtttccttgttcttgattgcattttttgcagaatatgctgctgcatcgattaatccagactgctctgcgtcaaataactctatggatcattctgctcaatctaattcgaacatgacactttattgccaaaaaccaactgtaatgaataaatcactaacaaagattattcagttggccacttgtgggctcgaaagcacaactattttcagtcataaatttaacaaatgacacatggttgcactgaatgaaactttaaatgtgcttattcatgtacatgtttgagaaatatgtgatattagttgagctacaattccaaattgatttcaatatttaacccagaaatttactgtgcggtgcattcaggtctttttcttcgtcacattgatgggcaaaatgcctctcccccttctgtcattgtgattggtggagggatttcaggcattgcagctgctcgtgcgctgtctaatgcttcgtttaaggtaaatgctgtcattgaaagatgaaataactatatctctgtcttctatattctattagcttattgtccaaaaataagttaatgttttgatgcttcccgggccctttttcttagatacttttacataactacaggtcacactattagagtcacgggaccgacttggtggccgtgtgcatactgactattcttttggctgcccaattgacatgggagcatcttggttagttgcatcccagaagtagctattttcgccgccttgcaacgtgtttggttttcatctcatggttttatcatgtggttcaggttgcatggtgtatgcaatgagaattcattggcaccactgattaggttgcttggccttagattatatcgcaccagtggtgataactctgtgctatatgaccatgatctggagaggttaggagttattcctaacccataagtttatcctcaacttgatgggctttcattctcttacaattgttgtttttgttcatttagctatgctctctttgataaggatggtcgtcaagttccccaggagatagtgacaaaagtcggggaaacatttgagaaaattcttaaggaggtattgtcatcgtttgcatttcatttgttatccatcaaatgcttttatgcaactcttgtgagcttactttgttaatattgcagacggtgaaagtaagagctgaacatgaagatgacatgcctcttattcaagccatctcaattgtgcttgacaggaatccacacctaaagtaagtggaatttagcattcacctatatctggaatggtggtgctttagcgacggggtgaaatgttctaatgatatgcattcactcttacaggcttgatggtttgcaatatgaagtactgcagtggtgcatatgtaggctggaggcatggtttgccacagatgtggataatatatctctgaaaaattgggatcaggtatgcaatagggggcacttttgtatttacatgcgcacatgaagaattgttgtattcacgtagagcagtggactgacctttcaaatttacaggaacatgttcttactggtggccatgggcttatggtgcatggttatgatcctgttatcaaagctctcgcgcaagatcttgatatccacctgaaccacaggtatgcagttacatatcctcatggccaagtaattcacataagttctgtttcataggtttcatagttataatcccaaatctatagtatcttatctcttaactttcctccagggttaccaaaatcatccagaggtacaacaaaactatagtatgtgttgaagatgggacaagctttgttgcagatgctgctataataactgtccctcttggtgtacttaaagcaaatatcatcaagtttgaacctgagctcccagattggaagctttcatcaatatctgatcttggtattggcattgagaacaaaatagccctccgcttcaatagtgtattttggccaaatgtagaagtgctaggcagggttgccccaacatcaaatgcctgcggttactttcttaaccttcacaaagccacagggcatccggttcttgtatgcatggtagcaggaagattcgcatatgaattcgagaagctatccgatgaagaatccgtaaactttgtcatgtctcagctcaagaaaatgctaccaggagctactgaaccggtaaatcctcaaaattcattttcagaccatgtacagttgagtactgtcaatttcagactatgaacagtagctctaacacttgtgctacacaactgcaggtccagtatttggtttcaaggtggggaaccgacccgaattcgcttggttcttattcctgcgaccttgttgggaagccagctgacttgtatgaaagattctgtgctccggtgggcaacctgtttttcgctggggaggccgcctgcatcgatcactctgggtccgtgcatggagcttattcttcaggcattgttgctgcagaggattgccgaaggcatctgtcgacgcagctaggcatctccgaccttttccaggttgggaagattatcatgagggaggagatgactgaagtcatggtccccttccagatatccaggctgtgaaagaagaacaaagcctgcctatttagcaccgtgtttatcctgcagctgctatggttaatattgtagctgctgctctgtagtttcctaattatctcagatcctgtaccgtttcacagtttgatcgtttatgtgtattcaaataaaaacagaataattatatatcaacagaccttgttctctgaatccatggatattgcttttcatttacacattcccagtcagtactgctgaatttattttagttttcagtgtttgccttgagactggagggctgtagtaaactagtaatcgtctgatcgaacttggcttgcgcccccatttgcttcattttgcatgtatatagggttgtagatgcaggctagttgcagttcaatggtcataaacagtggaggtttttctttctttactttcatacgtagatctccactaataataaaccatacagcatcctgcatattcggaaacgattccaccatcgtgtgaaccatatcaaacgcattcattccactgtaacatctgctgccacaatttgcaatgtccatcccatcctgtagcatcagacttgtaaattgtaatagccacaaacagagaatacattaattccctcccccaccacctaaaaatcattttttttctttcaaaaatacatatttcattaaaaaatctattatttattttcattgtattttgttttatcataaaatgcattttaccatgatttgtattttacatatttacacaaaatatttaagacgaatattcaaacatatatgtctaaaagtcaacaaccacatattaaaaaacggactcaatactacctcctttttaaatagatgacgtcgttgagttttgaatacacgtttgactaatcgtattattaaaaaatacgtaattatcatttaccatattttttagttgttttatcattaaaattacttaaagcattatttatatgttacgtatttgcacaattttttaacaagacgatactcaaacgtaacgttatctattaaaatacaaagggagtatatatattatctgtgttctagtagttcctcttgtaaaaggaagaaaagataaaaacaaactggtgccgacgccaactatttccaccgcatttgggcccacatgtccgggagccaaacgcggctacgcgacccaaacgcaaacgcaaaggcggaagctgggatcccgtgtcgtcgccgactccgactcctcctcctccgctccatataagactcgccccaaccccctcatcaacttcataccaaaccgaaccgaaggaccccacccaaaatcacacgcgccaaccagatcaaacccacctcgcaggagaagagaagcgatctacctctcctcgaggtggtggtgaggatttggagttgaattgtggggagggggacctcgcgggtgttgccggtttggagcccaagatagggttatgagctgcttcgcggaccgccgctgctacgccgccagccgccgccaggacggcctcctcgtgttcatgttcttcatctcgattcccatacgtactagtagcagtagtagtaataattgtaattccagtagtagtattagtagtaatctcctgtaagcggagttcctcctcgcggctgcgtgtacggggacgggaggaccttcttcctcttcgtgttcatcttcttcttcttcttcctctcttccttcggcttcggcgctggcggctatggatcccaatagcctcaaaactggaggtatgaattattcccacttttttgtaatttttttttctgaaattttatctggtaggagtacttggtagtggtgcgtcgtgaaaggtgggaatatttcccattgatcatagtatttttagaaatctatctattgtactttagaattaaattttccacatagggaaggtgatcatcacactttagattttacaagattattagaatttataattctagttgggtacaaattggttagttagttggtaacttgggtatctacagtattatgtagattagtgagcttgatgttcaacgtgatttctctctcttatgattcacatacctgacagtaaaaaacattttttgttcaggcctcttgcttccgaccattgagaggcaatgtgcttcgcctccatccgtcatcgtgatcggtgggggaatttcaggggttgcagcagcccgtgctctctccaatgcttcgtttgaggtgactgttttggagtccagagatcgcgtaggcggtcgtgtccataccgattactctttcggatgcccaattgatatgggagcctcatggtcagtctcaccctgaattgttagtgtgagaaattcactttagattctgttcatacaagcttacttactgttcattccaaaaattcaggctccacggcgtttgtaatgagaactccttggcaccattgattggctatcttgggctgaaattatatcgcactagtggcgacaactctgttctgtatgatcatgatttagaaaggtaatcttttagctcttgatcttacgcttttctttaccgatccgcacaatccttgttgattcttacatcaactctgtcaattgattctgttacagttatgcactctttgataaggctggccatcaggtctcaaaggagacagttgctaaagttgaagaaacatttgaaagaattcttgatgaggtacataatgaactcatttatacttggtacttctggtgccgtttgaagagcatgttcagttcactatctaatttctgttgcattaatgttccaaaaaaaattttctgttgcattgcagacagttaaagtgcgtgatgagcaggaacatgacatgccccttctacaggcgatttcacttgttcttgagaggcacccccatctgaagtatgcacattcttgtaccatgctatcaatttactcacaacatacttaataaattcctaggatgcatcatgagaggttgactgatatggttaccattatttgtaggttacaagggatagatgatcaagtcttgcaatggtgtgtctgtcggcttgaggcatggtttgctgcagatgctgatgaaatatctctgaaaaactgggatcaggttagctgaaatcagtctatattagcacactgcacattcttatagtgacattagtttgcttagtgaaggatattggtaaattacatcgaattgtttgccatcttgcatagttagttacttatgtttgtattcctcttaactatgcaggagcatgttcttaccggtggccatggtctgatggtgaacggatactatcctataattcaggctcttgcacaaggtctagatatccggcttaatcaaaggtgtgttcttttacctcccgagcatacaaacacaacaattaatttcagcatactgaagtccctttttcagtgtattttggctccacaaaattacttgtcgtttcacttgtcaatattgctaaacagttttgcttactcgcttttgctactgctaaatcttcagggtaaccaaaattgcccgccaattcaatggagtgacagttaccactgaagatggaacaagttactctgccgatgcttgcatcattacagtaccgctcggtgtgctcaaggcaaacataatcaagttcgagcctgagttgccctcatggaagagctctgcaatcgcagaccttggtgtcggtatcgagaacaagatcgccatgcacttcgatacagtcttctggcctaatgttgaggtgctgggaatggttggcccaacgcctaaagcatgtgggtacttcctgaacctccacaaggccaccggcaatccggtcctcgtctacatggccgccggtagatttgctcaagaagtggaaaaactgtcagacaaggaggccgttgatctggtcatgtctcacctgaagaaaatgctacctgacgccactgaacctgtgagtttgccatctcagatcatggccacagttagttccattttcgagttcgcattatctgaatgaattcgttgttcttgcgactgacaatttgcacttgttgatttgtgttattgcagacgaagtatttggtttcacgctggggttctgacccgaactcgctgggttcctactcgtgcgacctggtcgggaagccggccgacgtgtcggcgcggttcgccgcaccggtggagaacctctacttcgccggcgaggcggccagcgccgaccactcggggtccgtccacggcgcctactcgtcggggatcgccgccgccgatgagtgccggaagcgcatcctgatgcagaagggcatccctgacctcgtccaggtcaaggcctacgaggagatggccggagtcattgctccccttcagatttgcaggacctgaaaaaactgaacctgctccaccctgccattgtcatggaatctggattgattcaattgccatgcctatgccctggaatcttgatgattcaatcactcatacaagttcaagttcatgtaggggattaactgcatgaatcaaaattattaattaataattatgtaattgtcatgttattattgaataaataaatcgagatcatgcttgagatctttgtactgggacacagtttcaattaattaatgctagtaacaaccttggagtgaatgaatgtgagtagttgggctggagttgcttgttcgtcttttgctgctgtgattgcaacctgcgagggagaagtgcacggctgtctcgtctcatgcctttgcttgctttgagcctttgaccgtcgccggcggtggatggcagctgacctcgacgtcgacgtggtggaacacaaatttggcgccacgcatagttctgaagatgacaggtcatcttgtgactacaataaaacgctacttccttaaaaaaaattcagtttttaatacaacatttaactctccgttttatttaaaaatcttctaattagtatttttattttcgttagatgataaaatgtaaatagtattttatacgtaactatatttttaaatttttataaatactagaaaaaatgttcgtgctgaagtatattttaattgggtgaagtatattttaattttattattgttatatggattagttaagatgaaatttattgtgggagttcgcttggatatatatttttttagaaaatcatgagctgtggttaggagttcgagatcgtctcaaggtagtatgcgagttttttaaacagacttcttatatgattccttctgtattacaaaaataaataattttaaaaaccgactcaaatatatatatatatatgtatttactccatcgtcacttagagatttgggagggagaccggttgagctgacatgtccacgatggcagaatctcccaagattccacgtggaaccctaaccttccctttccaaaaagaaaacgagagcccttttcctattgacgcacgtgagcgcaccgcttaagccacgctacccacgctacgcctctctatacctaacgctttccccgaactccaagagatcaaaaaaaaaaaatctcaaacggcaaagtcaaaaaaatactactactccgacacgaaaaacaaacagaaaatcgggggaaaaaaatctctgtccattcgttcgcttctcccatggcggcgatctcgcgcgcgatccgggcgtgcgccgccgcggggtcccggcggagcatggcgtcgtcggcgaaggaggtggcggcggccggggcgcgggcggcggcggcggtggcgcggcgcgggcgggagcgggagcgggaggaggacgggaggcgcgtgcagtgggtgttcctgggctgccccggggtggggaagggcacctacgccagccgcctctcgcagatgctccgcgtgccccacatcgccaccggcgatctcgtccgcgacgccctcgcctccccgggccccttctccgagcaggtgaaacgccgcctccgtttctctcttcctctctcttggccttcgcccttcgaggtctcacaatgatggtgatggggatggatgataatgaacaagagagcatgcgtttttcagattccaatttcttgctgtcaattgcttttgttaagttgatggatcccctgcatcgagtacggaaaaggctttaagtactaaattgttcttactaaagtcttattatgctataagtaaatctagatttcctctaacccccatctagttaaatcaagcggttaagatcattgtttgtaagagttatgtaagatttttttgtagtacgtgtggttataacaacgaacaggaaaagaatgatccttagggtgcctaaagagatggcttgatgtgagaatagtaatgtattacttctatgtttttcattgttctgtgtctgatccgatttcagcttgcggagattgtgaataatggaaagctagtgtcggatgagatcataataaatcttctgtcaaagcggcttgaagagggagcagaaaagggtgagctgggcttcatccttgatggttttccaagaaccataagacaagcggtgagctagttatttgacctgactgtaagtatgcaaaacacatacttgcaacttctcagtatacaattatgatttgccttcaaatttgcattttcatatttaagaggtgaaatcatatacatagcatgcaatttgatacacataatgtgtaacttgattgctgaggtagtattaatctttggcagttcaacattaagacgctgtgcctttataatcagcttgatctggttactagcagcattttggcgactagacaaatcaatttgttaacctttgcataagttggtagctatgcattagtttacttaggtgtgccataattccataaacggatcagttaagatgctatttttgtgcctatattgcatatatcgttgaggccaacaatcatcaactacttgttaaatcttatccactggaactattttgtgctttggtaggagatacttgaaggagtcacggatattgatttggtcatcaacctcaaactccgagaagaggctctgcttgcaaaatgccttggtagaaggatgtgcagccagtgtggtggaaattttaatgtagcgtccattgatatggagggcgaaaatggtggtcctcgaatgtacatgcctccactactgcctcctccacagtgtgaatcaaagttgataactaggcctgatgatactgaagaggtggtaaaggagcgattgcgtgtttatcatgatttggtatgttctagcttgtgttatttttatttattgaattcctcacttgtaatttgctagtaaaagactaaggctttgtttgtttgggcattcggcagttgcaaattccttgttttccgttagcatgcttcccaaactgataaacaatgtgtttcttttttaaaaaaaaactttttatatagaaatttctttaaaaaacaaataaactcattttttaattttatttatactcaatttatcatgcactaatggcttgtcttattttatgtgcaaatgaaaagctgaataagggaaagtttacatttagtttactttggcatcgtgccgtcctctctaagctgtcatttttgcagtgtgagccagtggaggacttctacagagcacgtggtaaactattggagttcaatctaccaggaggaattccagaatcatggccgaagttactgcaagcattgaatttagaccctggcaatgaaagatctgcagcagcatgatttttgctttaggaatgttcgttatgtatttgtagccctacgccagaagtagttaagtaatgagtattccttgtacctctagaagtagttcaatcgggttaccaaaattatattgatatagcactcaattgtataggtgattcatcatcgatcttgcatgatgccatgatcgatgagtgtgctggttgttattcttaaatgagaaagcttccaataaaccaatacacatttatttgtagccaactatgcttgttgaaagcaacacaaggcaagccttgtgatgacagtaatattttccttgcaactatgcctgtttgaaagcaatacagagcaaccattgtaatgaaattctggtgctattgacacattgagagtgtttgcacatggttctgaaatttcccttgccccaggttgggtcttatctgaatatgcaagtagcctgctgaatactacctccgtcccataataagtcccataataagtgtagccatgagtttctgtgcccaactttaatcgttcgttttatttgaaatttttttataattagtatttttgttgttatgagatgataaaacatgaatagtgctttactcgtgacttatgtttttaatttttttaaaaaaaaatttcaaataagacgaacggtcaaagttggacgcggaaagccatggctgcacttattttgggacggaggaagtacagcagaggtcacagactcagttcaagtagcaaatctgtcttttcgaatgcaatctcctcacggtaagaaatgtgtctacccttttagcaggaaccaaatagtatctggattagaagaaggtatcacggttaaaggcgttaggaattgttatactacagcattggtagcaactcaccgtcacaacgggggtgtagctcatatggtagagcgctcgcttcgcatgcgagaggcacggtgttcgattccccgcacctccaatcttttgatctttttttgatttccattttatcataacttaaaacctgttttttgtttttcattccaccacagcttcatcactcagaacttccatttcatcataacttaaaatctgttttttgttcttttttttcattccaccacagtttcatcacttagaactttattttcttgtgatgaaatgaaatgaaaaacaaagaacttcgtatttaggtagtacaaaattggaataggccgtagaaggtgcctatgattctgggctctggctgtccgctgatccgctggccgtagaagtcaagcccatctcacagtctgcagatcgcttctttttacaacccaacgggccattttcagaggcgtcacccgtaaatccttgggccaatgtgacccaatcaatttcgtgaaaagtactccgtagcaaacaacgcgcgcgcgttccctgcaaaaaacgccggaaaacgcattgccgagcgagccgtttcagcaaataagggatcgttagactttatcagtgactgtatgaaacttttatatatgtgtgtgttcttacgacttaaaagataatgctgaaaaatttatttcaaaatttaaattttggttttgacttattatatatttttggggcaaccgatggggctatgaggctatgagctatccatccatccatagcgcaacgtgtgacagcgtgaggtgacaagatggaaaaccgtgagccgcgccaccggtgtaaaccccctcccttcacgcgcgtttactttgcaagcaaaggacaaggaaaaaagccgtaattggcgaagaatgttcttggatttgattagcagcggtacggtaacacctctagcttgcatttgcatggtagggtgatttggctaggagagcaggatcatccgtgcattcaattttcctcatttctttttgcaggctcaatagaggagaggaggggcctagctagcaccaagataatgcagcaaaaaggagagaagagaacatgtcatccagtccaaagtgcaaacgtctctatacaaatggaacatatggagtggacctaagcctagttgcttctgtgtcccaagctcccaagtgtcaaagccttaatgtgcaaaaccacatctgtggggactcctgaaagcaaactaaatgattgcaaaagagttcgtttattcacctatttatttatttattttattttctttccatgtgtctgttgtttgatactttgattgatcatgtgctaaactgcagaaaaaaccaacaggcccagagtaccggcgaaaaggctcctcgatgaaaagtgcagggattctgggggagttgccagtgcgccaccgttggatttttgcacacatataaacaggggactctgctgcacctctcacacagtaacatatatagggacggttccaccaagcacgtttgggaaatggttttttgagcaacatctcatgcgaacaatttaggcactatttacttgtaccttcaccttgtacgtgtgctccatcccatagctgcattatttgcatcaatcattttaattgcatatatacatactccctctcgtatttattttttttaataaatgacatctttcactttttatcacacgtcttttaataagacgaaatatcaaacgtatgataaaaaaaatcaataacgccatctattaaaagacagattgagtatatgcgagacatttaattatttgccacctctcaacaatttaacactcgtgtgacataggagtagacgcatagggtaacaaattgctaaacgtcaagtaatctatgagtagcaactagcaaatacttaaatatctcctaatatgttagcattgcaccaaagtctataactatattgagctttgtcctgtccatggtaaagtgtggggttaaagtgttaaaaagctattggtagcagtatctagtatggcgtggcaggccggtgcagataaaaggggccccgggttttgcccggaaatgaggagaggacgccccggcagctagcggacgctttgcatttgcatgcatggtgctctctacttctccctccgttcccacggcaaattgcaaaacgcatgctagtatttggcaccattagcctaaggtagtagtatcagcgtgttacagaaagaaaatagttaagtagcagtaattaattaaagcctgtgattaaggtaaagcagcagtgcagttacaaaccgaaacaaacaagagtcagcgaactgaaaagaagaccgggaagaagaagaagaagaaaaaaaaagacccgaacagagttttgatgagcagtgtcaggtctgtcacatgagaagagagcgaagtagctcagctcagcccccactcgctcacatggaacgcctctgctcgcctcgactacttaaccagctaaacgctcggttgattaggagaggaaaaaaaacgagggaaaaaacgggtggaaacacacgcaaaaacacaacgccgtgcggccttgtaaatacgggcgacgccgacgcgcatcgctccccgaacaccaaacgcctcagcttgccttggctctcgccagtcgctacgcccgcgacgacacgaccgcgccgcgcgcgcgcgagcgagcgagcatgtcgggctcctctgccgacccctcgccatccgcctcgaccgcgggggcggcggtctcgccgctcgcgctgctccgcgcgcacggccacggccacgggcacctgactgctacgccgccgtcgggggcgacggggccggcgccgccgccgccgtcgccggcgtcggggtcggcgccgcgggactaccgcaaggggaactggacgctgcacgagacgctcatcctcatcaccgccaatcgtctggacgacgaccgccgcgccggcgttgggggcgcggcggctggtggcggcggcgccgggtcgccgccgacgccgaggtcggcggagcagcggtggaagtgggtggagaactactgctggaagaacggctgcctccgcagccagaaccagtgcaatgacaagtgggacaacctcctccgcgactacaagaaggtccgcgactacgagtcccgcgtcgccgccgccgccgccaccggcggcgcggccgccgccaactccgcccccctcccgtcgtactggacgatggagcggcacgagcgcaaggactgcaacctccccaccaacctggcgccggaggtctacgacgcgctctccgaggtgctctcccgccgcgcggcgcgacgcggcggcgccacgatcgcgcccaccccgccgccaccaccgctcgcgctgccgctgccgccgccgccgccgccctcgccgccgaagcctctcgtcgcgcagcagcagcaccaccatcacggccatcaccaccacccacctcctcctcagccgccgccgtcgtcgctgcagctccctccggcggtcgtggctccgccgccggcgtccgtttccggtaatggtcggtgcgcgcaccgtacacttaatactcatagtagctgttacatcccctcccctccaaaccatttactactgttctctcacactgatatgtgggcccacctcgcagcgagctgagctccgccactatacgttattaaaagcccgcgttatgattgggctagttacgttgttgagttgagctggtcgtaattatttactaccgctacattttttttacctttttaccgtggggttcgggagagggtggtcgcggtaataataatgtcctcaactcaggggttgggagaataaagctgcgtgcagtgtggtgcagttcatgcatgggaaaggtgatgcgaatccggatattttatgggggtttaattgaaagatttactccacgacgatactaccctctactcctgccatgctgcaagcatgcgtaatgcgttacattgcgaaatcactcgctttgaatgaaaaaaaagcctgaaactttggagaaaaaaaaagcaccttttgttttctcctcgtgcatgcatgccgcgctgcgtatcttgaactactttggacttttgtatcgatcaacaaaactatacctatattagcagtaattaatactacatttgtagatatcctttgaccgttctatcttatttttgataattaaaaaaattagttacatttaaaaatgctatttatattttattatctaataacaataagtgtattagttaaatattaaacgttggatatgaatagtttaaaacgttggatatgaatagtttaaaactgtattgttttggggcggagtgagtaattgattgatcgattaattaagtggttgactaatgtgtgtgtgatttatttgtgtagcggaggaggagatgtcggggtcgtcggagtcgggggaggaggaggaggggtcgggcggggagccggaggcgaagcggcggcggctgagccggctggggtcgagcgtggtgaggagcgcgacggtggtggcgaggacgctggtggcgtgcgaggagaagcgggagcgccggcaccgggagctgctgcagctggaggagcggcggctgcgcctcgaggaggagcgcaccgaggtccgccgccagggcttcgccggcctcatcgccgccgtcaacagcctctcctccgccatccacgccctcgtctccgaccaccgcagcggcgactcctccggccgatgatcgccattgcaatcatatgcaatgcagcaaggacgatcgatgtaaataacccatggagatgcatggatcgaggcatcggattattgtttggaatggctgcaagaagaggagtagctatatatttttttttttgagtgtgcatcgccatcgcgtcgtctgcgagtattgggagtacggtgcattgcatgcacaacgcctccgtttcttgatttctttctttctctcctgtgtcctgtgatttttttgttgtttattcttttcgtgcaattagtggagagactggcaggtgtgtggtgtgaatgatcgaaatggttagtgtggctgctgctgctggtgctgttgctgttgctgcgttttttcttctcgggtgttgggtttgtcgtggacggcgatcattagcggcacagtggatgagagagctgagctctagctgcaggtcgcttggtctcgctgcgctgtcatgtgatcactactgcgcatgggggccacggttaccgctatagctgctgcaactgcgtgcgagaacgagctcgtgctgagctatacaagctttgctgctacttctgcttgcttttgtgctatggtggtgttggccgaatcagatcagagtttgtgctaccactttacattcgagattccgcttttgcccccgtggtgtacttgcaatatactccgttcataattaaactaattaacattgaattgaattgtacataacctaatataataaattaaatctgatcatgcatatccaaatttattgtattagattgtgtcacattcaatcttaggttgatttattatgagagtacaaaaatatactccctccgtcctatttttaagtgtaattatgagattttgtgtctaacattagaccgtctgtcttatataaaaaatatgattttttttttaaaaaaagtcacgcataaagtatgttttatctataataaaaataaaagtattaatcaaaaaaaaattaaataagatagatggttaaacttcgttggacaaagaaacacactactgcttttttttttttttgacaaaaggagtactagtacagtactacgttcgtgtggtgtaataattgttgagcacaagatagcatgagatcgagcacagcggagtacgtactcatgcaaatcacctgatacgacgacgcccgtccatgtccatcgagtacatggaattgacgtgcattgtaccgatccatgcatgcactggctacactcttctgtcaattaattaatggtatcactagtacggtactctagctagcacaatgttgtgatttgcagatggtaatctgagcaaatgacaattaattgtagggacgtgtgtctctctgcattgccgggtaagccaagtacgctgctcccatttcaagtccggattaatgcaacgcacgcatgcacgcacgcacgcacgcggccaagtgatcaagaccgcgattaccccacagtcccacacgtatctacgctcgccgacacacgcgctaaaccctcactcacctcacctgcttttgctcgcgtgcatgcatgtgtctcgtctcacagcattgaactcctggtcactgcaaacttaactgtggtttaagaaaaaaaaaagtgataagttccatcccttgagggatacaaccttactgtttactatatgttatctaaatagttattaaaaaattaaaaaataataatatagattaatacaaaatatatcacatgcaaaaccaaatttaatttctataagctgcaataaaaagaacaaactaaactgaaaatagttaccgtacattcacgtctacattggttatttttttttacaatttataggagttgaattttaatttgcatatttgtaaagtgatacatttcatattaatctatcttgctaaattttttaattttttttaactatttatatgatatgcacaaaatggaaggatacttcctcgagcggataagttgttctccacatgcataggtcggcggccggatcgaacagccgagctgagcagcagcgaacacacaaccacctctctagtatagctagccctgcatgcacgacacatatattactactagctcgttagtttagagacgatatcgtagacagattaatcatgtggtagtacgtagtacgtgctgattctccaggttaacaaccagctagctctcgtagatgctttgcttacgttacagacagtagtacgtagctcctcgatccctagctagcctgcatgattcctcacgatttgtttcttcttgtgaaaagaatttaattacttatacgaagtacgtagcttgtgttccaccgagaaattaacgcgagaaggaactagtaggggagagattctcttctctggtcgattccactagctactctgctgtgctgcctgtgtggtgggtagcgtagctttgccaaaagctcgcgatcgatggatcatcgcatgggacgcgcgcggtcaaaaaaggctcaaaacgcacacacgattctgcgattctgcgcgggcggcgtggtggtgaggagaaggccgtcgcgcgaggtaggcggccggcgaatcgcggggttggtgcgacggctgcgctttgctgggggatcaaccggcaccgccctgtgctgtactacctgggctattatgctaatctattctagcgagagagggaaggtagagactagagagagagagagagtgggtgtgggtggaccgctgtcttgtcgctttgctcccatcatctcacctcacctcacctcaccgtccccaaaggcagcgcagataggggcatttcggtcttttcattttgggcataaaaacaacctctaattttccattgtcttgcctggttattcaacggcgagaaaccaagttagggagaactgtaaaagaaagtctcagttataaaaagagttaacttctgataataaatctgaccaatatttatcttaattagattcattgttaaaaattagttttttgggacgtaaggtgtacttgtactccttggagatagatttgttttctttctcacatgatgttccctgtttcatgtatgttgtgtaaaaagttaaatttttcaaagaattgaataatacagatcaaaagatagcacatgatatgccactacacaaacatataaattaaaattcaacctataaatttagaaaaagaacccataaactatttattatatattcgtagtcaaatttattaatatttttgcttagcttgtattagttgaatctaatcttataaatatgtttgtgaagtggtatattatatgttgatttatcttattaattttttaactttttaagatgatatattacgacaacacaagttatggtaatctacatcgttcatcaacgctaagcaagcaaacagatcaggttaagatatcaggggtaaagtaaggtgctctcaataaaacatatacatctcagcaatagactagattaataataaaccatctcaatagtatgtctatatgggtatttatacctctttaatccattgcctcgtttttctctatagactatctccaggttagtagatagttttgctttctctcttcatttaatcttttccatataggaaaatatgctgacatggatcttttatatatagtctataagagcacccgcaatgttaaagtaaggtactatttataaaacatatacatctcagcaatagattagattaatagtataccacctcaatagtatatctacacatgagtatctatagctttctaatctattgcctcgtttttctctatagactatctctaggttagtagatagctttgctctctctctcttcatttaatctctttcaagtaagaaaatatgctgatatggatctcttatagagagcctatagataaccattgtgggtgccctaaataactattacggttgacctcatatactgagatggcggcacagcgtataggatagtactcgtacgtttggtggcgatcaggctttaattgattttggtggcgatggcgatgattttggtgtgggagagtgagaggagaggagagtggacaggacactggacactggacacaggcggtggtggtgaggttggcttggagtgctagtactacacgtactactactactactgggagtatatggattcctctccccgctttgtggtgtcagaaaaggccctgacaatctcccctagctgtcatccccgctcagagccgtagtcaaacccccttgaccggacagagtagataccatgccactcaactcactcatatccccgaaatgcccctcccttccaatcacaaaggtatacgtaaccctagttaaggacctgtttcgagaagtttaaaattatgagaaacagaaattaaatggtactctcctcgtttcacaatgtaaattaatttactatttctcacattcatatcgatattaatgaaactaaacatatatatttatctagattcattaacatcaatattaatatagaaaatggtataataacttacgttatgaaatggaggaaatagttagctttaaagaatttaaaaatatttaggtttctcggattctaactcctactttattttctggttctataactatatatatttttagaatctgaattataaactgaagcttcccgaatagggccgagtttagttttaaactttttattcaaactttcaacttttccatcacatcaaaattttcctacacataaacttttaactttttcgtcatatcgttccaatttcaaccaaactttcaattttagcgtgaactaaacacaccctagcatcacgtttagttccaaaatttttcttcaaacttccaacttttccatcacatcaaggtcctgttcactttggtaaagttgccaaaattttggtaatttgctaaaattttagcagaatttcttatatagttaccaaaatttgatagcaaactaaatgtagcaacttttttggtaactttactaaaatttggtaagattgtaaatggcatcaaagtgaacaggtcccaaaacttttctacacacaaacttctaatttttctattacatcgttccaatttcaaccaaatttttagttttgatgtgaattaaacacagtataggtcttaaagctaattccacatgtctctagctagaagtagccactactagtacgagttcaactttgctcctttcaattcacctcaccgatcatatcgatcacccttataattcaccgcccatgcaatgcatagccgcctacgagtagtttttttgacgttacgcttcgttgtcatcttgctgctacagtacagacagggcagtgtgctactaccccctaatctctattgtactacacaatgcattatgcatgtctctaattaagctcaaaaaatcgtaaaatttgtacttctactccttggactacaaatttctcaagagaaaatggtgtggcaacgctggagcaggggggcctacaggtgcgtacttgcaaagagcaaaagcattggagcattggatgctagtagctccactgaaatgggctctagagagagagagagccgcgctctgtaaaaaggcatgcagatgcagtgcgtgggcaggggatccggagctgagcgagctagcggtgcatgcaagctgtaaaaaaaaaaaaggcacagcctgcacgattctccacgcacacacgcacgcacgcacgcacgcacgcacaaggacccccgttcccgttccgtccaacaagtacggtgtacttatatttgccagaaaagagctttgtatgactcagaataaaaaccttaattcgtaagggaatgtttggtggtattttgcctgaattatgtgccacatatacagccccatcgttgggcttatatctggaataagccaaacaacatatttataaacgaaaaataatttataaataaaacttttatatatgtgtccttagtgatctaaaagcacagactgaaaaataaacttctataaaaaaactcaaaatcagctttaaatttaagattaaaaattcaaattttagctgataagtataagcgtaagcgaaaagatgagcccggtagaatggaatgatacatactgtttaactattcattaagaggaagtggaacacgtaccagcactagttgcaaaactgaactttcttcgagaaaaaaaatgtattggattattttcagttgaacacagtatgctctaattaagctagtactgaatttggctaactcaagtacgtatagcagtttttcaagctactaaacaaccccttaatgagccaattgtgagtcagctttaattgattttttttaaaaaagctagtacttcctgaaaaagaatatgaggtgcagctacaaacaacacactgtgaatgcatggttcgacggccagatcgacgagaaacgccgtacctatatagttaagacaacaataagctcatggatggacgtcagaggacgtggtgccattggaggagcgtaggccgggcccctacttacaacaatctgcctatacattcaggacataaattgagcttgtggccatttatttcaggcttttgggttggagccttgcacaaatagttgcattattatattggaggaaaagaaataaaacgaaagcatgaactgctggttatatccgagaaattagtacacacacagtgggttactgatgatcaggtgatttgtaaactagttgaagtgagctgcagaggcaagccgaactgataagtgatatacagtgttcttgcatctaaaaatattagtattttgtattattagtataagactttgactgataaattgctctacttatatactattcatgtgatgaaaagcataatcataaaaagtacttctgaatataaaactattaacaccaatttgatgtcgaaaaattatatgctaatggagtaattatcggtctaaatcatgtcttaacgtaacaaaatatgtcttaattttttgaacaaaaggagcccttaatcttgtgttattagtcgagagatcctggattgattgaccagaatatatagggtcctctagtacgacagtagcatagctagctagtcatacaagaatagaattacgatgctatcttaaacgaccacacacaggagtaattgaaatggagtttactggcagcgagacggtggtactggtacgtcgacggatgcgccggagatggcagcttgtataaatgcaatcccggcccatgggcaggggccaaaccgccaccaatcacccctcctctcctatccgggagggacacgggggccagtgaaaacgaagaagccaagccaaagccaacccacagctgcaataataacgcgtagccacagccactgccgatgccgctgctgcgagagggtgacaccggccaatgcaacagcggcagcagcagcagaagaggcaggcaaatcataaggcttgcccccacgcagctgcgtgccagtcaaacggagccagtcaaaactccaccgttctcttcccccacactgtgtttcagccccacacaaacccatccatccagcaccgtacgtgtacttgtccagcaagggtagcggcggtgacagtatatgacattattgtaccatggggagagagataattggctgtgtttagtacacgctgaagtttgaaagtttggttaaaattggtacgatgtgatagaaaagttgtgtgtgtatgaaagatttgatgtgatggaaagttgaaaggttagaaaaaaaaaaacttggttaaaagtttggaaaaaaaactttgaaactaaacagggtagtaatatataggttaggccactgggatgcatcatgggttaaaaaccttgaatgctgcgctggaacgagaattccgtggtagtactgaactttaattttagtcggtagattgtctgtgagagcatggaacatattgtgaattatggatgatagaaaaaactgaattttgtaaccattataggagaaaacaatcaaacgagttaagtattagtagaaagttaataacttggtttagaaaggaataacttatgacaagaaaattttatggacaaattagcatgagatctaacgtcatggaaaatctctgcaatttttcttgcaatctatccaaactgtcgttcgtgtaaaaacataaaattgcttgaaaatccatgttttacatttctatttttcttttaaaattttacatttttcatattaatgtgttttctcattcttgcatttttcttgtgttttatatatatggtcatttctcaaatgtttgaaaatcctcttttatatctgtcctaaatcgtgcgctaccttttactacattttcttaatcctacattaaaaaggtggtcttataattaaggaaattcatgaaaactgaactggttcctattaaattatttttttaaaaaaattactttgataaaaagagctgtagcattcttaccttttgcgtccaactacagtctacagtcagtcccggagacatttaaccgacatccgatatataatgatggttcacgtccagacaaagtcaacagtcaacatggcatgcaaagcaactgttcacgctcctcgatcagacaagataaaactgtgcccgtacggacatggctggtatggcagtagctctgatcaccaagagtactccctcggcacaattaactggagcctgcctgaacgaaacagaactcaagagtaccaaccaaaaccatcacacccttgtcttttcccaaaaagtaagatgcaggtaagcgcaaggattaccacgggcaccatggttattagtggactttctcttccagcatttgacaaagatccaaaggtaagaagaacaagattttatcagcatctgttcaggtataataatattatatgcattaaaagagaactggagtaaacctactcaagagttctataaacatactaggaaccactacaaaaggaatatgggcatttccacaccaaagaaaccagattcgtcatttggctccaagcaccaggagggaaaaagaaaaataagagaagcaattatgaaccctcacagaaaatcactcgataatcttgacttggagccaataaagaaataacatgagttgataaaataggcttttagtcccacaaaaggttgatcatcgagttggccaacccggcttctttgaaagttttatcactctcgtactccaggtttgtggatgccctaggaatgggctgtacgaaatggaaagccttcttatccccgtcctccacttgaggatagcagaatgaccacaggagctgcggcgagatggataaagcatcagcgaacaatgtaggagaagagacaaaactatggaaatttatttcagtgttctaaccttaataggatccgtgtgaaggaaattcctctggatcctcctaccatcaggtaggcgaattgcaactctgcacaaaagctcccgacttcctttgggttcttcagggagaggaggatagttcagcttagcactcaggctaggctcattttctacctcaggttcaatcttttcctcactagtgtcagagcctttactctcctcaagagaagccgctactgcccgtgctagttcttcgtcttcatcctctgtggctactacgggtacaggggttttacctacaaagaaatggaactgtgaacatgtgcttttggtcaaccttgaaatgcattgcacgtaaccagatcctaacataataataaaaaaaaacacacacacacacacacaatcaatgctgcgaaattaatccatcaaaatatccccttaagtagtggcatccatatgaccataccggtaatattgaaaattacaaattttctttgtgcatgtcatgccatgcatggagagcttacgctaacttttgttatgcctacccctcttgcaaataaatctgggtagttgcttatcacaagtcaaatttgaaataaccttaacttacaatcgacacacaaagaccatcgttgtcagagggtggcaaaaccagttgtgacttttgcctaaagataactgtgattagacatgatttaaattctaattcctaactacacaacaaataaattgttgttgacatatagactactgaaatattttttttccttgcgtctggtctatgttatgcattatcattgttcaagatgagtgttaatggaaagtgatatgtcagcgatgattcatatccaagtttgaaacatggctaagacaagtactgccagaaaccatacatttccaatgattttcctattataaaaaatgtccattgagtctcgtgtccatactatccaattattgtgttatctgggccattaagaatccttaatatctagaagtacctgccaaaaacaagttgaaataaaccactaaaacttattgccagctatcaccaacaggataaaatctggtgacagatgatgtatgaggatagaatgactcgtaaggccaatcctccgactcccataaaggtcagtgattatgccaggcacatccaccagataatcatcgttatatcataattcataacaagagtaaatttcacaaaactacaggtattttgaccaaattatcacaactacagatttaaggagttgtatcacaaaactacatatttagcaccaaatttatcacaaaactacagattttagattaagtatcataaaaatgcatatttaatattgaacttatcacaaaactacaacttttggagtttaaatccctagcaccattgttatggtggagctataaacatcattactttgtgatttaattgattctaaacctatagttttgtgataatttagttactaaatatgtagttttgtgacacttcatcttaaatgtgtagttttgtgataaatttggtgttaaatatgtagttttgtgatacaccgagttaaatctgtagtttggtgataatttggtcatagtatctgtagttttgtgaaatttactctcataacaattacaagcaacctcccaatgaccaactgctcctggaaatcacgcttatgtagtgtaagaacgacctaactgtagttggatgatacaaatgaacaccgctcccccttatccaattttgtaaagcatcaaatgctagtacagctagcctacccccaacttgattgggaacaaaggctgatgctgttatactaagtactagaaaacaaaacacaatgcacctagaggcaccctcacatgacaatcatccctgctactttttcaagaattggacatccactcacaaggtttgaaagttttgattgtatggaagccccatatctttaacagatgaagtttcgattgtcacgaacttagcattaactatgcatctattccacaaaaaagttatttcaccgtgttaaaagataaatccatataatgtgaagaaagattgcaacgaaaaaagataggctcaacatatggttatttatgtactaatgtgcttggttcatataatagttctgcagaaacaaactattcgagcttaaatgtttcaaagggaaaaaaaaacatcactgctagttaacatatctttggacacaagccataccttgtttgccgatagaagtttcctgatcaacttttcttggccgtttttgaggttgagctgcatggtgctcctttggacctttgtccaggtaaggcatcaaatcctgtggacagttcacatgcagacagtaacaaggaataccatgtcaaatcacagttaagattccagtattagaatgtggaagtaagaatgttatcactacagaagttagtaacatgagagatgaaagatagtaggtcgatagggttaccaaattacctccagcaaacggtccgggtgaatcattccattccacccacgcattttttgcccagtgatagggtcaatcagaagaatggcaggaacagagaccaaattgtagtaggtgcataccttcctcccctcactggtgtcatggtaaacctatatttaagatgatagaacatatcagtagacaactagagatgctaaaaatttgatccatcttggggtttgggaaaaaaagtgaacattagaaactctttctttccaatactattcctaatacatcaggaataaaaattggagatacagttatgtggctcaggtatagaaggcgaaacaaaggagtaaggaccaacctgccagaaaataaagttcgatcgaattgtctgagccacagcctcattagcccaagtgtcccgattaagcttcatgaaagaaacactcaagagtaaaaactttgccaatgcaggaaaaagaatgaagggttaacacaaggctgcatgacattaatggtaagatctgtaccatgtgagagctgaactcttcagtcgattgcaaattgatcaagagccacttgtccagaacagaagcctctaactttgcctacatttatgaaattcattgtttttagaaatctgaattaaattggtaggttatagaaaattaaaggataatcaaattagtattatgaagttcatcagctccaggctttcacatgaaaattagtagcagtttactagttctcgtgcactggtcattagacaacaaatgaatttgcaacaactaataaaaacatcaatgtactttcaatgataaatagtgtgaacaaagaacattaagaagcatgtttgaccatgcctcttgttgacaaaagggaggcaatgtttgcttgagtaataaactgaaccttagcagctaataaaccgaactaattatttgacaggtaggattgttagcagctgagataaatgaagagttcgtgggttacatggcgtgctgctccatgataacaattcagtatgtcactaatagaatattgcaattttcccaatgcataccaaatgcccacagacaaagcaggttattgaagtttgcaggcaaaggcagcacatggtcatgttagagataaaaaggtaacaccagacgttaaataagaaaaaaaggatagctgaccttgtcgaagggtccattgaacatcaaagcaaatggtggacgatacaatgccgccagattatcacgagaactagatgcagcattctgctcagaatcccaaacagcagattgccttgactcctcttcaaagttacgaaatgcaactgttgaattaggccgaacgctgaaaagaagtcataaaaccgtttcaaatttagaaaatgatagattttaaattagtagtccacgttccaggaaaatcatgcaaaaagtttggttctattagtgctatacttctctttggttactgtggctcaacttgagtttcatctctagcctattctaattttctttagagtaaaaggctgttgttttagaattttggttttagcaaagcaagacatagaagcctaacaaagcatgtcggcccaaaagaaaagagtacaacaaaatttgggccttatcatctccaaaagaaagagtagaacaaaaattgcatcacttcccacactttaggtcattaggtgtggctcagcgctattccttccagatttaacaaaagtggactataacaaagaaccatagtaataatgtcatatgtattcaagagatgttgcatctaccaaagaaatggctaaacatcagcaaaatcaaccccaattataataaatacttggcacagcgcatttaagtatatatatctaagtatacccccttaatttgcagtgccattggggcagtcccagatatgccatcggtatcatagagaataagggataaaataagagctgtgactgatatgttaatggtcattgtgttgtcctaatgggtagaaggataacaccccgaataaaaacattcctaactttatctttttcaggaggcaacaatctctcctgttttgaaaataattggcagcaaatgaaatgactagatgtttcttctgatcagtaaattctggttgagttcgagctagtgattgtcatcatatctgttggtgacaagtaaagatatctaacttgtagccatgaacgaaatttgttggtgaccaaccaaataccaataatctcattggttgcaaactatatgaaagagatgttagtccacttggcaggggaagagagggcaggaggcttgactgcaaattagtggtactagaaaatggtgctagctattaacatagccaaaggtgcaatttaggccaaaaggtttatatcccatcagcaagccaacaatgattaccaacaacacatgctaattccattggacgagaacaaaattactataggttagtgacatctattcatcaccaaccaaacacacacatgccttttatgaggacttaagcttcgatttgaagccatcaaaaacttaaagctcccctaaacagcatggccttaacattgtcggataagagtttttttagacaatcacatgccccatgtaacctatcccaatttctctttgaaccaaaccaatgattctaggcattactagtaccgattttgtgccaccgatacaccctatttggctatttacatgtatcagtacatcacataaaccacaatcaccacaggggcagcacagatattgcattgaactagaagttgtctcacacaaagtcttaacacttatactgaggaactcaatcccaggaacccaactatcataaagagtttgctaaccaagcactagacttacacgaccatgggggcatcgccgtagagagtctcccgctttgtgggcagcggtgcccgcacatcctcttcctccccaagtccctgcagcattccatcacccagtgcagcagctgggggcggagcgaacctgcccatcacagcacacggtaagcgtacacaaaccaacagaaaactcaaggacccaaaaaccaaagcccaaacccgagaaatctcgcgccgatccacctatgacctacctcatcgcgtcctccacctcagcagctgctgccaccgccgccgccgccgcttccgccgcagcagccggcgatggggccggatgcgccgcaagggcggcctcgccgtcgatgtagaacagctgcaacgcctcctccagatgccagctcgtcatctgggagagacgggatcgcatcaaacccttcgaatcgatcagaagctagactctagaggggggaggaacgagacgacggacctggaggaactgggtggccgtctcgggcgtctggccggcggcgatctcgaggaaggaggtgacgagggactccttctccgcctccgtcgggggagcgccggccatggcggcgaagtcggggatgggaccctctcgcgcgcggcggttagtagggtttggtgggacggcgaggagtgttggtgaggtgggggagaggggaagtggaaacgtgcggggtgagtaagacgagacgagtgcgaatgtgcgatgcgatgcgatggggaagtataggattggagatggtataagtgttggggggagtacggcttggaagggaagaaagggcccatcccgagcccagaaatgctcatgccgtgggcctcgtgattcgatcagttcgtggaccatgccacgtagtatatgggcctaggaagtataaaatgggtcgtttgtccagttggtcagattccagtaaacagtacaactgaggtccctcagcgaattacaaaattgtcaacttacagaaccgaattattcttggtctttaggtgatattgaccctggttttgttcaacaaagcagctgagtcagcacaggacccacgtaggctccgcatgtcatggtgaccaagtcattaccctgtcctcttctcctcgtctgagcaggccggcagatcgaggaggagggggaggagaccagcggggtgaggtaggaaagaagttgagccggagcatggcggtggacatgaatgcaaggtgggcgtcgttagagaaagtggcagaccagccgccgcagccactcttgtccacaggcggcttcacgatggagaggactaggaggatggctgcggaggtgagaagcgggagcagcagaagggagtaggcgacgtcgatgacgacttctatttctctcgtgcccttctcactgctgcaatgtcaagataatagacgtactattagccagatcgacgtagtagtattgtcttgccacgctaacccaaataacgttgttaaaatgtttagatcttatatataaataaattttaaaataaaaaaggttaaaaagataaacaaaaattgattcggtggccggtgcagcgcatgggacacggtggcgctggcttaagcggtttccggcgagagagaagacgaggatttttttttgttttttcgcggcaaatggaccacggacacagtgaaaagcccggcccagttaagtatactagtttcaggcccacgaacgcatcgcacaagcagcagtgcggccatggcggctcctcctcctcctcccatccgaagcaagcagagcgagatctggaaggcggccatggcgcgcctcgcgctcctcgccgtccccgtcgcgctcctcctctccctctccttcctcctcctgcgccccgcctccccgccgctccccttctcgcggcagcaagcggcgtccggccccgaccgccgccgcctcctcagggtctacgttgcggagctcccccgcgcgctcaaccacggcctcctcgacctctactggtcgctccccgccgccgactcccgcatcccggcctcctccgaccccgaccacccgccgccgcggcctccgcgcgcgcactcgccgtacccggatagcccactgattaagcagtacagcgccgagtactggctcctcgcctccctccagccgggctcgtcgtccgcgcccgccgtcagggtggtcgcggactggagggacgcggatgtggtgttcgtccccttcttcgcgacgctgtccgcggagatggagctcgggtggggcgccaagggcgcgttccgcaggaaggaggggaacgaggactaccgccgccagcgggaggtcgtcgaccgcgtcaccgcccacccagcgtggcggcgctccggtggccgtgaccacgtcttcgtcttgacaggtactgtgattcagttggaaattggaaatgtgctttttattttttcctgagtgaacttaagtgatcaaaatggcataatggaacgggctgttgatcatattaaccctccattgctcccaattggtgtgggttatatgttaagcattcgataggttaagttatgcttgttgtccgtctattatatactcaatcccaactctcaactagtatatgattggaaactagttttttctcctccatactcaatcccactttctgactgatatctacagggtttagctactcaactctaaaaactgtgagctgatttaggcttgaaatcattttgtgtgttctgttagttaccggctatacatgtgatttgttgctcggcgcctcagtgtaagacttaccaagttcccttttccaaacagagggagtgtgcccagaacagtgagcacattgacatgtagatttaaccatgataggaacctcacaatgcactcataaatttgaaattagttatgtgcatacttggaataggggggtcaaggtagctggttttggtttcttaggcacgctttacatgttttcttgtgtaagggagtggcatacccttgaaatgccatcattaaagaaaaacaattttgaaccatgtgactttctgtacatttgtcatcaaggggatattggtaatcctcagtgtttcggagcaaaagacacaactgttttgcaagcaatgtaggaatacaagatatactgtttatgttttcgttgtaattgatctgcatagtagcttattattcttttgtatgctcaggttttgttaaatattgaggcattctttgacagaccctgtggcgatgtggcatgtccgtaaagagattgctcctgcaattcttttggtggttgattttggcggatggtacaaacttgattcaaactctgcaagcagcaatgtttctcatatgatacagcatacgcaagtgtcattgctcaaagatgtcattgtaccttacactcatttgctccctacaatgcacttatcagagaataaggaccgccccactcttctgtacttcaagggagccaaacacaggcatcgggttcgtaccatttatcatactaataagcatttaatgtatgcatggcaatatttatcttctttgtagtatctgaatctaagcaattggaaatgaaaatggaataaaagaacatgttagtatgatatgggctatcttaaaattttattttagaacctgttgagtctgaatccacagctctttgatattatttagagtaaagtccatcaccggtccctaaacttgtatcgttgtgtcatcccggtccctaaactcgcaaatcgaccgttcaggttctcaaacttgttcgactgtgtcatcccggtccctaaacttgtagatcactcgtataggtcctccaacttgttcagttgtgtcacctcagtccctaaacttggatttgaatatcatctgggtcaaataggacggtttaaagactttatatttaaaaataattcataactttttcatgtgaactctaatgaagacaaactttatatcaaacttgtagccctcgacgcgatctacaactttgtagttgatatttttttttattttaagtcattttttgtcccagaatgtaattttaattttaaaattacaaaatctataaacatgcaacaatattttgggaccctaaacagttttaattcaaaaaattttcaactacaaagttgtaggtcgcgtcgagcgctacaattttgatataaagtttgtctttattagagttcacatgaaaaagttatgaattattttttgatataaagtttttagaccgtcctgtttagagaccggcgtgacacaactgaacaagttggaggacctaaacgagtgatctgcaagtttagggaccgggatgatacagtcgaacaagtttaaggacctgaacggtcgatttgcgagtttagggaccgggatgacacagcggtacaagtttagggactggtgatggactttactctattatttatgtatctacaaggaaactattgccatttgaagcattatgctctcaacagaacttttatttacaaaccagctttgtttatgacttatgagattgttgttctgtactactgtgcatctctatacagctttatcttactataacttctgaaattttctttcagggtggtttggtacgggagaaactatgggacttgatggttaatgagcctgatgttgtcatggaagaaggttatcctaatgccacaggacgtgaacaatcaataaaagggatgcggacatcagagttttgcttgcacccagctggtgacaccccaacttcatgtcgtctctttgatgctgttgctagtctgtgcatacctgtcattgtcagcgatgagattgagctgccctttgaagggatgatagattacacagaattcgccatttttgtctcagtcaataattctatgagaccaaaatggctcacaaactacttaagaaatgtccccaggcagcagaaagatgaattccgaagaaacatggctcacgtccagcctatatttgagtatgatagtatttacccaggtaggatggcctctgctgcacaagatggtgctgtgaaccacatctggaaaaagattcaccagaagttgccgatgattcaagaagcggttacccgagagaagcgaaaacctgatggaacatcgatccctcttcggtgccattgtacatgactcgcgagacatgattgttagtattagcaatcaatcccccatgggaggagttagttagcattccctgccaatttatggattgtttgtagtgcaaatatgagagaaatttcaacagtaggtttatgctcttgttgtcaattgtatttcgtctggagtgattccccgcattgctccatgtgtgaggtttgttggttcactgccatgagaattcatatatgaatctgcccattcggcagacaattttccatattactcagagagaagcttgagacagtacgtagtcccttatatttgttgcttctaaatgatttggctagcgttcacccaaaatgcatgcatgatcatgagcaaaataccttttgattcaacagaaagagatccaatctatgatgtttggcagtaccaaattcaggacatgaaaagcaaaagggagaaattttatagtctcaacaacatgaactgtagccaaataacagataggctgccaacatggtggccaaaggaacggagatattgtcatccacaacatcattgacaggaatacactccactacagtagctgctaatgcaacaagagccagtttaccaagtgccagatcccagcagacagtgaagtaaccaaggcaagagaagtagaacagcatcctgtgatgcaaaagatccatgagttaacaataacaaggagtaacaatgcaaaagaaccagcaatgcattctgaagcaaaaacctacagtgcagatagaaggaagccagaaatgaacattgagatgcttcctatccagctcttgttctcattgaatggcagcttcgcggagccataccttctcccaacaatgtcagcaaagcctgaaaaaataagaaccaagaaggtggatatacttagcagaagcattcatttcatcaagtgaactggggtattacaaaaaaaaactgcagattttcctaaattcccaggagatccaacatcttaccatcaccaccactcatcatcgacaacgaaacaatcccaataggagactggcgccagaagaccaaaacactgaccagcagcacaatgacatagtacagaggacctctcagcaattccctgtaagcaaccaaagatcatgtcaaggaatactattttgatttttgaatgaaggagtatcagaaataaggatcatagcacgaactctggttttccttcacgggtcaccgattttactagagcttcatcagtggaaaggcggagcccgtaggtcagaagccttatgcagttcagcaacgggacaattgccgcgaagaaccgtgcttctgtcgaattactgcgaaaggggcatgattttcttaagatctctagtctgatttggttgtagaaaacatttcgatgctggaagaagcagtggcaagggagacctgaatagtggccaggaagacatgaacaggactccggagagcacatgcacaatttttctgctcaggttctgagattaattatgaaaagaatcagaagttaacaagatataattaagaaaggtataaattttatgcttgaataatctattttcctttgattgatcaataaagaaagacttctcttttatctatcctaactactgtattttttgaacagtagcagtccatctgaaccagtcagatcttcccagcaattgaaaataaattcaagatacagatcacatccactgaattgtatataccatattttactctccggataacagtcaacagagctaaagaattgatattttttgaagaatggcggagatcaaagcttcagctccacctcaaaaaaaaaagaaatacaaaaaaaaaggaaaaacgagatccgacacctgttcgatgagccgccgcgccgtgagcccgtcgaaggcgcgcaccagggagtacgcgcccgcggtgatgagcagcgtggcggcgcagtcccgcagcgccgcgggcgtcgccgaggccgcgagcgccgccacggccggggcggcggcggcgcccacgccgagcacaagccttcgccgcatggagctcgccgccgccgccgcaggagacgcgagcctggacttggagcgcgacagcagcaaggaggaggaggcggcgaccgaggaggagcacgggaagtggcggacgacgtcgacgggccgcgccgccgcggccattcggtagacggactgcagtgaagcgaaatcgctggtaggccaccgcgaatttttgtcggggcgcgcgcgggtttctcgttgagacggggcacttttgtagttttgtggaagcgattcgtcccacctatccacggtactgtgtactactgtatctttttccgaaaataggagggctcgtccaaccctcctagagtgtacgtaatatctttgttggaaataggattctcctgatatttatattttggaaactcatgctagcaggggtgtgtttagttcctgaaaaaaaataaaagttcaaagaaagttgagagtttagaaaaaaagtttgaagtttatatgtgtagaaaagtttttttttgatgtgatatgatgtgatggaaaattgggaataggaaggaaactaaacatggcagttttattccacaccatgaaacagagtaccaatgcaattagttgcgctgaaactatcgttcaaagcacaagcataacatgcactggatgatctctcgcgctttgctgcagaatatatacgttagatattgaagaaacgatgaaatgatttgaactgaaatattatgaaaatgattgaaggatgatggtttagcatgtatatatttagttttataatgaaataattgtaaatataattactatatgtttatatgttataagttttgcgtgtttaatgagtagaatctatatatatatatatatatatatatatatagatttattatatgaatgtggggaatgctagaaagtcttataaattgaaacagaggtagtatattttgatgttaagttttaggtgtttaataggtattagttttatagaaagaaggattattgggatgagccaaatacgagatggttctcctgatatttcaggacagggttctccatatggaggaagctgttcctgtcaactcagtcaaaagctacaatcccatttgtcagctgtaacgtttattaataatttagttcccaatttttttctctaaaaatattacatcgaatctttggacacatgcatcgggcgttaaatatagattaaaaaactaattgcacagtttacatggaaatcgtgagacgaatcttttgagcctaattagtccatgattagtcataaatgctacagtaaccaacatgtgctaatgacggattaattagacttaataaattcgtctcgcggtttccaagcgagttatgaaattagttttttcattcgtatccgaaaacccctttcaacgtcgatcaaacgttcgatgtgataccaatttttttttcgtaaactaaacacaccctaaaaaacaaacgatagagctgtaacaacacgtgatgctgtacttgggagaactcatatccaaagatagataataacttcagtaatagtaacagtaactgtttaggactttatacatcttgcgaaaaaaaaagagcgataataataaaggactcggtaacagtaacaaagataaggcttctatactagatcttccctattcaaaactacaaaagagattgaatcaggttgttccggaacacttcgtgccatcgccgccggagtcctgatattgtacgggctgttcttgctctgtcaaggaaaaaacatggcaacgtgtgagcacataacacacacagacataacacgtattagcggccaatgtaacttttacatatgttcttaacaacttaaaaaaaagtcaatgatgaaaaagaaattacttataaaaacgctaaaatcaactctaaaaattaaaagtaaacataaaatttaaatttaaaaccttggagcaagtgcgagccttggcgttgcagacgggatactccttggggcagcaggtggagtgatccttgcagcaggtggcgccctcgacggggcagcatccccacacgatgcagtggttcctgatcccgtagttgcagcagcaggtggtccccgccgggcacttgctgtaccggtcgcattgctgcggcggcgatggcgccggagacggcggcgacggcttcgggttgggccccttcttgatcgggtaggacgccatcatggcgatgccgcacttgccggtgcgcgcggtgacgttgcgctccatgcggatgtagccgttctcgccccagtcgggcccccacgagttgcgcaccgtccagtaggcggcgccggtggcggcgtccgtgccgtaccccaccgccaccacgccgtggtccaggttggtgccgcaccggccggtgaacacgccggagtcgtagagctggaactcgcggccgccggcgtcgatggcgacgctgacgggctggtgcgccacggccttctggagcgacagctcgtcgttctcgggcacgtcctcgaagccgtcgatggacaccaccttgcggctcctcttggcgaggttgcacttgccgtccatggccgtgtacgggtagtcctcctccgtgtcgaggccgccgttccgggcgatgaaggcgaacgcgtcgtccatgatcccaccgttgcagccgctgttctgcccgttcctcgcgcactccaccagctcctgctccgacagcgacaccagctcgccggtgacgatcttgttgatgccctccacggcggcgaccgccgagaacgcccagcagctaccgcactggccctggttcttgacgggggcgacgacggcgcccttgtccctccagtccacggagtccggcagcgcctcgacgccgtcgtggcggtacgcctccccgacgcggcgccccctgccggcgggcgtggtgccgaggtaggtggcgcggaactcgccgttggtgaggtcggcgaagcggttcatcccgaggcggaacccgccgcgctcgtcggcgcgggcgttgtgggcgtcgacgaacttgaggttgtcccagaacacgcggaaccggcgctcgtgctcgccgatgaacccgttgcgcgagccgccgccgccgccgcgccggtgccgcgccaaccacaggtcgtacgcggcgcgcgcctcggcctccgtccgctccagcccccgcaccccgtgctccgcgttgtacctgatgatcgacatgatgtccggcggcgccgccgccgccgggggagcgaaggcggcgaggatgaggaggaagcaggccatggccagcgccgccgctacggacttgccgccaccgcctgccatggttgtcgtcgacgtcacgtcacgccgcggcgcctcgagatcgtcgaaacgaaatcacgtagaagtatgtgtggatacgaaatcgtgcggtgtttggttggcttgtgctatgttctggagaggcttggcggtcgatgaatttatacaggttggtggcgtacggttcgtgaccgaattttacttggtcgctgacgacgtgtcggtctcgtattggatctgtatcgtgtagagtgtactcgtttctactcctaaatctgacgtgtcacgttcaggttcggtattcgattctaaataggatgacgtgtcacgttcacacacgggccgtagcagattggggattgaggtgttacggcccggcccatttggcccacgaaatatcacctgacgacttctcttctcttctcctcttccttttcccatccgatttcttctccgggcttctggtagagtacgatttgatactatctgcgattccgcctcccctccccctcgccgccgccgccgccgcggggaaatctaggcgagactccactactaccgcacgtgtcgtaatggctcggaacaagaagaaggtagccgtggcggcgcccaaagcccggaagccgaagcgtgatgcagtaataccccgcgcctcagtcagctggagattggatcgtttttggtggaaggggaattgagctttagctaatatattttctcgtttttttttccttttggtgattgatttgttaggaggagaagaagttcgcgaagaaggccgacatgacggagttccgggcgcagctggactcgctggggttgaagattatcgaagttagtgcggatggcaactgcttctttaggtcttcttttcgattccattactcaaattcttgccactttttacaagaagaggctaatcgatgttgtacgatatgttagagtactgttagtttatgaaaggaggaatagtatatgcattatgcagtcttgtgttatatggttactcatcgtagtctgcagggcaatgggcgaccagctcgaaggcaacgaggaagagcacatgaagtaccgtgcaatgattgtgcaatacattaaggtatgcatcagatgagatgaccaaaacaaacatcttgtaacactgtgacttaataactgtagttagggtgccattgaatcaataaggtattagaaatactgcaagctttggctatgaccaagaaacatcttgtaacactgtgacttaagaactgtaattagggtgccattgaatcaataaggtattgcacatgctgcaaactttggctgtgtacatctgatctgggcgtagagtacaggctgccaggctgggttgttcttttatctaaaagacatgctgcaagcaagcattggcctatttacacttcataatctttcttgtatgcatcttacaggagcaccgtgtggattttgagccattcattgaggacgaggaaccgtttgagaaatattgtgactctatgcttgaggatgggacttgggctggtcatatggagttgcaagcagcttctattctcaagagaaaaaacatatgcatccacatggtaattttcaatacaagctttgcagtatgatttcttcaacctatgaataacacgctaggcagttgagccttgcctagtctgtattttgaaacacatgggtgatatagatcaatgtgctgcttatatatcccctgatggttctctgttatttttcgtactcattttcatattatagcctttcttctatagaagagaacgtactgtaacatttgattgatgcctgtaccattactgaatgatttgcagcttaactcaccacgatggtacataagaaacttttctgatcgtgaagctaccagtatgattcatttgtaagttaatgtgtgttctgctgttttaaactaatatgctaatactggcagtaaaaggacatacattctcatgttcctttgttttgattccaatatagatcgtatcatcagggtgagcactacaatagtgtcagactgagggaagatccatgtcaaggtcctgcaatgccagttattatcaaggtttctcactgtccaaattgtaaactgttggttgttttgtgtccctggaaggacagtgagatcctgttgtagctcaacttgctctgttactaatcttaattttatccgttatgaaattacaggcagatgccaatgtagctagcacaagcaataatgctcaaacaaaagcaaaggacctgaagaaatcttcagacagatcaaagtatgatcatatatcggttaaattggtgatggctggaactggatgttctaatatcgctgcagttgaacaggtatgaattatacaacaaatcgactttcttgtattgcaactgcgagcctaggctgaccgtagcagccaatcagtcattatatattaatggtcaatgccacatcacataggttttgaaagacatggatggtgacattgatgctgctatagagtacatgttagctgagcaactaatactgggttctgatgatgcggatggagatccttatctggactatgcatgtgatggtaaacatttgattattctgaagtctaaagtggctgtccctatgaatgaatctcatccttatctttcttgaggacttcagcttatgacaattaatgaaatttatggtgaaatttggagtacttctgggattccatagattgagttttcattgtttaatcctattcatattcttgccaaacatgagctgcctcacctgagcaagcgtttcatgcacacccctcaattcagtagcataaatctagtaggtaaaacctatactgggtgttgtgctcatggcattttgggtttatgcctcactaatatgatatttaccatttactggttatttttaagatcatcaaaatatgataacagtaccaagaagcatgaacggtgttatagaaagctcaagtaagactacggccttgttggagagcttctagctactgcagcttctcccagaattttcagctctctcaaacaatccagattcttagctatagaatccagaaaatgaactagatgccggttaccaactagctgtttctcagaattttaagctcccaccaaacagcccataccagttgctgtgctgggtgttttccatgttcagttcctctgcaattgccaaaggtcaatatcataccctgtaggaggtatatctgtactaagagttagtgtgctatctaaccaccctgtaggaggtaacatttttgtttggctggttattgttggagaccactattttagaagcacaagtagttcattttgtaaactgagggcattaactgtttcaattaatatccaatttctcatacctgttcaagtaatatttgttttacattggccatgcactgaactcatttcctttattgtgtatattacctggatcagcagagtatgtacagaccatagaggatgagcttagcatgaagcaggatgagagtcaactggatgaacacaagaaagaagaaaaggactgttctagcaaaggcgaaacagctcagaaacacaacagttcacattctaaaaaggtaactatcatgtggacgactcttaatagtttccaaacattgaattgccttgttaaaatactatgttggaaggaataaataggaattatccctttattcttttgcacagggaaagtcaaaaaccaaggaatgctcttgtggatctgctaggaagcacaagccttcttgtaatttagccacaactgtagcatcgagagaacctccaaaaacaactgcaccatcgagagaacctccaaagtatggctttataatggttttgctaaaaatatggcgccacatttttgacttgatttcagtcatttttttcccattcggattgctaccattcttttatactcctatgtaagtatgtttcgctctactatctcctctttcaagtaggtaattaattgttttcatcctaattctcttatatagtgtgtgctgcaaaaaatatggtgtaagtattgagatttggttttaatttttttttgttttttggtggaaaatgtggtgtcttaaatatagctaatcccctttataatgtttctgtccttttgtttgtcttttaccatattctattctacaactgaacttatgtcctgctgttcgcattgtaagcattctttcaaatggaatttttggggggtgaaatcaatatttccagcgtatttgcatagtgcattgctgctgttgtatctggcctatgaaaccttaacagtattgctgcaaaatatgcacttatcccatatgccttaaagtcaccgacctgattactatttcctttttcactagggaggttagttgcattgcatgtttaacacaatgctggaagtgttatgtactaatactatctgcttaatgtgctttactatcaggaccaaaggtggccaagggaaaggccagaaggggaagaagcaaaagaagaaagaacaagatgaaacaccagccatccgggatcacgattctaaagttgcaccagatctaggagctctttgcatatgaacatggtcgacgagggtgatgttctcctcagtgtgtagccgccaggaatgtgcggggcatcagttttgaagagagatgtctgcggtctaccttgcttggacgccatgatctagatggtgatttttctcttgcccagttgacggcttcacgtcactgccttctgctgactgactgttgttaagcctgtccaagtttcaggatgggatcatgggactgacggtgaggtggtgatctcagtgggcacagaaacatgaatgagctgttgatacatagcttcttttcttcatacatactttacctgtggatcaatgccatgtaaaacaatgatcagtcgtgcaaagcatattaattttgtgagaattatatcataatagagtattccctgtcctaacaaaacaaaaatacgctctattgtttgagatggagggatagtataatgggttcatcctggagtatatatagccagtcagtcacaattgccttcatgttctcgtgaaagtatctgttttaatataatactgttttctcgtgaagtatcttatctggtaagcagcttatctacttcaccagctacaagtccatacccccatgtgattacggaaaaagaaaatccataagaccaagctacagggttgttgcttagcaatcggtgaagctctcctgggtcagtcaggaagggaaagcatgttgcgatcagaaaaatggcaaaacgtggctcgcactaactcagagtcaaatgctttccttttgggactttgtgagagctccctttgggtcactgaaaaagcaatgtgcgagttgcgagataagaaagccattcgatgatgactcggataatcaaagtttaattgacatgtcattagtcgtgctggtgatagatattaaccccgtcagttgggtttggggttgtgcgttgcgtagggcaacaagctaatccttccaattaatcatagttgcactattcaaattattattgcgtgcatgaataattggtgcacgaggacggagcctactctaggatattgtcgataccatctgaattctcgtgggaaaaaaataataggagacgataagaggaatcgactggaatctgtgggagatgggctccggtcggcgcagtgtcctacagctattggatcacccatttttggctcttggctagctagtagacaccggccactagcaatgctcacaggcaaagatagattttttttaattgacatttagtaattctctttcaaaagaaaaagtagacaaatagacaatctgtagctgcctggacatatcttcggctcttcgatgagcaaaacgatgctactgtgcgttcattgggtcagcagggcacaccaggacaccggcgagactggaaggcgtgagatgtggccatcaaccaacaaggtggggagatagtacgcaacagacgcgtgttgcgcgagccgcgctgacgctgcacatacagcgcggacatgccacaggccacagcagcaagcggagcggagaagtggccgctcaagccaagcaactgcaggatcggaggcgaaatcgcggaagcaaacctcccccgagtgggcaaaagaaattcacgcggagttggccacactgccgactgcccgcgtctcgggcaaaatttgccgacctcgccgcccgccgcccggtaaacctcgcggcagattgcacgttggatttccctggtatccatcggtgaaaagcggcaactactacagtagcgcttcgtacaccagtgccgatgattctagtacggcactatcccgtcagtgtgtgcggccgattaacacgtgatctactcactggtccccggtggtgcacataaacaagcatggagtaatcaaccactgatctgcagcacgttgcgcatttcgggctgcgaagggaagggacggaccccagccacgttcccgtcatgttcagacgttgtgatgctcatgttcgcgcatggggctccggttcccaaggagatcggataggatttcagacacccggtcaccggccaccgctaacaccggccggcgagcggccgcgaacatgcatggcgtctcgtctgtcgtctcccgatcgaccgtgttcgtgtacgctaccgtggtgaccaaccagccgctctctgtgcagtgcatgggcgagttgtgtctcctcccaactctttttccttatcgggtaagcaaacggccgtgattgggggaccaactgccccggtgtcgtggtacgtatcaagtacacctccgtcttaaaatatactaattattttgtagcagagtagcaagtcaaaaaatttaaccaccgcaaaaaaagtcaaaaaatttaaactttaattattaatagtaaaaaaatttaaaaaagatcaatcatgtaaaattgatggtattagatttatcattaaacaaactattataatatgtaatttttttaccttaaaatactagttttacaatactagttttacagatattggtagtcaaactaatattttatattttagagaccttattatagtttaaaatcattatattttgggaggtagcgagtaccgcggtaggacgcgccaccacggagcgaaaggaacacgagattcgtccgaccgccgcctcgcgctcgccggcagttggccatcgttgacgcctcgctcgggcgcccggaaatggtgtctcgccacgtgtggatattatgggtaccccatacccatacggcatggttatccgactagtcataggggataacttatatctatggaatatgtaatagatcatgactcgggtattacgtttccttatatattacggaacagcctaaagtcctggtttgataagattgtaaagtagaccgataccgtgttggttaaggtttctatcttgtaatcctgccccccatcataaggtgggcaggaagccctctagggggcatgagacaacctgatcgtcagattaatacacactcggcggattcaaatccccaaacaggagtagggtattacctctcattgagagggcctgaacctgtctaaatcctttgtctccgcatccatccacttttaggtctcgtgcgctaccccttttattattgccgaattcatgtttcgacagttggcgcgccaggtaggggctgcgtcgagttttccgtcgagaagtgcgatggaactttgtgctggcatcatcggtgctactcttgtctttggccgtgatcctctcaacaaaagggcagggtcttcgtcgccaaaaattctatctggatctggtcaatcaaccaggagattaatcaccgatcgaatcgatctacaaccagcttgttaccgtcaattttacctccgtcagtgagatcaaatccgtcgctacaatgctgccatatctgttggtccgtcggtttcgtcaccagggcatgatttgaagcaatcagcaagcagccgccgccaaaatcatgcgaagatcaccgttggttgagcctgtacatcaccaagtcaatactactcggatacgtacggcaagacacaaagtccaggatacaaattaaatatacctggtcaaatctgtggtcaaggaaattaatccatacacaaatcagctattacatgcacaaagtggtctccaaactaatccgtgcatgtgctaccgacgattacatgtctacacggctgcatgacacggctgcatgctacggttcatccattgacaggcctcgaatcaaagttggatcacaaaccaggtttatcgttctaaattttcttatataaattagaattaattcacagatcactaattattatttgatctattattttatacatgtaccgccggccgccttcgtcgctgccgattggtttcatcgcctccacggttggtgtgcgccgctgccgttgcnnnnnnnnnnnnnnnnnnnnnnnccggcctgcctccgtcgccgccgactggtgtcctcgcctatacggtcggttggtcacaccaccgttgatgggcatcgtcatctacaccgccggcctgcctccgtcgccgccgactggtgtccccgcctatacggtcggtctattatgccgccgctgttgggcgtctacgacttcaccgccggcctgcctccgtcgccgccgattggtgcctccgcctacacggctggcctattatgccgacgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctgacctattatgccgccgttgttggacgtctacgtcctcaccgttggctcaccttcgttgccgtcgactggtgtttccgcttacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaaggatccagatccagatatgcataaaagggattcatggctttaagcttatctcttacgctccaggaatggatcagtcagaacgtcaccaccggctcgcctcgaccgccgccgactggtgtttccgcctgcacggctggcctattatgctgccgttgttgggcgtctacgtcttcaccgaccggccgcctcgtccactgccgactggtgtttccgcctgcacggctggcctttatgccgccgttgttgggcgtctacgtcttcaccgaccggccgcctcgaccgccgccgactggtgtttccgcctgcacggctggcctttatgctgccgttgttgggcgtctacgtcttcaccgaccggccgcctcgtccgctgccgactggtgtttccgcctgcacggctggcctttatgctgccgttgttgggcgtctacgtcttcaccgaccggccgcctcgtccgctgccgactggtgtttccgcctgcacggctggcctttatgccgccgttgttgggcgtctacgtcttcaccgaccggcttgccttcgccgctgccgactggtgtttccgcctgcacggctggcctttatgccgccgttgttgggcgtctacgtcttcaccgaccggccgcctcgtccgccgccgactggtgcttccgcctgcacggctgacttattatgccgccgttgttgggtgtctacgtcttcaccgaccggcttgccttcgccgccgccgactggtgtttccgcctgcacggctggcctttatgccgccgttgttgggcgtctacgtcttcaccgaccggcttgccttcgccgctgccgactggtgtttccgcctgcacggctggcctttatgccgccgttgttgggcgtctacgtcttcaccgaccggccacctcgaccgccgctgactggtgtttccgcctgcacggctggcctattatgctgccgttgttgggcgtctacgtcttcaccgaccggccgccgcatccgccgctgactggtgtcaccgcttgcacggctggcctgttataacgccaactgatgctatcttcttcacggctggctacatcgctgtcgctactaataggcatcagtatcttcaacacaagctgcctacgtttgccatggctaccgactgttttcttcacttccatggctgcatgattctgccagtgttgattggccttaccatcttcatcgccggtcgtctcgtctgctgctgactagtaccctcgtttctacatctggtttatacagctatcactactgatgaacatcatcgtcttccgtcgccgactggttatgttgtcgccgactagtgcttttattttcacaactgcgcgtcttcactaccagtttgcttctgttgccgacgactcgtgttcacttcatcacggcaatgcaactttgtcatcatggtagagcaacttcatctttattatcttcggcactggcaaactctattgctgctacttcgcaagttttgctacttcaccaaccacgacgtctttatgagcctcgacatctcggcatgcgatgccatgttattttactacaacaagaggctctccaacattcatgatttctacttggacatcttcaacacatatcttcaatcaagcaataactattcgacgacaagaggctacagttctcgactctatgttcagttgtttcccaactaatcaaagagtcggggactacacaactacaaggctcaaaatttgacaaattttatgtcaagctgaagaaatcaattaatcagccaacgagtcaactccaggagtcattatcttcatctttgcttcggagcagacattctacttcaacaacttcaaatatttcggtttagacgagttgggcaacaacatcaactctcctccaagtaaagcatctacaacagctataacattaatttgatggattattatcactgacatcatcaccagcacctctgcttcatcgaccctgacatctccgctgttgctaatggatgattatgttttcgccgacttattatttcaccttcacggttgacctactatgcaaatgctgatgagcgtctttgtcattatcattggttgctacactgctattggctggatcaccgacatcgtcatcttcatcatgtcggttgcgtttgtcgtcgtcaactattttcttcatcttcatgattggtggattttgtcatcacctttgatctacctcgtctgtcaccgactgattattttgctgccatggctacacaactttatcgctgggctccttcatcttcattgttagttgatctgtctgccgccgactggtttcttcgcctccatggctatgcgacttcattacttttgattggtatcactatcttcgctaccaccaatatttttgccacctctggtgggcaatattctctctatattggttgtcttgtctctatgccaactgcgtcagctaccatcaatgaacaattgtgactacgtgctcaggggcttactagcttaaatacaagtattatatcttcaatttggacttgctccggatacatgcaacatgaattcatgatcatgggtctattttatatgctcaaagactggactatttattattccccgtaagggttatcaattgaatacttgcgccagtcgggattcaattgttacatctattttagagtatcccataagggataaccactcagatcagaagctattcatatgagctacgcttggtctatattacccggaagatttattactcgggagcatgttatatgcgtcatcctttaaagggcgtcgaaggcatatgttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaatagtaaagctttatatagctgtcccgctgacttttttatatataagtcaaggtgctgtttgggtttttaagcatttgattggatacaatatcattgcttttcgccacgtaagtgtgcatttttattgaccaatattatggcttaggctgattatatgttgtggccattttctaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttggaaatttctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctgcacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgactagtcataggggataacttatatctatggaatatgtaatagatcatgactcgggtattacgtttccttatatattacggaacagcctaaagtcctggtttgataagattgtaaagtagaccgataccgtgttggttaaggtttctatcttgtaatcctgccccccatcctatataaggtgggcaggaagccctctagggggcatgagacaacctgatcgtcagattaatacacactcggcggattcaaatccccaaacaggagtagggtattacctctcattgagagggcctgaacctgtctaaatcctttgtctccgcatccatccacttttaggtctcgtgcgctacccccttttattattgccgaattcatgtttcgacaccacgtacacggcggcgatggccgcgtgtgcgtcaccggccagtctacgatgggtagctgcagtacagcgaccgcagccatccatcagtgacgggatcactttaacggcatgatgcaaatgaagatagtattgccctattattagtgacaattgacaatattatggcatgcgattagcttccggcgcattacagcgcgcgagtattatttagtggttttctaggaggtgtaaagcgtttcaaagcaaagattaccctctcagcaagtagtcagagtcttatccgatgaagtacatgttaaattaggatactatatactactaagtgatgagaaagagagagaaagtgaaaattggaaccatgccattatataaaatttaagatatgccattttgacccacatgtcattgactcatgtgagttctttatgtcattgagataccgatgacatatcttaaactttgtaaaattataatggcatggttcttgtcgatgacatgggaccgggagtatcgtgactagaggcttgaggcagacacaatcgcccacgtggcctggcacccacgggggggggggggggggggtcgggcccgagggtggtgtgttcgccctcctctttgtctccccgagggggtcggaccgctctcgccttggccccgagggctggggcgccccgaccccttgtggattttgcgccgcgtgtatgggttaggtgagcacagcggcgctcacctaaccgcatttattgcggtttggacgaacgcgtcacgccgcgtgtaatgcggtgcagcgcgctcgtttatccggtctgtgaccagtcacagaccggtcagatcgtgggttaggtggcgacaggcggtctgacgcacgcctcgccccgtccagtcaggacgagagcctccaagcactcgtccctagccggagccggcgtgttacctcctggagatgacacgttggttccggtcagatatataccaggcttcatcctaaccattacaggcaagatgttgta

SEQ ID NO: 72941 - DNA, 5946 bp, Oryza sativa
taaccttttcttttccaatgtgttttccgttaactttgcaatgtctaattataattgtcttaatttcctcaactgttttttgctgcttcggtgtttcattaattaccaatcccatatcgattactgaacttgtgaataacgccacaacctgaatattttgccttgttatctgctcccgtcagaattactaggatactattcgtatattattatgcaatcattttgtctttgcataaatatataagaaactcatcatgggctcaaggtgtccatattcttttacgttacgtttgtgagagaaaaaaacaaatgcatgtgatcctacaatttgtgtagtctataattgcattattgtcatgacagttgttgcaaataaaatagtatccctcatgatgctggattccaaatcaagtgaggtgtagatcaacaaattaagacttcttacagtttaattgttttcatgaccaggtatcattagtcaaactatttgattcactgctgattcagtgacgacctataaatctaggactagcatatctctcacaccggcacagggagacctgcatcgctctgcacgtgccatccccttcgtcttaaaaaaatagtggtagaagttctatactacagaaggaataaacttccaagtaagtactgtacttgtgtttacttatagactgaagcatagggtcgttgacaaacaaaacatatacaaattaaggcatggggtcagacagacaaaacgtaagtccgggtcaaatggggcttaagttactactgtgatggagattaattacttcctccgttcttaaatatagacacatttagaattaaaatttttacacgatataaacatttctgtgacactaatttcaatgcatggaaatcacagcattttcaaccaatcaggtatttaggcgaggaatccaagcaatttgaaatttaaaatttgaccactgagcttactgaaagaaaaaaaaattccccttacatcttaaaatttgcaaaacaacgtaaaaatccttatactaaggaacagatagagtaaagtgaaaggccggatcagagattaactaaccttctcactgagaacttcctgaatgagcgaggcgtccttggagatgctgttgatgatctccgaggtggtggcctcctgcgagtcgaagaagcccacctcctgccgcagtatggcctgcaggtacaggtacctgatcctcagcacctgcctctcgctcgtcctgctccagcaatacccctctgcaaaaacaaattaagccacatgatttaggtaaatgcatccgtacgtgtgattaattagcaggcagtaagtgatgttcttttctttttttttacccataaacgccactgccagcaccgcgaacgccaggtacacgaaattcaggcaagactgcacgcacaggacgtcaaaaaaagaaagagcagcaaaaagttagacagaaatgttgctcgatcgggcgagtgtacaaatatacatgcatgcgtgtgtgttctgtgcagacaaggtgatcgacgaattcactagaccgcgagtgtgactgtgtgacaacgaaccttctcgacctcgcgcatgaagtccacgccggtggcggcggcggcgccgccgtgggcgccggcgcgcgcgtacccgagcgagttcatcacgtcgctggcgaagatgaggagcaggttggtcgagcacccgtcgccgatggcacccagcgtgcccagcgccatgagcagcacgtccacccggtccgcgaacttgaacatgccacggaggctccgccgctcgccgccgccgccggtggtcgccgcggcactcatcctccttaatggtgcactcgggtagagagcgagagcgagagcgagatcgaggcaggttgaattgagaggagaattcgaagaagcagcaactacggatcacttgatttgtgctgctgctgctgcggcaatggcctttggcactctatgctaggggtttatatagtagtaacatatcactaacacacgcatgcttttttttttcttctccttgtcttgttggctttgcatgcatgatgagggtgcacactgcatcacattgcaacataagggtcgatgatgagttggaattcaaagcatgtgaccaaagttgagaggcaactagagatgccattggcttggccagtgaggcggctgatgactttgtttatgcgtataatattaacagcggtttttttaacttttaattttccattatgtgctccgtaatgctttgttagtagatatatgtgtaccttatctttaatcatgttagacttttgatgccaattggagctagcggccggtggtgtggtagtgtttttggctggtttttgtctatgataaaagtacagggttggtaactgatcagttaattagtgacgttgctttttgggaggtaaagttgacaagacaaaggagctgtgttttcaaccctatctattatttaattcctcggtgatttataattagtgtaacatatatacttcaattattgaccagttaggatatttttcttctgctactcctaaatgttaaattcattttctattcattatcactgatgtacaacttgagatcaaataatcattctaatacatcattttctacattctgtttctgcctactaaaaagtaaaaacatttgacttcttaaattttatattgctgtttatatctcatgggaagtatgctaaataccagattaaattttgtatatatatgttaggagatttatggaaaaacctaaaaatgtttgaccactaacacggaatttttggagattagtgtttgattgcacataattttaatctgcacaacttatactaaccttcaaagcatatacatgcatcatgcacacttaccatgaatgaagtgttgcgtgcagatagcttatcatttgcaagtgatgctgccgctaatcgagtagactaatcaagaaaagatagcgctagctagcttgtcatttggaaatagcaatgtaatcatgccggtcatcgagtagactaatcacaaaagggtgggacgtaaaagctagcacaaaatcttattgaaagcactttatgtttacaaaaataattttacttagctttaaacaatatttgcttctttacccaacccactgatgaattctccgatagcttgtagctgcaagtttcaacatgtacatgatgtacatcgaaagcaactggtatatagcttctttgtttgctagggcattagaaatgacggtggtctaagtcagtactacacatgtctattcatattatacgtccctgatgtctgaatttctgaatacacactagactggtcagtcaatctgaatcaatttcttctcactccagacacacaaaaacaatcccatgctaccacgttgctagatcgccaggaatcttagtgaagatgatgtgtccagttttatattttaggtacagtaaactttcgcagccatgcatgattaaaatagcaacgtgttagtatgttagtttgtcttctggattgcttaaggaatcaggacatagttatgcattaattattggctacattcactagctaatactgctagaggatgcagcttcaaggaagggtatgtagctgcattaagaaattaaaaccgtgtacactgtacaacactatggtctccagatgtcactggtcaaattatcaactactagtatgttctaatcacttaggctgtaggagtaataataacaagtaaactatactcttcgatgatttgcacgtgctgatttgtttattccatgataggatcagctgggtctccatgtaaatcaactaatcaagtggtagactggtagctagcattgctgaacttgcttccactgagaagagcctctgttcatggcttttttgtccgaccaaggtccaaattgtttataaacaaattgcatctggattcgacaggtgctcatcataattcatgacaacatgtagaagcacgcaaacgaagggcatatatcttcatcaaaagaattgttgagcctccaattgcacaaaagctaaccatttcattattctcatgttgttctttgttttgtcgtgtttttttagaacattgttttgtcgtgttaccaatcatctatctattcatctttgttatgaatattgttttgtacgagtgggtaacctgacaaataatatactactagatgatatatgctacaaagttttcaagccgtacaatcttcttttatctcactgtagatcgaaatgaaataaatgaggctacttttgtagtaaagattttttgaggatggtactaaaataatgcccatttaagagcatgagtacaatctaatgctaaacctattacgacgtgcacatgcagactacacaaagaaccatgctccctgcttccctgggttcaattgagcatgtgccataattaaactgaccgtagtttactttgtaatttatgcacatgcatactctagtccacaactagataccatgtacttaatcttttaaaaacgtcaaatttaatcaaattgttcatcatagactcgtcaatatatagctatatatttcgactcgtcaatatatagctatatatttctgcagagtgcaactgtgcaagtctataattctatataatgatggactgtaatagtacatggtggtaagtccgtttgacacatgcattctgtcaattggcatgataacctaattaaccacgtacaagaaagcaagaataagcaccatatatcacctcttggctattggaaataggttagtgatcaactaattaggtatgttggccaccatgagctaattattttgttgttgccgttgctgttatatgttgttgttggtggtgtgtgtgtgtgagcgtgtctgaattttgcggcaatctaatgtatttcgagataggctgtacactagcaactgtgacttctctcgagcctcaaaattcaaaagcaactaacatttgacagagcaagcgtgcagtgacatgctatgttaagagaaagacttgctttagctttttgtttcttttccatattctatattcttgaaaaggactgcaaagctcttctagtatatgcaattagctgctttggaaggcacttcaaaagggatgaaggaaagaaggctgtcatatcaattactcaatcatgaccagatcatcgatctgatgcagttaaaaatttcattaattttgccagtgcatccttcgaattaaagaagctacgaggtcgtggttcacatgcttaggtttttatcatatcatctatttactaatcgcattctttggataagaatttagtaatcaattacacgcatgctccgagatttgctaccgccatttttaatttacgaaaaagtctcaatgctgcccttacactataatcgaaagtccatcgatctagcaccattaacttttataccggacattcaacccctcaagccatacaatatcattcctccaacaccgtaagatggttttgaaaagtggtttttattaaatttgaatatatattggatgagttttactaggtggcgtattatttgtacatatatttattgaaatgtctacctaaaccttccatttttttacctttttaaaaattgaggatattattctagcatgacaaattaatatagagtataaattgatgactgatgattgacgatatataaacatgctataagagtaattataatcgcccatttaagtttcctaatatgtaaaaccaccgtccaaaatcacctgaggacgtaatacagtattgtaaagtttagagaattaaacatcggcttttaaagttagcgtgctagataaactttcagtcaaaatttaggggggctatataggcaattttccctttaatatatgaaacttttagttatgcatttgacaatttgtcttattatttttttcaaatatgaaaaaaaatatatcatgctt

SEQ ID NO: 72942 - DNA, 630 bp, Oryza sativa
gtagccgatctggactccagccgattcctgctctgtttccgaactcgatctccgcctccgacttcgctttgatcaaatcttctttcctgacacaaatgttaccaaatttggtcgttaacacatgccccccaagtccgggatatttgataatgttctggatttgccatgtaccggctccgagcaagtttcgcactccgccgcttttgactgttattccagcactttaaatactaaccgttaccccgagaaatctcacgccgtgacttccgttttcaccgctcaagcgaaacctcttctctctcttctccggtgattcccccggtgcaaaggcgatttctaggcgacttcctcctcaacgagatctccgcccgcaccaatgtcgtcttctgccagcccatctggtgcgctatcagccgaatacactgaggtaagttctcatcggctaaatccccttccttagcagcagatcgattttctcctacctcatattgctttccttctcttggttgcctcggatttgtagcatatttcccaccaagtcgcaattcccagtctgacgcatgaaaaccactactttctcggcccaatcggcaatcctgaccccaccgagttcattattggtgaaattaa

SEQ ID NO: 72943 - DNA, 5271 bp, Oryza sativa
cgaggcctaccgctgtggctaagcggcggcgtgtgccagcccaacccccgacgacgacgacgcgtggcgacggccgccgcgacacccgccgccacgtcgccccgccacgcgccgccccccggcgagctcctcctcctcttttataatcccagcctcgtctcccccgcgatgaccacccccctcgccgcgccacgtacgccgcatcgcatgcgcgcgctttccctcgccagagcaagtagcccgccgcctcttcttcttcacctccgacgagcccttgcacccgcgtcgtcgtcttctccggcgccggtgctgttgctgcgtcctgcggtttcttgttcttctttgtttgttagcgacagggcggcggcggctcgccggagcagcggcagcagcaggagaagcatggcgtcgcagcagttcccgccgcagaatcaggagacgcagccggggaaggagcacgccatggatccccgccccgaggccatcatccagagctacaagccagccaacaagctgaaggtcagtttactacttgatttgctgttcttctccgttcatgtcacgttcatgtcgtcgttcgtcggtgcaggacaaggtggcgatcgtgaccggcggcgactccggcatcgggcgggcggtgtgcctgtgcttcgcgctggagggcgcgacggtggcgttcacgtacgtgaaggggcaggaggagaaggacgcggaggagacgctccgcgcgctgcgcgacatcagggcgcgcaccggcgccaaggaccccatggcgatccccgccgacctcgggtacgacgacaactgccgcaaggtggtcgacgaggtcgccggcgcgtacggcggcgccatcgacatcctcgtcaacaacgccgccgagcagtacgagcgcccctccatcaccgacatcaccgaggacgacctggaacgcgtgttccgcaccaacatcttctcctacttcttcatgtcgaagcacgccgtgaagcggatgcgcgatcgccgcggcggcgccggcgccggcgggtgcagcatcatcaacacgtcgtcgatcaacgcgtacaaggggaacaagacgctgctggactacacggcgaccaagggcgccatcgtggcgttcacgagggcgctggcgctgcagctggcggaggaggggatccgggtgaacggcgtcgcgccggggccgatctggacgccgctgatcccggcgtcgttcgcggaggagaaggtgaggcagttcggctcccaggtgcccatgggccgcgccggccagccgtcggaggtggcgcccagcttcgtcttcctcgccagcgacgacgcctcctacatgtccggccagatgctgcacgtcaacggcggcgtcatcgtcaacggctagtttttcacttgtcccatctcgccgccggcgggcgagctcgccgtcgccggccgccgtgtctgtcttggcttttgctgtgggcatgtgcccacgtgtttgcagtgcgagtccaccacgtgtcagtcagtagtagcttgtgatcctgtgatactgtgatgagtagagttgcagttgttgtctgtgtactaagcttgcaactcaatctgcaaggaagaagatgaataaaaacgtcccatctcatcgctacctgtgatcttgcatttccttcctattttacacaaacttgatttgtactctaaaaaccctcacaaaaaaaggtgattaaatttatcctatttaagaaaatttcgcagcagtttcatggcaagtataaataaataatggtaatgtttgccacttaaatgttctacaagtgattttcctacaaaattgttattattaccaaaattgttctctcaataaaaatttgtcaaattgttaccaaaatacgtacttctctggatataattcgtccaaattcttgacttgaaatatattcatttactggcccagctggcgaattaaggccgtgtaatattgggccgattcagcattgaatcttgtattttgggccggtcttgtagtttcatctgggccatggaattaataaagagctaattaatcacgccgctttattacaaatacggatataaaaatacaaatcaaacggaagatcaaccgcatctctcgggtgtttcggtttccaaagcaggaggaaaccctagccgccagcctttaaatctaagagcaaaacctctcgccgatttgttcttcatttggcattgtcgtcgaaggagttcgttcgagtaggtgagtacctatgttttgtgttgatttctttggtttgttgttgatttattcaccttggttttgatttctttcggatgatgatttcctatatctatagttggcttggatctaatttatctagttttgagtgattttggtttttacaagatgaatacgtctggcctttgtaccaaagactgatttgttattcggaatctccaattgttggtgttgctttcttatgtagatatattgatttatcttcataggatcattgttttgtctttttatgttttctacgtaaaattttatacactttagataagattcaccaattttgaaagatcttcagatatattttccaaagctgatttgtctcgagccatcttattgggccacatggcggtgttaaattttgagataaatctaagaaaattatgcatcttattgggccacatggcggtgttaaattttgagataaatctaaagaaattatgcataagagaaaataaccaaaaggaaaagacacaaatccaatttctagatatttcccaatgagccacatggcagtgttaaattttgagataaatctaaggaattatgcataagagaaaataaaccaaaagaaaagaaaagacgcaaatctaatttctagagacttcccaatgatctatcatctttgagataaatccaatttctagatacttcccaatgatctatcctctttgagataaatctagagaatatccataataaaagaaattgagaaggaaacaaaaggcataaccgggaagcaaaccattccatactaaaagagaagcaaacaaaaggcataacattccatactaaaagaaattccatactaaaagaaatatcgagaagcaaacaaaaggcaaaacattctgattctatctcattatacattattatgatacattattcggacaaaaggcaaaacattcggattctatctcatgatacattcggattctatctcataatggttggattctatctcataatggatggtttcgtgccagctgattggctgctctcaacatcatttagttgagcgacacgtggcgagatacaagctcgaaaagagcgccagttaagaaaccctctataaaactagccaacgtgattgaaaaacgatggaagagtcgctccattaggttattaattctatctcatgatacattattcgaacaaaaggcaaaacattcggattctatctcatgatacattcggattctatctcataatggttggattctatctcataatggttggtttcagaggttggtttcatgccagctgattggctgctctcaacatcatttagttgagcgacacgtggcgagatacaagctcgaaaagagcgccggttaagaaaccctcactataaaactagccaacgtgattgaaaaacaatggaagagtcgctccattaggttattaatgaaaacggatggttgagatttcttatatgcatacattgatttatgataataggattattgttttgtgtttgtatgtgctaaaaaccaactttcttacaacgattttgctatatctcactcgaaagatttttttttctttatctctcactcgattttcttactcaaatttagagtgtattttcttgtaagttacagcataatttatgaaacttacattgcaacttttgtaagttaacagtgcaatttttgaatcttcgcatgtaagttttgaaatttagattggatttatggtgtttcttagttgctttttgccttttaccgtgtctattagatttaaattcaaagattaaaaaactgtgtgatatgatcaaaagatgcatagatactaattagaggtttattcgaggatgaaattttatcccgtaaccggtgcggggtgcgtactaccaccactacgtaccacaatttctcctttgctatgtaaaattctatactttagataagattaaccaaattttaaagattaaatcattaaatttgtatcaaaataaatttataaaatataataatattatgattaaattcgtcttatccatattcataggatatagagcatttagtaccgatgctagattcatcctttttggcctatcactactattgaatttgcacataatagccatacaacatatatatcaatatatatgatatcatactatatcatacgagagtcagtgtcggtcttggatttattgcctaaaagggtgtaggaaaaagtgccggtcttagatttattgcctaaaagggtgtaagagaaagagagaaacaaaatgggcacctgacgcctaattttcctaaatgttgttgcccgatattatccatgtaaaaggttgccatacatacctttatgaggctccaactttttgcagtgaagaacaacgtatcaagactttatgtacggtccaattcttcacagtgaagaacaacccagagaagaggaggagttcacagtacagaacaacccagataagaggaggacttcacagtacataacaagccagagaagagtacagaacaacctagagaagaggatggactaactctttatagtgaagaacaacccagaagagaagatgatggactttatctacgggtcgactttatcaacggatccaactcttcatagtgaagaacaacccgggtccaactcttcgtagtgaagaacaacccagagaagaggaggtacctattggctctattggcgtgtacatcaaatccctgatccctgatgtctcaaactcctagtttatgcatacgcaagcaataatgctctagctagtttctcaggaagattgtggagaaagagagacaaaatgacaaagccagtttctcgggaagattgtggagaaagagagagacaaagtttctcgggaagattgtgaagaaagagagagacacaatggtgtaggagagggtgggaagattatggagagggtgtttctcggaaagattgtggagaaagagagagacaaaatggtgtaggagagggtgggaagattatggagaaagagagttagggaaggggatgaaaattggagagtgtgg

SEQ ID NO: 72944 - DNA, 25194 bp, Oryza sativa
ttattgttgttcggtcggatgggggccttggtaaatctgtccataacattttttaaagttaaataaaaatgttgttcgaggcatctgtatataattcacggtggaataagaagcaaagcatgcaaggcttatggagccttaaagttagcaaacgcctttggttatttcttttctcgttgaagattagttattaatgaggctgggttgtgctttcttaaaagcagggctccaggccttttctcttaaaaaggaaaagaaaaagattgtctccttaacggcaccttgcttgcttacagtccgaggtactattctaaatagcttgcgaggaacaaaagatctactgggcatgcagcttgccggaaaaaaaattaagatagagattaaagattttctcttagtcacttcggtgatcaagttttaaatcgtttagatttccttccaagcaactcattggccaaagatatatagtttttcgtacattgatatcaatgctccaaaaattttatatcgtggtacaaattttaaatacaaaaaatacaaaatactattatgcatgagaatgacacgtggagcatagccgagcctccatatcaataaccggtactccctccatcacattttaaatgcaattgtgggtttccgtgtccgacgtttaaaataagacgaagggagtatagcacattcgatggctttttttcttccgatggtacgtaccaaagagattggcccctatatatatagtagtagattgctatcagctgacacagtcgtgtagtgtgtagcctgctagggtaattgaaagaaattacaccatggatgaatcaacatctgctttggatggtgatgagaagaggaggtcgaggaaggagagcccgctgccggaagagaagttcaacatcttcctactctgcactgctttcgtgtacagggtgatgaatggcctcgcacactggccactatctgggcgaccgtcgttctgctcggtggattctccaccctcgtcaagaagcaggatttctggtacgtcaccgtcatcgccttcgtccaatccatcgggtatgtatatatattttttcactcttccttcgatcgcttctaacttgtctgaattagacaaattttaaagtactgaccctaaagagtacttcttcagtcaaaaaaaaaaaaaaagctcaacctactttaaaatttgtacgaatctaggttgagtcttttttaggacggaaggaatacgtactttaagattgaaatagcacatcaattttttttggagacatgcctccctccccctgtattgcttgaatccataatacgtgctgttttgtatttttcatcccatgctccatttgtttggtttttgtgttctttaggcctctagtggttgaaatcgttccccccacccccaattttcttcaaactgagataaagaaatattgtctataaacaccatcacagtatccaaactttattctatacaacattaagatgcagttaagttcaaaaggtccacccaacgaaaatgccaagcagtatgtttcacatgtgaattataattcatcaaaactatcgagtccaacaggaaaatattatgcagtacattacctgaattgcatagaccacacagcattgatccaatagaaaaggcggcccaagcccatcatttgacattgcatgcgcctagtggaaaaaaaatatcagaaattagcaggtgcgaaaaaaaaaggcactggtcaatgaaatgtcacaagaaactacaaagcagtgaaagcacaagccaggctagcacctgacaataaatctcggcccagaatagaagcgaaattgcgtatgtccgtgaagaatgtgagcccaggcatatctacaagaacatttttgaagtatttgcggcagaacattgctcaagatcataacttgaatgaattctagcaccaatcaaatcatcaaattagccgcaattcagaaacctctggatgtagtggcaagctgatgtgtatgtgccgttgcatagaagagtctgcaatatgacgcttgttcatttaaggcctagaaccaaaacaaggtgacttcattaggacgctgaccaccaaaatacaaagcataactaaaaaaaggtcgttacacagataatccaaactgaattagcagcttgtacagtgacaaaaaaaaaatgtccaaaccaaaagtacacagccacactagatttctgaactaaaaagaaacctagagttatataagctctgatgaatctgtgccatgctgattcaaggaaatattcaattgtagtagtatgtctgaacttttctgcaagttccatcagtaaacagggcatactaatgctgtaactagagaaacacataggactaacattacaaaaaatgttagcgattaaattcagagattgtactagttcaccactcatacactaaaaacatctagtcttacaaaagttctggatgttacaaaagttctgacgagatgcacctaatagtacagtggcaaaaggtatgtggttttcaactctaaggtcccgtgttcaatccccatcacacataatttcttcttaaaaaaagtttggagggacgtctctccctccaaatctccttttcttttttttttccaaaattctgactaaaaatcatgtgatttgctccggtgaggtactggtatttcacgataccaaatcgtttccgttcattatctcaaaaatcatttctaggcttacaagcttctgtatgaaatgaaatatctaaccaaaaagaatggagcttcaatgattatgaaaaaaaaatcattgatcatgcaacacgatgcatcgcacaatctatgatgggctgattttaagagtaaattaccctgtcaccatcactgattttaagagtaatttactcttaaaatcagcacatcataggaaacaaactcttgattgccatagttttgatagttaccctgtgatggtgataaaatccatgaacacagtgatcacaatgacatgcagtgctttgctgctcagtttcacaattagtttgccaaatcactcctgtcaagcattggaatggaaacttagaattcacaactacgcacaagacacagaaacatagcataaaagtaaagggtgatggcatccataaaaaaacaacccaggatcgatgcctttcttcgatgcgaatggcaactgcaggtagtctaaggctttccagactcagcaccacattaccaatattatttcctccacagaacatatacaactaaaaaactaaatcaccgtgtgagagacaacaaataaccacaaaaaaaaagtgcaaatgtgatcatcaactctaagaaaattagctagtcattagtacaaacacaaatcatcatcatgttcagagaaaatctgaaaagttcttttgaaaaaagaagctctagatacataaacatgacagcaaaaaaacagcacattccaatcgacttgttaacttgtagaggcccccattcacttgtaggtatcgttagctcaaaagctgaaaatattactcagtaaattcaagtctagaaacagagaatgccagctccttgaaacaaaatttagaaaatctgaaatttctaagcaaacaaatggatatataatgtgcctattcagagacttgaacatctaggcatggtactgaatgcttcgtaaaagagaacttttaaaatttacattgctattagtaaatggaggtaaaatgaaattgttatcagtgaaattaacctcagagaagtcatccgaactaagtactataattgaacttaaataaaacactgcagtattcacatatgttacaaaaagaccatgctgtcaatcacacatgtattcagacagaacagaactagcagagtacacaagtgccaactctcaattatataccactcacaacctcactgatagcacaactaaacaccactagacaaacatatattggaaaaaatgcatatccgagaaaaaagtaagcttcatctaaataggaaaattggatgtgtacatccttttcacggatgttgaggccaggttttttaatccattatctaaaaaaatataaataggaacaaactaaatacataaatatgacatgaacaaaaccaaaagataaccacctatatgctttatgggtgaactccattggtcattatgtcacatagtaaaaacaaaatcaaagatcaacaaacataatgttgattatttgatgaaacaatatgtcttttggagcacatttgaataaaagggcatacatgtcatagagtagtactgactgagtcagatagttcagtatgaaaaatgtaaatatgtacagccaataacaaagaaagccatgttcacaggacaaagcaaattaagagatggatttctagccttctagattcttaccaaattctaacaaaacctcgggaattgcaagttcagacctacaaacagataatgccgcctttaaagttctgcatgcagtgaaatatcaaacataacaatatggtaggttgaaacaactaaattaatggaaactacatacaaaatggtaggcgaaattaatgaaaccatgcatacaaaactaacaaataatacttatatgctaatctatatcctcaaaccaagaattagctaactatgaactagcatataatacttgtatgctaatttatacataacttaaaaaactaggtactatctgctttctctatcaaaaatcaacccagggcttttacttgcagaaattatctagatgattgaagtttcctaacaaaactactcatgttccatgtgaacaaaacaattctaatttcctaaacaaaactgtccatgttcaatgtgaacaaaacatagtatacatagttgcttgttttgaaaaaaaattaaggacgaatgagaaagactgtaacaccttaaatgagagacatggggagagtggaaaggtggtttgggggcgggggtgggggggggggtaataaagtgagaaatttgaatgagagttgattggttggacaacaagtactctagaattccttacattgtaggacaaaattcaaatgcttggatcccttatattacgggatggaggcagtagatatcgagaatgcatataatattgcttctcatttaaggaaaggatattgctcaagtaaactgacacaggagatttctctgaacattcttaactaataaaagatatgttatcaagtaaaattgtcaattgatacaaaactagagcaaaatatatagtttccctagacaaaaaggagaccaacatgattttgctaaaaggagttatgagtaactggagcaaaatgtccttgtactatacaaaatatgaaactaaagttagactaaacttatcaaaatatgaaactgaaacttgtactgtacaaactaaatcatttttgtatcaaaatttatgtaaatttatccgctatgaatgatttgtacaatttaaaatattgttcatataaaaaatgtatataactttttccgctggaaattatataacttttatatcactatcggttcttgagaagaaccggtagggatttcaatggttctccttatgattaaaaccggtagtgatattatgggttcttcctatgaactggtagcttaagaaaggtcgggatgactcttttcctaacagtgatagtgatatgtgaagctcacagaagtatacattgcaatgcattgacaggattttgggtggttacgaggatcctgcacatcaaattttcttgcacgcaccagaagcactaataaagaacagggaggccgaagcttgggagcgacgaaagagttggtggaggcgcagaggaacacagcagcagcagcaacaacaacccagaggaaggcccagaagaagaaaacaagaggagaaagcacggaagtggtgcgacgacatctatgggttccaagccttccttgggattgccatctacgtcgccatgtggttgggcaaggtcgccgctgtggccacctgcatagctctatcctcgaagcgtctcgagaagcaagactatctggaatccggggacaatgagaaaggtgaccaccagaacatcaggtggtccctcaatatcttctacagtctggtgcttgcccagggaatcatcttcatctgcatgctactgaacccactgactgtttattttgtgcttaaggtccgaaggaagtacaagctatttgagccctctggtctcaagataatctaccgttacaagaagtacaattacctggggttcattgctggcaatgtacgtgccaccctcaacatgcacctggtcacctttgccaagaatttggcagtgtccaacacgatcgatgaccagttagctggtgttcgggccatggaccgcatcctcatgtcagtggagtttagaagcctggcccttaggaggcttcgagcttccatggaacccgacgatttggggaagctgatcgatatgctaggcttcgtcagtaccatggaggaggaacagaatatcatcagaggccatgctgcaagagttgtgctcaaattcagtcctgaccttatgcttcagagttatcctcaaatcctctacctcatttcctcttccctgctcagcacatccaacaagagggtgtgcaagtgcaacatggactctgacttagtctggtttggcctgcacatcctggacaagctcacggacaacccagaaaattgcaggaaagccaaagacgatgacagtgatctattattgcccatgattatagacctagccaacctttgtggacatggtcatggcaacagcgtaaggagtaacactaccatttctgactcttggattgaacaagagattattcctttgcttcaaaaagaagatgatattcctcttcctttcatcaacaagattgaccaagaaattattgttggcatggcactcaacatcttgagcaagctgatcgctgtgccgggtgaggctggggaaaaactaaggaaagaaacctcaaaagacttgcacttcctgacaaacactgggatgatcatggagcatgtcgaagcaacaagagtcatatcatgcttagctgtggataaggaagcacggcaagacattggcaagttgcctgagatcatcaagaaacttaaggattgtctactttccaagacaccatatgtaaatatgacgaaagtagctgccaagttgttgcttatggagtacaccagtgaggaattattaaaccgtgttctgcttttcatcgaggaaaatcgtactgtagaagatcaaagcttttcactaccaatttcagccttcatagaagaactttatcttgatcaacttccccagagcgtggtacagagacttgatctggaagatgtactttcctcgccacgggtgaatcactctgaagcagctgctaaagcattaattctgctcactacaggatgtgaaaacaatgttgaagctttcctaaaagggatcaatgaaaaggagttgaacaagatagtgaatgtgctctcttcagaagacagagataaagaaaagagaagggcgctggcacaatttgaaggacgacatcatctggacccagaaacattgcgcatagtcaaaaaaataatcttggctgagggtgaagaacaggaaacaagtatgcatgcaaaactcctgcagaatttgcgtgcctactcaggaccaaaagaatttgatgagtacatgaaattaatagatgcagcactgccaaaggtaattttgttttaattctagccatcatctttggatgtaatctactcaacatatatattttgtatgtatgcatcagctcagaataatgcctcatcaccattttactttatcacgacaatattcattgactaagcaatatggtgacaatgatcgatatatctatctgaaaatttaattatataggtgctcaaagcagtcgtagatgcagtggcgactttggaggatccatcatcatcagaaaatctgaaccatgtaagaaaatagtagctgttttcccttacctactgactacttcatttgcacctagtctaacttcccaattcacaaaagaaacaattttctttggatatatatgtaggtaaaggatgacctgtggatcaaacaaggcaaagtactagagagctttataggcctcgcagtgcagatttgtaggtccccgaacgcaacgagtgatttctccactgcactaaaagatgccaatcttactgtgcacacattcatcaagaagcttaagaagatattagaagtctacaggtctccaagtactgattttccatgcataagggtatccacacttgagttaattacttggatggtcgaagaaaacagcagctacagggaaatactcctaaaatgtggaatatatgaggaactgaatgaagtggcaaggactgctagaaaacttgagagcttcaagctgtttcactgcggtgttgggattcctacggatggtccaattgaatgcatctcttcccgcgcaactgaattacaagaaaagcttcagcaaagccccaattttgagaaaaggtactgtttatgcccttttagttaaaacatcagttcaaacatacttagactcctcttggagaattcgtaaacccaaacttaaatgtttgcctttaatctgccaattgtcaaggactctgccatgtactcccttcgtcacaaaatataaggtattttgaccggatggggcatatcctagtactacgaatctagatagagagtccgttccagatttttagtattagaatatgtctcattcggtcaaaataccttatattttgggatggagggagtagtaaacagttcccaagttggctgtgatttcatctaaaatgacttccttacttgttcttgcagatacatctgctatggagaacatgcaagcagcatatctgttttaattgcttagaacagtcatttgcttggttctttctgaccaccaacaccatcatcatccttttgtgtttgtgccaaccaaatttcgtgtttgagtgcttgtgttttcatttgcttggttatttctgaccaccaacatcatcaccatccttttgtgtttgtgccaaccaaaattcgtgtctgagtgcttgtgttttcatttggatagtgtgtcggaatggttgtgtttttaaacccagtgtcagaattttgtgagactataataatttccatggataccatcaaatcaccatggcatgctacaaggttgtgcaagtttcttgtatgttcgtatgatttttttttctgcaaaatatccatcacaaaacaccatatcaataacctcatatcatagatgaactcaccgacattgtaactagtgtgtctaccttgtttcatatcgaccatgttcaactgcgtgtgccctaaagaatgaggcgatcaagcaaattcgcagtataatattcaagcatgatccaaacagagccgtaaagctaatccgcaccagatattccctaaaccatgattaagccaccaaataaaccaaggagaccatcaaaaagttgatttacacgcatcgcattcatagcgcgcagaaatcctcagatagattttcccctcctccgctatttagaatttcatacattaggttagattaactaactacaaccaggcacaaactttccaacccagcagcatcctccaatctagcttggaaccaaatcggtaactcgcccaaaaataaaaagggggcaaaaatgcagcgaggaggagaggatgagagagcgtacgagctagtgcaggctccatccgcccggtcgccacgctcgtcggccgtcggccaccccgctttctccgccgtcgccgtcgccgtcgccgtcgcggcgccttcccatggcttggaggaactcgagcctgctccatttggattcgccgcagtagggaggggatttgggaggcccatgggccggtctgggtgttaattagtagcaggtaaggcccactttgatttaaaggaaggaattagttcactttaggtcccttactttgtcgccgagtccaaaattcgtccctggaccgaacgcatcccccaacttactgaaaaccaatgcaaacgagagctctcttagtagtattgtcgccagttttgactgacgtagctcatttgactaggccttcgccctatgtagtattgacatgacgtttacatgttaattcgatcctggaaaataataaaaattgttgggccacatgttagggcctgtttggcacagctccagctccagctccacccctcctgaagctggagctcagccaaacagtttcagctccaccaaaactgggagtggagttgggtggagctctctcacaaaatgtactagagttgtggagctgagtttaggcagctccacaactccactccagactcaactcctggagttatatttaggagttggagctgtaccaaacaggcccttagttacacacatagaatagtaaaaatggcagggcccatgtgttagatgtgcaactatttttttttatatcctacaataaatacacgttcttgcggtgtatatctatctcaaaataaaccactctagaattggatgggacattaccccgtaaaatgaatctggataagagcatgtccaaattcattgtatgaggtaacatcccgtctaattttagattgatttattttacaatggaggagtaaataaaagtccgagttgtgagccgctgaatggaatagttccatttcttagatgacaccctaatgatgtgctcctaacagctaattctcgctgtttggttggatggggaccgtggtaaatctgtccatattttctttatttttaaaagaaaagaaaaaaaaaaggcgtggaggcacctgcatatatcacgtcggaataagaactaaagcatgcaaggcttatggaaggcttaaagttaccaaactcctttggttatttctttaattttatcgttgaagatttaatgtctctgtatgtgtgctttattaaaagcagggctcttcggtcttttcttaaaagcaaaaaaaaatgtctgtctgtctccttgacaacaccttgctttcatattgtttttggtatattttttttacaattacacggtaaattcacacacgcacacaccactacacacgtaacaccatattcacacatccgtgaccgtgaatggggcttctaacacacgttcaaaaagaataaaaccaactatacatccctaacctcactaattaagtttccgctgaaaacacatgtttaaagagaatacacatcgatgatctaattaacggtcccattgtttcacttattcgtgaaataagccaaacgatagatttgtaagcgaaatgtaatctgtgaataaaatttttatatacgtgcttttagcgatctaaaagaaaaggctgaaaaataaacttcaataaaaaaaactttaaaatcagcttcaattttaaggttgaaaatttaaattttggctgataagtataagcgaaaagatgaggtctttcacgaccattgcatacgtttacgagcactgggaataaatatcaggatttaaattcagacgggttaaatcatacacccacaatttcatgaccgtaccacttgtgtttccttgttcctaggaactactccctccatattttaatatatgacaccgttgatttttcaaacaacgtttgatcattcgtcttattcaaatttttttgcaaatataaaaatatttatgttatacttaaagaatatttgatgataaattaagccacaataaaataaatgataattacattattttttgaataagatgaatggtcaaatgttgattaaaaagttaacggcgtcatacatattttaatatggagggagtacttattattctaaatagcttgtaagaaacaaaagatcgcctggccaagctttcattgccttaaaaaggctagcgacacacaaaactactggccattagtgcaacacaaacactgtgcctagtttagggtaatagccatagccaacgtacgatcgacgaccaatatggattcatctgctgcggatggtgagacgaaggaggagtcgtcgaaagtgaagatgttgctgccggaagatttcctcaacaccgtcctcctctgcactgctttcttgtacaaggcgatgaataccatcggcacgctggccaccatctgggcgaccgtcgtcctgctcggtggattctccaccctcatcaagaaggaggacttttggtacgtcaccgtcatcgccttcgtccaatccatcgggtaagcaccctaagatcctaagttaataggagcgaatttcagattgggttatttaacggctaagtccctagttggatatagaggccgggtaaaaaaaacccttctcttaaaaaaagtataattaattaagtacatcctcctccggagtattagcttgaataaaccaactttaatttcggtttagaatactggttaagcagtaattactccttccgttctttttttatttgacactgttaattaatattccctccatttcaaaatgtttgacaccgttgactttttagcacatgtttgatcattcgtcttattcaaaataatttgtgaaatatgtaaaactatatgtgtacatgaaagtatatttaacaatgaatcaaatgatatgaaaagaataaataattattttttgaataaaacgaatggtcaaatacatactgaaaagtcaacggtgtaaaatattttgaaacgaagggagggagtatataactagtgggatgactttatctcaatttgaccagtgggaacttttagttatgatgttttgatgaacttattagagatagtataatattatatctaagcatgtaaagtatactttgataatacatctttttaagtatatttcttaaaaaagtaagatgatcaatcaaagtttgtatattattaaactagcttataaaactctgtaacaaggtaaagggcaaaggagcgacgcaactaccaataggtgcccgatttttagaaaaaaaaatctgacactccgctcctctcctactagcctatgcgtcgtgactgtactatatctactgtttctactccagtaaattagcacatgtaagaaacctatatgcttgtgcacgcatggctgtatggttgtagcccttatctcaaccatacttttcatttctttaaatattttttcttctaaattaattatccgattttcaccattaaacttgttgcagttaaatctttataacaagatctcatacggttgtattttgatatggaaaatcaagcgttgtttcaccacttatagaaaattattttaccgtttgctaaatattccaactcactctataaaatgattcagagaaatatagcattcaaaaaatactaactgcaatacgaacaaccattatataaaacattgattctcgtgagacataaaaaatatataaaagatacaatatatttgtaaatatgtactattattaaaatatttttataacattgtataaaacattaagttgttacttttgacacattataaaatactaattggaacattcaaataacaacacgtgcaacatttacaaattaaatagcgaagcatagtataaatgctagttgaaacatttatataaaaccatgtgtaacatttaaaataataaaaaaagctaaaaaatcattggaatatagctacgtgtaatcttgttgtaaacatttaattgcaataaatttaatggtatgaccagattgtagattggagaagtaatttagggaaaaaatcatttaaatatatagagatgtatgcgtgcatggttagataagagcaaggataatagtaggctataagtaagctatatgcttatgtggaagagagagataaacaaaagtggggagtgttggctctcatgcaagagctaactgcacacaaactccaagaaatatgcattaaattcatggtgagagaaagagagaggatgaagaaaataaagataaccttatagccaatctactatatatgttagctttaatattgactaatagtaaatagtgagctctattattaaacttgctctaaagtgatatgcatggaggcaataaagtggacatgattatgcgcgtgatgatgagaatccgatattttgctagagcgtcaggcatccgacgcagagcattctcggaaaacaaggggtatataacacacgagaaactttttccgtttccatatcgaggccaatccagatgatgaggcttctctcactaacctcgttcagtttacggttatatcattaaattaatactatagttatgtcattgacatgtgggtcatagtaaaataagacgtacccacgtatcactaacacacggttagtgactccactgcaatctgcacaaagttactagatattcactttcgaccaatccatgtgacagtaaaagtcatagagaaagtgggatattggatcatggtacatccgttcagacgtctcgtgtcagtgacatgtggggttttcttggatcacatgtgggttaggagggtaagcctgtgtttagttcagtttaagcttccaaaaattccgtaacatcaaatatttaaacacatacatgaagcattaaatttggacgaaaaaaaaccaattacagtttgcatgtaaattacgagacgaatattttgagcctaattacgccatgatttgacaatatgatgctacagtaaacatttgctaatgacagattaattagacttaatagattcgtctcgcagtttataggcgaaatctataatttattttgttattagtctacatttaatactttaaatgttgtccgtatacttcaaaattttttctgaaaagtaactaaacacggcctaaatcctcaatttcaatccaataaatagagggtatatgatcaaattttgctataaaacccaacgatgtacaatgtttttttatgagatctcataaacattcgacgggcaaaagcgaagtagcacatataccaattgagattctcattgatgcaatgcaagtatattccaaacagcaaattatagtttaagctccttctcgacattgaattagctttatgttccatctcaacatcgaattatccaaactctgtatctatataaacttgtcctgcattttgatcaccatctccgctgctatcaccgtcgatcactgtaatcgttctcacggttagctgcacgggagtttgcagtactgactcgtcatcttctgatcctgaccatgctgatctcttctgttccatggcaaactgaggatgtccctagtccctacgtgcataaagagaaaatagatcagcaaatttacatgaaagtttctggaaatataggttggagaggctaaacacaatgaaagtagagggcaaaagctaaatataacaaggaaaatgtactgttagctatgttggtaaagaaaaaaaaatgtgtacaggctatgtaaaaatgagctataaaaatgttatagctaattttaacagaactcatgcatcttatataacgagtttgatcacaattaggcaataataggcatcacataatctatgctacttaaaaaatgcttgcgatgattatggataataatggatagatatatattctgtcaggagcaagaagattccctaaattttttcgcgaacgctagattccctaaatttaattgatccaccaatctttctaattcatttgtgggactggtcaaacaaaggaagccacattagcttctggataaacgttaaatttgctgacagaaactaattccaacttcgaataaaaaaggattagaaaaataatggaaactggcagctggcaagtgttgcaaggataatccaccaattaaataaacttgaagtcagttcatgcctgaactgagaagctaattagaccctatttattcctgcttctttgcaaattcagaatatacaaagatacctgaactgagcagcaggtagccgctcgctcggataatgcccgatctccatatatagctctcctctcccactccccgttgggcagcagggagttgcatggctgtaacatcaccttacctgtgtccctcgtgcaccattgccactgctttcggagtcggaggcaaggcaccctgcaacacaacagcaattttttagtcttatataaaggtagctagcttattggaaactgtgtgagtaaaacaaactctcatctatccagcctagctgaatccagacaattatttccggcacatgaattcattgtcatgccttattgttcctgtaatggaatacttcctccgtttcacaatgtaagtcattctagcattaacatcaatatgaatatgggaaatgttagaatgacttacattgtgaaacggagggagtatatggcatgagttttaaaactaataatttcagtactacttgtaacagagctagaaagagcatatacaaagcacgcaatgcagtagatcgatccacatgttcatgtgttgatgctacacaattgcacaagcagctatctaaattttggtagagtcatcttccgaaagaaacaaagaatcctctgaacccctagataattagtaatttaaaaagtggaaagcccaaaaggatgaaacaacatcgtcaagcgaactgcagaagacttcgcagcacatggtgggatggcagttgactgcatggtgatggacttcgatcatgagcgttagcacccccaaagattccctctacaatattataaatctaatcttgcaactctaatcagccgctgaagcaattagggaaatataactcatgttgtgatgccaaaaccactgaaacaaaatttcaagtgtattgcaatgccattggttgacgctagcaccatcagacatcaacacacaaactgtaaaagatgttgataatttccattttcgaataaattgatcgtttccccaaaatttaatgccgagaaatgtgaatgtcctgcatgccttgtgattgcttctcctgcatgtatagatggccaaaaggcctgggcccgacggcccggcccacagcacgggtttggcccggcccaggcacggcacgacccgactagtgtagagcccatgcctaggcctctgcctcggtacggaaggccggccggtgggctttcgtgccttggagccggcccagcacggcctgagtcttattaggccgtgcctgggccattgatgcagcccgtgggcgggcacggttcagcccggctgtaggtcgggtcgtgtcggcccgactgatctcgggcccaggcctggtcgtgctcgggccgagcggcccatttcactcactaatagctcttttcactcactaatcagcaaacctaaaaaatacatactagcactaatgtacagcattctcgagatgttcaacttgttaaaaaaaacttaaccaagtctatcactatgtcacgtggccaaaaccacctataaaaacacactatggggttatttgaacatgtttctatatttcaagggatagaataccctgtttcctactttatggggttaagtagaccaacattaatacttcaggggataaagtagaacttttcctagatagatttatacaaattaaaatattgtttatacaaaaggtttttattcaccgaaaaattgtatcacttttatatcactgtcaccagggttcttgagaaaataaaagcagtcagtacgtatttcagtggttttcctataaaacccggcagatagtgacattgcgggttctttgtatgaattggtagtttaatattaagaagggctaggatgactctttttgtagtagtgttatatgaagctcaccgcagtacaattcattgacaggtttttgggtggttacgaggatcctgcacagcaaattttcctgcgcgcaccagaagcactaatgaagtacaaaaggacctcaactttgaagggattaagttggtggaggcgcagaggaacacagcagcagcagcaagaacccacaagaaggaccagaggaggaagaaggcacaaagaggagaaaatatggtacctgtgcagcatctatgggtgccaagccttgctcgggatgaccatccttgccgccgtgtggttggccagggtggccgctgtggtcactgtcttagccctatcctggaagcgtctcaagaagcaagactacttgaatcccggggacatcatgaatgaccaaaaccagaacatcacgtggtccctcaacatcttctacagcttggtgtttgcccagggaatcatgttcgtcaccatactgctcaacccactgagctattattttctgttcaatgccgggatcaagtacaaactatttgacccctccggtctcaagataattttgaattacaagaggtgcaattacctggaattcattgccgggaatgtgaaagcaaccttgcaaatgcacctggtcaccttcgccaagaaactagcggtatccaacatggccgatgacaagttacttggtgtcggtgccatggaccgcatcctcaggtcgatggagttcagaagcctagctcttaggaagcttcgagctttcatggaacccgacgagctggggaagctggttaacatgctaggttacgacaagagccacaaaaacaagaccacggaggaggaggatatcagaggccataccgcaagagtggtgctgaaacttagtccagatcttctggttcagagttatcctcagatcctctatgccatatcttcttccctgctcagcacatccaagtccaacaacaagagggtgtgcaagtgcaacatggattctgacttggtctggtttggcctgcgtatcctagacaagctcacggacaacccagaaaactgtaggaaagccaccaacgacgagagcggtggtgatctattgtccaccatcatagacctcaccatcccatgttgtcatggtcatggtcatggccgcagcatgaggagtaacactagtaccatttctgattcttggattgaacaggagattatccctttgcttcaaacagaaaacgagattcctcttcctttcatcgacaagcttgaccaagaaattattgttggcatggcactcaacatcttgagcaagctggtcgctgcaccggatgaggctggggagaaactcagaaaagaaacatcaaagcatgtgcatttcctgaccaacactgggatgatcttggaccatgtccaggcaacaagagtcatatcatgcttagcagtggataaggaaggccgagaatatatcggcaagtttcctgagatcatcaagaaacttaaggattgtctactttccaagacaccatacgtaaatataactaaagtagctgccaagctgttggttctggagtgcactggtgatgagcaattgttaaaccaaatccagcttttcattgaggaaaatcgtaccgtggaagatcaaagcttttcactaccaatttcagccttcattgaagaacttgattttgatcaacttcaccagccatggatatggaattttgtacagagccttgatgtggaagatgcacttttcgcgccacgggtgaatcactctgacgcagctgctaaagcattaattttgctcaccacagaatgtgcgagcaatgttgaagctttcctacaagggatcaataaagaagagttgaacaagatagtgaatgcactctcttctgaagatggagacaaagagaagagaagggcgctggcacaatttgaaggacgacgtaatctggacccagaaacattgcgcagagtcaaaaaaataatattggctgagggtgaagaacaggcaacaggtatgcatgcaaaactcctgcagaatttgcgtgcctattcaggaccaaaagaatttgatgagtacatgaaattgatagatgcagcactgccaaaggtaatttcgttttagttctagccattctctttggatgtagtctactaaatatatatattatgtatatatgcataggctcagaattaacgcatcatcaccattttccttcaccgcaactatattcattgactaaagcaatatggtaacaacgaccaatatatctctctgaaaattgaattatataggtgctcaaagcagtcgtagatgcagtggcaactttggaggatccatcatcagcagaaaatctggaccatgtaagaaaatagtagttgttttcccttacctcctgactacttcatttgcacctagtctaacttcccaattcacaaacaattttctttggatatatatatgtaggtgaaggatgacatgtggatcaaacaaggcaaagtactagagagctttataggcctcgcagtgcagatttgtaggtccccgaacaaaagaagtgatttctccactgcactgaaatatgccaatcttactgcggacacattgatcaagaagcttaagaagatattagaagtgtacatgtctccaagtactgattttccatgcataagggtatccacacttgagttaattacttggatggtcgaagaaaacaacagctactgggaaatactcctacaatgtggagtatatgaggaactgaatgaagtggcaaggactgctagaaaacttgagagcttcaagctgtttcactgcggtatcgggattcctacggaaagaactatcgaatgcatctcttccctcgcaactaaattacaagaaaagcttaagaaaatccccgatttcgaaagaaggtattgtttttgcccttttaggcaaaatgtcagttcaaacatacttagactcctcaaggagaattcgtaaatccaaacttaaatgtttgtctttaatctgccaattgtcaagggctctgccatgtactccctccgtttcacaatgtaagtcattctagcatttcccacattcatattgatgttaatgaatctagacatatatatctatctagattcattaacaacaatatgaatgtgggaaatgttagaatgacttacattatgaaacggaggaagtagtaaacagtaaaagacttaatatgatgtgtcaaatttcccaagctggctatgatttcatctaaaatgactttcttacttgttcttacagataccgctatggagaacatgcaagccgcatatctgttttaattgcttaaaacagtcatctgcttggtactttttgaccaccaatataggcatcatctttttgtgtttgtcccaaccaaaattcatgtctgagtgcttgagttttcatttgcttggttctttctaaccaccaacattatcatcatcctttcgtgtttgtgccaaccaaaatccatgtctgagtgcttgtgttttcattgggataatgtgtcagaatggttgtgtttttaaacccagtgtaacaattttgtatgactacaataatttccccactagctgcgtcattgccccaagcgcaaagataccatcagatcaccatgggatgctacaagtgttgtgcaaggtagtgcatgtatcatgtgtttcttgtatgctcgtatgatttgtctgttaaatatgcatcacatcacactactacagaatgtcatgtccataacctcataacatagaccatatccataacctcgtaacatagaccgactcaccgctatctataaagataccatagacggtttctcaaagtggcttatgttggtacatggttcgtaactagtggcttttagggataaattaaacactaaaggcaacatggtaaataagaactgggacaacaaccctcactgtgacatctgctctgcccagcaatagaaacataagaccatattattctatgatgcaaggctgctacagtcttatgggagaaattaggacttctagacctagctaattcgtcagagtcggcctcaattttcttagaagcagttattgacagccatcacaacattcagggtatagaacccatttggtttgcagcttgtgcacacacaattttggaaagcaagaaacattaggaattttgaagggcaacaagccagactttcaaacacaactcaataaatggttcataagtagtgcgtctaccttatttcatatcgaccatatttagcacttatatgaactataggatcatatggatactataattttcaggaactccagactaccatcccaactgcgtgtgcccaaaagaagaagggtgatggcattcttttgcataaagggaaagaaccaaatgaaaaaatataaatggataatcagaagagtgacaaaaatgagaaactactacttaaataaaactgaatctttataaaagcacaggacaggagcctgtgggtaatcaaattagcttagttgcatgaagctcgtagctttttgaaaattgtatgtattcttctctaagaatcagaaaccttggccgctgactcatatcgacaatattattggttaatgaaaaaggaacaaatcaattgagacacaacatgcattacaagcgaagatgaagctttttgctactgttgtgataaagatattcgcttgaatggaatttaattggtaaggaagagcatacacaatcagattgaaatcacaatgggataaatcagaacatatataggagaggctttgctaccatgaaacaggctctctctagctcaagatctagatggaaaagatttagcgagggtttaaaggtaggtcgtaattttggtgtacctcctcccaatatagtattcaacgcattctgtaaacagatctctaaagcaaattcgcaccagatactccctaaaccagctactaatcgacctaataaaccaacgagaccatcccaaaagttgatttacacgtatcgcattcggattcatagcagaaatcctcagatggattcccactctcgcgctatttagaattcatacattaggttagattaactaactccaaccaggcacacacacaaaataataaaaaagaaaaaggcaaaaatgcagcgaggagggggagagggatggaggatgagagagcgtacgaaatcatctgattgaatcggagcgccatgcgggctccggctcgaggcagcgagctccctccgcccgccaccctcatccgccgtcggccaccccgctttctcggccgccgccgccgccaccgcgctgtcttgcgatgactcgtcctccctcccatggcgacctcgagtcttctccatttggatttttggattcgccgccatggcaccgcaatagggacggtttttcttttcctttttttttgatttgggggcgacggacttgctatggtcccgacggatttggggttgggcgaagattaaaatttgtgtgccatgtttgttactctgtcaaacggtctacttcgtatgaatactttctatacgacatatcgtcttacgtaaaaaagattaatcttgtctttatcttcagaagaaagaaacaccacctatatttgctactacagtgctatatttcatttcttttcttttgatgaggatacgtgctcagtagaggaaagaagattgcagttaagataaattttaaatgtttgaagttattgtattttgtggatttttgattatatgagaatgtggttgtgccatagccaataaaaataaggccttattcggatcggagggaaaaatgaaggacatgtgatcattcgtttcatactccctccatccaaaaaaaaagccaacttagatggggatgggacaccatctaggacaatgaatctggacatgtctagattcgttgtctcgttgttctaggtggtgacccatccgcatctaagttagctttttttaaggacagggggagtatgaagtagtcacatgaatgcccaaggaattaggaatttttcccgtgctacagattttaagtgagaaacacatgaatttttccattcactctgaacttatttttctattcatttgcgtaggatccagacaaacatgcagctaatccaaacaccttcatatgtttttcaattatctgttttgcatttatattcttatcatatttctatgtttttttatgtttctgtattttttttttcaatgatgcgttccgaataagccctctgcaagcagcaggtaacaatgggttgcaacagtcactgtcatagctgaagcctcggcgagcgacatgttcggaacggagcagaatgaatagtgtgctacctaatgattacattattcgagtagcaccttaagatcttaaatttaaccgatttggctatatctcactcgaaagatttttttcttatctcactcgattttctcactcaaatttacagggtattttcttgtaaattacagtgtaacttatgaaacttacattgtaatttttgtaagttgcagtgtaattttttaatctttgcatgtaagttttaaaatttatattggatttggtctttttcttgaagatatggtaatttattgtccattatggtgtttcttagttgctttttatcttttactgtgtctattggattttaatccaaaaattaaaaatctgtgtgatatggtcataaaaatcttttgaaagatgcataggtactcccaatttaattcttcatccgagcgaattttaaggcttagttaaagaaaaaaaaacttactaataaaggcccaccaataaaaccacgcgcgatcggaataagttcacttcgtcacccttaactgtgatcgaaatctaatccatgaccctaaaccacaaaaccagatatatcgacccccaaacttatgggcgccggcaactagcaaggagaggatggcacggaggaaggcccgcccgccgccgtcgtcgccgcctccgctcgggcctccctggcgcccatcgctatcgcctctgctcgatcctcctctggcaccaccgccgctcgagtcgggtggccgccgccgtttgggatgccccgtcgcccggcgtcgtcgcctctgctcgagccgagcggcctccgcccatgaggcgcgcggcgaggctaggtgtgcgcggcgtgttggcctcggagggtggcgcggacggcctgggccgcgcgagagcgccagaggccggctcgatctggacgccgatctggatgtcgccgcggaggaggttggcgtcgaggtcgaggctgttgcgtggcgcctggaggcctccgtcgtttgtgccgccccgtcgcccgacgccgtcacctccgctcgacctgcctctagcgccgccgccgctctaccgggtggccgccgccgtttggcctccccgttgcccggcgccatcgcccatcaccgcctgtgggagacgtaggggaagaaggggggagaga

SEQ ID NO: 72945 - DNA, 818 bp, Oryza sativa
aaatatatttcatattttttttataaaaaatacacggtttagcagtttgaaaaattggatcgtgaaaacttcggattagaagagcggttaaaataacaaacccttagtagtattaaaatgaaatttactcgaaactaaaattgaaaaccagcttttctccctccctctctcttttccttctctgtttttccttcttccgctgcagctgccgccggcgagggcgggggcggccagcatcctcgtggcacagccggaaccctagccgccggccgccggcgccgccacctccccgaaaatccgtcgccatcgatcatcctctcgcacaatcgaaggtaggagtgggttcccccatcccaatgcctctgtttctccctctccttcccccgtcctcatcgcctccggttctcgccgccgcggccgccgcccccctcgccggagccgcgccctatctcggtcgcccacctgcccgcacgtcgcgccactgttccgccgccgccgccgcctccgtccgcttcctctcgacaccctgatgctcgcccccccccctcctcgaagcctaggtcgccgccaccgcctctctcgccgccggcgcagctgaacccgtcatcggtcgtccttgaaccgggggaaaccgacgaccaacctttttttcgaaaaataaattagggtgagagaagggaaaagtgtttatcgtgctcgtcgatggtgtcgtttggaattaatgctgtaggaatatcttgtttgttatggatttgcaacaattttggggcaatcgagtggaagccgaaagaatctggtagtttcaccaccatgaagtc

SEQ ID NO: 72946 - DNA, 1988 bp, Oryza sativa
ttaaaattttgaggatatggccccaactggcaagaaagataggccaaatagtagagaaacccagaaagcatcattgcacaagaagatagtattttgaacttttgaagtaccggaattacaaaactattccaaatattgagcatcaaagcttcattgcactgaggttgcttctaggtcaggaagatatatttacaaaccaagaactccgacataataataaatagtaaaggccaaactacacatcggatgattttttagattaatactccctcagtttcataatgtaaaactttatagcattgtccacattcatataaatgttaatgaatctaggcacacatatatatctagattcattaacatctatatgaatgtgggcaatgctagaaagtcttacattataaaacggagggagtagctcaaaactccagagaagttctagtacattaggaaatagaataaaaggggaatatcaaatttgatttgagcaacaaataaattccccaaaagaagattttggactagacatatggcatgcctttctgttactatatcccaagtatttccagaaaaacatgtttggcagagagagaatagattatttagacgaggaacatggaaacttgatattctacaattctacagaaaggtgaggttaaaagacaacaaaggaaatttaatgtgagtatttgttatttacatttgtttacattttgtttgactaacttgacctgtgttgcattaattgaaggatgtcaccttacctccaaagtgatgaagaacaatcgacgctgcaactgtaacattcaatgatgcggttccaccaccatactgagggatgtagacaaaaaagtcgcagatctcgcactccttctgcgagagtcctgtaccctactagatgcaataaaaaataggaaattataatataaagggcatgcaaattgctcttgtttattcaaaggaattacatcccacttcagttttatcctagtcatccattgaatatgatctacaaactggagaaaatgaatttaacagtataacaccatatatttaaatatagtacaatgaagtattgccctagcaagtaatggtcaccttgagttgaaacaaagcctgcagttcacacgtgtatcaagtctaaaaggtctcacactttcactattatgctagtgctagcaactcatgccaatctttcctcacccctcctgtactggcactggccttttttttcttttgagaaaactagaatagctatcacaaactgatgtttagaaaaaatacattggggacactggaacagtcccccatacagacagaaaagcctaaaaattatggaagacattgatgacattagatctgcattcattactcatcaggggtgaacaataatccacatccattgagcaacagctgaatagctcaaggcactgccgtcaatttgacattattgaaatttcctcacccaaatgccccgaaaagggtggaaccgtgacagcaacggtattttctgcggtatcaggtagtcaatcacatttgttatggtatttccataattttgtcattgtgacggcaccaatatacttctctcctctttttcactagcggtttttattgtgttttagtaaacattacgacgctcataaaactcaagtggagctaacatccactcaggattccaagggatcacaaaaaagggtcaaaattccaacagaatttggacgtgtaagtaaattggcaactgatacacatatctgcctgcaaactagtactaattccacagagtcaattgaatttgtgtcatacaagcagaagtactcaaaattaatgaggaatcatgagaaaatccgacccacccacctcattgccgaagaggaaggcggtgctccggcggaacggatgggccgtcaccggcagcgcgttgtgggtgatctccacgccgcaaatgtcacaccccctctcgttctgcacacacacgcgcgtatgtc

SEQ ID NO: 72947 - DNA, 1656 bp, Oryza sativa
ttcctgcagcccaaattactacgcataataattacgtgcatgaagatgcgttttccgtagaaattttgtgtgtgctgtgtgcaagtgtggtttcgtaggcgtactattttacccgatttcaagttaaacggtgtaaaatgtttatagaattagagttgatttttcaatatattgatgtgcaaagttggtgtattctatgctctgacttgtaagccttttacaagtttggcgaaaagttgatttttcatactccaataatataggagtatttgagagtcagagagtggaaggataataaaactaactttctccttattccaaaattcaatactccctccatccctaaatattaaacgccgttgacttttttaaatatgtttggccgttcgtcttattaaaaaaatttgtgaaatatgcaaaactatatatatacataaaaatatatttaacaatgaatcaaatgatagaaaaaaattaataattacttaatttttttaaataacacgaaaggtcaaatatgtttaaaaaagtcaacggcgtcaattatttagagacggagggagtatatttgagagccagaactttggagcaagtactatcactacttgtttgtagctaattaccaatattattgcaaacgctggccatggccatggagaagcagcagcttcgcttctccgtgcgccggcgagagcccgagctcgtcggccccgccgcgccgacacctcgcgagaccaagcggctgtccgacctcgacgaccacgagacgctgcgtgtccaggtcaagttcgctttcttctaccgcgccggcggcgagcacgacgcggcgggcgtcgtccggcgcgcgctcggcgaggcgctggtgccgtactacccactcgccgggcgcgtccgggaggtggaggagcggaagcttgtcgtcgactgcaccggcgagggcgtgctgttcgtcgaggccgacgccgacgtgcggctggaggagctggaggaggacggtgacggcggcggtgagctgaggccgccgttcccgtccatggaccagctgctgctcgacgtcgagggctccggcggcggcgtgctcggctcgccgttgctgctcgtgcaggtgacccggctgctctgcggcggcttcgtcctcgcggtccgcgtcaaccacaccatgtgcgacgccatcggcgccgcgcagttcctgctcgccgtcggcgagctcgcccgcgggctccccgccccgacggtgcggcctgcatggtgccgcgagctcctcgacgcgcgtagcccaccggcgccgtcgtttcctcaccgcgagttcgacgtcgtgccgccgccgccgccgcccggcgacctcgtgacacgcaccttcaccttcacggccgccgacgtcgccgcgatcagggaaggcctcccaccgcgcctccgcggcacggcgaagacgttcgaggcgctcacggcgttcctctggagagcccgcacggcggcgctggagctccccgacggcgaggacgcgcgcctggtggtgatcgcgaacctcaggggcgtcgccgagctgaacctccccggcggctactacggcaacgcgtgcgtcgccccgacggcgatcaccaccggcgaggcgctgctgccgcgcgggtcgctgggcgacgcggcggagatggtgcg

SEQ ID NO: 72948 - DNA, 1981 bp, Oryza sativa
acattcactaaaattataagaatgaaatttgttctgtgaatgtaatacattattagtttgttttgtgaatataatttgatatttagcacacctattttctttcgcacctcagtatttgtttgcttcatggctacttgcctactctcatgttagcaaattcttttacatttattcttcatccttctttttagtgattggacattattaacatattccttcaagcttagtgaaatgaatagttttgattttttaggataattttacattgatttttttgaattgacattttacactgacttacatttactatacttcatttgtagatatcaaatccgtcgccgattacttttgactggcactccaatccaaaatagcctacaagagctgtggtctttgctgaactttattcttcccaatatttttaattcatcacagaattttgaggaatggtttaatgcaccatttgcatgtgaagtcagccttaatgatgaggaacagctgctaattatacatcgtttgcatcaagtgagtgatggttgcccccaatccacctactcatgtcattcagtatttttaagttttaacttaaaatttgcaatagttagctttaactttctcttgcatatcaccttttcggttgaattcctgcagcatgcaaagtgtgtggctaaaacatgagttaggctaattattaatatatgtgaatatttatttaaataattccgttactctttgttctctgcacaggtgctgcgtccatttttgctgaggaggaagaaagatgaagtggaaaaatatcttcctgtgaaaacacaagtaatactcaagtgtgacatgtctgcttggcaaaaagcatactatgaacaagtcactagcaatggaagggttagtctaggatctggtatggatactaatccttttcatattgttaattgtttgtaatgtttgactggttcgaagagattggaataatgctcagaattaatgacttggctccactgcaaatatggatctgttttttcccctgttgttgctatatctaattcatagtctcatccttgcttttagtttttcactttcattctttttatgacctttctgtcttgcttaagaaaacaacaaacttattgtcatgtttgtatatgcaggactcaaatcaaaggctttgcaaaatctgtcgatgcaacttagaaaatgttgcaatcatccctatctattcgttgagcattataacatgtatcaacggcaggaaattgttagatcatcagggaagtttgaattgcttgaccggctacttccaaaattgcagagagctggtcacagggttctgcttttctctcagatgacaaaactgcttgatatcttagaagtatatttgcaaatgtaccagttcaagtacatgaggcttgatggatctacgaagactgaagagcgagggagattattggcagattttaacaagaaggactcagaatatttcttgtttcttctcagcacccgagctggaggccttgggttgaacttgcagactgcagacactgttattatttttgacagtgactggaatcctcaaatggatcagcaggctgaagaccgtgcccaccgtattggacaaaagaatgaagtgcgtgtattcgttcttgttagtgttggctcaattgaagaagagatcttggaccgtgcaaaacagaagatgggtattgatgcaaaagttatccaggctgggctgttcaacacaacctccacaggttagattaaatcctcgaacaaaattcatacttcctctgtttcatattataagactttctagcattgcccacattcacatatatgttaatgaatctagattcattagattcattaacatatatgtgaatgtgcaggctgggctgttcaacacaacctccacaggttagattaaatcctcgaacaaaattcatacttcctctatttcatattataagactttctagcattgccc

SEQ ID NO: 72949 - DNA, 964 bp, Oryza sativa
tctgtgctcacggaaaacgaacagaggacgagtccttaccgtcagtcgtacacacggcaccttctgctgtagggaagagaagtcattttggtttcctgtaaggagttgtgatgttgctacatctgtaatcgcctgattgcaatgctcattgcaacagtgtataggactgggtgctgccaaactgcattttctgttgtagagaggccattggtcgcctgcaaagagttatatttgtgctctcctgattgcaacagtgtatatagggtgaaaacagtcgaaaacggtagcgtttctttgggcacaattctcagtcagtcaggaattgactatacttatcaatttaactattcagcgacaatatgatgttgaaaaaaaatagaaaacctaaattttataagttgctaaaaatggtaactgtccaaaacggtaacacttgtacggttggcagcattagcatttggtgcagtacaaattggcttgtagagctttgcaactgaggcatgtttagggaagcttctagcaatgcttttcacaaaatctccagttcctccaaatagaccaaattgtcatctagattctgaaaatctgtagttgtagaatatattcttagaaactggttaccaaccagtaaattcttagaatcttaagcttcttcgaacaaggcttgagaatgtgattataaatgatttgtgtcccaatggcagtgaaaattggttctgttgcatccaaaattcacgaatatgtctagtaatactgaattgatcatcaaatacttggctgtgtttgaagctgagggttggaaaacctatgaaacgacgaattactattagttgaaaaacttgaaaattaaaaatattaaaaagatcaacgtttaaaagttctgaaaacaagaaagcaaaagttaggaggaagtatagaacacacagacttgacctccaaaaataacccaggaatgctcaccgca

SEQ ID NO: 72950 - DNA, 10264 bp, Oryza sativa
gtgttagaggtggattcaatacggtggggccaggcgtcagcgacggtcgggttaaatggggtgtacgctttgccggagtcaatggtggcagctggcagcaacagctcagaggtgggggaaggacaccaccaccaccaccaccatcggaggagagagagagagacgaggaggacgaggcgggagtaaatgggaggcgcggccgccgccgccggccggagggtggtgggggcgccgtcgcagcagccagcagcgcagatgagcggagcagacgagtcctggttggccgggggctctaactggtgtgaattactactagtactattggtaggacaccgtacacggctcagattacaccaggaggggtttcttctccggggacagcaacaggaggaggtgtgtgggaacgccatggcgttctagaaaaaaaaaattctaggatgcttcctccagtgccgtgtgctgtgtgcgtgtcctaataccttctttttcttttctttcaaccgtgacatttgtcaacttttttttttggttagagatgacaaaattaagcgggttttcaaagatgactttgaggtattaggagaaatgtcgttgtttgatggtcatcggtttttgcgggtggtcatatggttgacgaatcagtttaaaagtatgtgtatggtctattagtagtcaaccgataaaattgatttgagttatatagagaaagtgagtgatccataaaacgactcaacaagatattagaaaacagtacagtatgcatggaacatgcaaaactaggctattaattgacctaagcgagtgctttggtgccacgattcaaaaacatgtaaaactacgttattaattgctctaagcaagtgttgtggcaccatgacttaatacacatttttaccgttgaacacttggaccacggcattaactgtcatgattggattataatttaattttctattttaagcttggttttagtggctttctctcccgcctccattgttcaaattttttttcatgatcacgacgaagacgattaaatatatattttataaacttatttttaaaaatcagtgaaacgaaataagctccatcttaaagcggaagctatgccaagtgggcacttaattattaagaaactagtactcactctgtttcataatgttttaacttttttctagtcaaacgtctttataattgaccaagtttaaagaaaaattttagcaacacatacaacaccattttgatttcaataaatataacattgaatgtattttagtatatattgttttgtgttatatagaaatgttgctatactttttagtaaacttggtaaaatataaaaaatgactaaaagaaatcgaaacaatccttataatataaaacatagggagtgatatctaagccatgtcgtagtgtggaaattggacattttatacatgcacaacataacaaacactaaagctattaggttttagaaataaagtgagtaatcatatataatcacaaaggcactagagatagtgattaaaaccaacacggaggcacaaagggcatgtagaaagtgggttgttgagataggaggtgtaaaggattgtgctttgaagacatgaagaaaatcatctcagctatttggacaggggcactaggtagtacatattgtgtcatcagggtgatatcgattgattgttaattaggttactataagagtttttttaattagtatgactataaaagaatacccaagaaccatccctttcattgacatcagaaacacgataagctaagcatgtaaactagggtatgtttctgttgacgtaaaacacgaggcctaagagatctgcttaactccagtgcaggtccaaaactcgccttcgggtatgctagcgtgccagttgatttgattttgcaatcaacaagaaacaaagacaatacaatcgtggttaaatacataaatgatagccgatcggctatgtgccgatgacgtatcatttatctttgagccaatgtcatatgtgagtcgatcggcggttataaatagataatgaagaactaaatctattcgatcggctgtagatgtcaatagaatataattcttatatcgacatatatttaaaccaagtgattgggatagatcggtcatcatgccgagacagtataaatcacttagattgaaatatatgctaataacagaactatatgtgtttacagcatagccgatcagatagatctagcatgtatcagctagtactccgatacaactctatgttaagaggttaaaacaagtagaatataacagaccgaagcttaatatacttaaatgcaataatatcttgacataaggggcagatctaatgtgtcaatgaagcatataaagtaaatatagttaaatcagataagatcggctgaaactccgatactaccctaatcagcaaccagaaggcatgctagagattgatattctaagcacgacttaataggtcaaactcaactgatgcagcattaagtatgaaaagaagaacaatatctagacaatcaaaccgctggaagtttcatagagtggtagatatcttatacaatctaaaccaacatcgatatttaacctaatcggctgccctatgttaacagatgttagccgattgtaggttagatggcgacattgctagagattatataagatatatgataattcaacgaattacataaacaagattagagtgtcataaagatagaagcactaatcccgagaacgcaagccgtcataacaagttttatctcttgttgaagatcgaaaccgatgcagctcaacccgaaagcaagaactcgtcgaaataaaactaaagcaaaaagggtggcgatgcgccgaaattgtattgaacgtgtgttaaaaattacatagggctcggggtctatttatacccgagaattacaagatatgtccataccggacacgactattatctctaacaaactctaatataccataagtcttttgcggcaaacttttgcccaagcatatctctaaggaaattacataaaatatcctaattaatagatacaattgccttctcaggactctatccatgtgcggcaatcatcttgaagtacatcaactcaaacccgatatcggatacaagtcgtattgtcagaatagactgtatcacttaacccagtccaactcggacttagccgattctaatcgtagccgatccgaacctcagccgattcttactctgtttccgctataatcctcatcttcgattccgcttcaatccaaccttcatcggaccttctttccgatgcagatattaccaaatttggtcgttaacagtttctaatcatttcacacaaaaaagagatacccatgtcccttttggcccaattttgagggtaaaccattatacaaacgtacaaactatttgatttagtgttctcatctatttatatataaatttacatataagacatcattctcgttatttataacttatagattatggagtatccatggcacactttctaagctaaatggcatgatctccaataacttttcttcttcggcatattttggaaaaccttttaactttgtaacgttcagttcattcgcgttttcccttgaataattattatgaacttagaatcaatcatcatttctcgctgggaatgacctatgagctcttttgagcatttgagcaggacctaaattattattattattttccttgaacaggaggaaaaatatattgtttatttgctaatagagatacttcactgaatgcctatatctatatggttaggacaaaaatacttgcaaaattattacttcttccattctaaaataaacaaagacgagtcttgatatattatagtacaataaatctagataataataaaagggatcacttatacatttatcaacaattttttttttcaaaaatttaacaaatataactatagtataattgtgatgtaattatattatagcttacgtgtaactataatgtaacttgtatgtagctttttaaaatctctacgtaacatgatatttcagtgaaacggagatcgtgggaatgaatcctctcacatgtatgcacactgtgatttttttccttcctcacttgcacaaatcttgaaacaaatctaacaattcaacatgtgaaagttacgtacaaattacatgcaagttacagtgtaattgcatgcaagtctcgatataattatattataattatactgtaattacatccgtcaaatttttaggaaaaaaattgttgataaatatataacaaaaattgtaataataaaatattgaacagagatactatcgatagcctatccagatttatttgggggagtacctatacatatttcgaaagatttttatgatcgtatcacacatatttttaatctttgcattaaaattcgatagatataataaaaagcaaaaagcaattaagaaacaccataatggacactaaattaccatatcctcaagaaaaagaccaaatccaatacaaaatttaaaatttacatgcaaagattcaaaaattacattgtaacttacaaaagttacagtgtaagtttcataaattacactgtaacttacaagaaaatgcactgtaaatttgagtgagaaaatcgagtgtgagataagaaaaaatctttcgagtgagatatagcaaaattgtttggttattttgaagtccgagggagtactgtaaacatatcgttatgggctgggccttgggttaagacaaatcggatccgacaggtccaccgacccgacccactacaaatatccccaacccgaacgccgtaaaaaaaacaaaaataaaaaaaccctaaaatttccccaccgaaagcccaagccaagccacacaggcgcggcgcctgcctcaccttccctcgccccggtcgatcgatcgaagccgacgaagcagcgggaaaacgagtcttcccccctcaaaagcgagcggaggaaggaaaccatcgaccgtttgccgcgccccgatttgaaccctcgccgcctcgcctcgcctcgcggccgtggaggcggagcgaaaccctagggaggcgatggctgcctcggtggaggcggcggcggcggcggtggtggccccgcccgcctccgtgggcggtgacgaggtcgtcgtcggcggcggcggcggcggggcgtcggagcaggccaggacgctcatcggcgcgctcaacctgctctcccgcaacctcccgctgccgcccgccgtcctgcacgccgtctcgtccatctaccacggcggcgacgcgtgggagggggaaggggaggaggggggtgaagaggaggtggcggcggcggcggcggctgtcggggatggatgcggcgagagcggggagggggaggaggaccgcgcggatgcttctcccggtgcggatgaggtgcgtgcgcgcccctgtgcttcatcaattttgctgtgcgttcccctttcggttgggtgtgcttcgagttgctcgattagtgctagctgttggattagctagcatgttcagtagaattggcgagatgtagttagggtttcccgtgctgctggattctagagtggtttacagttggggaatgtgggctgcacttgtagaacgctcctccggtgacattttttgatgaatgtctatacctagtatggttttgggtttcatcgggtggaggcattgcaaggcatacttacctgattaatctggagctagaactgctttgtggatcggatgcttgttccaccaaaaaaaaaaaagagatgtttagtgttttagggatttctgatgatgtggaaacatcatttttttttattttttacaaatgcatatatgtttgtggtgtgtaatattttagatgtcattaatcatttttttttacagttggtatgccaccatgtttgtgaagtgtgtactagcgtctaggattatattagtaaaagccttattgtctttaaggccttgttcggtttggagggggttgaaggggattggaggggtttgagggggaataattgcacaccacaataggtgtggaataaatcccctccaatccctcctcttggggattaaccgaacatagcctaaacgggatataagttccagagaacttggttaatactgggtctatacaaggatttgccctcagtagatgtatttacttacgtacattacctcatattgtttttatgtgattgaaacaaaattctggtccaaaagttagattcatactatttgggccttgttgagttgcgtgctgttgattttgttgttagggttgtagtttcaaagcaccatattgtcactgcgatgattgggtgtgtcattacctcttgttctcctttttgggttatggctgaggcatagtgcttatgagtaggcttttgaatggccttctcatttgcgttttaactgagaataaatcgattgccttatagggagtcaccttgattcaagagcttgaagatgctgtattgaagaatcaaggaccgtatatgtcatactcagagttgactgctttaaaagaagaccgcttcaacacttccattcagcataggctgactgaacttgaaggtctgctcatacatcacctatttttactttctgatttattctaagttaaattactttaacggcaagactcctctttggtgtttgtgattatcctgctttgattttcctgttcttacaaaactggatgggttgggatgtgttttcccggcctactacgttttggtcttacgaagttcccaggcctggccttggtgtaaactgcaaaccttttgcttttgggcctgtaagcttgcactgtgaaaaagttgaattataactggccttctgaaacggtgcaaaagctgatgttgttgtgtttgactttttaaagtctatacgtgttttattgtcaacagtttagttttttctgaaactattcttagcatatattccaccaataggatgctgcctactaatattatcatgcataagatatttttaatattcagcctctctaaaacctgctttgttgttgactactgtattagttatgtaccaccaccaaactcatttctgtttatgtgccaggattaccatctactaggggtgaagatttgcaaatgaagtgtttgcttgaattgtacgggcttaaggtaaatgtgatattagaagcaaatgttactttggaggcgttgatgttttctgctgttactgcttttcttagatggtgccttttgtgtacagtgatgtccctagtggtgtgaagtatacaaattaactttgtttggaaagcgacatttgtgcaaacatgcataatctattgcattttagacttctagtacattttatggacgggcagatttcagacgttactacccaataatgtactgcagtagtcttgtccagggaaaaactgttcgtcttttcttttgactgtaccaaaaaacttattgtctttaactagcagtttgcctaccaaatcttgatgcatgtgtgaagaaaaccataactgtactatcctaggcagttgttttagctcctagaacagaaaccaaggaaactattgatgtggcgatgattactatgtaaacgtcgggggcgcctaatgggcgagggagtgtgtggcacgcaatttgcgctcacgttatcacgcgtaacatgcgtagcattaggtacgagccatctaggaagttttgataacttcctatatgggtttaaatctttccattagaaaaatcactctacagatttttattctgagagaaaacttcccatagttattatggatacaaactttaatatggtaaaactgtcaatagagagaaaaaaatccaatgatccattggaaaaacttccttttcttgaaaattttatctactcaaagatttctttttgaaccaaaattgataaaacctaaaaagaagaaagctcatgtagccctctacctctaaagcccagcgctctgtcagtggaatgaccacacatacgttcgcgtaaacagattgttttatgcggaacagaaaacggatatcactcactgggagaacgctaaaatggaaagcgtgagaaccattcacactgaacgcgcttgcgaatcaggagttcaaatatatatgtggccggttgaggaattcagggatggaggtgtgaagctacatcaaccgcaatggtgattttgcaaatatctaataggccctctactcaatagataaataagcttcactactaaaaatgttcgaattggtgattgtgatggtgtgttctaaaccacattcctcctccccactccctcagtagtaactagtaaagatgtttgactgcatgctttctaaaatatcatatttctgaacggatagaatttgttcctaaatttgggtcttgaatgtacatgtaaataactcacgccttactgattttttttatttaatatgcctcagtacttctataaaaaaaccacaaaggatctctgtaatttctcaactgtacaatgatttgcataagtaattaagtattgtgcttttccacaaaaactgctatgcacctagctagatccaactccgttttgatcaaggcattgaaacaattaatcagttgagtagttggtatggaggacgtctttaggcagggagtactagtacaatagtagtatcatcatatgatctgtgcactatcctttagtgaggtgttaattctattttgttggacagtttggctatttgaaaattgaaactatctagtgcaaagctcaacaagtgtatgaattccataggtctatatcaagaagtacgatattagaagtgagttatcctatcaagctcgctgattattcatatacttgtgcagttattagacttgcagaagaaagtaaggactgatatcagtgcagaatactggctacacaaaaaatgtgcacaccctgataggcaattgtttgactgggggatgatgcgtatacggtatccttttaccatgtatggaattggagatagtttttcaatggatgctgatgatatcaaccgcaaaaagagattctcagaggttttgtatcatgtatcttttgattattatatgtttggttaatttatatacacttgaattaataaggactccctttttggtatttgggaacaacagaggatctcaagacttgaagaggaggaaaagaaccaggcagagatcaggaagaggaaatttttttcagaaattcttaatgctgctagggagtatcagctacaagtaccggcttcttacaaacgaaaaaaacagcgcaatgatggagttctggtacggtcaatataattttcattagagattaacagatagcttgagattggcctaattggttccttccctatggagaaactaactcaccatattttggaccaattattcccttttttttggttacaaagactaggttgcactggtaccagtaccttatgacagtgttgtttgccaatagtgcctataggtataagagaaaagaaactatttttgttttactatgccttggaataatattttatgccctatgcccctatctgtaatggtctcgcgcctataacttatgatatgccttggaataatattttatgctgttggtgattatggaagatgagaattttgatggcacacacattttggtgagaaaacaagtgaacaataccttatggatgatgacttaattgtgtaccctgcaaaaataatgaattaaagattgagtttttgtgtgatagtatggatcaagttctctataaagaatgtttaaattcttgattcttgtttgctacttcatcaatacattatcgagttatcattgtactgcatttcctttgttagagcatatgtacttgttcctagatatattccttttgtggattgttcaaatgtttgtgccctttttttttcctctaaatgtaggcatggcatgttcgtgcacgtcaacgtataaatcgcatggaaaagagtagattacaagttttaagggttggtgaccaagaagcttatttgcgtatggttgaggagagcaagaccgagcgcctgaaactgctccttggaaaaacaaatgagcttcttgaaggaatagggaaagctgtgcagagacaaaaagatgctgagcatgttagtcgccctgatggatctgaactgccaaaagggtcagaatctgatgattgttctcaaatatcaggcctcaaggttgaatcccctgatgaagagtccccatcagatgttgatgcagaccatcatagttctgctgatcatagtaaattta

SEQ ID NO: 72951 - DNA, 6971 bp, Oryza sativa
tggatatcacatcctactttatgacaaacgacagttacttaaatatatcttgcaaatttgttttgggtattttggtcctgaggtcttctatgtttccatttgattctgtcaaaaaaaaaaaaagcaattctaatttgtcacacgcatcctgtccatttccctgccttactggtgaccaagctttcatactccaggattgttaatatcatggtatttctcacctgcagatacagtcgccatgataaacggtctaaactgcctgggtggatactgtcacacttacatgatgcgcacctaaatctgagcactgatatggctttgcatatagctcgtgaggtatgttccataacatttatttttctttgactggtgctatgtagtttgaattgcttcaagtactgtaacttgtaatcatttaaagagcaagtttatctctaaccgataatgaagctatgcttgcccgtgttattattttccaacacaagcacaatttgcatgataaacattcttgcataacaacctgtgcaagaaattgttcagacttgtcgcattctgtgctgaatatattctaacatctggtattaccatcttgtataacagttcctacggaggatggcgcagccttacgataagacggggagcggcggcaacaagactctcttaaccgaagaggatttgcagaatatggcgcaggacgccatggagatgtgaaaccatgaaagaaattgaaagagagggagggggagagagagttttctgctgtacaatacattcaaaattgaggtagaagtcactaatgtacaaaaaaattttggctactcatgtgaaccagcatgaattcgagctgcacggttcatgctaaattgctaacaaattggtccttccaagcacatgtgatattactctgcatctgatataggtatgtacaccttaaagtccttccggatacttatatctgaatatgatggcggcctctgaatttcagacgtgtcgttacattgcctacagccaaccgttctgttctttacaactttattcaccgtattattaccacggattatttgcttcacgtttttagacatacgatatctcaatattccttctgctgcttatatgatgtctacatgtactcttttgaactcttatgtaagattatatgatgtctacatcgtgaagtttatttccgtatgaattttactttactttctctgaacgttttggttactcgtatccattcagtttctctcggtttctctcctgctgctgtcccaatcagatcccaacacaagcatttgattgagaatccgattcaatttcgatcttgactcggtacggctctcgtccaattcccgtagattagattttgatgactctgtgattcctgagtcagggtttacaattccaaaatgtcctaccattccaggcactggcggtatgttgaattcacgaaatccggtggaaaactgacagattctgaacaaattttatgaaccaaaatttgaattcaaaatttctgagctaaccgatatgttcacgaaaatgaatcggctttggtgaaattccgacataaaccatcgaaattttactcgacaactagaagacaaggtattctaaaaaccattcggtttctagtgaaaactgatcggttttgtcaagaaacctacgagaaaaatcaaatttgtttttatcagtaaaatatagaaaaatgtcagataattgaaaaaaacgtaaaaatgtcaattcctataaatttgatagcctcccattggcatacatatgtaatacatattcataaaagtctataatttaaaacacacgtgacatcactcatcaaccattagccaaatagaatgcccatcacctaaatattaaagtcgattgcacacatagtttagagttcaatacatactcctcgcctccgccgtagccttcatggcccgcctgagctcaaactccttatgtatgtagattacttatggttccgttcgaattagattaagataaagatttttcggcgcacgtaaaacaaaacaaaccattaacatatatattgtacatcctgaaaattcccaataataaaaatcactaaaattttaaactttttaaaaacttttgcatcatgctagttgttatgattgctattgcttgccaaaccgtaagtgatcacaaagaaagtaaagaaaagatcgacatttaagcaatagatatataatttacgagaatatattattgttaaccctaccaatatttatgcacaaaatagtaaagtcaaatattaatttctatataaattacaaatcagatattaaatattcgaaccatgattgatagcttgatgtcacaattagctaaagaaatagtaagattgaatctaatccaatctcacatgaaatataagaacacatgaaatgaaatgatgatcaccactataatgatcgtgtttataaataagtaattcactagaatatatatagattgatacttagaacatttccccgagttcctcatgacatgaaaatcactcatataaaataatggtcatataaataaattaagctttatatataaataagaatatgtgagtgtttaactaaacaattagattaatgttgtactgagtctcaatctactatttataagataaatagattcaacctatccgtgtaaaatatattgctatgcaaataagatcaaccaatgtgctattgtgtcaatatggatcatattaaaatattttagttaattctataactatcaaagcctagaagttatataggataattctaggataaattaattgaaagcaaattcatttaggatgaaacaaacaaatgaataaataaaaattcaaataaaatatttgagttcccaaaaacaaaatgtatagattgcatctcaaataaaattctaatcccagccatttttcagtttggcccctccatctttcccttttttttccctttttttcccttttcttcttttttgtgattctcccagtcggctactgttcatgggccgccaggtgctcgaccagagcccaagccgaacacccagcgacccgcgtcccatcgccgccctccccctgccgggccgtgcctagctctgcgcacgccgcatcgcgtcgcgccccgtgtcgctgccgcgccacgcgccgtcacgccgcctcgcgccccgcgccgccatcgccgtcacgtctcgtcgccgctgccgcgctgcgcgccgtcgccgtcacatcccgtccccgctgccgcgccgcgcgccgtcgccgtcgcgtcgccatcgccgcgcgccgcgagccgtcgccgtcgcgctgccgcaccttcgagccccgagccccatgctgccacgtgccgtcccatcgccatcgcgtcgccgcccacatcgccgtcgccgtcgtcggtcgcatcgtctcgaacccctcccctccgcgcgcgctgtcgtcgtcgcccccgcgtcgcgccccgtgccgcgacgcctcgcgccctgcgccccgtgccgcgccgcgcgcgtcgctgtcacccgtcgccgtcaccctcgccgcgccacgccgcgccgttgccatcacccgtcgctgccgccgcgcgccgctcgcctgtcgccgtcccgcccgtcctgtcgcgccgagccccgtgccgagccccgcgctgcgccgcccgcccgtcgcgtcgccactccgagccccgcgtcgccgcgcgtcacagtcgccacgcgccccgcgcaccgcgccatcccatcgccattagggccggccacccctccccgcgccctataaatccccccccagtcgccattccaccccacaccaccccacatcctctttccccattttccccttctcctccaccgcgccgctgctttcgtgccgccgcgcagccgccttcgcgccgtcgcgccgccgcctcggtgccgccgcgccgcgccgtgcgacgttccgccttacaccgtcgtcgccgccgccaccgtcggtaagccgccgccctccccctcgttcggtcgccgttgccgccccgagtaggcagagagccgagagagagagaaaaagaaaaagaaagaagaagagaggagcgaaaagaaagagagaaaaagaaagaaaagaaaataggaagaccccacctgtcagtcactatagcttgtatagcttgtagataaggttgtattataaataaatgaattaggaacagtaccatttcgcaattattagaattaattcaaatttgaatctttacactagcataacttattcattttagctccgatttgagtgaaacttgaacctaaatttatctaaattcataagctttccaatggtatataattcactatttgataaaatacatttataattattaaataattaatactaagataatgcataatagtcaacttaaaaatgtgctaataaatagatttgatattgtgcagtagagtagatgtaataatattggtccttaacatgttttgtcactgtagaaaccacataaattaatcataatcaatgtttcagattaatggatgtataggaaaataatagtgccatttattaatctatgtccaaatataattaaacccatgactgataggttatttaaataaagtttagcctcatatttgtaactaaaaatataaacacgtatagatcattccttagcttatttgtgaggaacaataacagacctattataaatagactactaaaaggaagttgatcagtagcatagggaatagcatatagttaacttggttagcatccaatagttactccaacagtaaaatcacttgtcaacccacttagatcacatatactatacaatccatttaaattcatacataaggacaatcttttgtatataggaaactaaggagtctatgacaaacatgaatattagataaatactagttataaatcttgacctcatataattatagttcagctgtaaattaggattgttcattaagggataatctgtaaccataatgtgattaacctaaacaactctaacattcaaagcatggataattattaaccttttataatttattgtgacaagtaaaatttgttcataattaaagtaaagcctccatcaattaaataataatacaaatgattcattatttgattgatcctaaatccatctaacaacagaacctctgttatgtaacagtgctatttagatagatgcatatatagccataatccttccatagccatttgatagactaaaccaccgattagccaaatatatgtgtataccataaatgctatgttggttaactcctaaatagaccacgatgacaatagaaagattaagaaactttagcccttagcatgattggaattcattagcaaacatgaatagtacattttgttgtgcatatttgattgttgtttgaatattggtttttctcgcgtattatagaccttgtgtatcggttagtcgtgaggcaacgtttgcaacttccaggaggtaacggttgatcaagattatatcaagaataaggcctattctgagcaggcaagtcatcactattctttgaacatgttgatcccaattgcgaaattattttgtttacaaataaaattgcatgcaatgatgaacatcctacttgtgattatgccatgccttgattattgtttaccccttattccttcataaccatgtttacgtatgagtccctagtcaattatgacaattgcttagaaatgctattctagaattatgcatactcatatttatcaaatgctatatacttgggcaattacctttgggaaggtaattgagatgcggcatgtcgagacatgagcgccacattgccatgatattgatgacatgatttgtgaaatgagaaataaaactaaacaactgttttcgactggggcggacggaggatttgggtggtatctggaaaaggctagtaccgtccccggtcaattaaggaccgagccatgaagttaagcatgaaacgacccccgtacaaccgcacttctcgtatgggtatagacctagcggattagatagccgagcggaggcagtatccctgcatagatggttcacccctgagtgaggcaggtgcgctaccgtgggacagccgttgaggtagggccgagaggcgtgccctacatcggtgtcgccattggtaggactgccatgagtgtgtgagagagaaactaacttaatgagtgtgtgagacttcctttcccgggagcgccagaactcctctcactgctagaaactgtgtacgcctagagtgcatgaggatgaaaagttcatggagcgggtactgccaatgcgaggttatcgaaaagctttgccgtggcgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaactggtgtgggatgggatattgcatgatgaattttatgctgatggagacacttcctgagaggagggaaggtggacgtcctcagaaaaccatgacgactcaatggcgggaagctatccttgggattacaatggatggtggacagaaccgccgttgtttaatgtgaacactggtattaaaacttgatcagtctatggtaggtcttaggcttgtgaaaagaattgcaaaactagctttatgcaaaagaacctgaagccattccttgaaataccctctatcatatgcattgttgttgtggtggcttgctgagtacggttggtactcacccttactatttatatatcttttaggagagtgttgaagagaagcccttatcggtacgcttgcgtatccaacaagatgatcggagtgcggtcttgttctaggtctcgtttccccagtcgactgcctgtggcatgttaaccgggcccttatattattttgtcttccgctg

SEQ ID NO: 72952 - DNA, 5841 bp, Oryza sativa
tgtgcgtgcacgcattatgtcaacatgccagattgatgtgatcagtggaggcatggtgctatgagtatatatattggctacatatggtgttttctgcctatgtaagactaattggtgcaatgtccaatttactcacatttagtgcagtatctgtggtttgatcttagtaatacagggaccaaattggttgtatggtcgttcactttgcacaaattggtgtactagataagttcgatagatggcagtccattttccataatagagcatattgctgagctaaaaacaagtcatcttatttcttttcagattaatgatatgcgtgtcacagaaacagggtcctttcagtatttactggagtatcttgattacccagacgaaggtaagcaaatcattatctgagctatcatttattcgggagttgtttttctttttggaaaaatgcttttacacaattggcgatctgtgccttgacttgaaagaatctgttatacagattgtaatttaaggctattgaacgggaaacttacatttcattatgttttagtgaatagggaagttgaacagagctaacatacatgtgcaaatgaaggatattttgcatttgaatttgtctgacacttctcaacatcttctctattggggaacacatgttttcttctgtctactgataatggtttacagtttggtttgtatggtctccactatcttgtaaccctcttttgttttatgtttggtggtgattaactgatcaatcctccatattacataaaccagtattatcttgggttgagggttaaataagttgtttgtgtaaactaccaggagctatagtgtcacataaatcagtattagcatggtttaatagttaatatacttatgttttcttctcttccttgaatagtggttgtatataataacagttgcaagggcttgtctaatgatgtcatgcgcgaatgcttatcttgaaccatagaaggggcattacaagtagacatttgtaaccttgtgaagatataggcacattcttgaggcctatatattttttatctcatccattttgtccttgtatgctgacaaggcacaagcaaatattgggagaacagaaactcatcatgactaggaaattagttttgtatacacctcacgtcattactccccatgcccttcttttgcagagaaaacatggactgaagtctttgaaaagaacccagcgtatggcaaaaggaactcaaatgtggttagagaaagagaatgcatgcttcgtccttcctatcctgagttgtattggggggatcaagttcccgagcaatttccaaagagtaatgtgatagtatctgtttgtgataccccgaaagtaggtgatctggttgagtggttgtctgaaggttcttactggactgcgaaagttactaagttacttagtgaagatatggttaaggtaaacatttaataatttgcaaaaccaataaatttgttgctgcccttgtaagatatgaattcagttgttgtccgcacgtgataaatatattagtgctaatataaatttaccttgtgtaatccaacaaatttgtgtctatttgtctaatactagataatgaaagtaataaagtccaaataattcactgtcaattttaactctgaagtttgcaatcgattgttgatttgcatcttaaatgtcaagagaggttttacaattccttatgtatacttttcaactgtccggccttttcgaagtggagatctattagtatttcttgtactcccccaccaagaattgcagaaactaggaagatgtaacatacttttgttggaacatacccgaaacaatatattgatctctctgcttggccatctacttgcaggtacagctgttgaaacctcctataggtgaaggggggagttatactgcttactgcaaggacatcaggcctgctcttgattggtgcctggagaaaggttggactgtacctctttcacaggtatctacctaatgtcctgatgggaaggactctcaatacctttgttgatttcttcgtatttattttgtagtttaggaccaatgtatatataatgatctggagtgattcttggtcagtttgggctttttgatgagtctatttctgagctgaagcagttcttatagcttaaaacagtttcagctaaatttatatatatgcatctaatgatatattcatttatggcatcaggcaaatggacggtgctggcatgctgctcgtctgattcatcataaatctggtacagctgatcttttgtggattcaatatggctgtgtgtcaattaataaaaatgtggcattctgagattttaatattctttggtggtttacgatcctcttccatttcttgtaagacaagaacaaaaaagaaagtgaaaaaaaaactaataagttatgcatcgcaataaggattgtatcatgattagattgtttatccttggaatttgaaggaaacatcatgacaacttttcaagcaaattacatttcatattctacaaaaggatatgttcttcctattagacatttgaccttgacgttgaaactttaagtttgaggcaaatcttgtatgattcttttttcctctttaagaggtgtccctggtatttcaattgataaaatataaacaataaccatgatatttgccaaagttttgtcaataatggaactctagttttttctttgtctgaacaaagctgggacattcaattaatttgattcacttaaatattctttttccctcaagctttgcatagatttcttcataatgtgattctagaagttatgctctctgctatgatgtctcaatctttgtttacgcaaattatggattgcagacacagagatgagtggttcagatgaagagtcgacatctgatgacgatgaagaggaagcgcagaaatccttgaaaagagcatcaaattcgtctcaagaagctccaggctcaaacctggaaattacatcagatacaacctccagttctaggattaacagtcagacagctaccattgccacaaccaaggggatttcgagatccagcccggtatccatttccactgggccatagtcatggtgcacaagcagctgtgacttgtacagttaaccaggtacccgcagttccagcagacaattagggatataggtgcgccaacccacaaatccacttataagctatttaaccacttaaatggcctgtaagtgcgttatcttgctgacccacttgtggcatcgttgcaggtgatagacatgtccaatagcacaaatgtttcagagctggataggatctcaaacagtactatagccgctgagtctcttccaaagatctgaactggctaccccctcaaccatttgtggagaaggatccatcacgagacacaacactatataaatataagaaatataatgatgttggagtcttggagatacatcagcattcagccagtacttcatcccatgaaatggatatatgctttacacgttgttgttttcatgactgaagtgctacgttggcaggctgcaatgtttgcagcgttgccgctacttttagggacagttcatttgactgatcaatgagatttatacagctctgaaatttcagacacgttgcaacacaaactgctgacatgaacgatgattagagggaaaattcctagtttttgcattttcttaataattaggaaactggttctgtcaccaggccatacaaggaatgaaattatcaagcaaaacataccaaccgactacgtgattatcatagggatacattaaaaaattgataaataaacttaacaactgatttagaaccgatcgaaccaacacaatagaggaaagtttaaaagaaaaaaaatattttttttgaaaaaagtagtgcaaataatctgtttcaacaatccgataaataatctgaaaaaaaaaataaacctgtcaagcattcaacagctagccaaataaattagtcagcttgttgatccaataacagtgggagggaaaagaaatggaagcgctgatgcagcatcgtaagttcctacccacatatgagcacaatacttcactctcaagctcattaaattgctcaatgatcatatttcatgatgaaggaataaggaacgcaagcatagctgtgacacaacacgatgtaaacaccccaagcaacaagcatctcatcacaaagatccaacatcagcggttacaatccacggcaactagcgtgccaaacttggaacagtaaacacagctccatccatatactgaaaagagttacaatgccacagaactatcacagccatcgactgaaaatagcagacgagctaatattgataatcaaactacggtaggaggccaagcaaacaaccggaatcctacaagcaattcttgcattctaaagcaccatcatcacatggtggggagcactcagtatcttctcctcggtggggatctggagcgtcttggtgatctgacaagaacaagtgaccaaataagattataatttcatacatgtgaggatatccaatgcttacaacatgttgcactgtgaatgtatcttgtcagtggttccgacttcaacagaagtatttgatagcagggaaatagaaacagtgtaaatctttacatgtgtaattagaaaaaaaatgaaacaaaaagaaatcaatatttaggatttcacattatcacattgccactaggtcagaacaatgaccatatgtattgtaatgataaatgaattacttcgatattctgaaataccaatcagtagccatactatccatatatgataattggacaggccagtgagatcaaatatatttccgagcacatagttgagagttaaaatgaacaaataattttcagagaccgattaaataaaacaagggatggttatggcatgtattacttttagttacaaagaaaaaggccaaacaactttcctcccatgctattttccacctcacagaaatttgtaggatgattaaatggtataaagaatagtttacaacaagtgccatactcactctcaaaaagagattatgtgacaaaacctaaccctctgacagtgtgattattctgccataacaaaataaaaggggcatacaagctaacataaaacatacctcttccgaatattcctgcgcttgacagggccattactaaatgcccaatcaacacttatgatttgtgttagaagctcagttccatccaatgcttttattgcagcctgagcttcctcgaaagtttcatactcaataagagcatatccctggaaaggaaaaaacgtgaagatagaatcaagagattaaaatgttcttaagagaacatgcaacataatattttcttctaaactaaagatggtgcatagtgaaggtagcaatttgcaatattagataagaaagggacctctgaaatactgagctactttctgcagattgttttattcgttatcatggaacattttctggaatctcatttaagagaatttcctaaaaactatgactaaaagcaattttacaaggctgcaacagggctagacacattgcagtattgaaaaagacaaaccttcacgaatccagttcggcgatccaaattcaaatgcaagttcttgacctgcccaaagtcccggaaaatattgtgaagatcatcttcctgagcttcttcatgaaccccagtgactagcacaatccatccttcaatggctgtaacaagaggcaaaatatgcatgggctcagacaatgccacgaattatcttcaaacaatggaatcttccatgaagaaacaaatagcataagagatcacaatttaaatgtccaccattacagtttcattagatgatactt

SEQ ID NO: 72953 - DNA, 5159 bp, Oryza sativa
attgtacggtttcacataatataaaactcctccgaacagaccctacatatatatatcatatatacaccgatcgccatatagccgcacacgtatgtacttcaacggtttcagtggcatcatgtgcaaaagttaatcaacttggcctgcgggcttattgttgcctcgctggaacgcctctttcttcctccggatgaaatccgcggctatctcgtcgatgttcatcaggccgtccccggccttcttctccgatgccgtcggcgccaccccgttcatgaccaccacgatcttgtccaccctctggacatggacttcgccgtccagtacaccaccatcaccgctgcctcgtgacatattccccggagcttgtgactactttgatctaacttgctacaatatttataattctagatcaatatgaggaggattgggtacttctctcttggttgatatggattgtatttataggctggctcgactcagctggcaagctacgctagctccaattattgtacagttaattaactggctctttgatctgaacaggtagtagctttgcataccgttaaagaagtgtaacttaaggttaatgtaaggtacgggtcaggtcagatggaacatatatatatatatatacttgtcatttgtgcaaagtgaaatacttcctccgtattttaatatatgacgccattgactttttgataaacgtttgacatttcgtcttatttaaaaaatttatgtaattatcatttattttattgtgactttatttatcatcaaatattttttaagcatgacataagtatttttatatttgcataaaaaatttgaataagacgaatggtcaaacgttggttaaaaagtcaacggcgtcatacattaaaatacggagggagtaattatttgatcttcagattaaggctagccacacatgcgtaattgcatatacattgcgttgcgtgcgtgtttgtgcgaatgaaggtgcattacggtagctagctgcattcacaaaagtccgaaagagtggcgcccgatcgaatcgatcgatggatcagttgtctgattgacaggtgacacatggaatattagctcgctcttgctgacttcttttgttacatatacaggagtagcgtatttcagatcttcggccagaagagaggatactggaagaggattctctgatttacttcctactactttgagtcactaattaatatgcagggtttacaatttcgttttctgaaaattttggtgatttaggtaggaccaaaattttttgaaattttgaaagattttgaatgaatttaaataaactttgaccaaatttcacaaaaaattgaggaaacccaaaaatttcggtcggtatattaattgatttgccggtggggtccaaaattatttccgaaattttgaaccaaaattataaacactgctaatacgtgggtcggttgggtagaggaccctcctgtcagtgaaacagttgaggcagtgcatgcaaaccacagctgtcgcgagagagtattaattgttacggagccgtttagcaatacatgttatgcaaactgaaatttcgttgtagtaactcctccattcaaaattataaattataagtatttttaagattcaaattttgtatcataatatttttcccaatattttaatgcatgaaaatctatacatttttagccaaatgagatgtttatgaagagagcaaatctaagcaatttaaaattcaaaatttgaccacttaagtgactaaaatacattttttttcttcgcctctatattaatttttgctacaaaatctaaaaaaaatatattttaaaaaggagagagtatttcattatttgtgatcatcgatattatgtggttctgtaattattgttttgtcgattccgcttgacgtggataagcctgtaattgtgttattttccgttgattccacttggcgtggataaagagcttataacatagcacctggaatacttattctaatatgtttcagacaattaattagcctttagagccaagtgtgtcatgcatatataaatataacccagaagttaaatttggtctacagtaaaataaaatgcagtttgttgtgaaaaatgatttttttttgaaaaaaaaatgattcattatatttttcttgaaaactttcagttgaataataaaaaaatagatttaaaaaagggtgaatagccaatttagtccttcaagtctttacaaaggttcactttggtcctttaagttgcattttgttcgtatagaacgaattaaatattcgtattggctcaaaatcatccttgtacctacttgatatgctacatagctaatcctagtcaacgtttctactataaaatgtcccagtttgcacacacgggtcaaaagggaaaaaactaaataaatagcaatgtaatgtacttctcattatttcgagctgtacacacaacagtagagcttcaatggatatattgcactacccctagaagtaattaccatgtattcattatgatgaaaaatgtattgtacacaaattttgataaaaagtagctgcatataatcattggatgtatatttgatgggaagtcttgtccaataagtaaatattatagcatatttctcatttgaaatcattcttatgtatgtgaatgaggtgtataagggtcatttatcacaagagatgctgactagatttagccacatggctcctcaagtgggttcgagcacatgatctggattcaaaatgaaaaactgaaggactaatatggatggattgcaacgtcaagtactaaattgagccttatgtgaaatttagaggactaatttagttattcaccaaaaaataaataataaactcagatagatagagtcatgcgtgcaaccaacaactccacctccacaccggtaatcattttattatctaaacaaaatctggtatacggctctctctgcatataaactgccaagtcaagttgcatcttctttaatcatttcaatcccaacacattgattactacttaagtaagactatcatgttgactcgacgaatgaagaaacacacacatatatatttagcctagctaaatttgtataacaaaagtacaaaattgcatactaattaatccagttaactaacattaattgacaacaaacaacagtaataatacttaacatgcaaaaaaacataagtatatacatatatgcataatgcatccatatcatatccatttgcatatatatgtagtaacactagtgctgcgcattgatctctagctgctatgatcagctgcctcctccgccgcccatttctgtttcaacctgtcgatgtacgcctgggaggccttgtcaatattccttcctgcagctgcagccctctccggcggtgctccgccgccaccggccgtcctcggcgtccgcgccgcgttgatgatcaccttcgtcttcgtctccggctcatcatcgatccgctccaccctgctgatcttgatctccttcgtcctctcgacacgcgacatattgttgtttctatatatgtgttcaggttttgcttggtctgaaattctgaatgaatagatgataatcaagacatgtatttataaacgaagagatgactgaagaagtaacgctaactatgtggagtaccttggtacccaaggaacagaaaagaaggcataccagaagcttcatgcatttgtgttgatattgactggacctattcagcttaggagaaaatgcagtgttctttctgacgaaaatcgccgcaggatgtatcggagataattaattaactagtataatgtgcatatctatcgcattgtcggttcagaatagcctagcccaagctagcaaaactaccaagtgcacaggatctgatggtcaattgttaagacgtaaaaagtaatatgaatcagttgaagattttgcaacgaaaacatggaccagctagtgctgcactacacggtgtttttttcaaacagtaggcttaatactgaaggagcaagacttacctggaacttccttggttcgtactctcgattcgctttaattacgtcattagattgcagctggttaatttcttcagcgtgaatgcgtcatgatcaggagaactccaaatcggaatccgatttggtagggatgggcgcgtatacagtgtaactgctcatcaaggtcaaatgcgcccatccctagctagtaaacatctgcctctctgctctcatctatcgatagtgcaacacgcaagttaatcagggcctgtttagttcgtgaaaagaaaatttttagatgtcacatcggatgtttgactggatgtcggaaggagatttcagacatgaatgaaaaaactaatttcataactcacctggaaaccggagacgaatcttttgagcctaattaatcagtcattaacacatgtgggttactgtagcacttatggctaatcatgaactaattagactcaaaagattctctcgtgatttcccccctaattgtgcaattagtttttttaatctatatttaatgctccgtgcaagtatccaaagatttgatgtgatgttttgggaaaaaaatttgggaactaaaccaggccttatgccttctacgtactcccttcctttcgtattataagctgctttaatttttcctaatcagttttttatcaagtttgcacaaaaatatagcaacattttcaacaaacatattaataaattatatttaacgttacattttcctccgcaaggttcgtccacggagggtgagttagggcctaagattaggctatttaaaaaaataatttagtgttttagatgttattaattttttttataaagttggtcaaatctaaatattttgttgtcaacaatatccgagagagttgtttgatctatatagtttaaatgctatttttgcaggtcaactacattttattccgcgatccttgtaatcattccttctggggataattaaaaagagctcattctggtgcaacagtttaattacttaggtctggttaatttgacacagcttcagatattagatgcatgatagatttgaagttcatatgttaaattatagttattgttatattttatattttatctaaaatgagaataaaataattaattcaaatgtgttaacgtaatcgcagatctagatgcataaat

SEQ ID NO: 72954 - DNA, 1334 bp, Oryza sativa
gcgctggcacgcagggcggggtgtggcggtggactggtggttcaccctgaacaccccgcccgtgatcatggttgattcgactgtttgttcaccacgcacacgcagcaaaaataaaaaaataaaataaaatggagccaacgatccagtcaggctagctagggcttccatacctgaatacctgcactgtgtgaagcgaggaatcgcgcgcggtggactccgcggtggtggaggaggaggactgcgagctgttggctccggcggaaggaggggcgcggcggccttcgtcggcgccggcgaagaggtggggattcgattttgttttgggacgaagggtatccgtataaaaagaccttttaccctaacaaaaaaaaaggactcgtctacagttcggattcggaaatatattaagagaattatgtagtgggctcgcaaattcgtgatagattcggagacgaggcccaacaaacttgggagcccatctagtggggagaaggccgcccagcaatacaggggccttctggacatgggccgatctttagctatgttggcttcaaagatcggaataagttcacttagggtccctctatttgtcgcccagtccgattttcgtcccttgaccacgaaaccgggtacaatctgtcccccaacatacgaaaactggacaaaaaaaaggtccctcggcggttttgatagcggttttggctgatatggcgcctacgtggctaatttgacccggccttcatctgacacttcgatccaaaataataataaagtccgtgggacccacatgtcactttcacacaaaataataattaaaaatggtgggacccacatgggccccacatgtcattctcacccctcatcttcttcctcctccctctccatctcccctctctccatctctctcccctcctctctccagcctccaggtgccatggcccacggggtcacggggaggtccagcggtggcggccggcgacgcaacagcctcccgccccgacgagctccacctactcccccccgatcggcgttgctgttgggatggaagttgcgcatggcggccttgtacgccgaagtcagccttccacttgaggagcacgccgtcctcgatgccgagctcgccggtgggcagctcgatgtggaggcggtgcaaacctcagacggcgagtggtgtgagacgtccacggcggcaggagtggatggcgtcgaagtcagcgccgtccatgctcaccagcctcatcgccgggatccctagcttctcgtggaggtacgccatgcctcacaccacgccgacggcgatcctcatcctcgccggaccaatccagcaccaccct

SEQ ID NO: 72955 - DNA, 3779 bp, Oryza sativa
ccaaatcacaaatctctttcaagaacacacacacacaacacccataatcacaccaacgcaggcaagaatcacaggagagaggccctaaaaatccctcctttcccatctccgcatcaagcagaaaccacccaaaaacccaaaaaaaaggggcctttaactgacaagcgtagcaagagcagaatcactcttatcaccttcttgcgaagctggatctcactcacccagggcttgggattaccgagttcttggcgagatctagccggtgtgcaggaaacaaaagcaggagaaattttttgggtttggaggagcgaagcacggctgtgaatgatggtgggagaggagtgaggtggaaaggtggagagacagggtttactacacttttgctgctaaagcaccgggaatttaccactggtaggagtaatagcagctgtcatttagtttttcattttattagtcccaattaagctgcgggtttggatggtgatttttgcggattagcccggttcggtcagtgcctgccttgccggagcggaagctcgccgccgccgccgccgctgctgaccgtcgcagccaccgctgctgattgccacgcgtgcataggcgtcgcggtctccaagttgagatgtgtagggaaataattgcagcagaggtggccaaacgggccgggccaaacgggccgcccggggcacggccgaacctgtagcaggcacggcccggcacggcctgctacagtaacgggccgtgccggcacggcacgagtagccgtgccgtgcttgggccgctggccgagcccgcgggccggcatggcacggcacggctactgtagcaggccggcacggcacggcccgcggcacggcacggcccgtttcgccggtggcccgtcaggcgtggacagggcgggcggcggtcgaatgggaaggcgccacgtggcactaacggctatttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctctttgttctcaagtgtgcattttttttgattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacggctgtcgttgaggaggtaccggttcaggcggcgatagcttcggaaggattttccggaaccgcgagcggaagtgtttcgacacacaccggctcgaagagatcgagaacctccgttgtgtggcaaaacttcgacgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacgcagttgggagtacgatcccatggttgctcgggaatctcttgtccggttaatcgccagacaagatttacccctgaactttggggagtcccctgcttttgaacattacattcagcaatctcataaccctaggtttaaagctgtgagtagacaaacatcaactagagatttagagaatgtttatcacaaggaagcaactgcacttaaggaactgtttagtacatgtactttctctgttagtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgcatggaagaggttttgcaatgcggccggtgtgaaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaatttcaccaatttctagaaactttttatgattgtactctaactttgtcacaagtttattatccaactgctaatataattttgcacaaccttcttgaaattgctactttatttaaagaatacgaaaatgatgacgttctaactgaacctgtctttcacatgaaacaaaaatatttgaaatattggaaaaatatacctatgttgtatgcttttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcagagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttgtttggacagcgacgccatccaccacgaagcacaagatttcaacgtcctcgggtggtggaatgaccacaagataacatatcctgtgcgttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccagttcgagcaactctacctggatccagaccaaccccagtagaattttgttagaagtagttctgacctttgagctgtactcttttctttgtcatggttttctcattttcccctatgagtttttacatgacaaagtttttaacgaggcagcatgtatcattgtatcctgtaatgatataaacatcaataaaggtcattactatttttaacaaattcttttgcaatattttcgcaagtgtggatttatctttaaattatttcaaaataatgaatcacaatctaggtttttaatttttacaagggggatc

SEQ ID NO: 72956 - DNA, 10809 bp, Oryza sativa
cgatgtttgccaacgagtgaaagcagagcaccaaagaccagcaggtttactccaacctcttcaaatcccggaatggaaatgggaggagattggaatggactttataacaggactgccccggacatcatcgggtcacgattcaatttgggtagtcgtggatcgactcactaaggttgctcacttcataccagtacataccacgtatacgggcaaaaggttggcggagctctacctctcgagaatcatgtgtctacatggggtacccaaaaagattgtatctgatcgagggagtcagttcacttcaaagttctggcagaaactacaagaagaattggggacccgtttaaatttcagcacggcctatcacccgcaaactgatggtcagacagagcgagtcaatcaaatcttggaagatatgttgagagcttgcgctcttgattttggtggagcttgggacaaaagcttaccatatgcggaattctcgtataacaacagctaccaggccagtctacagatggcaccgtttgaagctctatacggccggaagtgccgcacacctctcttctgggatcagacaggcgaacgtcagctgttcggaacagaagtattagcggaagcagaagagaaagtcagaatcatcagggagagattgaggattgctcagtctcgacagaagagctacgcggataaccgtcgaagggagctaacttttgaggccggagattacgtgtatcttcgtgtcaccccgctccggggagtacaccgctttcagacaaaaggcaagttggcaccacgcttcgtgggaccgtacaaaattttggaacgaaggggagaagttgcctatcagctagaacttccatccactatgatcggcatccatgacgtgttccatgtgtcccaattaaagaagtgtttaagggtacctgaagaacaggctaattcggaacacattgatatccaagaggacctaacatatgtggagaagccggttcgcatacttgacactagcgaaaggagaaccagaaacaaggtcaccaggttttgccgtgttcagtggagtcatcattcggaagaggaagcgacctgggaaagggaagatgagttgaaagccgcccatccgtacctcttcaccagctccaccgaatctcggggccgagattccgtttaaggggggtaggtttgtcacaccccgaagttttcctcccaagtcaaaattgtaatttataattgaccctaagaaaatgctggtgaaatcaggagaaaaccctaagaaagtaatgcaaataataatcggatttgacatgtggaatttttcttgagttctacatgtcgaaattcattaacaggatttttagtggaattttcagagctctagaaataattttaaccaattaaaaatcactaaagtgcaattgttaattccagggaaaatcctttttccttttctttttctttttcctctcttttccctcctttttgtcaagtgggccgtcggcccacttctcccttccttcccctcccttactgggccggccgcaggccgaggcccagcccgacagccggccgcccgcctccctcctctcggggtcgccgacaggtggggcccacctgtcggacccgtctccctcctcccgccgatcccgctcgcgccgccaccgccgcaaccgacgccgcgcccacgcctccgtctctcccgggccacgtcgaccacgcccgcgcgtgcgccgcattccccgcgcccgttcccctccctctcccgctcgcgcccgcgcccgagatggccgggattcgaaaaccgaatcccgcctctctctcctccccactcccccacgtcggccgtcgaatcccgccgctcccggccacgtccggttcccccatcccctatttaagcatcaccggcaccccctctcgctttttccccattgcgccgacctctcccgagctccccaacgcctccgcgccgtgcaaccacccgccgccgccgcttttgctactccggccgccgctagccgccgctaggctcgccgccgtctcacgccgtcgccgccgttagcttcgcgcggccgaggtccacctcgtccacccctcctccgtcgaggttcgtcgccggagccctcatctccacgcgcacgggtgagcgccacctctaccgccgccttcggccatagatcccgatcgccatggtccatctctctctctctaatctctatcttctccttccttagggcacgccgaagctcgtccgctagccgacgccgtcctcccgtggcttgccgtcgccgtccgccatcgccttcctccgcgccggccaccctcggtgaggcatcccctcccttcttttccccttcctctcctctagccgccgctctccgccgccgtcggtcgtcgctttgcgccgctgccgcatgtgcgccgccgccgtgtgagcgccgcgccgccggcgccatggtcgccgccgtctcgcgccgcgcccgcgcgccccggccgcgaggtcccgcgccgccgtccgatctacccttgggtagatcggggccgtcggtccggtcgccacgtggcgccgccgcccaaccttttcccgtgccgctgaccggtgggccgcgcgccgccaccctctttctctctctcccggtcgctgaccggtgggccccgcctgtcggcgccgcgccccctcgctgacgtcagccctggttaatattgcgcaataaattatttaaggatttcttttatagtaataaacacagtgaatcttctaaaattcatatctaattcatccgagctccgtttaatcccattcaagtctcagtaaatcaagaaaaatgtgtagaatccattaaaaatggttttgttctctgtttcagtagtcttatagcctgtttgcaatgtttgctttgtatgtcgctagattccggttctttcgacgctccggtgtacttcgaaatagtcgccgaggtacctccagcagcagagcaaggcaagtcatgcttgtcacttgaacatgttgatcctatattgcaaatgctccattgttttctttcaaatattgcattgttttataatatcactatgggatggatacctactgctacagccatgcttttggatatcatgctcctttgttagcttgggttataacatgattagactttggactaggacttgcttagccatgcttagttcaactagcacacattggggatctcatttaaaacctagactataggtttatatgataatgttggtttaataccaccgctctggtgttggttaaataaaatgaaccacatggtgggctgtgggtgcacggttttgctagtcgcacccatggcagttaaggaccggttcgcaggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagtttaggtggatggttgggcctgtcgcaacgtgggttagcgttggacagcggatgtttaatactgcttaattattacaactgttttcgcattaaattcctgtttataaatgccagtatttatgcaaatgaaccactctagctcttctttgttaattccctgcatcatacccctattccggtatgacttgctgagtacagtgggtagtactcagtcttgctctacttttcccaaccccagaggacgggtatgtgtcagatgaaggtttctccgaggagtaggcttcgtccgtgccgtcgaggatgcctgtggagtggtgttcccgctgccgttcaagtcaaggcttagctccagtttcttttgtttttccgctgcatttctgtcagacctttataatgtttgtaagacgtggatctgtatgtcaacattgtcgtttgtgtaccccggctggtcctggacgggggttttaatacacattctgcttggaattctattcgggaatttctgggcgtgacaagttggtatcagagccgaccttgaccgtaggacaagccaaatggaaaaacctaagagccctctgaatcctttttcattgcatatgttcttcgcaattggatttgttccgggaaaatggggatctgttcttgtggttcaagggaaaaatcttggtcgctcgtttaaagtgagtttttcaaaacgagtcagtctagggttttagtaaattattgggatttattcgtcagtcagttgggatttgatgggtgaaatgcattcggtcctagctcggtatcatgggttgcaaggtatttatgctttgttcgttattattattatgtatctaatttcccattattttatcgttatgtgagtctgtcttatttattcgcgctcatgtaaaatgatctatgcataaaattttgctcttatttgattcctttatttgagtcctttattgctttatttaaatttggatttgagcatgcattgatcctactcctttgtcttctctagatggccggtcacccacccaaccaccgcggagaaggcatgatcgacttcgtggcagagctggcacgcatgacactggtagtgggctaccccgacgcgccggaatacacgaccattccgccgctcagtggcgagcttccttaccgtgtccgcttggaggtccatggctacgtggggacttgcctcgctaacatggcggtggaggcgtcaggaggcacagcagatcacgcctgtcaggaggcagcctacttgatgatggccagactacgggagcgccacgactacatcttccacgacacggcgtaccgctaccacccccgtcgagcccatggtgatggcgtcagctccttccgtccgacagctggcgagaacgacaccaccttcggtcacatgtgtgctgtgatgaggggattggaccggatgcactcggacctgcacaaggcgaccaaggccttgaatgatgggaagctcatgaggatcgtcgctctgaaggacgagatagcgcgcctgaagaaggagaatgctcagttgaagggtcttccagcaccaggaggagtccggatccgcactacgccccgtaagaggacgactgcacccgtgcgcatccagcttgcgcccaggaacccacctccaccagcagctcccgcagcacctccagttccgcccgcagttcctgcagctccagcttcagctccagctccagctcccgcgttcactctttccttcgctccagcatcagccgccagaggtccagccagtggtaccggaggttggttgtccgctactcccagtggcagcggcgagactgatctgtcaggctccaggagtcgttcagagggaccaggtgacgagcaggaggacgctttcgactccaccgaccgcaggagccgttccgagcattaggctcgttttcccattagtttatcgattgtctagtttctgcttgttagtttgtgtgtttaggttgcttgtttggggtcagtcgacggtcgatatcatgtgcctatgatatggctgtcttaataaggatttttgcttgcctttttaagtgttttaattcagatcagaacaattgcagttttaattcctatataataaagcttagttcttgagcatctgtttttcttcttctcccccgtctgctttcccctccagatggtctacaccaggactggcaaccgcacgacaggcgagggcagcaacggtgaagaacgcgctgatggtgtgcaccccaacagtgattccggcaatggtccgccaccacttcccgagaatccgacccttgcccaagttatggcacatcaaactcagatgatggcagccatgatgcagcagatgcagcagcagcaccagcagatgcaccagaggatgatgcagcacgccgaacagcagcaccagcagtttggtccccctccccctcagtccaagttgccagaatttctacgcgtcaggccacccaccttctccagcaccaccaaccccatggaggcgaatgactggctccatgcaatagagaagaagctgaacctcctgcagtgtaatgatcaggagaaggtcgcttttgccacacaccagcttcagggtcctgcgtcagcttggtgggacaaccacatggccacccgcccaccgggtactgaagtcacatgggcagagttctgccgtagcttcaggaaggcacaggtgccagacggggtcgtggcacaaaagaagagggaattccgggagctccatcagggcaacaggactgtgacagagtacctccatgagttcaatcgcctcgcgcgatatgcaccagaggatgtccgcaccgacgccgagaagcaggagaagttcatggcgggtctggatgacgagctgaccaaccaactgatatctggggactacgccgactttgagaggctggttgacaaggcaatccgccaggaggatcaacgcaacaagatggataggaagaggaaggccgctcagttcagggcacatcagggaagtcaccagaggctgcgcttcactcccgggcagcagggtggacctaccaccatgatcgtccgtcagcaccgcccgttcaaccccagcaacttccaccagggctccagtggcagccagaatcaccatggaagtcagcccaaccgcggtacagctccacgcccaccgatggcaccggcacagtcaggcccgcccgcacaagccaagaaggagacgggagcaaagccagggtcctgcttcaactgtggcgagcttggccacttcgctgacaaatgcccgaagcccaggcgtgccgggccaaggtttatccaggctcgtgtcaaccacgcatctgcggaggaggcacaagcagcaccagaggttgtactgggtacgtttcctgttaactcaatccctgcaacagtactttttgattctggtgcaacgcattctttcatctccaagaaatttgtcgggatgcatgggttaataagagaggaacttagcacaccgatgcgggttcataccccagggaatagctccacttcggttcaattcagcccttctataacaatagaaattcaaaggtcaccgtttctagccaacctcatccttctcgaatccaaagacctagatgtcattcttgggatggattggctgaccaagtttaagggagtcatcgattgtgcgaatcgcacagtcaccctgaccaatgagaaaggagaaaccgtggtgtacaaatctctagtctcgccaaagaaaggagcctcgttgaatcagattgagacggaaatcccagtggacatcgaagagaagaacttgagaaaattggaggacatacccatagtctgcgagtatccagaggtgttccccgaagacctcaccaccatgccacccaagagggagattgaattccggattgatttggcaccaggaaccgctccaatctataagagaccgtacagaatggcggccaacgaattagcggaggtcaagaagcaagttgatgagcagctgcagaaagggtacatacgaccaagcacttcaccttggggcgctccggtcatttttgtggagaaaaaggataagacgaagaggatgtgcgtcgattatcgcgcacttaacgaggtcacaatcaagaataaatatcccttaccgcgaatcgacgatttatttgatcaactgaaaggagctaaagtgttctctaagatagacctgcgatcaggctaccaccagttgagaacccgggaagaggatattccgaagacggccttcaccactcggtacgggctatatgagtgcacggttatgtctttcggacttaccaacgcacccgcattcttcatgaatctgatgaacaaagtgttcatggaatttctggacaagtttgttgtggtattcatcgacgacattcttatctattcaaagtccgaggaagaacatgaacaacatctccgtctggtactcgagaagttgaaggagcaccagctatacgccaagttcagcaagtgtgacttctggttgacggaagtaaaatttctgggtcatgtcattacagctcagggtgtggcagtcgacccatcgaacgtggagtcagttaccaaatggaccccacctaagaccgtgtcgcagattcgaagttttctaggactggctggttattaccgtcgtttcatcgaaaacttctcaagaatcgcccgacccatgactcagttgcttaagaaagacgagaagtttaaatggacagctgagtgcgacaagagctttgaggagctcaaaaggaaattagtatccgcaccggtgttgatcctgcccgaccagacgaaagacttccaagtctattgcgatgcctcccgtcacggacttggatgtgtcctaatgcaagagggcagagtggttgcatatgcctcgcggcagttgcgtccacacgaaggaaattatccaactcatgacttggaattggcagcagtggttcatgctttgaagatctggaggcactatctgattggcaaccgctgcgaagtatatacggaccataagagtctgaagtacatcttcacccaaccggacctaaatctccgacaacgaagatggttggaactaatcaaagactacgacatgagtattcactaccacccgggtaaagccaatgtggtggcagacgctttaagccggaaaagttactgcactgccctatgcatcgagggcatgtgtgaggaattgcggcaggagtttgagcatctcaacgtgggaattgttgaacacgggttcgtagccgctctggaggcacggcctacgctcgtggatcaagttagagccgctcaagtaaatgatccggaaatagcagaactgaaaaagaacatgagagtcggaaaggctcgggatttccttgaggatgagcatggcacaatctggatgggagaaagattgtgtgtaccggacgacaaggaattgaaggatctgatactcaccgaagctcatcagacccagtactccattcatccaggcagcactaaaatgtatcaagacctcaaagagaagttttggtgggtcagcatgaggagagaaatagctgaattcgtcgcactctgcgatgtttgccaacgagtgaaagcagagcaccaaagaccagcaggtttactccaacctcttcaaatcccggaatggaaatgggaggagattggaatggactttataacaggactgccccggacatcatcgggtcacgattcaatttgggtagtcgtggatcgactcactaaggttgctcacttcataccagtacataccacgtatacgggcaaaaggttggcggagctctacctctcgagaatcatgtgtctacatggggtacccaaaaagattgtatctgatcgagggagtcagttcacttcaaagttctggcagaaactacaagaagaattggggacccgtttaaatttcagcacggcctatcacccgcaaactgatggtcagacagagcgagtcaatcaaatcttggaagatatgttgagagcttgcgctcttgattttggtggagcttgggacaaaagcttaccatatgcggaattctcgtataacaacagctaccaggccagtctacagatggcaccgtttgaagctctatacggccggaagtgccgcacacctctcttctgggatcagacaggcgaacgtcagctgttcggaacagaagtattagcggaagcagaagagaaagtcagaatcatcagggagagattgaggattgctcagtctcgacagaagagctacgcggataaccgtcgaagggagctaacttttgaggccggagattacgtgtatcttcgtgtcaccccgctccggggagtacaccgctttcagacaaaaggcaagttggcaccacgcttcgtgggaccgtacaaaattttggaacgaaggggagaagttgcctatcagctagaacttccatccactatgatcggcatccatgacgtgttccatgtgtcccaattaaagaagtgtttaagggtacctgaagaacaggctaattcggaacacattgatatccaagaggacctaacatatgtggagaagccggttcgcatacttgacactagcgaaaggagaaccagaaacaaggtcaccaggttttgccgtgttcagtggagtcatcattcggaagaggaagcgacctgggaaagggaagatgagttgaaagccgcccatccgtacctcttcaccagctccaccgaatctcggggccgagattccgtttaaggggggtaggtttgtcacaccccgaagttttcctcccaagtcaaaattgtaatttataattgaccctaagaaaatgctggtgaaatcaggagaaaaccctaagaaagtaatgcaaataataatcggatttgacatgtggaatttttcttgagttctacatgtcgaaattcattaacaggatttttagtggaattttcagagctctagaaataattttaaccaattaaaaatcactaaagtgcaatcgttacttccagggaaaatcctttttccttttctttttcttttt

SEQ ID NO: 72957 - DNA, 5093 bp, Oryza sativa
atttttgttgctacagagctagcccaatcaactcagaggtatcgatctttgttagctgcaaatgcaagagcatcaggttctctccaagacggataatgaattggactcataacagtagtctactactactatgcaaagaattgcaaatatattcaggaaagcacttctcagtgtgatagtggacactccatagcaaagatatttttgtgtcacttttgaaaggaagctttgatctttttgatgtgctggccttgtgaaatatctacaagttggcgattgcaacctttaaaaggtatccattaattattaatttactgttttaggactagcttgtgatgtctgagagaaaaaaaaaacaaagtgaatcaagttcagcacatacagctatagtttttgtgttatgtttggtttagttggttgttggttaaattaacttccaaattatggttccaacttgcaaactttgttagatttcactttctggcttctgaacgtgtttgtatttctacaaacaaaaaaaaagatgtttggttcaattaatgtagccttacagttgctgaagagattctcttgaaattaaataaaagttgcagcagacatgcatggctagttatgttactgaaaataaatcctttttactgatcattaaatacttttaactgctcttaattaattggcaatagctaggtaaatcttggcataaaaatcattacctcagaaatgggtacaaactgcatatatgtttttttttgggtatatccttctttggtaaaagaaggaaaactgggaaattaaccatgaaataagggtgaatcataagttcttgttttatcaatcattgggagttcattatgtacacttctgtttcattctttgaacttgtaatataattcaataaagtgtctgataatttatcttttaaaataaagttttgcccacacatcccaccaagtcatggtatggccaaaactaaggtttatttctaaattaaaaataagttaccggatcacttttaaaatccaactaaatggttcaaaacacaaaaattgaaattggccagtatctccacaggctaataatattagagagaattggtagcactagtgcagcttgctagctaacattccatcaaattctagatatgttagagtgtaaactagagagaattggtagtagcctttattagattgcattgagcatcatgggttgtttatatggagtaacagattggagggcatgaagcttgatctcctaggtaaggcaacccatacagataagtcagatgagatacttaaaatcctagtatatagtagatatggagatatatattccaaacatacttaacaaagagggcattgtaggattatacagcaataactaaaccaatcagggggagggtgaatgattgaactacccaaaaaccaaaacttttagcagaattaaaagttacattcgaatagatagagcttggtctgactggagttgatgcgccggtctaaccacacaggtgcctccggtctgaccagtgtagtcgctctagtctgaccgtcctttgcgtagctgtcgcctgcttctgatacttaaatcctagtatacttgatatggagatatatatattccaaacatacttaacatatagagaacatatacctgctagtccacttgaaacaaacatatctaagttccaaatgtttcagtctcaaaggagaaagttcgttcaataaaaaacactctcaaaggagaaagaaagatgctagtttttctgtacacaattggaggggtagtaaatttgcaatctgttttttttgcatattggagcatggcgatgtggaaattgaagtatcacaggtgaaataggcacaatttctaaaacaatttattaccatgaagtttcaagacacaaaatggggccttttagccctttacatgactggtagtagccacttttgtatcttatatatatgtcattacaagcatgtcacacaattattgacatataataaacttatacatatatggattattacgttcatggcatctagcgacaccgtggtagatgactggccagttacacatgacatatgacagagcctataaccatcatccctagttatcccaagtagaaactcacattttccctagtaaaccatgcgtgctaattagttgttatgtatagccactagacgatgacgtacaccgtctatttctccgatcataacttagttgttcattctagccactgggacgatgtcgtctggttttccagccacagctccaacccgaacaacggtgacggccatgctttcggcctgacctgttatcggcgatatcctgcttgtggtcgctgatggcttggtgacgaggttgtaagcctggatcttctccaccttcctcaccctcaccacaccttcaaccgggagatcgctgctcatgttcttggctccagtgcggaacatcttctccctccctttctacaccgcccctctttgatcagatgatggagatcagcctagctaggtatatctatcacagttaggagggatttcaagctctagctagcaagatggtacatgttcttgtgtgagcttgccttggccaccatttatactcctagacaactaggagttgtgttcttgtgggactctgcagtgtctccatggagatgccaattgtacagtgagagcaatcaatcaatggagaaatatgtaatggttgctgctgtttggtcgacgtggctgcacttttttggattggatattttttttttgaaaagaattttggattggatatgatgctgtgctatctgttcggttgttgctgtgcagagtgcttatcgttttgggcatcttgattccaatcaattaatatcagtctgatcttttttttgcacccatgtggaaatatcgatcccgaattcgcatcgatgctcttgatcaaaagtgaaaactcatgctgtcctggatcattcaataattaagcctcgtgctagcgcgctgcaggcatttgtgagcatatggaatatatatagcccctatttttttcggcttgagcatattgacttagatttttaagatgcttttatagggttatggttttataaaccggtggatatttagattttatttcaaatgtagagttatactctaatccacatatataagtcaatatagtttctcaaatatagttttttggttcaattgtgcaagaatggtttatggattatatatgactttaaaaagccaattgaaaatattgctagtttgtttagactttggcttttagacttataaagcactcataggaggtccaaacaaaaagggctatagaatcgtaaccaatagctatgattgaggtatgtttcatggaaaaaaattatgccaagtgttatatatatggagtgtaaatttaattagaatgtaaatatctgaatctgcatgcgaattccgatcatgcatctgtatacttttggttatataaatcaattaaggagaaattttcatatttttgctgatgatcatccaaagcttttaagcttcattgacacactaccaatctcatgcttatttacctaacaaagagaaatcaagcgtgctgcacgttgcatgctaaatataattaattcaaaagcttaggatctccaataactgagcacagtggagaaaagtttcaggatgcagctgcttttttttcatatataatatataaaagcccatatatatatgcatgctcttttgtcggagagatatatagattttattagtcaactattgaactatatttatctccaagcatatatgtccctggcccaagctgtgtcgagtttttatacgctgtcgccaattaattattgcgacaatagtttggcaatccttgtatgacaaattaaataattaaattatcagtgttaaagtacattgcatgtaaatttaccggttgttgtccttcacttttaattttttacattcattttagataatagaaatatatggtttaagcttgattaattatgtgagcaaaaaattatccaaatatatatgagattttcttccatccttgaatatatacctccatatatactacttcaaaagaaaaaaaaaataaattgattgaaccgattagaaccagagtcccactccggtgctctttacttattagaaagcaatatgaaccattaatctaatttgattgaaggtttcagatctatttctactaccacatcatttaacggtagagagcaccagggcatataaaagttatatatacctcaattttggacaggaattatatacctctgactaaaaactaaatatttatacatctcccaaagattattgaagtaacacatcaaaaacatatatgtataatgtatgtgaatttgaatcctacactaacttgtgagattagttttgatacatcacttattgaagagcagtctcatcaagtgatgatatgagagatatattcctgtccaaggatgacagagaatctctatatgtaaccagagatttatttaatatattcactgtctgcaagcccactcgacatcaattacaacgaaaaattaaatggcatagtgcacaccagagacaaagctgtacttttccttttgcaagagaaataactgtagcttgtgttggtctatattaaaatgttcggtttctcatatcatgagtggctttaagttttttggatgaactaatattctgttcattaaactaacaatcaaattaacatgcaagtaggacaacacatgtgctaccaccatgtaggaaacaaaactatcaacatatataaaaaaaaccgaagtagaagatgtgctgccttattgtgatatatatatatatatatatatatatatatatatatatatatatatatatcgactctttgaaacatgtcaaaataacatgaacagtttataattaagaaaggcttgtgcctcgtgtgtgacttttgtccaatcaggtatatttcaacgtctccatcaaaattaaaattaagggcttctttcaaacatggaaaatttacaagaacttaaataatagtatttagttcaaatttcctaaaaaaaatccttcatttttcaaagtaag

SEQ ID NO: 72958 - DNA, 4752 bp, Oryza sativa
  unsure (1)..(4752): unsure at all n locations
atgctataaactcggcatacatagtagaccctgcagtgatagtctgttttgagcttttccatgaaatagctcctcctgccagggtaaacacgtatcccgatgttgactttgtattatcttttgcaaagtcagaatctgagtaccccactatctggagtgattctgatcttctgtaagtcagcatgaggccttttgttccttgcaaataacgcaagactttctttaccaatttccagtgctctaggcctggattactctgaaatctgccaagtaacccggtaacaaatgccaagtcaggtcgtgtgcacacttgcgcgtactgtaggcttcctacagctgacgcatatggctttgttttcatttcattgagctcatactgatttctgggacattgcgatgccccatacttttcgcctttcattataggagcaggtgtagcactgcatctgtacatgttgaatttcttcaacaccttttctatatatgtcttttgagaaagtcccaatgcatactttgttctatctcggtgaatctctatgcccaaaacatatgaagcctcaccgaggtctttcatgtcaaagtttgaggacaagaatttctttgtttcctgcagtagactgacatcactactagccagtagaatgtcatccacatacagaattaggaaaataaatctcccattcttaaactttgaataaatacagttgtcctcgacattctcttgaaacccaaatttctttattgtcccatcaaacttcaagtaccactgtctcgaagcttgctttaatccataaatggatctctttagacgacatcccatattttcgtttcctttcatgacaaaacctttcggttgcgccatgtatactttttcctccaaatctccatttagaaatgccgtttttacatccatctgatgtaattccaaatcataatgtgccactagtgccattataatcctgaaggaatctttacaagagactggagaaaatgtctcattgtaatcaatcccttctcgttgcgtgaagccttttgccacaagtcgcgctttaaacttttctatattccctctggagtcatatttggttttgtagacccatttacagcctactgttttggctcctttaggaatttcttctaaatcccaaacattgtttagtttcattgatttcatttcatctttcatggcttccaaccattcagatgagcgagcgcttctcatggcctcttcatatgaggtgggatcatcctccatatgcgactcttctatattataaactttatagtcatcacggatagccgatcttctgactctttcagaccttctaggggcctgcacatttggcacatcctgtacctgaggctcttgatgagtctcctgtactggcacattatctatttgaggctgttgtagctcctcctctggtgtgacaaccatttctgttgaatcctgtataacaggttcctcactctcattcattgttgccacaggaggggtaacaacaggtgctggtacctcaatgacaggcattgcaggcacaacatcagcaggtagagagaagaaaggttcctgagtcgacggagcgggtacagacacccgcctctcctcaagatcaatttctcgaactaccgagctccccctaatcatttcgtcttccaagaagacggcgtgtctcgtttctacaaactttgtataactgtttggacagtagaaacgatagccttttgatctttcaggatagccaataaaatggcagctgactgttttggggtccaacttcccaatatttgggttaaatactttggcctctgcaggactcccccacacacggaggtgagttagcgagggtactctccctgtccatagctcatacggtgttttgggtaccgatttgcttggaactctgttgagaatatgaatgtcggttttaacgccctccatccataaaccgagtggtagtgtgnagtagctcatcatgctgggcacaatatccataagcgtacggttgagccttttcagctaccccattctgttgaggttcgcccggtgttgaatactgggctactattccattctctagcaagaaccttgcaaaaggtctagggacttgcccataaggcgtatgtcgaccatagtactctcccccacggtcagatcttagtactttaatctttatatcaagctgattttcaacttcagctttgaatatcttaaatttatccagtgcttctgatcgctctttaattggataaatataaccatagcgggagtaatcatctgtgaatgttatgaacgagtcatagccatccacactttttacaggaaatggaccacaaatatctgtatgaatgatctataaaattcctgcgcttcgttttgcaccctttttgatgctctttacaaattttcctttaatgcattctatgcattgttctaagtctgagaactccaatggaggaagaatttcattcttaactagtctctcaattctccccctcgaaatatggcccaaacgacagtgccataatttcgatgagacatcgggagttcgctttcttttcttgttttcttttgtcaacgaggacacaacattcacattctcagaaagagataacaaataaagctcgtctcgcaacacagcaagaccaatacatgcattattatgccatagttcacatttgccacttccaaagcggcaatcatatccatcaaaatccaactttgatacacttattaagtttctttgcaaagaaggaacataaaagacatctcgaagtaaaagtgtgaagccattcgcgagctctagcggaagatctccaacagcttcaactttttcttcaactccattggcaactctaatggtgctttctcttccttgcgtagtcctcgtcgaacggaatgcctttaaacaattacaagcatgaatagttgctccagaatcaatccaccatgtggatctagagtaaccaacataatgagattcatttacaaatgtaataatgttctcacctttctttgccatgatcattttcaaaaagtcaggacaatctttcttgtagtgtcctgtcttcttgcagtggagacattgatctttctcaacagcgaactgttgttgctgaggcagatgctgagactgtttaccttttgaggtgggagacttgtggttctttttcttatctttaacatagtttattgaaccaccatttgattctttgattctctcctcctctgcacacaattagcaatgagcttctcaaagttccatttctctggacttatgttgtagttgacaataaaatgtcaaactgctttggcaatgaggccataaccagatggaccagaaagtcatctgttatgcccaaatccattggcttcaacttggaagccatgttgctcattctaagtatgtggtctctaacaccacctccatggtacctttctgtcacaagctgcttgatcagctgtgtagcataagtctttgaagagccagtaaactgactctttattctttcaaggtactctgagacagcgtcacactctgggatcgagcccaatatggtaggctcaatcgtattctttaccacagccaaacatttcttgttggctaaggaccatttcttttgttcaatgtcatacgacatgacgagaggagcattgtccctctgtctcttttgccagtcagcatctgactcattttcacctctgacaagttcagcaggttctataggacatggggtagtcaatacccagtccacctctcccaagataaaagcaaggtcgagttttcttttccattctgcgtagttatctccttttagggtcggaatatctttaatgcaacccatcaaggagtagccacctgaaataatcatgtgcggtgagaacaaaattaacattaaaatattatgcattaagcctacatcaccgttgggcagaattagacataacacatataaccataactataatattgtaattaacaacgttggtcagaaaattacaacatcatagcacatacttaatgttcctaaaattaaattctcccgttggtttgaaatttaattttagaaacactaattttcatcaattacatctatttgcagcggaaaactatataaaaatcatatgaacagtagcaaaatctctgtaattctctctctgtgaaaattctcccgttggttcaaatttaaacagaggtaaaacatgcaaaaaactattcaaaattctattgaaatttgcatgaaaattgacaaaataaaaattgctactgttctcttttattcatttttcggccccgaagggaccttatatggacttcttccggcctttgccggtcggcccatggccaccttgcgcgcgggcgagcgccccctcctctcccccaggccgcaacctgggcctgggcgggagaagccgccgccgcgcgctccccacttgggccgctttcggcccgagccgccgtcggccgtccgatcgctagggtttcgatcggacggccgggaggggagatcgggagaccaaaacccgacccccaggccgccggaaaccctagctcttcttctctcgcgggcgcgtggccgcgccgagcggcgtcgccgacgccggcggccctcgcgccgccccgccatgaccggcgcgcctttcttttctcttcttctccgctcgccccaccgtctctaacccccaccgtgtgagagagagatggcgacgacggagatggcggcgccgccgcgggccccctcgccggcatg

SEQ ID NO: 72959 - DNA, 10834 bp, Oryza sativa
gacatagaaaaaaacatattttttgatggatggagtactagctagagtagtagcatcggattaataatgaacttcaacaacaactttcgtgcaactcgatatactatgtactaaccccgtcacaaaataaattcacttttcatccatcccacacgctaccaatatacaaaacaaaaaactaaaatactcttatttcatcaaatcctaatgcaactcttactcattttatttatttttaatgtaattattctctactttcacaaacacagatacgatgagtactttaaagacaaacttatttttgagataaatgaaatgagttaaaaaagaacttattacgggacagcagaaagtactatagctagctagaccttatcttccaaatcagaataaccaacaatctaaagcaatgagaatagcatgtaagaatcatcaggagactaaccatctccttaaagcttcctcgcaaacaaacacataaagaaaaattagactacttagggtgtgtttagttcatatcaaaattagaaatttggttaaaattggaacgatatgatggaaaagttggaagtttactccgtgtgtaggaaagttttgatgtgatggaaaagttgaaagtttgacttattgtaatattttggcagcctcgatcgctagcctagctatatatataataactaataagtagtaccatgtcccatctctgctagtcaagtctctctgtctttctctcgacttgaattttcatcgatcggttttaccggcaagcatggcgtcgcggcgggccgccggcagcgtgggcgtcgtcgccggcgacggccaagctgctgctgtctgcgtcgacaaggtggcgaagattggccggcagcgggaagacgtcgatggcgtcggcggcggcggcgacgacgcggcggtggcggtggcggtggacagggtggaggagatcggcggcaacggcgtggacatctgggctcagatcttcatcgaccagacgagaaggaagatgaattcgcagctaaataagtaaaaaatatcactctccgtcctaaaatatattagattttgattgatgtaatacattttatactaatctcattcaaccaaaatctcttatatttgagaatggggtatactaactgcacatatagttattaaggatatatagataagtaattagctgcgaccatttgtgattgtaatttctttcaacagtgtgtataacgtacaaaactcgtgtgttatcgatgaatttatttattattgcactcaatgatcagttacggtaagtacaacttggggagccaatcgaccattcgaccgtgttaattttgtttaatttctcgttttgcttgtactcacaattttgtgaacctcaactgttgggcttcctaaatgtggcccatctaatgcgccccggcccatgcatgtgaaggtgccaatgcacatagagtaaaagtatatgagatggattggaaacttattaatttctccgtttcacaatgtaattcattctagcatttgaatgcgatgttaattgtagcgcccgtttcgtcgtggcgcctagcgggaaaactatctcttaaaaaccctaattgcgaaatccgtttctttgcttgttgtctagtgtccgtgccatctcatatctcaaatccctccgcaaaagtctatcttgcctccctcgggttcgatgggccgaattcctctcggcccatctctccctccctccccatctctctctctctctctccctctcccccactctgcccgtgcgctgcacacgcgtgcgcgtgagccgcgccgagccgagcgccctccgccttcgccgccgcttcccgccgatgccacccaaatcgcagcgccgcccgcgcgcgcgcacgccgtggtggccgatcggccagtcgccgccgccgtcagcgcctgctgcgcctgccccgcgtctgccgcccgagtcgctgctccgttccaaaccgccccgccgtcatcgccgtcgtcatcgactcggccccgcctctccccgcgcgtgcctccaagggacggaggcagagcttcccccctccgccgcgtcgccctctctccctcctccttttccccaaagtggcaagggggcaagccccctttccctcctccctttttcccttttctcttcccagccggcgtcatccacctctgtcgccgttttggccgcgagcgccgagcgccagctcgcgccttgaccgcccaaggtcggtttccaaaccgacattgccgccctataagcccaggcaccctccctcccttctcctctcgtttgtcccaccgcctccactccattgtcgccgcctcccgtgctctgttcgccgccgcctttcgtgcctcgcgtgccggaggagccggcacgttcgtggacgcggaaggggactccaggagctcgtcttcttcctcttccccggcccgaggccggagagaacactcccgcgccgtcggcccctcgtcactgcaccccgtcccgcacggtagtgcatccctccgttctccctcctcgcaacatctcttccccttagctttgagtagccgctcgagtagtaccccagtagttagctggcgccgttccgactgctgtcgtcgctcgccgtgtgctcgccgccgtcgccgcccgagctcggaagcgtctctcgtcgccggcctccctcgatgcgtttcctcctaatccggcgcaagcgatgggttcccgtagccgcgtagatgctctcaccgccgggaatcggcccctcgagacctcgtcgccgtttccccctttcctctccgccggttgccgccgccgcaatccgccgccgacggactccctccggcgaatccaagccgttggctcgctccctctcgttctccctcgtcatcccagtgtacgccccgtcacccctcgtcgtcgcacggcgtcccggagaaaccgccgccgcccgccgtccattcgcggccggcgccttcgtcttcctccagccggcccgcgtggcagccacgtaggcaccacgtcggcgccacctcggccgcgaccggatcggctgacccggccagccgctccctccgttcccccccccgtgcgcatggtccacggtgagccgtgaggctgcgcgtgggcccgccgcaccgcgtcctccgcgaaccgcgcgcatgcaccgcgcctccctccccaaaccctagcacgccccgcgtgcacctcactcacggtgagccgagtcgccgacaagcgggtcccactcgggaccacacgggatggacccggcccaccggctctctctctctcctccccacccgcacgcgcgccttgggccgccttcttgggccggccggcccattaagctcggccgagccgcccctttctctcgggccgcgccctagccgcccgaggaaagtctaatttccctccctccttcttttcttttcttttctttttctaaaaggatttaaataaatccttttcctttagaccaaaaatccaataatgttagaaattcaatatcttcccaaccgtaagcccgtttgactccgttcaacttccaaaactcctcaaatctcgagatctatctaatggcatgcctagaggtcaataatagggctttattttcgccgtttgttgagttgtcccatttcgcgtgtagtttcggagcccgaagacccgcagtgcgaggatttcgaggatcaagctcaagatctcgagcaaggcaagccacctttgaacatcttgaacctatatttgaacgtaattatattgcttgcaaaatattatacattgataggagtgcacttaatctgtttgccccgtctgcaaggcagaccggtgggcctacctaacttgttgcatttgatccttccgttgttaattgttatatcatgttcccttgtaaccacctagttgcgcctcggtaatcgtgcactctgtacgagtatcgacggtcgccttcaaacttaaaatctgagaaacatcttgggtaaaacttgggttttacaaaagacttggaaaacccgacacctgggtcggtgcttgcaaactaaatgaatttccaaaatcgcggaccggggaacgtaccgggtgtacggtttcccgctcttgcacttaaggaccgtttccttggaatttcatccgaacataagacaagtgcgaccacatgggtggaatgggacacccctggctgagtaattagctaatcaggggagccttgatgctgagagacaagtggattcgccgaggtggtgtcggggaggacccctgggcttcctggcacagtatggtctgggacctaacctgttgttggtctgggacccctctcgtcagcatatggtgaacctgtgtcggctttcgaaatgccttgtcatgaaagccctaaggtctctagtcgtggccgttctgcacgggctggatgatccgggttagtaattagtaatgtcgtgtgggtaaagtgtaccccctctgcagaggttattaaactgttcgaacagccgtgcccacggtcatgggcggatgtgaggtgattccttgcgtagttttgtttgactactgctttgtgaaatttgctgatgtggtttgggattgatgtttggaaaatctgcggctgatgggatcagccaggcccgggtggccgtttgaaagttgttggccgggtgccaatcctgatcaattcaaaagactgatacattgcacatactccgaccggacgagacgcactgtctcatccgtgtcgtttgagaagcactcacttagttgtttcagaaaagagtttaaataaaattaattgcaaaaacaacagcctttccttgaagcctgcataaaatacttatttcccatggcttgctgagtatccctgtacccacccttgctctatataaataatctcccccagttgctgaagaagatgaagcggaacccgctgacgaggagttcttccaggagcaagtcggccccgatgagttttagggtttcggcctagttcccaagtcgcgcctgtgatgtgtggtccaagtcttggcttccgcttcccttatgtaatgcagttgtgagctcgggatctgtccgcagcccaacatgactgtacccctactctataataaagagacctctgttgctgtgatattctgtcttcctgtgataccagcactgtttcctgggactggtatcgattaacaggttaatttggagcgtcacgggctagtcccgctcggggctagttcggggcgtgacattaatgaatctagatagatatatatgtctagatttattaacatcaatatgaatgtgacaaaagctagaatgacttacattgtgaaatggagggagtataaacttttctataaaagtgtcagggttacgggttaggtataccctttacccttcgatatacgtcgcatatcggtatggcatacccacgcgcatacggatattctctgcatacattaaggaaatccttcacggaatttacggatggaaagagttctactcggacaagactgggtcgtcaatgtatcgtgtaaggtctgatgtctccgagttctacttggaaaccgcttgacctgcgatataaagggaccccccggggaggacctagggatcgaatctcagagccaacacaaccctcacagcctacgaagtcagagcctgcaaggagccaaatcgccggggatctagtcgaaccaactcgactacgaactcgccggatccgtcgagttccattgttcccattgtaaactggattagggctattacctatcaaggggcctgaaccagtataatctttgtctttgatttgcttgatgtcgtattacgtagattcttgtaccaacgtaccccaataccctctatatccggtctacgggtatcacccgtcgacaaaaagttcttaagaaatctttaaaaaatcactcagataggtaatatgtaaataaacaattctataaaatttcatggacaaactcaatgtgatacaaaattaacaaataatactatttttgtttgtctttttttctccaatgtttctctatttaatatctcacggataaagttgagtttatcatcgaactttaaagtgttgtctaatattatgttaactatctgtgagatatttttttttcaatttttttgaaaacttgtatatatcatcttttcttcaatgtttctcaattttatatctcagacaccgatagatatgaaatgtttcaaataactgatcatataagacaaattccagtacaaaaccaaatcgccgcctctgcatacatttcctatctattttcacatgaatgatatgatgcatgcatatttatatatatgtgagaatggaacttataatttaactcttataatataccttgttcgttcctgcctagcgaagctaagccaaatctagtacatggctggccttctgacgtatgccaagtgatatcagcaacgcacacataacacataatacatcacgcgtgtgattttaggagaaatcatgtgaatttctgaccttcagaaacgatcgtgtatgcgcatcgcatataccatgaagaggacgaaatctttgtttgaaaaagaaacttttgatgaaagcgttagcggttgacgccttcgattattattcagttcttactactatacaggcatatacaactcagtgcacgtatatcgctatcgatatctttgtgcctgatactctcttaagcgtaaaaccctttttttgccatacgtatgtttgtcccttgatggatcagctggattgtgcgctaggtagctcccttcattattttagttcactatactttcagtttttaacatgtgttactgttactatttctgtcactaccagaacacaacacccgtgctgcctcgtcagtgttggttagccaaaagccaacattaatgggatttctctctccgcgcgcgtccaatctgaccaactactagcacttatgactattcactagtgcctttattttttaattgaaccagcatcaaaagaatgtgagtcgaccaaatcaaaacgagccaattttttaagtcggactccggaatctagattggtcgatccccttttcctcctccctgtccatctccccctactcgcagatgataaggtgtatttgaatttagattgaatatgtgatgttgatttgtatttgtcagtgttgatctatgcatattgatttgtgagtgtgtccattgatgtgtttgtgagatgttgatgttgatttggatatgaggatttagacatttggtattgagttgatctaggcatccatcgatttggacgagccagctctttttttttttagcttgtcaacctcatcagccagctcataggtgcccatatatatattattgtgccggttggggacccatttaccggcactgatgagagagggctcatcagtgccctattgttgtgccagttggggactcatcatagatgagagtctccaaccggcactaaagttgttccctgtcgtaatgtgtaaactaaaaaccatagcctttacaaagtaattaatttaattataccatatagatgtaagaagtaatattcaaaacaagtatttcctctatccaaaatatgagcattccaaacgtttaaaatttatttataaatttagggatttctaagaactacttgttacatcaatttatctctcattcaaattactttccatcttatatccttaatcatcctcctatctccaaccgtcctttatttaatgaaggacacaaagctcttttctccttagtcttaatctccactaaacatgtataaatgtttgacatggcacatgtacataaccaattagatggaattggacaagtaacattcgaacatgagctacaattagcatagcataaagcttaaataaggcagtaaagtagtaattaaaccgaatgaaccctaggcctacttggaatgtctgtttctggtccaaaacggtgtaaaatactggcctatatcatttttcagttggactgaaaaacacccttggagaagttgtatctcggattataattcggcatggtatgcccattaccataaaaaaaataatctcataacacgcaaaagggaaaataagttggccgattaagtgctctccgcccagcaccgacgccagcctcttctttgcccatgcccccacagccaaggctccacatcacgaccatcttcttcttccagatgccaccacctcctcctctcccaggatctgctttctctcatgcgcaccggatccgctaccttctccgccctgttgccgttgccagtgctcctcagcacgcgttgccttcctcaccgcaccaccccatcaacaagcttagtcttttccttgaggtcgatggcaccctctccagtgtccttatgagttttgagttgttggcatcatcttggagttgcattgtgcctccacagctcagtgataacttgtgcttgccacttctcttccagttcaaatacatattccaaaattttcaattaccgtgttgatgattcttgtatatcttctacttaatccaaactttcttgttccaattcgatgttccatttatgttttgatgaatagcgatgtctcgaactgaattgaccattcgcttatccagttctttatgagagaaaactttcacttttgtgccttctcccaaatagctcagctagggatttccttttcaccggtattcaatttttttttgggtaaccgaagttataaatgattttatttatttttggactagaaaagaaaacccgaaacattcaagcctatatctcaaagtgagccacgtgctataaataaaaatttcaagactgaaataaaaaagtttacgttctttgcgggaaactattttaatccctcaaggggatatccactcgttctttgcatgtcacttaaatggttatgaaaaaaattaaaaaaaattgagaatgtgtattaacatgtgatataacactccacaaacatgtaagttcaaattcaacttctatatctcgtaacgaaaaaaaaattaaaccgcagctagttaacgtatattcagagtcaaatttgttttttcgttgttagatttagaagttgaatttttacttgcatgtttgtggagtgatatatcacatgttaatacatcttctcaattattttcattttttttcataaccatttgagtaaaatgcaaacaacgaggggatatcctctcgagggatcaaaatcatcttcccttatttgctgttggatataaaagatacagtacggttgttgcacaccataaaagaattggtaattaactatggaacactaggccattattttattatttttatgagattttagaaagaaaaatttgcccctagggctagaagcttgtattggaaactttgacgacgaagtcgaaatgatctttcttgaaaacaaaagcttgacgacgtcgagtgtattgcagacttgcagtgtgccgatccttaatacccaatccaagatgctgtctttttaattatgagtagaggaatcaagtcagaaattaggcatgtgatagcatcgtagtatcttaggtcttaaggcagtacgtacacaggtagctgctggctaccgcgttatcgcatctgttggtagggacgacagtattgaaaggcagctagtgattgactgctaattattcctgacgaaattacgataggcatactgttcaattcaacaactgctatacatatatatgcatcaaattttataagtatatatacgtacgtgtatgtatatgaaaagtatatgcatgaatgtatgcggcgatccagtcaataagtctctggatccgtgtggccgcggcctgcaaattgcaaattctaattcgtcacagagaccgaatctgattcgaatttggaacacgctcctgacgcattcgacgattggagacgaaaccaccgtgcaatttgacgcaatcaaagcgaactgcgagtattactactatgcaaggaagtttcagtaatatatattcagtctactgtagctttctggtccatattttccttgctctggatcttcaaatggttcatacagcttttacgctttaatttgaccttcactagctaatgctgttctgaacctcacagatttctgcattattatctcctcttggatcagttagttttcgtcagaaagaaagaacagcgcattttcttcagctgaataggtcaatcaacgctcgctacagtgtaataatacaaattaaacctcacaagaagcttctataaatacatgcaatgagtggtttcgtgatcattcattcagagcaacagaaaagatcaaggtgaacacatcagagagctagatcatcagcagatcgatcaagaaaaaacacatttcgtcatcgatctgcaggacgaacagtatgccgagtgttcaggagatcagcgtccacagggtggccaagatcgagccgacgacgccgacgacggtggcgaacgcggtgaagacgccggcgccgcctgcaggcggcggcattgacgcggcagcggcggggtacatcgccaagatgaagcggcggtgggcggcggagtcggcggcggcggcggctgcatcgtcgtcgtcgtcgactcgtgctactgcgaaaaagcgttagagattaaggaaatcaaggattatattgcatgcaacacatagatctacatgcatggatggatgaaagttaattagtttttggtgttaattttcattgacaggttgtttccgctgattgtttgttgttattgattgattaattgactggattattgtacgtagcttacttgttacaaacaaggacgttgaggtgtatatatgtttcttattattaatataatataaagcctaaacatgtgtatatatgttc

SEQ ID NO: 72960 - DNA, 806 bp, Oryza sativa
ttcttagttaattaattagtaatcagtgtggtgtgatcatgagttgtcaaggtatcttgtttggtatagctctaactctaacttcagctctagctccagctcgagcttcatctctcctggagtttgagtctagccaaatagtttagctctaatatctaaaataggagtagagctgggtggagttctctcacatgaactaagagaggtggaactgctcgacaactccacttcaaacccaactcctagagttaaatttagaagttggagctctaccaaacagttcatatgggtcatatcagtcgctaatttacacactatgcatgacgcaattaattagcccctgatgcacatggagtaagtaaaataattgttgcaccggacgagctctttttagaattaaatttgaaaatatactgttgatttgtttgtttctcaaaaatattcggaatgcaaatttattagcagaaatataccgtcgatctcgcacaaccattccacgaaagtgacgtggaagtgatgccctgaacggtctcgcgcgaagagagcgcgagaccgcacggtatcgcgtgatcatagcacgataccgtgcggtctcgcacgacgaaaaaacgataccgaacgacgaaatcgaggacgtactacgtggtggcggcatcagaccacgcggtctcgcgcggccaaaccgcgagaccgagcagtctggctcagtcagtgagcgatagcgactgcctctaccgattgaataaggttaattagtgattaattatcgataattagaataattaatcactaattattattaatta

SEQ ID NO: 72961 - DNA, 10204 bp, Oryza sativa
cggccagccagcagtggatgtggaggatgtgtgaggggagtgggactaggagtaggggatggcgattgggaaattagggtttagattttataatactcacttattgggccaaccgggcttgtattgttgaaatgggctatattttaagatatatcttatacctcggggccctgccgggtcacccacggcccacgggtggctaacgatccccgcccccatccccgctcacccgccggcgaaaattgctccccaccccggccctaacggggaaattgccaccctactccttctcttcccgacaagcagaggcccttgtggctccctccttagcatggcaactccctctcatcttcatggagctggccatctagagctcaagaatgtccagatcttatggtcatgagcttaggggcaaacacctccctctccttggtgagcagagggctgctctaccatgacatacacaggctgctatagatccattgggctggcgggctggctgcccccaagggtagaaaccattgatcaaggtcttggcaaacaatttccccgcaaaaaaaagtctcggcaaacaatgacctcctccagcagcctcttcatgcatcttctaagctagtgagttgtagattaaatgggatctatgcatatgtgtgtttgtgttggtcttgggtgttattttttatgaaattcgtgacttgtaaagtgccattattggatatacattttgtgcatttttttcaacttgatgaaatttgtgacttgtttagaattgattgtgtgttgtgttagtttatggatgagcaattgaaattttatttcatttttatccgatttatggtttaaagttatgggaacaacagatcaaaaatgcctcgaaaaggatagcaatgcctttgatctagctcaaagcatcggctcgatttttcattctctcatgaaagcaccatcaattaatctattctggttctacaactgacactactacattatcattgctgtttacacatggaatcgacactgacaacgatctcaaacaggcactgataaccttgtctagtcctgttcagtgattccccatatttgaatgtatttgaggtccacacctccataagtatgaaattatggggctgtttggttcactccctcattttaccaaactttgccatactttttaagacatatgtttgtttcacttctaaacttgtggcatgccacagttttttaattcaaaggcccacatgtcatacaaccattttttagccaaaccatgtttaaggtgtggccattaatttataagccacatatttagctaggtttggtaagaaggtttggcaatgtttgggagggaaccaaacaacccctatatattccccttcgaatcccctcaatcctcttttgaatgagattaaccgaacaagctctggacacgtcaagcaaactgtgcatgcatgcagttactcaaacagccaaattagcttagcaaaagtacttagtaaatctgcggtgattaattctatcttactataaagttataatccactaactcctaaatcttaacatgcaaagatgacacatcatcgttcactaacaagttgacacatcatcatccacgaacaaccaatacatttaacatcatgcaaacatgctatattatctataatttaaaatttattatattttagagcttttaaaatgaaagcatgttaaatcatcatcccccataattcacataatatttcaatatatatcttcattattttttataatatcttatgtacctatgtaagttcatcctcacttgattaatgctatttctctcttctctaattaatccatatcacatcaattgattttagtgcttatgtaagtttatgttgtttagctatcttacatattatttttacttattattttcatactgaattctcgcagcaacgcgcggggtttcacctagttattagagaggtgaatagttaatagagagatttcacccaggtgatgattaatccctggatcaatcacaataatgcatacatgcaggaatctcgatatatgatggccgtcgctctcgccgtggaccggatcggacgacgggaatcaaacgtgatgtacgcaaggtttcccatggaatcaatttaagctaataaaatcggttgcttgtgttgctcacatcgctccacgtctatagcgtctatagctatctcgatcgcctgcgtatgtttgatagcgttacgttcccagcatcgatcatcgatcgtcagcattcatgccacagcatcaatatatctcctcctccttctaatgaatgatatgtaatccttctgtgcgttcacgaaaaaaaaaaagagcatcggtcatattcagtctctgagtctcaagatgtcatctgacgcaaaggagaagcaccaggtcccttctacacctggatcatgaaattaaggttcaggtacagtttcagctaacttttgtacagtttgtatagtcagaattgcagacagaaggtcgtacgcaattgcttctcttcagatatggttgtgtttagttcagcgcaaagtttagattttagttaaaattgaagatgatgtgactgaaaagttgtgtgtgtatgacagattaatgtgataaaaaagaactgaagtttgaatccatatgaccacctgtgtgattagtctggagagaatcgtcaggtaacaatgttcctagcttgactctggcatgacttgacctgctgcctggtcatgcatgttatccagatttcagaaaatttatcgtcagtagatgtacaggtaacttcacaataaataagaagtatttggagatattatattttcttgtatataaattgatatctccaggtatttgaggtatcaaaattcttagtataaaatttatgtaacttgtggtgatttttttaatgattgtaaaatttctttcagttgtaaaggccggactgtattgagaaatgaaacatatacctcagattactcttcagtaggataaaaattcatagttccatctaattaactccattagtttctggattctgataggcgaaccagtactttatcaatacattaaaatcattatatattgatctgttcataagtcacgagtaacatgtgtgacaaaatatctacggcatggaaaatactcagttcgttgcagccgcattgtaaaagctgctttagttttgttttataatcacagggaatttctgatggaagtgttcatttctttaatttaattaatcaccgtcattatattcctgccgcatgatctctgcgttgtatgtaattaattactttgcaaatcattaacgtcaagtcgatagatatataagctgttatatattgcggtgtacatgcatggaatatatctctcctgccaaattagtttggtaatgagacctaatcagccataataattgacacgattaggcatccatgactgcgactactctaatcaatctctcgaaaaagtacaaggggctagcttatcatcatctcacgaatatatcaccactaatcgcacctggtaattccacatggcacaagctaattaacgttaattctttctctctacagttgtcaagattttgaaatatttaatttagagctctcgagaaggtaccatatttaacaccacttttaacaaattaacaaatgccattatatagtagtacttttgtaaaggccgtaaaaattatagtgtgattattaatgggcattattaatcgtgcatcattcgtcaattcattctgaagagttaggtaggctaactccaattaaaaagattatggctatgcctatgtacacccatattggtgtaaatttaatacattataaaaaaattaaacaagattaaccttacaaccttcggccgaccccaaaaaaaaaaacaaaatcttacgatgaaaaaaaggaaatatatgtggtggttttatatactatctccatcccataaaaaaagttcatttttcagtttttaaatacaatatttgactcttcgtcttatttaaattttttattttatgattaataataataataatattattattattattagatgataaaacataaatggtactttgtgtgtgactaatttttttagtttcttttaaaaaaataaaataagattgacgatcaaacgtagggcacagacctaaaaataaatttatttttagacggaggtcgtatgttccatggttccaccatcactaatttcccgtgattaatatgtaagtacgtctgtttttcttaatataagggagaacatataatattttttttgtggggaacatataatatttaacattcatctcattacaacttattacttcttttttgaacgcagaaaagaattacatgcacatcaatatattatattagaagaagagtttaattacatatcgcaaccagtcagaggaccattgccgggggacaagaagaaaagaaattacagcttattactgattatcttgggtcagaataggcgcagctgatctcagattggagagctcacagtacggggatcgatgctgccgcagacgacgatgacaaccacgatgaaaatgaaaactgaaaccacaaatttggtatcaggaaattaagatttacagaatcgatcttactgttcaagctagcacctcatgtcaactgctcaaaattttttataacttaaaccaatatatctgctgccaattatttggcacacttgcacgttgcagacgcatcaggtaccttccacacgtagggcatgaacgcaagctagatcattaagagactcgattaatattgataggatcatatcgatctagtcttctcgatctctccgtgaatgcaatggagtccatatgaatagctagctagatgcaatactggagcgagcaggaacaatgactgcttctcttgtctggatttttgatcatcttcatcttttggaaagtctcaaactgtctagaagaattttattaggtaccaagctagatcataactctccatgactttgatggccagagacaggtcttaacttgagcaggtggctagattggcttactttcgattgatcgacccattcacaaaaaggaaaactttatttttaaaaataatatatttatttgtgttaaaattatatacttaataaaataacacctttatcattacctttttttctcaagaaatatgctcaataacatccaagatatataagtagagaaattttgcggtccttaagaaagtatatgtaagtattaataaaaattttacactaaaaattttggtacctcgagatatctaatatatatttggagatatatataaaatatggtatatcccggtatcttcttaagaatgataaaattcctgtataagtatagcataggagcctctaggcttgcatgcatgtcagtgactcatgcagcttatttctcatttttcagtgttatgcgcgtattataagcaattcgctcccaaagtcttatgttacttgaaaaaacattctgaaaatatcagtcaaaacattttcatagcaaaattaccaatacaattctagacaatatcattggccaagtaattaagatagttaaactgcactcttgggtgaggtacatttttttcaactgatatagcacgtaatatagacattccatacatagaaaacgatagtacctcaaagtatttactcaaaaactgcgaaaagggctcatcatgcatgctagacatagagcccaaccagatttgctaatagctagaaattaatggataacgtgccaacagtttctttcgataataaaaatctcaattcagcctctacatttaagatgatgtgcatatgtatccaaccatcttttggctgtgtacatccagcttagatgtagaggctgggtttttaatccattttctaaaagaaatatatccaactatcgtgccaacaattgattaataatgtgtaatgtttgtattgaaaattgtacaatttcttacagtaggcaacctagctagaaaatcctcacaaaaaaaatttaatttacagtcgtccttatccttatataagcactaactatagcctatgaagttcagtctctgaaaattaaaaatctcttgaaaacacagtcaacatatagcaagctattcatatatttcaggtaaatattttacaacacaagcgcccatcgatcaggggctaattattttccccatatttatgcatgcatacatccgtatatacgtacgtaatacagtgcaaatatcacatcatgcagaccgatcttaacacttcaattaatttccatgatcgagctcgaaactaatttggactaattttggccaaagaacatcctcttcctgtccctgatgtagttttcagacctcttgttgatgtcctctatcgacacgacgcccggctgcttcctgccggcgacggcgccgccgctgccatggtcgccgccggtagccgccggtcgccttggtgctggagcttttggagggttgttacctttgccggcgccgtacaccggcggctttgtcaggatgttgaagacgaggtccagcttgtccaccttctgaaccctcacctcgctgtcggagggtgcggcggcggccatggcggcgcggcgaaacatcgtcgtcgccgtcgtctgaatttctgtgtgtttgaattgaattggctagcttagctaggagacagtgatgtgttcttgttctaagcttgctcttattagcttagctatctctgatggcaatggctgatctaccaatggctcaatttatagggagctgcacatgttgctagctagctggtaggaatgttctactttttcttttatgggattctatggactgtccatcactgtgagagcaagtggcaccatttcccatttctctgaactatgtaaaggaggaagaggtttgtacatattctcatttgtagtctgaaattgttggtatatgctattggaattaattaagtttgtgatggtaaggtggtggcgattaataaacgcgtgggcatctaagtggagcctctccttggcagaaatatcgagtatcaattccaaaagcaaaatcgacacatgggtattgaaggaagtcccacggaagtttggggaaaatgcaacccataataagagaccgcggacaacttggttcctcagcggtcctatcacttctttgtatatagtcaaaacccactatccataaatcagttttcatgtttagccaagtcatcaacactcttggccattagattgccatatattcacacactatctgtaaagcaaccttcacatatagccacatcatcatgtatttgcttagtatctattgttagatgatagtcttcgtctctagtttatccagggccacctctatatttttaagagccctaggcaaactcggtgataaaaatccttaaggccaaatataagtttacttgtaatatatactttataaatcatgtatcatctaaagtgacacaaataagtaatactaacaaaataaacacataatattatggagtaaattaaacaagaagaacaaaacaagatcttagcctaatttttggactaaatagatgaaaaaaaaataaaataaactctagtcatgatgaggtaaggtgtggccgcgtgggattcaggcataaggatggacgatgacaccctctgctagctaggttggttggtgataagcctgagccctaggcggtcgcacaaccgacctaagccctcgagccagcccagccctgagtttatctaaaggttatgtctcatgctacaattaatgtttagtgagttaaccatttatggcgtaataggtttatttttttcgagtacaagtcggaccatacacaacacccggctggtgccaaatctaaaactacaaacagattccaacacaatgagcttaaccatctaaggcccaattcgcatatggggcttcatattatttcctaaaagtaagacaaattacatataaaaaaatattatttcttacctaataatattgtttgtttttttaactgaaaaggagcatctacacagtgaaaaaaaaactctatgagaacaatcaatatgaaaagcttaaagagatttgaatttatatttaaactttgaagttaaagatttgaattttccagtagacattgctcttattgctttcttactgttagaaatttaaacttctatttaaaagataagaacttccaaaacatttaatcagactatatatgaaaccaaaagcaagagcttctattgttaatatatttaatcacaagcgttaacgctatctacattctggctacgatgttagaaagccattctatttctctataaccaaatgttctaccacgtcataaaaaaagagttttaaaattccaactcttatgtgttttttttttgctaaaaaggatatataatatctgttcttaaatatatgtttattgtataaagagaaatttactgacatactacctcaatccatataaaaaagaacagagggagaacaaaatactagtattgaactttaacaaaaaagaaagaacctctatttagtttgttaggttgtcttaattgactcatgatctttaatctctcaaaaggaaatgtgtaccacgttgcgacttgatcacgaaggtatgagaagaaactctctaatctagtaaagttatataaagaaaaggtgttgcccttgttgtaagatataagttcattaactgtttagacatttttacattttttttagcatatgagtacgttgcatatcatttccttaataaagagagattttagaaagttcggacaagtaccttgtaggtaagagcctagctaccaccgcttccctttcttttgttttctttactccttaattttaaggtaatgaaaacattatttggcctctatacctacatatattctacttttgatttattaatatagaaaaaagccaaaaagtcctatctttctaaaaacaaaaagagcctagctagcactaactaacatgcatgttatcatcaatcaacaagacaacaggggagaaaatatgttttctcaacaactcaaagtctaaagtcagaaagaacagaatcttgttcttccgagtgtctgtctttacttcctgctttggggaaacaggtgagcacccaacatacccagaaattaaaagaataataaaagctcgatcgtaccaaattgcatgatcgaattaaatcgatgctagttgatcgattaatttttctccgacgaactagatcaggctctgcaacaatatttatctgaacttccttttttcatcccaagtacaatttcagatacacatcaatcagaatttcagataactcattgagaaaagacaagtgtactggtcaattaactagctgaaaaccataaatttcaggtcatatatataactcgttaatatactttataaacaactccatctggaagctagatatacatattcatgagttctactctcatggaatacttacatattatatgcatttctaattaatacataataactaataagtagagcatcttcttatgtagatatgtagctgtatttatactaaatattacatgataatattgcactgatcgatcaactgataatattaatctgagtttactgctcattcgtctccttgattaaactgcctcttcttgtcctcgatgtacttgctgatgaactccttggtgaccactgatccatgcggccagctcgccggcgccggcgccggctgcctactgttgctgctcccggcgaagccggcggcgacggcagtggtcgccggcctcgccttcaccgtcgtcgccctccggttggcgccgtagacggagggcttggtgacgaggttgtagaccggggcgatcttctccaccttctggacatccacctcgccattgccagaagaggagttcttggcacgagccatggcgtttctaatttctttctttcttggctcactaattgtgactgtaattgaattgtgttgttgctgaagctgagctttgcctgcttgattgctgccatgggagtgagtggtgagctcaatttataggcctgcagctgcaactgaattcaattgagtgagctactgcacctatccctctatggtcactgactcactggtcagtgtgagcagtgaccaatcactagtacagaaatagccatctctgccggttcactttggttcggacggaaaaatg

SEQ ID NO: 72962 - DNA, 1364 bp, Oryza sativa
tagctcgtgaacattcgtatactagacatccccttcactatttatacaaaaatatattgatagtgccgacatatatgaattaaaacatcatcactttaataatagatcacaaaaacattacttggttggttgaaaacaaacaaatacaactagattacgtcacatttaattctagatttgtttttttggatggaggaagtaccaaaaaattgaccgtgcccaccacaggacctgtcgaacaaccaattcgagaggtttaacatgccacaaattgtattaattgcggctgtttgatacgagacttgtaaactttgattgttcaacatggcattaaaattgcgatttcttaccattattgttgcaatttttattaaaagagtactattattttttttaaataaaatcttcatatatggatgtatgcggcgagatggagtcaggtttcttaattaaattcgatgcgcgtgtccacggcctgcaattcaataacagaatctgattcgaattctggaactctcctgatcgagtccagctgacgcactcaaacagacgaaatcaaccagctgcaattatttgatgacgtaattaaatcgaattgagattacgtatatatacttgtatccagaaattaaagcagaagaagttcgaggccgcacttttgttgtgtttgtgtgtgtgcatgatgcatgcatgcacggtcaggtcaagtcttgctctatcagactactgtttgagaacacgctattcctagctggtccatacattttttgttgctaaagcttcaaatggttcatacagctttatgttttaattgacctgcagatcgagtgttatgcacataattatcatgaagacgtcgttttcgtcaggaaaatacactgcattttcctaagcttctgatatgatctcgccttcctctgttcttggaggctaaggtactccaaagttattattagtgtttcttctatcatttcatctccatctataaatacctgcctcgagttgcttcatgatcattcattcagagcaagctcaacctagctgatcagtactcgattgatcaatcagctatatatacaagttaattaattacttgctaagtacggagtaattagctagcctttctctgtgtgtgtgagcaagacagattaattaatatgccggcggagatcagcgtcctcagggtggataggatcgagccggcgaagaagacgaagacgccgccgccgccgccgacggcggtgaactcggtgcagacgccgaggatgggcggcggagcaccggcaccggcggcgactagtactgcaggccgcagcagcattgacgcggaggccgaggggttcatcaacagggtgaggcggcaa

SEQ ID NO: 72963 - DNA, 5170 bp, Oryza sativa
  unsure (1)..(5170): unsure at all n locations
ggaaaaaatccgaattactcccgaactatcacagtcaaccgaattacccctaacttaaataccaaacattttacagtcaactattcgagccagacaaataaccatttgactccatccattcttattttggtcctacgaggcagcaagtagtcaacaacttttttaaaaaagaatcggtgggaccaacctatcagattccctcccctctcacctctctctatcttagcttcctcattccccaccttctctctccctcttctcccctagctcaagagtgcggtggtggctggcccgtcaagctcgccggttgtgcctccatctcgttagcacaataagcatactgccattgtgacactctcccacacgagctcgcccgatgcctgacggtggagcttgcgcagaggtggagcccaacctcgcgtgtaggcggcgacaagactggcgatgtctcaagctttcttgctctcaaggaggctggtgagcttggctcctcctcggccttcgatgtgatgaaactcgcagtcaccgcagctcctcctcgatcttcgcgggcacgcggctcctcctcagcctctgttggcgttcacgtgttgaggctctagtaatatagaacatcaccaatgggacaaattataggtgccgaaaattgtaaaatcaacatctatagacattttcccacctccacaggatggaaaaatataaaccaatacctttaaccaactatgtataccagttccagagaaaactggaccaatactttatgtgcttattttgtaaaaataccaacaactttaatatattataggtgtcggttaaaccagaatatataatatattttaggtgccggtctgttaaaaatccagcacccttaaaattcgagtcacgccaatggttgggagcgagctaaaccagctcctttcgcatccttatcctctcacgcccctcgcttccttgtcctctcatgcccgcgcacctcgtctcatcgctctctcaccgctcattctctcgtcgcctcctccccttgccctccccttccccctcttggtatttgttacgcacacagataaattcacaagagtattccaagcgtatcgaacagaaggaacgtgtgtatctcagaacaggatttaaccaaggacaacaactaaatgataggcttaggacagagaatattcctatggatttaaccaaggtaaaactctatcgaatgctttgggcaccggcccttccctagtctactgacaggctgagttcggccttgaactctattatgactgtcaccacctgctgcctacctcactttctgtgaagcacacaataaatgaagctaacctctaccctaaacactacgtctaagctaagcaaagaagcaaccttttcgtttggtttttgtttaagtcataagtcactcatacactattaatccaaaggctaggttggagaagtttttttatcttatgtgcggtacatgtataaccacaccattaaacttaatactttatatccattggcttataagttatataaaccaaaaaaactgacttaaaaaccgaagccaataataagtctaagcctaaacaaagagactcttaaaaaaaaccaagttaatatggattacctttttttatttattagtgatttcataatgactttatcacttttttgactaactatacttcaccacccagctgccacattatcaaaacttgactggtgtagtctaaagataaagtacggatcatgttgagagtttgcaaagtattactaaatgatttcacaagtgaatttcaaaccaagatcacgtagtttcattacaacggaacccctcatatatgatgggcggtaacccacatctgtaacgggtatatgtcccatctattctcatttgtcagtgacaaagaaaaccttatctatgatggattccataagtcatctatacgtataagttatgtaccgtcactactagtcatgattttttttaattttaaagacaccaaaaatccctaaaagaattttaaattttactaggtatctagtcgtggtcacgcatcactaaccataaatctacgatctttcccgattgagctttgagcctacttggtgtaattccaaaacttcctcttgtataaaagatatcaatacaaactatcggtagtcaaaactaaattggtgccttttgtcttgaatgaagcctgcagcttctctcatgaattcatggttttaaaacgttgaaattaaaaaaagctagctactacatgtctacatctactaggaacagtagtattattactagcagacagataatagctttattgaaaagcattgataaggtcttgagacttgagtaggtcaagcacgatgacaagtatatattgacccataaaaatatctttctacatgcaatgcatcctgtgctaatcaaaccctaccaagctattcgagctcgagctcactaggtttgcgaacctcaacctatgcttaagtttggcttgtctgtagcattcgagtcgtgctcaaattaagctgtaacaaatcaaactcaaacagattgacagccctatctgtagctaccacacttgttagaaatgtcctgtcatctttgatgacgggtcacaactaacacccattatagatggattcacttctaatcttctatgactggtatccacatatgcatatatcaaacgtacgggctacttttagatccgtccgttagatattagccatttgaaatcggtaatattgatccatcacaaatgacctgctgtgcgttcacgaatatgtgagtgtttaggaacaaatatggaatttttgtcccgatatgtacttaatttagtctttcacctttgatacatattgataatcaggggtgctattcccttttatttaggataaacaaattagagcacagttgataattggaaatatgaatgaaacattgatcggtattttctttgtcacaattcagcgacaactttattttattatttataacaattggtagcaatatgtgaactatatttagaaaagagcacctgttgtaataaaaaagctaataagcgcgcttctcggatgaatacttcttcggattttacattaaagagcacatgagctgtggttttcaattctcattggatcatcctatatccaggtttctataggctattgtgtgggtgatgctataacgtgaaaaacaatacgggaattcctgatcatagcgcgcggtttccgattttcaatctgaagtttcaattcctatagcgtacgtttctaattgtcccgtactgtttccactagaaattcatcccaatacactataaaaacgattatttttttacaagaagccctttagattgcaaagagaccgtacgtaactggcggcatctgcaaaaactgatcttcattttcgcatatacttcttccgtttcatattataattaaggctttctagcattgtccgtacaaataaatatattaatgaatctagacgtatatatgtgtttagattcattaacatctatatgaatgtaggcaatattacaaattcttataatatgaaatgaagggagtagctctttataagacctgcatgccaaaatcaattttctctttgcatgcgggtctattaaggagcctcatgcaaaaataagcctattttctcatgcggtcctcttaagaggacatatgcgaaaaggggacctcttaagtgatccgcatgaaaaatatcatccctttacatattttttttatctccctccactctcttttccctctcatcatttatttattttttgaactcctctgctctactctcctaattatttactttcctctctctcgaatgctctctctcttctctctctctatccgagtaggagccaacggccgataggggtaggagtaggtgcggctactatgacagcgggcaccagaagtggctgcggagacgcgccgttgccgggcggtagcgggagatttggcaacgtcaccctcggaagggccggatctgctgccctaggtagcagctcggtgcgaggcggcgagggtttggcgctcggcggcagncggcgcgcgtggatccgacgatgacagtgggcaaccggaagcaggcgcccgaaagcggcgagcagcatcgacaaggcggctgggagtggggccaccccacatggattcggcaacagcgtcaggtgccggcaaccaggagctggcggcagcggctcgtcccctcgcggatctggcaccgacgacgacggcggcgaccgggaacgggcggcgacggcccgttctcggccgcgtggatctagcaccgggggtctttctcgtgtggatctagtgctggtgacacaacagagggaggtgggaccatcggatccgatggcactaacgacgatggcggcgggcggcggatccgaatgacgatggtggcgggcctaggttcacccggtttctatttttatttttattttttctcgccgaatttatttttgtatgcagccggtataggaaaccgcgtgaaaaaaatggaattttggcatgcggttggccacatgaaaaaaaaaatattttcgcagaccttttggttggttgggatggccgtatgcaaagatcgcttttgaccgtttgtagaaatggtttatgtactactgatatattcatcacaaatttgtattgacagttatgaaaattttgttttacagttgtcacaaatattaaaattttgtttcctaactctgtggagttgtaaaacgtaacacgactggaaaacgaagctggcatggcacacgtgtgaaataattagtgtacgtaaagctcacgacgagtcgatcaagaattgaattgactttgactttagtactccctcccaaaatatagcaatctaaaaccggatggaacgtattctagtactacgaatctggacatgtctcatgtctaaatttatagtactaggatatgtctaatccggttctaggttgctatattctgagacggagggagtacagtacagtagtacgttactccaggtctgttgtcgtgtcttctaactgactttgacttgatttctaactgactttgacttgatttctcttagagaaacagtacgttccatctggggcttgaaaagtagagtgctttaatacaactaggtggcccccgcaattacacggctagc

SEQ ID NO: 72964 - DNA, 19077 bp, Oryza sativa
  unsure (1)..(19077): unsure at all n locations
gtctaccactgattctattcatttttcttataacctttaaaaattgaacatcgtagtttttgagtttattttgtcattgggtttcgttttcattatttctagaagtctcgccaaatgctgtcactatactcctctacagcccatccgcttccttctctttgttatcattgggattttaagaatcaaacataataataatttgggttcattttttatttttctagaaatctcgccaaaccgtcagcgtctttgccactttactcttttacgacttacctgcctcccctctttattgccattgagattttaaaaatcaaacatgatatttgttggggtttattttttacatttcagaagtcccgcaatcgccatgactgtactgcttaacgacatatctgccgtctctccttttaatcattattggaattctatttgaggttttgctaataattttcagataacccattaaccgccaccactctactcctctacaggcatgatgcttctctcctctttattgtcatttgtcatcgttgtgttccagatgattattttttgaaaattccatatttttattccaatatttttatttataaattatattattttttttcttgaactcttatatttatttttctattttggaatttattttatttcttattttaaattttaattaatctcatcatgggttctagattgtctttttttgacaatctttatttttattacaaaatttagttatttataaattatatttctagttgaacttttataatcatttttctaatggattttattttattttttattttaaattttaattaatctcgtattgggttcttatatggtttcttctttaaatattgcttatttttatttctgatattcaattatttttaaattatatttctacttaaactcttcttctatttttctttttctccaattaatgtgggaatttctaacacccactgcgagcgtgttgcttctcccctctttattgtgatttgtcatcgttgtgttctagatgaacttgttttcttaaaatttcatattctcattccaatattttttatttaaaaataatattcccacttgaactcttatattatttttatatttttggaaactattttattcgttattcccaattttaataatctcgtcatgtgttacagatggtatcttctctttattacgaatgtcagtatttataaactgtatttctattttccttttttaattattttttttcaaattttaattaatcttgtattgtgctgtatatggagtattctttcaaaattcctaattttttatttttcaatttcagttgtttcaaaactatattcttacttgaactctcttagtttttaatttcagatcttattttattttttattttgaattttaattaatattgtattgggttcttatatggactctttatttgataattacatatttttaatttcgaatttcagttatttttaaattttattcctacttaaaatcttctatttttttttatctccaattaatgtgggaatttgtagccccaataactatcgtgatacctacttttataattttcttaatagtatactacatagagataatagtatcaacaagcatgagtgtcgtcatctggagtagtgtttaaggcaaaatatcttttgaacaaacatagtacgggtctagggcaaaatatctaactgaaatcagtattcataataaaactctagtgaaaaccatcgtcgtcctccactcctccccagtccacactatatatagaacagtcatacatatatatatcacaaatttggcttctacctttcgtttggtcgatatgcaggtcatccaagtagatccaagcggtgtttggacagggtctgagctgtttaattgtcatcctaacagatcgatcatcagctgtttaatcaacgcctcagctgctatctgatcgattaatttgtatatttttgtcgtcatacagatcgacggcttgcatggggtgcagctgttgccgatcgagctagctctgctgcatgcggtccgcccacgcctagaattaatgtgcagcgagaagttagctctactcttcctttttttttttaagaacaagttctagtagtgatatgcatctccatccgtctcatagaaaactaattaatatcagatgtaacacatacttctatatgtacagattcgtaatactaaaatatgtcacatccaatcttagatttgtttttatgagacggggggagttacttcgtagcgtactcctacatgaacatccaattctagcctaacctccgcaatatggtcaactccctccgtcccaaaataagtacagttttatatcgataatgtccaacatttgaccgtttgtcttatttaaaaattttttatgattaatatttttattgctactagataataaaatatgaataatactttgtgtgactaattattttaaattttttcataaatttttcaaataatacagatagtcaaacgttggatacggataccaacggctgtacttattttggaattggaggtagtaagtcatttccagctaagctagctagggccaacgaaagtaggagatcttacttaccctacacgtgaccaaattagtgaactggatggcctcttggagtgtatccgatatactcttaccctacacgtgaccaaattaagctagctagctactttctccgttcttttgaaacgctagattgtcaaaaacagaaataagaaaaaatgtagaaataaaatgtaatgttcaatgcattcttatgggatttaaaaacatatgaaaggtccccaactaccatttaatatttacgcggtaaaaatgaggaattcaagacacatgaagaagaagatatgaggtaagacgtcgtactaattttcctccaaaattccataggaatcttgaattgataagaatcaatattttgtttccaagggtcttatagtattattttccataggatataaatccattggaaatactatgttttttctttgtttcaaagcgcgccatatttttaggctcctctcatttatccaaaataaatttattttaaaataattatggtatcggagtttgtgaaagtaaagaataattgtatcagaagaagataaagtaaaaaatagttgtattacgatttgataaaatagtggtatttcagacttgtattggtttcgtattgtcacgtgtgagagtagtgcatgaaaagtaaacttgacggacggagtactgacttgtccgtcgctcgctttgacgggccgacgtatctcgagtctcgacctgcataatccttctggaatgtttaatacaagtcggcacagcgaatgtttattttgaattttaattaattttattttagattttgatatggactctttctttcaatattgcttatttttaatttcgggtttcagttatttttaaattatatttctacttaaaatctttttttatctttaattaatgtgagaattattaacccaactatcctaataatataatagatatatagataatagtatcaataagcatgagagtcgccatccagtttctaaggcaaaatgtcatttgaacaaacatagtacgggtctaggacaaaatatctcctgcaaattaaatatctaacggaaatcagtattcataataaaactctagtgaaaaccatcttcgtcctccccagtccacactatatataggacggtcatacatacaaatttgacttctacctttcgtttggtcgatatgcaggtcatccaagtagatccaaccggtgtttcgacagggtctgagctgtttaattttcatcctaacagatcgatgttcaaaaaaaaaaaaaacagatcgatcatcagctgttatatctgatcgattttgtatatttttgtcgtcatacagatcgacggcttggatggggtgcagctgttgccgatcgatcgagctagctctgctgcatgcggtccgcccacgcctagaattagggcctgattagggaggtttagattctgagaaacagctatttagtagctagcttttaagaatttggaaaagctttgaaatccagcttctccagcttctgacttcttagttcatttttcagaatctataactacagattctcagaaactatggactgtttggggcattttctagcagaagcagctttagaaaaaagctgcagctaggacaagttctcccaaacagggccttagtgtgcagcgagaagttagttctattgcaaaagtagcgatatgcatatacttactattccgtcttaaaaaaacgaatttttaaccatatatctaaatttataggtagaattatctttttttttaaaacagaaggtatacttgtggacttttaaaatactcctacatcaacattgtttaatcctaaaaccttcgcaatatattgtctaacatttccagctaaactaacttgggccaacgaaagtaggagatctcttgtgaagtggatgttctcttggaagtgtattaccctacacgtgaccaaattaattaagctagctagctacttcctccgtccctttcaaatatacgattatcaaaacatgggaatagaagaaatataagaatagaatgccatattcattagattcatatacgggattcgaaaacacgggaaagtttcaaaactaccgtttgcatatagtcacacaaggaaaatataggaattcaagacataggaagaagaaaatatgaggtaagacctcactgcagtagaagcagcccctagagacggtttttatgtgatgtagagacggccatgtctaggatttattttttctctcagtcaacttcaaaatttaccaaatagattaatgtgatcgtagagacggtctattatcctgtctctaattagtgtatctacgtaagaggcaatgtaggagatgggctttaatagggacgacttgcttaaccgtctcttacgggatgtctctacatgtcctttttgtagtagtgcctcatgctaattttcctccaaaattcctctacaataatccattccataggaattccaaataaattggtatgaatcaatacttcgtttcaaaaggtcacgcaggattatatcccataggatataaaatcctttggaattcctatgtttttttctttgttttgaatggggccatatttttaggctcctctcatttatcctaaataatttttttaaagataattattgtatcggagtttgtaaaagtaaataataataataataatagaagtagataaagtgagaaatagttgtattatgatttgataaaatagtagtattgcagtattttattggtttcgtattattgttacgtgtgagattagtgcatgaaaagtaaacttgacggagggagtactgacttgttcgtcgcttgctttgatggaccgacgtatctcgacctgcataatccctctggaatgtttcataaaaggcggcactgcgaatgtggcagcgacgtgtcattctaggggtgtatatatgttgattggtaccgataatggtttagaattgatttattgtaatttatttactactagcaattatacctgtgcgttttaattatttttcttttttttttctgtgtcgaggcctcgttaggctgaacagtgcaacagacagcttgtggctgtgggcagtttgtggaggcctcattagtcagttttatattttagggtatcgatccgtggaattatcgggccacggcccatcaagagttcacggactatattttcagttgtgttctgtcatgtacctttagggattaagcatttttgctcttggcaatacatgcgtgctcaagtgtctaatatataccttaaatctttttatatatctgatacacaacttttcagtagttggcacaatacaatttaaaaggtggcaaaagtaaagctttacgtatggttgttaagacgatgtttgctttttataaagcaattgattgatgttagtttatcattgctttcggccacttatgtgtgcatttttctaaaaaaccaatattatggttgtagtctaataatatatcttggtcattttcaggcagttggtaaattcatttcttagtgttattttacttggattttacactacaaatgccatatatttttggctgggggcaatgttgtgtgtcttatagggacataaacatatttgtcctggcaatatgcgcacaatgtgaacaaccatagaaaattcctttactcactgcataaaggctttttattaaatcatttactatgtgacttttaaagatgcagttggcttttggctatgcacattatactttttaataagtagtaggtatatcactcggatcatgttgtttgaggattcataccgcctatgctatatattagtattaagtcacttggttgactataattatcaaaaaccacttgtttggttagattatttattccttgactatatacttagtttgtccaactaaccatatagtcggagggctacacctaataaggtgtatctagtcgatgtatctgagtatatattctttattatctcataaaattttttcagcctttcacagccttatgatttggtaaaagcacttgggagaatgtggtgaagatgatcgaagcactcggctttcccaagactagtcttgatttctctatatttgggaaaaaaaacaccacttggtaaatatactggtcctcttgtcttctactcagcaatcgacccatcaaccactgagttgatcaaatttgacaatgtggtgaccaagattccagattggttgatgagagcatggtgcacagctaaatcaagacgatcctataaagtcatcaactgttttttattattatcatcttctttctgctctcctttggcaccagatgctccttctccttctaacttcggcatttggcacttgtacttttgaataactttcccttgccgagtcatagaaaaagaattaatatatgccttcttcagttcttgcatcttctgctccatctctgccttttgctcttcagacagatcttcaaccttagcaggtataacattttctttaccaatgtcagacagtgacgacatggttgaataacaaaactttgtcccactagatgtgccaaaagcttgttgatgtgaaaacacggcggcctaggagatctgcttaactccagtgcaggtccaaggttagccttgagtgtgtctagggcataccagctgatttgatcctgcaatcagcaagaaaggacaaaagcagaatcagtcgatcgatagccgatcgatcgataggccgatagcatatcgttgatggtctcagtcgatggagttagaccaaatcggtatggactggatatatcaaagaataataaaccctaaacatgaccaatcggctgtctatagaatttaacaaattgatttaagacagtattatcaaagtagccgatgcgaccgtattttcgagtgtgaagggctcatgggctactgtggagattacgggtatcatatacccatacgattagtttatcgactgattatatgagatagtttatatctctagaatatgtaaaggattaagccttgagtattacgtttccctgagtattaagggatacggcctatagctctgactccggaatattgtcaaatagataccaggtttagttaggttttatctataatcttgcccccgacctacataaggcaggtaggaggcccctcaagggcataatcatacccaagatcattatatcaaccagttcataccccatgcgttgcagtgggcacactataaaattttctatgtgcataaaattgatgtaaattggtcactgaatcagcatacgaagaaaaggagatttacaatgttgagatagagatgcgcctaaatgttcgtttaaacaagtacaattcaatcaggaaacccaattcaaggtacatggtattctagcgtaccgagctggtcgatttgcttgattgctgtgaagatatgttaggtgtaaaaaacaggattagcctatgattaactgagtaagttcaaaactttataaaaacatcatttgtcatattagcctcttggcaatatgattaacttttttccaagaatttaaggagcgtgtgcagggtgggctggcccaacggaaaaaaaatgatgggaagttggcccaagatatcaacatcgttcatctggaaacatgcagtccaatccaacggctgaaaataaatgatgatgtggcgcaacgtggtgcaaactttatagtaataacttctctagtgggtaccaactatataggaagaagagatacagcacctcatatatacaaatcccttaacatcatgagtatgatattacctctcgataaggtcgtaaacttgtataaatcttttgtcatccaactcacgtactttagttctcatgcgctacacccttttcatattgcggattcctagcatcgacagtaatgttgatccatcacaaaatgacctgctgtgcattactgaatatgtagtattctgtggacccccgtttttataactggaatcaatcgtgtaaacagtaccatttccctggatcacgtagtctggtacacacgaattcatagctgaaataccaagtgcacatacacgagtgtctaatacgaattattacatcataagcccgcaggcgtagtcttaaatcatcggaccgagcggtccggaatacatcccaaaagcagaaatagataaggcagcggaattcaagcagcggcatgccattgccaccggcaacgaccgtactaagacctactgagcgccatcgtcttcatctccctcctggtagtaggcatagggatcctccgaggcttcatctcccgcttctgattaattttatatttgcaagggtgagtaccaaccgtactcagcaagccaccacagcaatgatgcacatgacagaggaattcaaaggatggctatggttcttttgcgcaaagcaagttttgtaattcttttctcaagcctaagacctagcatagactgttcaagttttaataccagtgttcatattaaacaatgacggttctatccaccatccattgtgatcccaaggatagcttcccgccattgaatcgtcatggttttctgaggatgtccaccttccctcctctcgggaagtgactccctcagcataaaattcatcatgcaatatcccatcccccacaagttaagaatttagagtctagccaagtgtaatacatgtcccggtgctcaataaccgcgagcacggctattcgaatagatttggtttactcacactgcagtggatgtacactttacccgcactccgcgactgcccaacacatgagtctcgtcccaacacatgagacgcgtcaccgcaaagcttttcgataacctcgcattggtagtacccgctccatgaacttaaatcctcatgcactctaggcgtccatgtttctaacagtgagaggagttctggcgctcccgggaaagagaagtctcacacacatattaaattatggttcaagttaagttctctctctcacacactcatggcagtcctaccaatggcgacaccgatgtagggcacgcctctcggccctacctcaacggctgtcccaccatagcgcacctgcctcactcaggggtgaaccatctatgcagggatactgcctccgttcggctatctaatccgctaggtctatacccatatgagaagtgcggttgtacgggggtcgtttcatgcttaactttatggctcggtccttaattgaccggggacggtactagcctttcccagataccacccaaatcctccgtccgccccagtcgaaaacaattgtttaattttatttctcctttcacaaatcatgtcatcaacatcatggcaatgtggcgctcatgtctccacatgccgcatctcaattaccttccaggtaattgaccaagcatatagcatttgataaatatgagtatgcatgattctagaatggcatttctaagcaattgtcataattgactagggactcatacgtaattatggttacaaggattttaagggtaaacaataatcaaggcatggcataatcattgcatgcaattttatttgtaaacaaaacaattttgcaattgggatcaacatgttcaaggaatagtgatgacttgccttgctcaaagtcttgcgggtcttggccttcgcttggatccgcaactccctcgggctctatggttacgtgcaaaaattgatttgaattcggttagaattcaaataaaaatccaaataaatccaaatgaaagtcaaatgcgaaagtcgattcctttttattaactttactatctgtcaactacggcaaacccaatttcgatttaaactattttgcgggtataattattttgttgtcataagttttaatttactcttcccgagcattatatccatataataggttagaaatttctattacgagctaaatatcggacgaaatcctagaaatattatacaatttaattcagtctatgactaaacgattaaatataatacacggctaagattcctagtaattaaatccgaatttctaccgtgaaccgatgacttatagagattaccaaaaataatctataataatctataagaattcatctaattgtttagttattaattatatctaaattactaccaattttaatctaatctgtttaagaaacatatttttataattaactcggaatttcgaccgaaatactattacgctcgaggaatttccgaaaataatctatgattaaccccgaccatttttatttcctaaatcctcctaatttctcccccaatttcccttctattttctccttttcttcttttctattttccctctttttctctcctccctttctttttctctcttttctctccctctctttctttttctctcctttttctctcctctctttctcttttctgccggcctctcttttctttttcttttttccttctcttttctcctcccggctcctttctttcttcccttctcttcctctattctctttcggctccttctcctcctctctctcgtgctgcctaccgcgaccggctgaggaaaggaaaaaggcggcggcggcacggcttaccagcggcgacggcaatggcggcggcgcacggtggctgcgacggcggcggcgcacggcgactgcgacggcggcggggaatgcggcacggccaaggcgcggcgcggcgcggtggcgtcgtggcggcggcgcggcagctctatgcgacgacgcggcggcgtcgaggcggcggcgtggtggagtgggtagaggagaggaggtgaggatggaggggaagagtgggagtagggggaggattatataagggaagggggggaagagataatggggaagagggaagaggggcggccgcctcatggcatcagcggggtggcgcggcgcggggctcgactcggcgatgtgacgacgacgcggcgcggcagggcgcggggcgcgaggagcggcagcggcgacgcgacggccgaacggcgacggcgcgaggcgatggaacgggcggcgcggcgcggtagcagcggcggcagcggcgatgggacgcgcgcggcgacgggacatcgatggcgacggcgacagcggtggcgcgcggctcggggcgggatgcgatgggcggcgacacgacggcacggcgtgacagcaacgatgggacggcgcggcgcgggctcgcggcgcggcagcggcagcggcacggctcgaggcggtgatggaacgcgcacgcggcgacgggatggcgacagagagagggggaaaaaagaaggagctgggttaggggaccccgtcgaacaccttaggtgcaatgaacagtgccgatttctaattaacccgattttagtgtattttccatataaatttgattccacgattcctaattttgcatatatgcattttactcaatatttgtgttatcttaactaatgaattcaccctagattaatattactcatattttatttttatataatttatttgagttttaattagggttaattcttattccatcgtatttaaatttaattgatccaaatatggttgcgataatattttatttatttctatccccacctaatctttattttaatttgtatttattttaccaatttgtttttaaggtttattcctaattaactattctttactcacgattaataatcttcgagatcaaatccagataaaatagacgaataagatcagcatgatgcaattagtttaaaaagtttttgaaaatccgtatttttatagttttgattttgtcggtcaaattttcagggtgttacaaacctaccccccttaaataaatctcgtcccgagatttcttaccagttttcgaatagatgcgggtactccgtcctcaagaattcttcggtttcccaggtggcttcatcctcagtgtgattgctccattgtaccttgtacatacgccacactttgctcttagtcctcttttcggcttcatccaatatccggatcgggtgttctggatatgtgagatccttgctaatgtgactcttccagcggagcttgctcttccggcactcgtaaacatttctttagcttagacacatggaagactgggtgcacatccgcgatattctctggtaactgtagctgatatgcaacttctcctcgcctggcgatgatctggaatggtcccacatatcttggtgccagttttcctttgaccttaaacctttttgttcccctcatcggagaaacctttagataaacgtaatctccctccttaaattccaggtttcttctttgggtgtcggcgtaactcttttatcatgattgtgctacttttagacggtcacggatcaagcgaaccttttcttcggcttcttgaataatgtcaggtccaaataccgcctgttctccagtctcggaccacattagcagggtacgacatcgtcgaccaaacaatgcctcattgggtgacatctttaggcttgcttgaaagctgttgttgtaggagaattcggcgtagggcaaacatctctcccagtccttgctaaaatccagagcacaagccctcagcatttcctccaggacctggttggttctctctgtctggccatctgtctgtggatgataagctgtgctaaatgcgaggtaacttcctagggcttcatggactttctcccagaaatgtgaggtaaactgtgtgccccgatcagatgtaattttcttaggtacaccatgaagacatactatcctggtcatgtataactcggctagcttagcactgctataatttgtcttaacgggaatgaatctcgccgtcnnnnnnnnnnnnnnnnnnnnnnnnnaaatggaatcatatcctgttgcggttttgggcaatccaacaataaaatccatacctatctcatcccatttccattcgggaatcctaaggggttgcagcaagcctaccggtcgctgatgctcagccttcaccttttggcacacgtcacagagtgctatgtattccgccacatctctcttcatgttgggccaccagtatccttccttcagatcttggtacatcttggtacttccggggtgcaatgaatatgccgattcgtgagcttcctttaaaattaatcccctcagtccaccctgttcgggtacgtaaattctctttttataccatagaacatctttttcgtcggttgaaaattcctttgcacgtcctgtagctaagcgttccttcacctctcggacttcctcgttgtccttctgggcttcttctatttgggttctcaaaagaggttgaatgtccagggtgtttatctgtccacgaggtactatatgtaggttcagctgagctatctcctccctaagctcagggatcatcccttccattctcagatgattgcaatggctcttacgactcagagcgtcggccacaacgtttgctttgcctgggtgatagtgaacttctagatcatagtccttgattaattctaaccatcgcctttgcctcaagttgagatctgactgggtgaagatatactttagactcttgtggtcagtgtagatatcgcaatggtttccaatcagataatgtctccaaatctttagcgcatgaaccacagctgcgagttctaggtcacgggtagggtagttttcctcatgtggttgcaattgtcgcgacgcataggccacaacttttccgtcctgcatcagtactcctcatagtccttgccttgacgcatcacaatatataacgaagtctttcctgatgtcgggaagaactaaaataggcgccgaggtcagcttttctttgagctgctcaaagctttcctgacactgttctgaccacacaaacttcttttccttcttgagtagttgtgtcattggtcgggctatcttagagaacccttcaatgaaccgtcggtagtatccagccaagcctagaaaactccgaatttcagtcacagatttgggtgctttccattctgtgacagcctccactttagcaggatccactgctactccaccggccgagattacgtggcctagaaaagcgacttcttttaaccagaactcacacttgctgaattttgcatataacttatgcttccgaagtttctcgagtaccaatcgcaagtgttccgcatgttcttcctcatctttggagtagattagaatatcatcgatgaataccaccacaaatttgtccaagtagtccatgaacactttgttcataagattcataaagtatgccggagcgttggttaaaccaaacgacattacggtgaactcatataatccatagcgtgttgagaacgcagttttgggtatgtccccggttctaattttcaattggtggtatcctgaccgatggtcaatcttagagaacaccttagctcctttgagttgatcaaaaagatcatcaatccgtggtagtggatacttgtttttgatagttacttcgttcagtgagcggtagtccacacacattctcatgctaccatctttcttcttgacgaatagcactggggctccccaaggtgacgaactggggcgtacaaatcccttttcttgcaactccctaatttgctttttaagttcatccaactcattgaccggcatccgatatggtctcttggatatgggggcagttccgggtatcaggtcaataatgaactctgtgtctcgatctggtggcattccaggtaaatcttctgggaacacatcaggaaatcgctgcactacgggcattccctttaggggtagcatggtaaatatacctccggcacgttcggttagcctaggatcttgatccatggttgctctcatatccgatccccagggtgtggtcagggtaacttctctacgtctacagtcaattatccctctatgctttgctaaccaatccatacccagaatgacatcaagagtttggggtattagcaccataagattggagggaaataccacatcccgaaggcggatgggtacgtcaatgcaagctgtatccactgctatctcacccccaggtgaatgtactaacattggttgtcttagtttaactctgattaaattgtgttgttgacttgctttcaaagatataaatgaatgcgatgctcctgaatcgaagagaactttaactggagtggagttgagtcaaaacatacccatcagtacgccttggtcttcctgggcctcttcagctcgaacgtggttcacttgcccgcgtccaaattcggtagcggtcctgttagtctgcggagtcctgaatagacctcgtccagcagcaggggtagcagtcccgtgaatagccgttgcattagctccggtgcgaatgggtgtcttgttcggatgaggacatttattggcgaaatgcccatactctccacagttgaaacaacttcctggccttactgatccagtggcggcctgattcggtgcaggagcgcggttctgaatggtaaccggcctgtggaaattactggaggcggcaggtcgactggttgtcaccactgttggtctccatgccgaggaggttgtccctttaggacgctggggtgcggtctgaggcgggcggttcatggcaagcctccttttacgattgtgctccacgacctttcggtcgttctccaacctaacgaccttattgattaaactctggaaactatcgtggtcttgtccaatcatgggcccgcgtaactcgtcattcaagccttcaatgaatttgtcgatcttttcctcctcgttggcaagatctctagtcgcgtagcgcgccagctgagtgaaatggttcaggtactcttgtactgtggtattcccttgccgtagtctcctgaactcattcttcttcatccgcatcactgcggcaggcacgaagttgtcacggaaggctgtggtaaattcctcccagtttggttctccagcatcttcttctcgggattctttgtacgtgtcccaccagtctccggctggtccttccaattggtttgccgcaaagatcactttatcggcctcacgtactcgaataagagttagcttcttctcaatgatccttaaccaatcttcagcatccataggttcttcagctgtggcgaatgtgggtggcttggtcctcataaactctccaaagcttggccctccgcggttgccttggttgttcgcgatagcttgcagaagttgagtttgggtggccataactccggccagagtggctaagtcgggtgtctgagtttcgtcattgctggttgttgcccgacgtcggcttgccatctgtgcaggttgattgattgagtaagtatcctaattctctagctatcttttacggctttatcccattaggggagattgttttgatgtgaactttgttttgcaagcatggtggaataaactcatttataacacagcaacaatagatatcataaataacatcacagagtttcacaaatggcacataaatcatgatgcaatcgactgcatacatacgcagtccaaataaggttcatccaaaagatacatcaaactaatcatcaatctactcgtcaatctaggtaagggaggggggtgtctcgcatactatccaaaaaccatctgatacgagatcgaagctgcaaggagtccgtcagtctagtcctccagccatccgcaggatcctggggcaggtagagggtggtcgctggcacgcgcaaaccggagtccccacggctcagaagtagtggcctctggatctggcttgggcctcttgcccggaggtcgtgtgctcttgcgagtagtgctgagggtgcgaggacctccaaggaaggtgatgcggggaacaggggtctcatcctctgaaggatcagtgatgtctggcttgatctctggctcggtgtcggtcccctctgtctcggagtcgacctagatcggagtctccaaactggaacccagctgcggagaaggtgtagggatcagtggagtgtgcaccatctccgggacaggtggctgtgctgctgtcgggtccactatgtaaggtgctgactcggtagctagcatactagcctctcccagaagagcgtggaacgccggtgggtacggcggggtgaggaagaagtagcggtcacggcctactgctgtggaagtagaagcccctgtggtgctgatcttggctactcgaagctgctcctccagctggctgacgtgctcctgactctctctcagctgctcctcaagagtatccatcatcccgcggcgatcgttgtactggtcagataactgctggaactggtcgccgtggacctggagctgtgccttcagtaagtctatctcactgccccaagcctggtgctcctcctccaactgaagctgctgcactgagaggtcagtcaactcagtctccagctctcccatacgtctctggtggtcgtcaatctccaacagagcctcctcgtagtagtcatctactgcctcagcccatcgtgacaaccgagtcaccatcgggttgtagcagcagggcgtgtcctgaactgtgcaaactgagttgctctcctcccggaacgggtgatgagcaaactcggtactcactaactcagctcggtggatagagctgagtcggaggaaggcctcccgggctgcatcctgcatcgcggtatctggcaggtctcggtggtgacgtgtctgaaagctgtagtccaactcggaagggactcgggggtgaacctcgacccgagcctcccaaagtgagccacactgtctcactcggtatgacgggaacccagagtatcgcagacgcctcaacatacgatgcagctcaatgacatacccctctgattgaggtaagctcaactctcaggtagcgggtgaatccgaatctgccatctaattttaagaaaaacccaaagtcaattgagagtaaaacttgttttgtgaagaaaatagttaagagtaagatgaaaattgtaccgagttttgtaaatatagcgtttttatttttgaaagtattactaaatgggaatttctcccttggccaacttagaaaaggggtggggcgccttttggtcttttcctacagtcatatggctctgataccagctctgtggacccccgtttttataacaggaatcaatcgtgtaaacagtaccatttccctggatcacgtagtctggtacacacgaattcatagctgaaataccaagtgcacatacacgagtgtctaatacgaattattacatcataagcccgcaggcgtagtcttaaatcatcggaccgagcggtccggaatacatcccaaaagcagaaatagataaggcagcggaattcaggcagcggcatgccattgccacaggcaacgaccgtactaagacctactgagcgccatcgtcttcatctccctcctggtagtaggcatagggatcctccgaggcttcatctcctgcttctgattaattttatatttgcaagggtgagtaccaaccgtactcagcaagccaccacagcaatgatgcacatgacagaggaattcaaaggatggctatggttcttttgcgcaaagcaagttttgt

SEQ ID NO: 72965 - DNA, 2819 bp, Oryza sativa
tcaggcagaagtggaggtaggtatgtgccgtcccgtcaggaggatgttcggaggacgaccgtgcaaatctccgtccatttatgaaaagaagaaaagtccagtttggaaagggaggggtgcatgtggtatccccttgaagtataaaaggaggaccttgcccatagagaaaggggttggttgattcttcccaaattcagagccttgaacgagggagaggtcggctcacactttgtagctccttcatacacagatccaccaaaacacaggagtagggtattacgcttctcagcggcccgaacctgtatacatcgcccgtgtctcgcgtttcttcctggcggacgatctttccacataccgagagagcttgagatttcaccctgagcccccggccgaaccggcaaaggggggcctgtgcggtctcccggtgaggagcgaggacttctgcttaggctgtttcctaagcagaaggtcgtaggtttcacgttgcaaacggtgggagaaaccaccatcgcaatttgccctccccgggcaacgcacggcgggcggtcggactggtcaaaagtgagggcaacttccgaccaccgcgcccggcgcgtcgcctcatgagtaggggcagcggccagaagctctcgcttcatggccttgaggctccgggcgaaaaacgtgcgcacacgctcctccatcgacagtggctatggtagccccaggctcttggaaacctaggtcattatcgccatcatcgatgtcctcggcgggggccttctgcttggcctcacttcgccgacggccggaaggaaccgccggggacttgccttcccggcgctcctgcctcctctcctcctcccacttccttgtccgctcagccaagcttttgactgcgcgacagtccgcaaggtcatggagggaggtgttgtggacggtcaccacttgccggtagggcgctccctgctgggaacgctggcctccttctttttgtcgctcgcaggcctcccctttcgggtggcccgtgaagcgccctcgacggcgaggacatgaccctcgtagtcggaacggactgacctcttcttcctcctcctgtcacgccgccctgactgagcggcggatccgggggcggccgaagctgccactccggaaccggaggggttccaagtccaggcctcctccttgcgagccactcggtccgcgagctgaaaaagctctgcggtagtctggggctctttggaggcgatcttttcgagcatgcggttgtgccgcacaccccccctgaacgcgtagattactgcgtgtgcagggatgcatggtatggtattgcggacttgacaaaaccgctgaatgtacgattgaagcgactcatcgtcccttcgctgtacagcgtgcaagtccgcttcctcaccggggcgcggatacgtgccttggaagttcatggtgaactgctggcacaaatcctcccaggagtggacagacgcgggtggcaagttcattagccaaccccgtgcttgccccttcagggccatgggaaagaaattcgccatgaccctgtcgtcacccccggcggcctcaatcccggtcgtgtagacctggagaaactcggcggggttgacgctgccatcatatttttcggcgatggtgggccggaaccttgggggccaacggacattccgaagactcaccacgaaggctctacagccaacaccaccaaccgggggcacggagggctgattcccacgtccgtgtcgaggtgacactctagacgaggaagcgccttccattgcgtgggcagcacttcggtcattacgccggcgctcgaggctggcgcgggcgccctgctccctacgcagatcttctcgggtcgaaggagtcgatgagggagtggctactgaacggcgaacagcggctgctgctcgtcgtgcccttcgtcttgacgacgcggagccagtggtagcagcaccagaggtcttggtggcggaggaccgcccaccagcatctaggcgctgccgcgccgtcatgaccaatttggccacgtcgtccagccatcgttgggctggagattccgggtcagggacgacaggcgggtggcgtaagagcgcgcccgcagcttggagcgcgccctggggcgtgctgccgtcgccgtagacgaggaggcgacgctccccatctcgccgttctcctccatcgcccgcgatcggtgaagccgcggatctttcgaccctttcgagcgcctccccctgcttaggactttggcgaggagggggcggtggagtacgagctcgacggcgtggattcggctccccgtcgtcgccactcacactgggagagaggtcgggtgcctttgcttgctcagccatgaggctgatcaagaaaaacttgacgcacccggaaaagtgcgagagctcagaaaacactcgctgagccccctacctggcgcgccagatgacggagctcgtggcccctcaccgggagaccgcacaggcccccctttgccggttcggccgggggctcagggtgagatctcaagctctcgctgtagatgacggaaagatcgccacctctcaagagaacatgaaacacaagcgatgtatacaggttcgggccgctgagaagcgtaataccctactcctgtgttttggtggatctgtgtatggaggagctacaaagtgtgagccgacctctccctcgttctaggctctgaatctggaaagaatcaaccaacccctttctctatgggcaaggtcctccttttatactcaaggggataccacatgcacccctccctttccaaactggactttttttcttttcataaatggacggagatttgc

SEQ ID NO: 72966 - DNA, 2221 bp, Oryza sativa
ggagaccaagaggtgggcgcacacatcaccctcgggcccgacgtcccccgagggtgccaggccacgtgggcgattgtgtctgcctcaagcctcgagtcatgatactcccggtcccatgtcaccgacacccgtccattgtcttttctctttattgtcattgggattttgaaaatcgaacataattatcgttcgggttcatttttttactttctagaagtcctaccaaaccgtcgacagctttgccattgtactcctctatgactcgctcgctgcctcccttcttattatcattgagattttaaaatcgaacatgattatcatcgtttttttcactttgtagaagttttgaacctttaaaaattggtttattgtcttgttgggtttcatttttttataacttttgaagtatcgtcacacgatgccactatactcctatacgacccattcgcctcttagtctttattatcattgggattctaaaaatcaaacataactattgttggaattcattttttattttctagaagtcccgccaactgtacggctatgtaactatactcctatacaccccgcccgctgcttctcctttttattgtcattgagatttttaaaattgaatatgattatcaatggggtttattttttctactttcaagaagtcccggcaaccgcattgcccgtttgcttcacggccttcctgtcgtccctccttttaatcgtcatttggattctatttggtgttttatgaacagcttttatatgttttctcaaccgccaccactctacatttttataggccaattacttataattctatttggtgtattattaacaatttttatatgtcgtatcaaccaccacctctctattcttttataggactgttacttaatttatgtcgtcatgtgttttacatggtcttttctttcaatagtatttattttttatcaccaattttagttatttataaattatatttctaattaaatcttttttctttttctaatttcagaatttattttttttccaaattttaattaataccgtatagtgttcttttaatatttttatagcaaaatttgctacaggacactcaaaaaacgcgtaattagctgagggacaccgagaaaatgtttaactgctccaggacactacaaattttgtgaaatttgccgtaggacaccgagcttattattttatcatttcccggctgaaagtggcgagtattttttcaaaatgcctaaattgccccgcgtcccaatctatactctggagctttggagctgatgatggcatcaacctgctctttcggggagatgaagttgtgcgcagggttggtgagatccggcacgaggaggttgtgggcacacaccatgtctgcctcatcgaaggagcccatctcgatgagcacaaaggcgagcgcaaaggcgatgtgcaggcagcacggggccatccatgctgctctcctgaggtgattcgtcgccttttgctgatccgcgcgcgcgaagtaccattgcgcaaggatggtgtggtacctcccgaggagctgcttggtggcgagcccgtctccgcctgtgtcctgcagcgcggcgatcgccccgtcggcctcctcggtgaatgcggcgtcacagtccgaccagtcccagttgctcgccggccgctcgccgctggcaccggccatgggaggaggaggaggaggaggaggagcgcgtcacgacgttgcagcccgccgcgaggcagacgaccgacaccaaagaagcgcgcgcgtgaggtgtttgtcgaaatgccgatgtggcgggacgcgacgacttaggatatacgcgagacttaggatataccgacaccaaaggagcgcgcgcgtgaggtatttgtatggtatggggatcgttggaactaggatatacgcgagacttaggtaaaagagacagacgagaatttttatacaggtttgggcccctgaattatcaggtaataaccctacatccttgtcagggttatggaaaccacataccatgtcggtagggcccaccacatactatgtcttatacggaaactgacctcgagggagttccggataaggaaagacaaccaaagttctacatggaaacgacaaagactgctcgaattgtatccatattggtttccctagttctacttggacaaggggacacatatgggtataaataaaaggcatgcaagcttgagtggggacacaatcaac

SEQ ID NO: 72967 - DNA, 874 bp, Oryza sativa
aaggcggaggaaagtggtatcagagccatctcgactgtagggtaagccaagtggataaaacctaaggacatattttataaataaaactatttgcgaaagttcctctttttctccttcccctaatgctatttgcaaaaggtttactcttttcttccttcttcaaatttcaattagtactagttggtcagatttgtgaagaaaaagatatcgtcagttgtttgccgaagctccggaagactgcaggattcgctagcgaagtgtaggaagcagtgaagccagctgtgaagccgaagctaagatcttggagaacctgtcgctgaacctaagccaccctctagggtagagtcgttagtcgtgtgttccttgcttgtgtgtgtagtgcgtggtttgcatcggtgggttgtgatgtgaccatgctaggttgtttgtttaatcaacttgcagaataagcaaaacaaacaacacatcaacaaaaagagttagttcctttaaggtcttgtccctagctctggtctattctttccttgtatgcttcctctctcaacccctaccttgtgacagatggataacactggtaacaaaggctatgggaatgatggatccgatgactcaagaacccaagccaatgggaatgagaaaagcatcaacgaaacctcaccagagctaatccaaattgtggttaaccaaaccaacatgttggcaacagcctttcaactattacagaatcggaacaacccagcaggggcaaccaacgttcaagtacctacagtccagcaacagtgcaagttatcagaatttctcaaaacggggcctccaacctttgccatggccgtcgatcctatggaagccagtgattggttgcgcacagtcgaga

SEQ ID NO: 72968 - DNA, 1475 bp, Oryza sativa
cgaaagtgagcataatcggatgaagaactgcaagaagaaggattgtcaccatcccagtatttccaggtggtaaccaaagacagcgcactgagccacttcagatcaccggatcttctgttgtgcatcaagagttcctgccccaagaagatgaacacaatgcagacagcaacactagcaatactaatgatgatgataccaccaacaaccatggttcttgccccattagtgaccactcgaataaagcgtgcaatgtcagtagcattcaccaagatgtcaacgatagtatcaatgttggaacccagaatgacaaccttagcaatttcgacactgagaaagactccaatggtgatagcaactatggtaccactgatgccaatgttagcaaggattcccaaccaccaattccaactccaagtcaaaatgatcgtccccagatggacagctcagtaaagaagacgttgatttgttacaactgcaaagaaccaggtcatttctctagagattgtccacagccgaagcgtaacctgcgccatcactccggccattatgcaagaagaagacaagtcactcgccttgtggtcactggagcaaacgctgtacctgtgaggcctcatgttaattctaacccatagtagaaacaatgtaccgatgttaagcaccttccctttttgtttaagacagtgccttgtattcatgaaatatgggagaaatttgtaataaaaacaagttctaagaggattcttttggaagatgcggatatgtgatcatgtgtataattgtttactgacaaaggagacctagggtctcgtgccagaggaactatattctaacctcgagctaataaccaacctgaggatggaaaagaaaatcaagtgattaaccaaagagacatttgtttggactaagagtttcagatgtgtctttttcggatcgaaggcaatgacagtcagtatagcttttggcgaaacacttcaaggtttcactgaaaggtagcagaccaaaggaccacatcgtcaccagaagcatccacaactctcggagagaagagtacttggttggcaaagtttaaaaggtgattgatagaagataccagcaaaggtgtttattaccgggcaaggaagtaggtcgaaaggtgattgataagagaaatttgaaaagaacacatcagggttgaatgtgtaaaggaatactttgaatgctaaatgatgacaaacatggtatcctagtaatgacaagctagtgttgacgcatgacatgaagtggtaacttgtatgaggttgactccaaagatatgagttataagaagttctggaactgaagccccatcttccaatgccgcagcccagtcgaagtcagctagaggtgcaaccagggaaaagtcaggtgaagagaagattccatctgcaacaggagattgagccaagcagtccagagtggagaagttttgctaggcaagtttgttataaaagatgcga

SEQ ID NO: 72969 - DNA, 1183 bp, Oryza sativa
aattttgaacaactgttgtctgtatttgtggcgctaatgtgtagtgtgtgtgaattttgggcagcaaagaggtgagtgggatttgattgactcttgtcaacatgtgcattaatgtcattgtaaactacggaatgtttactctttctttgtgccaatcatttgctggcaagcttgttgtcacgcccagaaatttagcccaaatttccaaactattttgtgtattaaatctctgtccaggaccagccagggtacacaaaacgacaagtaaatatacatatccaaacgtaaataaagcgtaaaatacttacagaagaggcacttagtcctcacactgagatagaatgacagcagcggaaaaggcgatcctagcggggcttcagctctactccacaggcaaaactcaactggggtctgagccttggtcctctaacttcgtcttcagctcagaagcactacacttctgaaaagggggaaccatagcaagactaagtacaaccaccgtactcagcaagccacactaatgatgcagacgtgcaagggcatacaaggacggcttgtggctatttgcataaaggcagttgtaaagcattttattgagcaaaacagtaaaacaatagagtaattaaggtaatattaaatctccactgaacaatgctacaccatgttgaacaggcccaaccattcccacctgaactaataagtgcattgagtcgatttactaggggtgagactaatcacggtgaatctggtcgatctcccataaccgcgggcatggctattcgaatagttttactctggccagaggtgcacaactgtacccacaagacacaatccaccggcatgtcacagtgtcatcatgtgcccatgatgaacaggtcaccacgtcgagtgattgtgagaagacccttcatataaccccctctaaccaatcgcaccacacctcaggtttcgcccccgcccccagcaggcaacgggcagccccccctcgtgccacagtgaatccggaagccgatcaaccgaacaccccagccgacccaacttcatcacgcccaccctagcctaagaacgttagccagaggaaagctattgtcacgcccagaaattcccgaatagaatttcaagcagaatgtgcattaaattccccgtccaggaccagccggggtacacaaacgacaatgttgac

SEQ ID NO: 72970 - DNA, 3341 bp, Oryza sativa
gagttccggttcgccgccgccgtcgctccggacttcctccccactcggcgtcacctccatcggcttcgccgtgttcccgtcgacctcgtccgcgccttcgcttcgcccgccgaccgccggagctccgtcgtcctcgccgtcccgaaccgcgccgccgccttcttccgcttcggccgccgttcccgtcgtcgccgtcgaccggggtgagccgaagaccgttccgttcgcttcccccttccctcctctctctcgggtgccgctccgccgcgccggtggtcgccggcggtgaccatcggggcgcgggcgcgttcccctcccgtcggccgtgccggcgaggccgccttcgggcgcgccctcgcggctgccaagtgggcccggccgtcagccgcccgcgcccgcgggtgcggctgacgcgtgggacccacggcgccgaccgccgcaaaacgcgtgctcccggtccaccgtggaccgagaggctgacgcgtgggccccactcccgtggacccggtccgcgcgccctctccctcggctgacgcaataaatgcgtttttaattaaaatttaaatgaagaaattcgtaaatatccatttaaagagcatataaacttcaaatggccatatcttggccatttgaactcggaattggaccgttcaagtctctaatttttccttaagaagtcaagaacccatttttgtgctttgtttctgctgttatgtggagtttattagagtaaaagccttttcttttccgttggtcgtgtagacgctgcagcttcggaagatccgctcttcgtggaagtcgaagccgtcggttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccatattattattgttattgttattattattaccttgttcaccctagattaaacaaaacctcaactagtggacactctactcgtggtatccctagtttaaatttaggtagatgcttcgcaatttaattaggtaacattaggtggttttataactttagacttgggaaatattcatatcacctggacactgtggaattgttggattattgtggaattggcttcacaccgccccctctattcaaaatcccctaaaatggttttaggctgggctcggggtgcatggttttgatggtagcacctcggccatataaggaccggtcttcgggcctctgttgcaaagcactaccgtacttccacatgtctaatgggtaaggcttagtttgtggctcagtctagtcataaacaaaagtacacggattggagatggatgaagtcgggtgtcgatggacattctccagggcaaatgaaggctacacgagctgcggcccggtagtcgagatgtcatatggcagagggttggtgccctgctgctaggggctcagttctgcctgcctgtcccgggtatcccggccgtaggtgggattgggtcggtactcttgtctaaggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgagccctcggttatgggcaagccgagcaatgtacccaagttagtgttttaattcttaaaacctgcttaacaactaaaatatggaatggttggcctgggttggcttaggacgagctgggacccagggtcgggttgccagttcggtctgaatcatcgtaggccttgggttaaggcaggttcgtgtgggttcacggccttgattaataatattgtttagttctaggatcgtgtttacaaaatagcttgagcaactaaatgtctttaaatgctgtttactgcaaccctaacccctctatggtataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttctcgtttgtctctgtgtgtgctgggccttcgtcgcccatgtaataaattaactatttacgcttccgcttgttaaactctgaattgtatcaacttttggtgtaccttgcctcctgggacaaggattaatgcacgcacgtaaggaatgcccgttgggttatttccggtcgtgacaggaatcctgcgcctcgatcatcacagtggtggcgatgagggcagccccccgctcctcctccacctctcgtgcgatctccgccagtgccgtcttgcgggcctcaagatctgagacgtgccggcggtgtgccttgcggcccgcttctaccatggcctccaccgagcgccgcccctcctcgacacgcgcccatgcggcgtcgagctccgcacgctccgcctgcagggcctcacttgggcgctgaacccatctagcaccgcggtgtttgcggcggccaaggcctgcagaaggggctcggcgctcagcggggcgacagaagacgaggggaagagctgccttgaagaagacgccgcgcggctcggcccgccaatggacgcgccggcctcatcgcgggccacccccggacctgtttggtcctgggcgtcgcctgaaggggtgggcccaagcgaggcgtccgcggcctcgtcgtgaactgcctcggaagccgccatcgcctcagcccggcgaacccgggcggcctcctcccgagcggcttcttcggcctggcgaacccgggcggcctcctcccgagcggcttcctcggcttggcgggcccgggcggcctcctcccgagcggtatcctctgcatggcgagcccgagcggcttcccgggcggcctcttcagcttcccgtaggcggtctgcggcctctcgccggtcagattcccgcctccgtgcctctgcggccgccggatcttcggcctcggactggccggacttgggatggtgggaggaacgcgatgggatatcactgaagcagaaagaaaaaccagaaggcaaacaagatgggtaagagaaaacttgcttttgggatagaagaaaagacggtcgcaatgagcgtgggacgaacctgcgagggggtcggttaaatgacccccttgaaggggaaattaggtttccccgggatggttctgtctcccccatcttgcgcagc

SEQ ID NO: 72971 - DNA, 1018 bp, Oryza sativa
caccacgacacaccggaaagaggccgtgacaggacccttcgcataaccccctctaaccaagcacaccccacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggagagctacactacaagcctagccgttgcccacgctggcttgtggtaagtacgataagttcttccagggcatcccgcgaaccggtccttaactgccatgggtgcgacttgctaaaccatgcacccccagcccaccatgtggttaattttaattaaccaacaccaaagcggtgtcactaatccaacaaagccattagaaccaacagtctaaacattaatgtgattttccccattgtgaactagttgaactaagcatggctaagcaattcctagtccaaagtctattcatgttataacccaagctaacaaaggagcatggtatcaaaatagcatggctgtaacaataggtaaacatcccatagtaacattataaaacaatgcaatatttgaaagaaaacaatagagcatttgcaatataggatcaacatgttcaaatgacaagcatgacttgccttgctctgctgctggagaaacctcggcgactatttcgaagtacaccggagcgtcggaggaaccggaatctagcgacaaacaaagcaaacattgcaaacaggctataagactactgaaacagagaacaaaaccatttttaatggattctacacatttttcttgatttactgagacttgagtgggcttaaacggagctcggatgaattagttatgaattttagaagattcactgtgtttattactatacaagaaaaaccttaaatcatttattgcgcaataaatcccagggctgacgccagcacggagggggcgcggcgccggcaagcgggccccaccggtcagcggctcagggggagcg

SEQ ID NO: 72972 - DNA, 4413 bp, Oryza sativa
  unsure (1)..(4413): unsure at all n locations
aaaagaaaaagaaaaaggaaaaaggattttccctggaattaaaatattgcttgctcaattttaattggttaaaattatttctagggctctgaaaattccactaaaaatcctgttagtgaatttcgacatgtagaactcaagaaaaattccacatgccaaatccgattattatttgcattactttcttagggttttctcttgattgcacctgcattttcttggggttgtttataaattaaatttaggcttgggaggagaacttcggggtgtgacagctatacttcaagtcaggcagttacctattcccgcttgtggcaagcactgtgtgtcttcaagggtttcaagcgaaccggtccttaattgccatgggtgcgactagcaaaaccatgcacccacaacccaccattcagtcgcattttagttggataattacgaccatgaaatatggccagatgtctcgagcacgcagctcgtcaagatactgaaaggtctaatactgcaattatcccatcaaatgagctagtggtaattaagcatggctaagcatatagttctagctaggtcacataagtaacatgagctagtcgatttattacccaaggttgacaaaggatagatatcaagtaaacatggcaaaagcgagcagataggtaaaccctgatcacatgcaattagtaagacatgcaatttttatttgcaaacgataaaacatttataaattaggatgaaaatgctcaaggagaatgtgtgacttgccttgcttcttcactttgatcttctgaactattttcctcacaaccgcgatctttcaaaacgacggaaactactcgctggcacgcaaaacgaggaaaaaactctaataaaaaccaagtaaacagtacataaaaagtaaacaaacatgtagagctcaattttagatgaattttgcaagttgaatggtttaatttggagtttgtatgaattagatatggattttagaagtttcgagccatttaaatgaatttctagaattattattgatttattgcgcaattattatatatttttcttaaaggaaaacaaaagttattggctcagcagtggggcgggcgtggaccgagtccaccaaaggtgggccccacacgtcagccaaaaggggaggggcggcgcaccatggaccaagaccacggggtggtccacaggctaccaacacgagcggcatggcaagggtgcgggttggctcgccgaccaactcgaggcggcggcgcgtggccaaatggcgaccgccggcgacgacactagcaccgagcggcggcacgggaaacggggaaggaggggaataaatggagaggaggaggagggagggcggttcaccgaaaggcgcggcgacggagggagtcggccaacggagctcagggcagagggaggcggcggcgcttcagtgactaactgcgacggcggagggacggccgaggggcagtggggcgcggtggagatgatggtggtggaggcgctacgtggcaacggctatggcggcggtggtgtgctaccggagtcgtcaaagcggtggtagagctcgggttcacagtgaaatggtggttccggcgaggatacagggaaatggagtaaaggccggtgtccgcgaggggtggcggagctagtggtgccggtggtgcaaagcggcagcgattggagcggcggtagcggccaggactagcatacgattgaaattttaatgttatggttaatgagattattccatgtatgccacagactaacgactggtattactctctttggttcatattataattcgatttaattatttttccagttaaattgttttatgtttaattaagtttttaataaatatagtagtattttaaaaaaacgaatatgttgttaaaatatattcaaagcaattataatatggagtaaaaggagtactaatttagaaaaaaacgaaggacagaaaagaaaggaaaggaaaagtaaaagcaaacgacgattcagacagacaggctcccttccatgcctccccattgctcctactctcccttgaggccttgacccacccccaggaaaagcaagggaagcatgcccagcaaaatcgaacccacaaaacctcaggaattaccatcgcctagcaaggaatcaacaatccgtggtcaatccatggcagatcaggatgtggccgagccatggggcttgtcggcatggccccccttgacctccctcctcctccgagccatgaggaagcggcgcacctgggcggccctcttcctcgccgtgtacgcctctctgctctgctcgtcgtggcgcctggtggagtccgtgcgcgcctggtactactccgcggccggcggggctggcgccgtcgcggcgtggccggcggctttctacgcgtccgtgatgtacggtgccgtcttcgggctcctgtcgatgggagccgcgttagccgtggcggcgccggccatgctcatcacatggatcaccgtgttggtgctactcgcgttcgccggaaacccgcggaggtcgctggtcgcagaggggcggcgcgccacggccgatatcgcgcggctcgcgctccgcgtcttgctgcgcgagggcaacgcagtcgctgcgctctgcgccgccgccagcttcgcggccctcctcctcggccgccgcgacgacgacccggcggaggggagcggcagctgatgtgacgcttcctgcaaaattgttcaattccatgtttttttctttcagttaatatccgttttggggtttcagtgtttcaccaaccacccctccctcaccatccttttttttttctgtagaggtaaattatggagaaaaaacagattaattaacagtactacataattgctaaattgcaatcacagtgttgatgccgtcttttctttgctttgctttgtgtggagattatgggtaccccatacccacacggcatgattatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagccccctctaggggcatgagacaacctgatcgtcagatcaatacacactcggcggattcaaatccccaaacaggagtagggtattacctctcatcgagagggcctgaacctgtctaaatcctttgtgtctgcatccatccactttaggtctcgtacgcaacccccttttattattgccgaattcatgtttcgacagttggcgcgccaggtaggggttgcgtcgtattacccgtcgagaagtgcgatggaattaacttcaaaagaaacgttgagatcaatttcaacgtgttcaatggctcgtcaaatctttgatcttcatccgggtttgccgctccaatttattttattattagattaatttctaacaacagattgatcgatgatttgttttgcgagatgacatgctcaacagcgcacgtgggcacaccatcgctatcgcatcgattttgtgcatggcgaactgttccatctacatggcgccgcgagagttgccgccgggtgcactgcatcacgtcaggagtccagccggccgctgtgtgctcgccctggccctggtcaaagactattggttctttacagggttgacttgcatgcacgttcagcacctgcaagaggatggataaacccatgttgcatatttgcatgcatgcatcgatcaacatatatacttattgagttgtttctgtagttgctactaatttgatcaatctgggtttttttggctggctggccgattcttctggctgcttctactgctgcagggaggcctcaccatctcagtgtcgattgcttgattagtcctagtgacacagtgcaacaccaacgaccaattttctccgtctcggagtgagtccggtcgaggaaatcaatctcggcgagttgaatgatttaatcttcgactttgctaggtgatctatgctggtcatggactcgagacgtcccagctattcggtcaattggccgcgagtccactccgccggcttgcctttgccaccgccgctgatagcaacaacgtcttcaccgaccggcctgcctccgtcgccgccgactggtgtcctcgcctatacggttggttggtcacaccaccgttcatgggcgttcacgtcttcaccaaccggcttgcctttggcaccgncgctgatagcaacaacggntttaccgaccggcctgccttcgtcggccggcgactggtgttctcgcctatacggttgggtggtcacaccaccggtcatgggcggtcacgtcttcaccaaccggctttgctttgccg

SEQ ID NO: 72973 - DNA, 9302 bp, Oryza sativa
tcatcattattccttgattatatgtttggtttgttcaattaaccacatagtcgggggttacacctattaggtgcatctagtcgatgcatctgactttattttttcagccctccacagtcttctgatttggaaaaagtactcgggagatcatggcgaagatgattgaagcactcggctttggagtaatctagttcgagagaagattatctttccgactgtgaaggtctcaggggctactgtggagattatgggtaccccatacccacacggcatgattatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagccccctctaggggcatgagacaacctgatcgtcagatcaatacacactcggcggattcaaatccccaaacaggagtagggtattacctctcatcgagagggcctgaacctgtctaaatcccttgtctccgcatccatccacttttagatctcgtgcgctacccccttttattattgccgaattcatgtttcgacactcggcgagttgaatgatttaatcttcgactttgctaggtgatctatgctggtcatggactcgagacgtcccagctattcggtcaattggccgcgagtccactccgccggcttgcctttgccaccgccgctgatagcaacaacgtcttcaccgaccggcctgcctccgtcgccgccgattggtgtcctcgcctatacggttggttggtcacaccaccgttcatgggcgtccacgtcttcaccaaccggcttgcctttgccaccgccgctgatagcaacaacgtcttcaccgaccggcctgcctccgtcgccgccgactggtgtcctcgcctatacggttggttggtcacaccaccgttcatgggcgtccacgtcttcaccaaccggcttgcctttgccgccgccgactggtgtctctgccgacacggctagcctattatgtcgtcgttggtgggcatcttcgctttcaccgtcgaccgccttcgtcgccgccgactggtgtcctcattgttattgatggactgtttcgttcccacatcggctacttctgctgccaccgagggaatacgacaaagctaagtcatcatttattttattctttatatgatatttttccttttcctctgcctcactacaccaattggtcttccattgagtagtgagtcgggggctacagatgttatatcatattttttataatatttatcttgattgcttgagatgtaatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacctaagtagtaaattctgatccgtgaaactttgttccattaatgacgaactcatgtcactcatatgcatgtttgggaaatgcctaggccgactcccgatgcttgggggctatgactagtcggacagagtgtttaaacgtacagagtcatctgctcggggaaatcaaaattgacaagaggagaaatacatatttatcaatattttaaaatacttgattttttctcgagtattatatttatatcagatactactcatcctatatgtttgttctgcaggatccagatccagacatgcataaaagggattcatggctttaagcttatctcttacgctccaggaatggatcagtcagaacatcaccaaccggcccgcctcgtctgccgccgactggtgcttccgcctgcacggctgacttattatgccgccgttgttgggcgtctacgtcttcaccgaccggcttgccttcgccgccgccgactggtgcttccgcctgcacggctgacttattatgccgccgttgttgggcgtctacgtcttcaccgaccggcttgccttcgccgctgccgactggtgtttccgcctgcacggctggcctttatgccgccgttgttgggcgtctacgtcttcaccgaccggcttgccttgtccgctgccgactggtgcttccgcctgcacggctggcctattatgctgccgttgttgggcgtctacgtcttcaccgaccggcttgccttcgccgccgccgactggtgtttccgcctgcacggctggcctttatgctgccgttgtttggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggccttaccatcttcatcgccggtcgtctcgtctgctgctgactagtgccctcgcctctacatttggtttatacagctaccactactgatggacatcatcatcttctgtcgccgactgattatgccgccgccgactggtgcttttatcttcacaactgcgcatcttcactaccagtttgcttctgttgccgccgactcgtattcacttcatcacggcaatgcaactttgtcatcatgcctcgacatctcggcatgcgatgccatgttgttttactacaacaagaggctctccaatattcaggatttctacttggacatcttcaacacatatcttcaatcaagcaatgactactcgacgacaagaagctataattctcgactctatgttcagttgtttcccaactaaccaaagagtcgggggctacacaaatataaggctcaaaatttgccaaattttatgtcaagctgaagaaatcaattcatcaaccaacgagtcaactccaggagtcattatcttcatctttgattcggagcagacattctacttcaacaacttcaaatatttcggtttggacgagttagacaacaacatcaactctcctccaagtgaagcatctacaacagccataacattaatttgatggattattgtcactgacatcatcaccagcacctctgcttcatcggccctgacatctccgctgttgctaatggatgattatgttttcgccgacttattatttcaccttcacggttgacctactatgcaaatgctgatgagcgtctttgtcattatcattggttgcgacactgctattgactggatcgccgacatcatcatcttcatcatgtcggttgcgtttgtcgtcgtcaactattttcttcatcttcattgttagttgatctgtctgccgccgactggtttcttcgcctccacggctgtgcaacttcatcacttttgattggtatcactatcttcactaccaccaatatttttgccacctctgttgggcaatattatctctatattggtcgtcttgtctctatgccaactgcgtcagctaccatcgatgaacaattgtgactacgtgctcaggggcttactagctcaaatacaagtattatatcttcaatttggacttgctccggatacatgcaacatgaattcatgatcatgggtctattttatatgctcaaagactggactatttattattccccgtaagggttatcaactgaatacttgcgccagtcgggattcaattgttacatctattttggagtatcccataagggataatcactcagatcagaagctattcatatgagctacgcttggtctatattacccggaagatttattactcgggagcatgttatatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctggcccgctgacttttttatatagtcatggtgctgtttgggtttttaagcaattgattggatacaatatcattgcttttcgccacgtaagtgtgcatttttattgaccaatattatggcttaggctgattatatattgtggtcatttttcaggcggttggtgaatcctttatgagtttatttactcggattttataccacatatgccatatatttccaggtgtggtggaaccatgtgtcttctagggacttaagcacatctgttaaagcagtgtgcgcatggcgtatgcccaatactatggaaatttctttattcacaacatacaagcttctttatagctgttttgctatgtgaattttcaatgatgtagccaactttaggttacactcatcatattttacaaagcagtcggtatatcacttggatcatattattcagggattcacaccgcatatgctacatattaatattaagtcgcttggttgactacaattatcgaaaccactcggttggttagattatttattccttgattatatgtttggtttgttcaattaaccacatagtcgggggttacacctattaggtgcatctagtcgatgcatctgactttattttttcagccctccacagtcttctgatttggaaaaagtactcgggagatcatggcgaagatgattgaagcactcggctttggagtaatctagttcgagagaagattatctttccgactgtgaaggtctcaggggctactgtggagattatgggtaccccatacccacacggcatgattatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagccccctctaggggcatgagacaacctgatcgtcagatcaatacacactcggcggattcaaatccccaaacaggagtagggtattacctctcatcgagagggcctgaacctgtctaaatcctttgtctctgcatccatccactttaggtctcgtacgcaacccccttttattattgccgaattcatgtttcgacactttgctttcctggtaggtatggcatctgttgcaagacttcacccttccgacagctagaagaaagccgtgcagactgcagaacagaggatccaaatgggagatctcggcctggaaggtactaggcgtagaagaaacaccggttgagtccgttaggacatccctgatggaagccacgtgtagtagactagtagtagactcatgtaagccaatataatctaggattaagggccctttgaatcaaacaaattatggaggaaatttcataagattgaaatcctaccggaaattttcttatgtagctctttgatgaaaaggattgaaatcctacaaaattcctatggaatggcttgttgcatataggttttggagaggtccaatctcttggtaaaaatcctttgagtttatctctctcatccgattcctatgttttttctgtggtctaatcaaacgatcattcctgtgttttttctgtgttttgcaatcatttgttttacactagcattcctgtcagaatcctatatttttcctatttctccgtttttttattcctacgattcaaaggggccctaattagattcataccattataaatttgctcgttataaaatataccattataatttataaaattggaaccacaatttagtaagtatcgaagatgtgccaatacttacccctttcaatacaatttctgaacaaattaccgtcgtcttcttcctccatcctcctcctgttccttccccgttctttccctcctctcagcttcgagttccgatggaacaagaggcaggaatggccgtcgttggcttcattgtacaacgtgcagcatgcatcatcactcccaccactgtagtgatatgccctagaggcaatcatacagatgattgtatcacatactatgtttatatatttatccaactttgttctttgaaatagataactcattattggttaatgaatatgtggttctttcattagactctttatgttgtttgttactatttcttaaggatccatgatcaaatatcatatgtggaacaaatatgtttaaatgatcagcacaagtattaattgatgatcatgtctcatggatcatagtacagagataccaaattaataatgtgaacacatgttggggaacatgttgttggatagacccaacatgatacagtgcaagagccatctgtgttgtgtcatcagtgatctcatttagtgttggtgttgaatccttagacctgagattatcatggttcccaacatgtgtcgtagcttacttagggactgctaaacgctactccgtaattgggaaattataaaagtagtttttgggtatgctgtgaaacatgtagtggaatatgaataatcaagatgggattggcccctcctatggagagatatctctgggcccctcgatgttatagattatggaagtgcatggccatgccaaaagtgattgaggagtcaatcacaagttatataatctatctatcacagattcgagtgaatgattgagctattagaggatggcacatatcttttcttgagcttaatcgatatcgtgaggcaaaggggttcatacaagtatacgctagaggttcagctgatatgatctttatgtatgctcggtgggtcaatacgttctgctaggggccgctgttgacacgtggagcgaaaaggagttttcgggttacagccgagtgtacatgaacctacagggtcgcatgcttaatgggccggaataaggggattggatggagatccaatatgagcttaattcagatagggatccgaataggagtcctacgggccttggaggcccgagtgatggattctatatattcgtgagaggtgtgaccagcggagggatcgcatcacgtgagaaaccctagccgtcactcccctcccggagcaaaaccctagccgcacgcgggtgctagcacatctgcgcgtggcgttccgtccttgtacgtgtggataccagtagaggtgccgctgatttgcggtgctgatcggaatgggagtacggcgagaagagtacacgaggaggagaaggtcgagccggtgccatcgactacttcctctacatcgacgcgcactacttcgcgagaattccttcgacttcttagcgccttcttccgctgcgcagcgcgtcgagtgataacgatctatgatctaatacttgcatgggtcctagtttacgcggtagaaaagttttgatttatgttatcgtagcctacgcatatcccaacaaccatctcctccaggtcaatgggctctagaaaactccataggtgtccttcctgggagctgtacaaactacaaaacacagatatacacatactgacataactaaagcagtctaattgggggaagaatacaactatgtgaggatggggccgggccccagcaactcacttctggagaattccgccagaacaacaacaggaagacgatcttgtaggcgtcgccgacatcatcgtctccgggagcagcatcatttaggtcgttgctgcacattacggtggcggagtctctgagacataggtcatcacctagccatcctgcgaagttgctgacctctactcagtcttgccatgtggtggcaaggtccggcggtggcgacgttgtaggacagcctcaaaacgagggcaacccccggatcttgttctatcgagcttgaagctgagagaagagagaaagggaatgaagaggatgaacaagaagacaagggtaatttggtcagaaagaagtaaaatttgtattgaaatggtaagcaatggcacatctttatggtaaattgtaatggtatggttccaatttcatgaattataatggtatatttcaaaacaagcaaatataatggcatgaatcaaattaaccctataatctacgataatacatgagacgctacacttccattaaaagatattcttaaaaggaataagttcacgtgacatccctcaattgtacgccgagtctgtctaaggtcccctaaccgcaataccagaaatgtgtacccctcaactatataaaaccatccaaaaaaggtcccgaggtagtatggatgcccggtttcgctaacatgtgatgaggatatcaacaccatcgatacatccacgtccccacaagtacaacttcatggtcctattacccgcgctcgtgcacgtcaactgaacaattaggtgagttctttcttgagttcattttcctcttctttataccccgaagacgcgtgcactcttgttttactcaggaacgatggagaggatccaaaggggagaggatttccgccggttggattcagattacaggacagcaccaacatcggacggtcttcacaatttcatgcgatttcggcgtgcaagtacttcatggaaagcttatcaagtctactttcaaatggatccagccacatgttcatatctgttctggagcggccgcaatcgtcgttttagtcccaactgctttctgtccatggtgctgcgtcacctcctttggcccaatgggttgtgtatcaagttgggcccattaggggtgcgtcctagggttggagcacgaccctgtggttgttcttcccctcttcttatacctctaatcgccgccaagaacacttgggttttgatgatagagttagctacttgctaccggctcgcagcgtgcatgttggctaaaccgcctgtctgcatgtaatcagaaccccaccatattgtgtttttgattgtgaaaactttcatcgtcatctagcaattcagtgcttgttctacttgttcttgcttgttctttgattgtttgcaagatgagtgccctcgtggcagggttgacgcgcaccacaagttcgcggtgaccattg

SEQ ID NO: 72974 - DNA, 7712 bp, Oryza sativa
ttcctaaaagaatatttcaactataggattaaatcatatttttttctataaaatccctataaaataggcaataatatagagattttaaagaaaagttagctataattatctttaagtttatttcccacatttaatttctactgactaattaaatgaccatttacatatttttcctgtgatttacaactgttggttttacgctcactattatgccaaaatcttactacttcatgtgtttctatttctcaagtattttttttcatcgcgttttaaacgagcctttcactgctctccatacacagcacccgtgagcaaccggctactcctactctataattaatgagggtagagtatctgaagtgtccccccccccccgcacttttgtcctgttcgcggtcacgcctctacgtagtactacctaggtgtaggtatgtttgaggaggagtggattggggagattgggaatatacgtaaaacgaggtgagtcattagcgtatgattaattgagtattaaatattttaaattttaaaaatagattaatatgactttttaaagtaactttactatagaaaatttttataaaaaacgtttagtagtttggaaagcgtgcgcacggaaaacgaggtgctttctcaccctatatcacacacacgaacgcagctttactgtatagaccctctagtcaaagagcaactgaagttgcaacaccaacctccgaccctggaccaaacaacaatatggctaccacatcactagagggatgatgaagatgaaccatcaaaaaacctgcacaggctgcagggtcccctactccacaatccacaacgctcagttcaaggttcctccaggctttttcccctgtcacggcctctctcgtcgtcgtcgcttgcgtagctctgtaggagtacgcaagcacactcgaatactacaccaccaccatcggttgattgacatttgaccctgattgacgcctctgcgactgcactgatcgatcgatctctgacatgcaccgatcgacacgtccggatcatgatatcttttccctctcttcttgcatcgtctgatgaatccacaatattcatatccttgctataaagcgcggttgcaagcgtacgctgctgtcgctgtcgccattgttcttcatcttcgtcgtcgtcgtcgtcgtcgtcgtcctcgccgcttgcagtcgctgctgccgccgccgtcgccgccgatgcaccaccatccgtcacacgtctttactactaggtactgtagtgttgtagcagtgcgtgtcgtcttgcgacgagctttgtgttggaccacgacgccatgcttggctgtaagctctagcttggcatcgcgctaaccccttttttgttggcttgcgcggcggcgtcacgcccgtggcggtgctactgttcagctgcagggcggaggagcagcagctgggtggcatcggcacagctggataccacatcggagatggcgccatcttccctcctcatcatcttcttcctcctcccgacctcccgctcctccgcactagtaactcacgccactgtctcttccactgttgcattccaagaactgctcctttgtttgattcttgctgcattttgttttttgttttttttttgaaaaggtccgaatccgagctccaagtcgtcgagcaacctcaccgccggaggacaccttccgccgttcgccgtcgccgccgccgccgccgccggggtgagtttggttctttcttcttgctgattgattgattcttcggctgatgcaatgcgaccagcagcagcatggcgtaccggtggtgggcatggcggcgcaccaggggatggcggcggcaacggcggcggaccggttctgcctgccaaggatggcggcggcggcggcggccgcctcgcaggtggagaactggggcgactccggcgtcatcgtcagcagcccgttcaccgacgacacctccaccgacctcgacgacagcgccgacaagcaccacctccacgctctagtggtgccactgccaccagctacctcctctcgccgccgtctttcttggctggctccactcgtgtaatgcggtttctcgtgctactcccagggcggcggcgatggcggcgacgacgccggcgagcagcgaggcgcggattcctccgccgtgtccaaggaaagaagaggggatcagaaggtgcagtcattttgtgtcagaggggaaacggaatctgatctcatgagtgatcaatttggttgtgttcattctgaatatgatttgtccccgaatttgtgtgcagatgcagcggaggcttgcgcagaatcgcgaggcggcgcggaagagccggatgaggaagaaggtgatcgtctgaacctatacattatcgatcattcattcgattaatgggacaattacaatatctgttaaatatactagagcattaattgcttcggaatcaatgttgactgctgctgccgttgctgcaatgttctggaagtagatgctctgctgttacttgcatctttgttttgtggttattgatgatgactaaagacattgcgaattgctgtttgtcgtaggcatacattcaccagttggagagcagcaggtccaagctgatgcaccttgagcaggagctccaaagggcaagacagcaggtgagccctgcattgttcagcatacttatcaaatcgccttgcagaatctaatgtttgaagtctgaacagctcagtaacaaatacgcaaatgcaattgacgactatcctttacagggaatcttcattgcaactggaggctccggcgatcacgggcactcgatcggaggaaatggtggtgttttccacttgcttgatttctctgatctgtcatggcatctgcgcaaacatcgcaattctgattctgtgttgtgttgtgtttgcttctgcaggtacgttggcgttcgaccttgagtacgcgcggtggctggacgagcaccagcggcacatcaacgacctgcgggtggcgctgaacgcgcagatgagcgacgacgagctgtgcgagctcgtcgacgccgtgatgatgcactacgaccaggtgttccgcctcaagagcttcgccaccaagtccgacgtgttccacgtcctctccggcatgtggatgagccccgccgagcgcttcttcatgtggctcggcggcttccgctcgtcggagctcctcaaggttttgacacgatcgagtgatcacccacccaattcagcaacaagcaaagaatctgaagctaccattgaccgccattgttgatgatgttgtttgtgcaggttcttgccagccatcttgagccgctgacggatcagcagctgatgggcatctgcaacctgcagcagtcgtcgcagcaggccgaggacgcgctgtcgcaggggatggaggcgctgcagcagacgctgggggacacgttggtgtcggcggccgccaccgtggtcagcggcggcggcggcgccgacaacgtcaccaactacatgggacagatggccatcgccatggccaagctcaccacgctggagaacttcctccgtcaggtaattgaagcttcggaaaaacatcgacggcgaggcgaactgaattgctcattaccacagcgtgatgcgatgattgattgtgtgtaggctgatctgctgaggcatcagacgctgcagcagatgcaccggatcctgaccacgaggcaagcggcgcgggcgctgctcgtcatcagcgactacttctcgcggctccgggcgctgagctcgctgtggctggcgcggccgagggactagactgactaaagaggatcaatatcatttgcctgagttctgagttctgacgatggatggaggtgaacctgttttttgattgctgaatcctgagagagcgttaactgcgatcggcattgtaaaatcagttgctttggtgatgaagcagtagtagtaggagaatattttagattgggctcttgggcctgtaacgtgttgtagtgttagcgtagtaagaactaatccgcgtacaatgtcaaaaggagaagttttattacaggcctatttccaatctcggatgccgtcaaggaccaggtcattgcatctgatcggtgctacctgcgactttagcaggtttgtgcataagcccgttacttgaccgaaacagcggagtagctcagagaagacccttacgtcctctttgtctggatttatgaagacgaccgtctcgtcggtgtacatggatgtgcagaagcggacggctctacctcgcatcttgctaatcaccagtggatagtgggtcgccctaacgtagcctcttgccatggctgatcgcttctcccgggatcccatttgggatgatctttgaggtggaggtggataggaggcccgttatctagttctgcctcttatttttttggaaccctctattttgaaggtgaggaggtatatagccccatctcatcaagtcgaaagctttggagatgtctagtttaaagagcaggattggtcttctactcatgtggtgtttcctcaccatattcctgacgtacattaagttgtcgtaaatgcttcgatcggggatgtaagagctttggtttgttgagatcagctagtgcatgagcggccgtagcctgatggccagaactctggagaagattttggcaaagccatgaaccaggcttattggtttatagtcctagattccctcagccccatccttttttagaatgaggatcacgtttgctgagtttagcaggtttacgtgcgtgctcctagcgtcatgcaaggcgttgaaggccgccacgatgttgtccttgatgatgtcccaacatgacttgaagtatttcccagtgaagccatctgggcctggtgccttgtcaaccaacatttcatttatcgccttgcgaatccctgattatgtgaatggggtcattaaaactagacatttctatcagggcggtcctcatggaagaccagttgagatcttgcgttcttggctccaattggcccattacttgctagaggtgcttggcaacggaaagttccttttatgtgtgttgtattgcccatctgttgtgcttacgcaatcgatagatgtggttttttttttccttttgtgtgcattcattttggggtgaaagaattacatgtttacgtctccttctttgatgttggttacatgcgcggcatgtttcttcctttctcattctatgaccgtgaggccgagtagccttcactttaaggccgtgcgaaacctatactttgatgggcaaatcgtacatataattaaaaaaaaggaatttaaaaagtagcagaaaataacatcttcacaaagtgtgtttagattatttaacatcttggcacacttctattgacttagatgatcccatatgtaatcctcacaaatatcaattaaattaaactaaggtagcccacatacatgcgtgggtatatttaatattgcttaaattttctattacaaatgtttataagttggtgatatttttctaaatattttttacttcattttaaacatgtttcgttagtaatttgtttgggcattggttatgatctttttgctaactacccttggaacatataaattttaaactaaaaatgtttgaaaccgtgtagtgttgaatttatgagaaaatagtgtagtaataatagagttggttcctatctctagataccatatgttatttttttggaatatttagcatatcttatttgtgagttttaaaactttaaataacaaattgtcttgtatactatagatgtcttcacataatttaggatatattaatgaatttttaggattgtttcatccacttaaaggtagcaatgtatttatttctaattagagtgagatgattagttatgtatagagatatatgatgggttagatagtgagtggatgccagtcgctctcgattggacaaggagtagtataaacttgcaccaacataaggagaagtatcatgacttaatttcgttaacaatagaagcaatatcattctgttgccagctatgttctagatatcacatataggaagtaaaaacagtaacaagcaatttctatgtgatttgtatgaaatttctagttccaaagggttctagggtcagatttgcaccaacatttaaattcagccaggtcacacctcaaaacccagtacacgaaacatatacaagcaagtaacactttaagtacatgcttaccaaggcatcaatatgcttccatttgccgtatgttcttactctgcttccatttgccgtatgttcttactcttcacttcgtctgattcttctaatttccttttccttttcattttggaacctttgattctcctaatttcatccccccagttaagcttcgctgccaaagcagtcttgttaaaagcatggataatcttagagtccctagcaggatcaaaaatatatgtagtcctctccaaatgtaccccgtcgacaagctattagcttcccatgactgatgattcgctcattgtcaatagtacgtctccccaaagccatcttctcgaaatccatggcatctccacagtaactttcaaatggatgcagaatcctggtcccttcaaagtcacaataacagcaacaagcttttttttaacagatcaattatattgaaccggctttgaaagaaagcccaacaaacaaacagagtcttataaaaaaagaacaaaaatagaaaaacacagctcaaacacaggctgtttttcccttgaagcacaggtacatgcaaacatccacacacactactccagacctagatgcaaaagagcaccaactgaactacatagctacaaatcttcaggcaatcgatctgccttcagttgtcccattttctccagcagacgatcacgccattcttccaagataccatgctcctcccattttagcatgatacatcatttctgaacaaaagacagagttttgtaaacaatatgcaaagggtatttaatcaacacattttcaaaaacccaatcgttcctaaccaaccgcaatgcccaacacacagtagccagaagcaccacccaaaccctatttattttcttccccttaaccaaatccaaaccctcactgatattacttggtcttttatccaagccaagagcatccctaatgacacaacacgcaaaactagctaaagggcacataaaaaggatatagttcgaggtttctttttttaccacacagcttacacaactcatctccccctctccacttccttttaaccaattgagtagcataaggtagtcttcctattcctgccatatacaagaaatgcttgatcttttgaggaattttactcttccaaatactcatcatttcagaatctttcacacctccaaaagttatcaatctatacatcgatctcacattaaagatcttgttgctggtataaggccaaaccactctatttgctcccccatccaaattatattcatttaaaaggcctctcaacctaattaaatcttgacctctgttatcatccaaattccttctaaactccaaattccaagtctcattctcccataaatcactcacagtcgcttcttgatgataatttatgtcaaacaactcagaaaaaacaactttcaaaggtacctaacccagccaaacatccctccagaatttcacacaccctccctggtgaacttctttaaccactaacctttctagccaacccttacagtcatgcaaacccttccaaacttggaccccc

SEQ ID NO: 72975 - DNA, 3227 bp, Oryza sativa
aaaatttggatttgttttgttttgaaaacattccgaaaaatccggtgcctgaaaacggcgtggagtccggataagttacgcgcgacttatccggttcggttacgcggagtggagatcgtgcgggcaccctgatcaagcgacctatctctatataaaccgagccaccgccttcacgcaaaacacatgaaatcaatctagggtttgcctcctcctctgtgttgcgtcgtcgctcgtggactactccatcccgctcgtcagtgtgcaccggcgatcgggagagcaggtctccggaacctctgcctttcgacgtcctgcacctggagaaggcggcgataaggtttttgggaagcgcttcacgcgactgctccctgttcgtccgcgatggctcgccttcctctccgctcgcgtgctgcacgccttcatcgacgctcgcaaccgcgagtagttcctgccgagcaatcagtctttccgccacctcggtacgtgttcgacatgttgcgcatatttgatctgttcatgttttactgcttagtttacatgtatagatctaatgatgcgttaatgctagtatacatctgtaatgtcatgatttatttatggaatatattaaatcattatatgactatattctcaacaatccaaaaatcttaatataggcgctatgattttactatggctgtttttgccgatgcactgaggccggataaatttaatggtgtgcactttaagagatggcagatcagggtcactctgtggctgacagctatgaaatgcttctgggtgagtactggcaagcctatgggcgttcttaatgctgactagcagaaagaattcgatgaggccactactctctttgtgggatgcattcttagcgtgcttggcgatcatctggtcgaggtgtatatgcatatgaccgacgctaaggagttgtgggatgcattgaatactaaattcggtgctactaatgctagcaatgatctgtatatcatggagcagtttcatgactacaagatggctgacaaccgttctgtagtcgaacaagctcatgagatacaaaccatggctaaggaactcgaactccttaagtgtgtcttacccgacaaatttgtggtcgggtgcattattgcgaaactacctccatcttggagaggtttcggttctgcactcaaacacaagagacaggaatactccgttgaggggttgatagcgtctcttgatgttgaggagaaagctcgggaaaaagatgcggcgtctaagggcgatggtgggcagtccattgccaatgttgtgcaccaggcccagaacaagagcaaggggaaatacaaagctcagcagaccaccaacttcaagaagaagaagaacaacagcaatcctaatcaggatgagaggacttgctttgtgtgtggtcaacctggccatctggccaggaagtgtccacaacgcaaggggatgaaggcacctggagggcagacctctaagtttgctaatgtgaccattggcaacactggagatggaagcgggtatggtaatttacctactgttttttcagttaaccagtctactaattggtgggttgatacaggggccaatgtacatgtttgtgctgacatctcattattgtcttcttatcaggtcgcacggggttctaccgtcctaatggggaatgggtcacatgcttctgttcatgatgttggcacggtagatctgaagtttacttcgggaaagatcgtgcagctgaagaacatgcagcatgtcccttctatcgacaagaatcttgttagtggctcccgtctgactagagacggatttaagttggtttttgagtctaataaagtagtcgtgtctaaacatggatattttattggtaaaggttatgagtgcggaggcctgttccgcttttccctttctgctttctgcaataagtctgtgaaccatatttgtggcagtgtggatgatgaggctaatgtatggcactcacgtttatgtcatattaattttggattgatgtctcggttttccagcatgtgtttaattcctaagttttccattgtcaaaggttctaagtgccatagttgtgtgcaatcaaagcaacctcgcaagcctcacaaggctactgaggagagaaacttggcacctctagaactcctacactcagatctctgtgaaatgaatggggtgttgacgaagggtggaaaacgatatttcatgacgttgattgatgatgctactagattttgctatgtgtacttgttgaaaacgaaagacgaggctctagactattttaaaatttataaggcagaagttgaaaatcaacttgacagaaagataaaaatacttaggtctgatcgtggtggagagtttttctcaaacgagtttgacttattctgtgaggaacatggtattatacatgagaggacgcctccctattctcccgagtctaataggattgctgaaaggaagaaccgcacactgaccgacttggtgaatgccatgttggacaccgcgggattacctaaagcatggtggagggaggcattgttgacctcgaatcatgtgttaaacagagttcctaacagaaataaggacaaaacaccatatgagatatggattgggagaaaaccatcactttcttacttgcgcacatgagggtgcttggcgaaagtcaatgtaccaataacgaagaagcgcaaacttggacctaagactgtggactgtgtctttctgggatatgctcaccacagcattgcctatagatttttaatagttaaatctgaggtacctgacatgcatgttggtacaattatggagtctcgtgatgctaccttctttgagagctttttcccaatgaaggatacacatagtagttctagccaaccctctgaaataattcccagttcaatcacaccaccagaacaaactgaacatacacatgaacatgttactaaggaggatgacagtgaagctcctcgaagtagcaaaagacaaaggacagctaagtcttttggttatgatttcactgtgtacctcgtggatgacactcctaagtcaatttcagaagcatacgcatctcttgatgcagactactggaaggaggctatccgtagtgaaatggattccattatcactaacgggacttgggaggtgacagagcgaccctatgggtgtaaacctgtggggtgcaagtgggtgttcaagaagaagctcaggcttgatggggggatcctcta

SEQ ID NO: 72976 - DNA, 8476 bp, Oryza sativa
actcacttgttgctagattgaccacaattcgtgtgctactttccctagcagcctcacatggtcttctcgttcatcaaatggacattaagacagcttttcttaatggagagctggatgaggagatctatatggatcaacgtgatgggtttgtagttgaaggtcaagaaggcaaagtgtgtaaattgttgaagtctttgtatggtctgaaacaagctcataagaaatggcataagaaatttgacaaaacattgacatctgcaagctttgcagtcaatgaggcagataaatgtgtgtattatcgccatggtgggggtgagggagttattctgtgcttgtatgttgatgacatactgatatttgggacaaaccttgaggtgataaatgaggttaaatcattcttgtctcaaaattttgatatgaaggatttgggagtagctgatgttatcttaaacattaagctaattagaggtgagaatgagattacactcttgcagtcccattatgtggagaagatcttgaatcgctttggctacattgatagtaagccttctccaacaccttatgattctagcttgttgcttcgcaagaataagagaattgctaggaattaactggaatactctcaaatcattggctcgctgatgtacctggctagtgcaactaggcctgatatctcctttgctgtgagcaagttgagccggtttacctctaatccaggagatgatcactggcgtgcgcttcagcgagtaatgcgctatctgaaatgtactatggaattggggctttactattctgggtatcctgcagtattggagggatatagtgattctaattggatctctgatgtggataagatcaaagccactagtggatatgtcttcacactaggtggtggtgctgtttcgtggaggtcttgcaaatagactattttgacgaggtcaaccatggaagcagaactgacggcactggatactgctactgttgaggcagaatggctgcgtgatctattaatggatatgcctattgttgaaaactggtgccggctatccttatgaacagtgacaatcaaacggtaattgtcaaagtgaatagttctaagaataatatgaaatcgtctagacatgtgaaaagacaattgaagtctgttaggaaattgagaaactccggagttataacgttggattacatccaaacagctagaaacctggcagatcctttcacgaagggactatcacgaaatgtgatagataatgcatcgaaggagatgggtttgagacccatgtgagttatactatggtggtaacccagtctatgtgatcggagatcctgtgaattagaacctgggaagaacaaaccattagtaaactagaggagagtaccaatctataccctctctaagtgaagatgcatgtactctcgtgagctacaaggcaggttggctatgccttaatgagttctgttggctttatatagcgaagatgctgtcctgcagagcattcttgaaagaactcacctttgtaagcttgactgttggtcgcagtctatgaagattttgggtgaatcttctaggaagcttactaaagacctaggagtatgacttatatgctctacccgaggggtaaactacagacggtctagtaccagataagactctgagtgaaacttgcttgcacaagactgtcaattcaaggcgtagtccattgttcaagttgtgagtaagtgtagcttggagatctaggtggatgttcaaccttgatcggtctccatcgaaccgctggtatataaacaatacattggaaaagacaaatctcagtgggattctgagatttggttggggattgttggaattaatagatgggctaaggcccattcgaagattaattctttggaaaatcacaaaagcccacctcataggatggcatgcatgtggagtttagtaccaccttgcttattctaggagagggggacctccttaaaatggaggatgccctcctagccacttgaggcatgtgtggtggagagaagagggggaacacacgcgcgcgctcgctcgcctcgcctagcctggcaggcggcgcgcgtgcacgacgtacgcgtcgaatggtccgcaaaattggctcctcacctttgcgcagatgcagcctccttttgcagttttgttttgctgcaggaaaattcagatttgttttgttttggagtccggaaaatccggttcggtgcgtgaaaacggcgtggagtccggataagttacgcgcgacttatccggttcggttacgtggagtggagatcgtgcgggtgcactgagcaagcaaccgtcgccttatccggttcggttacgcgggtttatctctatataaaccgagccgccgccttcacgcaaaacacacgaaatcaatctagggattgcctcctcctctgtgttgtgccgtcgctcgtggactactccatcccgctcgccagcgtgcaccggcgatcgggagagcaggtatcccgaacctctgccttcgacgtcctgcaccgggagaaggcggcaataaggtttttgggaagcgcttcgcgcgctgctccttgttcatccgcgatggctcgccttcctctctgctcgcgtgctgcgcgccttcatcgacgctcgcaaccgcgagtagttcctgccgagcaaccggtctttccgccacctcggtacgtgttcgacatgttgcgcatatttgatttgttcatgttttactgcttagtttacatatgtagatctaatgatgcgttaatgctagtatacatctgtaatgtcatgatttatttatggaatatattaaatcattatatgcctatattctcaacatacttcaagtccctgaagcttttgctgcccacacactcatggtgcaaatgaaacgtagttcatattgtccctatagtcacaagtgtcaaaaatatgagatttgctccgtccaataaaaaagtacctcgacgtaccagtacctcacggtaccaaatcatttctgaccattggatctaacaatactcgtcatgcccaactatatccaacgatcgaaaacgatttggtatcatgagctaccgatacctccaggtactttttgctggaccaaagagcctcgcatgtgcccatcctaaaaatcacaaaaaggaataatgggcaactaaacaactgattttacaaccggggcatgcacattaaactgtaagatgtggagggcataaattacacgaaagctaaagttgtaggaccagaactaaccttattttgatcatagtttcacaatgtatgttccacctttttgcgaacaatgttctgttgagagaaaaagtttgatttgtagctttaggccattttcaaggcgtcctgtgttagctcatcagttggctgcaatgaattataagggtaactccttgtatatgataacaactctgagaggtgaagggtaactccttgaatatgataacaactctggcaggtgaagaatatggttggaagagagagtatgtgccaacagttcttgaagaatgtggctggaagagagagtatgtgccaacagttcttgaagaatgtggctggaagagagagtatgtgccaacagttccatgacaacagaccgcaccataggtagcaattccatggcaaaatgcagataagcctcaggtttcggatgagacgatgcatatgttgtagctatgtaagcagtaacatcccaacttgatgtcttatatcattttgtcccgctgtctagattgcttgagtaagatctagattacttttgagcaaataaaccatggcatcatgttcagagaggccagaaacacgggcaaccaacacattgatgagaccatccaaagattgagactcgatacatataaaaatttgagagcttgatccggtgcaggaaacattggattgagtggcccgtaacaatagccggccttgagaaggccgtggtgataacggccgcggaaatcttccatagggatccgagaaattgccctgaggtacacaccatggattctgtccagaaaaatgccccggagtgacagtgtcaatgtaggctgaaccttcatttcgaatttatggcatctcatagcagcaagatccataggattgttcaaattcttcagatccagcggcttctgcatcaatctggttaacctggtcacatcttgaatcgagaggaggcgacgacgggccggaattctctgcagacaaagagtgggcgaggtgagacactggcgcggacaatccaatgaggaaagcattagcatcaacatcaggcagcctcgtggacaacgcggcgcatctaagagcagccttggcagcatgtgagcggaattggaatctgtccttgtgacgatgatggtggcggtcaacctcgatgaggcggacggcgagaaggagatccgccatggataggcggaggtagcggagcgcatcctaggtggggagatagtggtagtacgatgtcaaggtgatcaggccttccagcgagcgctccgcgacggtgtgcgcctctggaggggaggggacgtcgccgccggtgacgatcttagagaggaccatctccccacttgctcttgccacccgcgaccgtgaggccatggtggtctcccgcttcggaatcatggcaccgtcggagtcggggagttcgctggggacgacgcggagggtgttggcgatgatgttgttgacagggtcggcgaagccgaagtagacgcctgcgttgaggaggcgtgtgttaacgaccaaatttggtaagatatgaaccaggttcggcattggaatcgaagcagattcggcaaagagttagattcgaagaacagagtatgcatcggctgcgaaggcatcggctgaagtctgcatcgtttgagatggatcggatagagaacaacggatacagccggtagagtcaatacaaccgattccgatggggatggctccgaggctgtttctagaatcaatcaacgtgcttcacaaggattgccacgatggagataaatctctcagaaagacaattatatatattaattaggatatttcgtgtaattctctttagagatatgtttgggcaaaagtctgccgcaaagacttatggtatcttagagtttgttagagataagagttgtgtccggcaaggacatattttgtatctcaggtataaatatgacctgaacggctgaacccaatgtaataaaaaacaacagttcaataatactttcggtgcatcgccacccttttactttcgttctatttcgacgagttcctacttttgggttgaactgcatcggtttcgatcttcaactagatgaaacttgtcatggcggtttgcgttctccggattagtgtgtccatctttatgacactctaatcctgtttatgtaattcgtcgagttatcatatacactctgtaatctctgttagttgcgctatatgacttgtcatcggctggttcttactattaggaagtaaacgatagagttatgttttgttattaatctagattatataatgtatctaccatctcttagaggttttcatcctcttgcctagatcttatacttgtctttatgcttaatgctacatcggttgaattcgatctattaagtaatatctataattaattatgatatctggcttgttttatgattatcaagagagatagcatcggggtttcagccgatcttacctgatttagctactttacatctcatatgcttgattgataggctagatctaccctttagagtgagatcttattgcattaaagtatattagactttttgtttgatatattttgcctgttttaatatcttagtataaagtggtatcggagtattagccgatacatgctagatctacctgatcggctatgctataaacgtatatataatcattactttagtgtatacttcgactttagtgatttatactatctcggcatggcgaccgatctatcccaatcacgtagtttaaatatacatcgaagaaagcattatatatcgttaatatctacagccgatcgagtagatttagctttatcttatttattcataactgtcgatcgattccaacatgacatcggctcaaagataaatgatatgtcatcggcaactagccgatcggctatcgtttatagatttaaccgcggtttttcttatctttctttcttattgattgcatgatcaaatcaactggcacgctcacgaacctaaaagcaagattttggacctgcactgaagttaagcagatcttacaggctagtgtgtgtttttagcatcaatagcgtgcggcgagcactagcacacggtccagcgacagcgcgtcgagcgcctcctcgtagtacccgtacatcagtcctagaatcacgcgtctgttgcgagccatgccctcccgcgagcaatcggaacggtttggcccgacgccggagtcgctgccgtctccatcgcggtcgctcccgcctcgcaccgctgtcggccggccatgatctggggttagggtgagcgtggatcacaggaggaggagggaaacagatcctctgacattgggtggaaagtcacggtgttgcagttggtttcatccctgctgaccactgcatccaacggcacacatccatcttccctccttcgaactgcatattgtgcggcccagttcgatttctgtggccatcggctaggccatcaggtcacaatgaccctgttgcctgctactacatgcaaggactcagtctcgcagaggacaaggctgtcaagtctacaacaagaacaagagaaccaaaactactgaagcataaaactgctatcatttagaataattcaaaataagacctaagtttcaactagcatcattcatgcattgcaaatcaacagctgagtttggagaacactacaaggcgtggctattgtgactaaaacagtagaattgaaaaaaaaacaaaagtattgcactgggtacaagcagcgtgtgtagccaagattatgcggtccagtaacttcttaacatgccaactcattgcagcttttggcctaatccctgaattaccagccgcttcaatttcaaaggcttgaatttctgaaatttttctttgtgatgccatcaagtggatggtttctggcaaatgaaggatgtgattatgctcaagaactagatccgacacttgataatttcctacctctcgatttattatgagacccatgcgtactttacagtcagttctagtttcagctctaggatacctagtgagatgatctcttttgtcctctgttcgtcgaccctcatttgaacatacatatctgcaggatgtgatcttgtcatcagacttgcttttatttttgtatcttttttttacatcaaagcccatatgacctccatattgtacccaaaactcccaagccttatcctcatcaacctaggtaagaagagcttcagtgcggaagcagaaggcctcgagccaacagaggagtctgtcaacaagcatttctgcacaaggaaagttctcctaagcaatgacacgccaaacgttgtcgccactctatgtttctcatactgatctacatttgttttattttttctgcaaggaaatcaatttcatactatctatgtcaatgctataagcaagaagaaaaattcttcttgagattgaattatatcatcaaataaaggaagctatttaatcagttgaggactagacacgatttatttccgcctttgttccactaatggcaacttggagaactaatttgttattgcaacaattttcattctatatatgtagctgcacaagaattggcaattaatttaattatgaactatttcgttattacttcaacagtttatctaaggtatgattcacaccccctcaaacccctctattctaagaaaataaaaatcaagaaaatatttgtttttcgatctatgtgttggaaaattattgggattttatgtgttggaagaaaattattgtacatattatcttttaattaatgagtagatgatagggttaaaattagagctagtagtcacatttactataaaacttgctctaaggcaagtagcacattccaacgaagttcaatcaaaagaagccaaaccatcgcgccaccgctagtgatgactagaatgacccgtcacaacatgtgcacaatctccgtggtacaatctcaactccagtagtactccagtgctctctggaacctcctagcttgcccgagacagagaaaaaaaagcctcttctctggcccctcttcctccttgattccggtggctcgccgccggtgacgggagggagaggggtcaggctcaatcgcgtctccttcgtatagtagtttagtcgggttagtctcgtagtcgagttagtctcattctgtgtccttcctattcttcgtctttggtcctctatgaagagtccagtgttcccttcttcagatctgaaatcttgtgggtggatcagccagggaggtcagtcttcgcggtgccaga

SEQ ID NO: 72977 - DNA, 546 bp, Oryza sativa
ccccgtccaacccgtccaagccgccgccggtaggggacgtattcgccgacgtcttcggaaccgttcgtcgtgagccggtcgtggaccgatcgatctcagccgtccgttttggatagggttgatctcggccgttcatttccgtgaaccgctgccgtgcacccggtccaccgcaaaccctagcccgctgacgcaataatccttcttttccttttcaaaaataattcattattgcgtcataattcaattaaaatccatataaaggttttaatccgatttaatctttaaaaattcataactaattcatttgaactcagtttaatgtggttcaagttgcaaaaattatataaaataaagatctacatattaaaattgtccataaattgaattaaatttatttaattctttttaaatgggctttaaatagatttaatcttgtaaaattcataataaattcatttgaagtcagaatgaggccgttcaagtctcataattcatctaaaaatatgatctacatgtttgtttactttttatgtactgtttatttgg

SEQ ID NO: 72978 - DNA, 2308 bp, Oryza sativa
actcagcatgaaaatgagctgcaagtctgtagaaatcttgtgcaatgatatgctagcatttttccatgaaataaccattgaaaccatctgggccaggggccttgtcaactgggattatagagatgagattatcaatttcttgtgtgtagaacatgtcaatcaagcactccaaatctattctaggaacaaaaagctcgttcaaattgaaatctatagttggggagcaagagatacccatcctattcttgaaactttgatagaacaagtttgccttttgatcatgcaagttaactatctgaccactttgattcaaaacttgagaaattgtgttcattctgtacctttctgtggcaatagattgaaacaaattggtgttttcttctcccagcatcatccatctattagtacaatgttttttcaatatattttcctgtattccagaagttttaagatatgatgcttaactgcctccctgaaattccactaaataaagagaggcttttgtcttcttccagaagatcatgaaaatcgatcactttattgcagttattcaagagaagcatgattctggacagattcttactccagagcttaagctttttccccaaaattttcaacttgaaggagatacattttggaggatcatcaaaaccaggatctagcatccaatcttgctgaaccacatcaaagaaaccctcagcttcaacccaaaagttttcaaatctgaaaaatggagacttggggatttttgtatcaatctttaccacacatggaacatggtcagagatattcctggtcaaagggagaactgttgtattggggaaggttaaagtccatgaagcagaggtgaaagcccaatcaagcctttccagcaaaggattttgttgcatattgctccaagtgaaccttctcccttttaaggggatttcaagcaatcctagggtgctaataatctcattgaaaataaaaatgtcattcatatcagctcccactttatttctgtaaatagatctgtagaaattaaagtcccctaggaaaagccagttctgatgagcatcaatctggatatttttcaaccaggtcacaaaatctgatctttaaggcccattacatggcccatacacacaagtcaaggaccagacttgggaggtaaatctagaagttaattccactgtcacagataaagggttaacttctttgggtgtcccactgaagactcttgaaggccagacaattaaaattccccctgatgcacccatggagggggcaaaagcaaaagagtcaaagcgcttgggggcaaatttcttgatgtcagaaagatcaaagttctcctttttcgtttcttgaagacacaagacctggcaactactctcttcaattttctgtcttaaagacagaagcttattttcaacattcattcctctgatgttccagcacaagacattccaaggtttaaaattactattcattatcacaccattgagagaggggcaaaagaaccaagcctagcacagctaaccgaaaatgaaccaaaagacaatcacaccagtcttgacatatgatgagggatgttaggtcaagatcttccgataggtattgataaacaacgatttgggcggagtcgcgacacaactcgatccggcttctgaacgaacacgctactgagccccgcaatcgtagcaccacgtctcctctggttatcaaccgtgcctaaacccggttgacctcgccgagaaggctaatccctgcatgtgaatcgaagaacacaagcaagaacaagatagattgcaaccaaattgcatatgaatgattaagcactcgaatttggggttccacaaaccgatctagcggcgaaactgttcttgacaggataatccaagcaaaacccaactctaaatgatgacgtctactgaattaatatgattagggatgtcctagggttgccctagggcgcacaccgccttgggctaagcccacgacacaattacaaggcccaaaactcgtgtcagattcggactggatgagatacatggcttgttttgcagattcccggtagctcggtaggaattttgacatgggactaaaaccatctgaaagtagactccataagctttccaacaagtactcatgagcctcgaaattccttatagatcagtggctaggtccgtttgaagttgatgctgtcaggaggcccgaatccgaatccaaaacgtgtagaactttatctcttttcttctatggaccaaaaatgacgtgatgagatggaagtggacttggagaaggtcttgatatggtccccaatcaactt

SEQ ID NO: 72979 - DNA, 7747 bp, Oryza sativa
gcgctcaatggtgtcaaggattttcactggcctctccacgtaggtcaagtcttcgcgaacttcaatctgctctgagtcggcctgctcggacggcactcgaaggcatttcttgagttgcgacacatggaacacatcatgcacgttgcccaaggaggcggccagctccaactggtaagcgacttctccgcgccgagcaatgatacggaaaggacccacgaaccgaggtgcgagcttccctttcgtctgaaacctgtgtacaccccgcaatggcatgacccgaaggtacacaaaatcgtccactgcgaattcctgattacggcgttggttatctgcataacttttctgccgggactgtgccacctttagattatcccgaatgattctgactttagcttcagcttctctcaggatatcagtcccgaacacttggctttccccaacttggtcccacaatagcggtgtccggcatttgcgcccatacaacgcttcataaggtgccatttgtatgctggcttggtagctgttattgtaggagaactcggcataggggagactcttatcccaggtcttcccgaaatctaggacacatgcgcgaagcatatcttttaggatctgatttagactctcggtctgtccatctgtctgcaggtgatacgtggtgctgaaatttaatcgggtacccagctcttcttggagcttcttccaaaagtgagaggtgaattggcttcccctatcagatacaattttcttgggaacgccatggagactcacgatcctagcgaagtagagctcggctagtttgttccctccataggtggtcttcacaggaataaatcgagctaccttggttaatcgatccacaactacccatatagaatcatatccaccttgggtttttggaagtccggtgatgaagtccatcccaatttcatcccatttccattctggtacttggagaggttggagaagtccggccggtcgttggtgctctgccttgacacgctggcacacatcacacagggccacaaactctgcaatttcccgcttcatactaacccactagtatttctccttcaagtctaagtacatcttcgtactgccagggtggatggaataaggactttcgtgagctacctgaagtatcagctgtttaagttctctgttatctggaacgcatacccgctttccgttccatagggttccgtgttcatcctctgtgaaaccagcagctttatcctgtttcatattcttgaggagtccatgcatgtccggatcattcttctgagcctcgcggatttgatcgagcaaggtaggcttggcttccaacgcagccaagaatccacgaccaactatgcttaggttcaaggcttccatctgttgactaagttcgggtggaatgccacggacgttaagagtgttgcaatggctctttcgacttagagcgtcggcaaccacgttggccttaccaggatgatagtgaattcccacatcatagtctttgatgagttctaaccatctcctttgccgaagattcagatccgactgggtgaagatgtatttcaaactcttatggtcggtatatatttcacagcgattcccaatgagatagtgccgccagatttttagagcatgaaccactgcggctaattccaagtcatgggtagggtagttgccttcatgcggtcgaagctgacgggaggcataggctaccacatgaccatcctgcatgagcacgcaccccaatccttggcgcgaagcatcacaatacaccatgaagtccttgcgagtatccggcaagattaacaccggcgaggaaactagcttttccttgagagtttggaacgccttctcgcattacgggctccacacaaatttctcttctttcttcaacaactgtgtcatgggtcgagcgattttggagaagttctcgatgaacctccagtagtatcctgccaaacctaagaaactgcgaatttgagtgactgtcttgggttgcttccaatcggtgacggcagtcactgtttcggggtccacagcaactcctttagcagatatcacgtgccctaagattttgacttcggacaaccagaactcacacttgctaagtttggcatacaattgatgttcccgcaacttccccaacaccagacggagatggtgctgatggtcttcctctgattgtgagtataccagaatgtcatcaatgaaaaccacaacaaacttatccaagtattccatgaacactttgttcattaagttcatgaagaaggcaggagcattggtttaaccgaacgacatcaccgtgaattcatacagtccgtatcgcgtggtgaatgcggtcttcggaatatcttcttcacggatgcgtaattggtgatatccggaacggagatcaatcttggagaatacagtggcacctttgagctgatcgaacagatcatcgatccggggaagagggtacttgttttttatggtgacttcattgagagctctgtagtcgacgcacatcctcttcgtcttgtctttcttctctacaaaaatcacaggagcaccccatggggaagtactcggacgtatgtaccccttttctttcaactcttccagctgtttctttacttcggccagttcatttgctgccatacggtagggtcgcttgtacagaggagtggttcctggagcaagatctattcggaactcaatctctcgcttgggcggcataccaggtagttcttccggaaacacatctccgaactccctgacgatgggaatttctgacaatcctatctgatgaagttctgaacttctgacagaggttgggggtgcaaagaaaacaaccggttgttctggccctcggtacagagtgacagtgcgtctcgcgcaatccactactccttggaattgagccaaccaattcattccaagaatcacatccaagttcttggtgtctagcagaatcagatccgagggaaaaggaattccctgaatttctatagggacggcagggctataatactttgctgtcataacccctccaggggtggtgatgagcagagggttcctaagcctttctacccccaattgatttctccccacgaatggcatagatataaacgagtgggaagctccagagtcgaacaaaatggtagcagggatggaatgaatgaggaacgtaccaacgatgacgtctggagttgtcagcacgtcctcggccgtcacgtggttcacacgaccccgaatgacatccttaccaccgttgttggagcggggaggcgcttggccttgctggcgcctcggctttgggcatttatccgcaaagtgcccaggctcgaagcagttgaagcacagacactgcggaccttgaacgtccctgcggccttgaccaggctgcacggctggcgtaggaggacggggcgcacgggtcccttgctgactctgctgttgttgcggctgtgggacgcgcaccacgaattgaggtcggggcgcggagcgaggttgctgctgctgttgctgctgctgtgaggaggatccccctggatagggattggtgtagcggaccctttggttagccccctgttggttgcggaaactcgccaagcgacgcttgtgcgactctagttccttgtgcttggcttccaagcggatgctcttgtccaccagacgttggaaatccggatagtccccggagactagacggacggacagctcagggtccattcctgccaagaacttctcttgcttctcctcatcttcacgaacatcctccggggcgtaccgggccaggttgttaaactcatgcaaatactccatcacggagcggttgctttgcttcaactctcggaattcccttttcttaagggccatgactccggcgggcacatgggttcttcggaaagcggcggtgaagcgggcccaagtaataggttgcccctctggctgcgtagccttgaaatggtcccaccatagagatgcgggcccctgcagttggtgggcggcgaagatgactttctcctcatcgctgcactgcacggtgtctaactttttccccacggcatgcaaccaatccaacgcatccacggggttattggagctagagaaggtaggtggacggatgcggaggaactcggcgagtttagagtgttgtgggggtggtggtggagcattatgttgtggcggattttggatgtggtggaggaaagcagccatcatgttggcctgctgggcgaggatttgggtgagaatggcgttggtgtctggtggtggtggtggaggcggtggaggaggtgaaggtgggttgccctggtggttgtggttgctgccttcggggtgactgccatcaccggtagcagcatttttcctggtcgtcaccatctaaaaaccccacacagaaccagcaaacagagagagctgacaattaaaactaaccacccacgactaccataaatcttgaatttattactgctattaaattggttcattaaagttcaagttgcttaagcaaataaaataaagacaggctccgacatatttataccacacaccggcataaccatgccccatacgactctagcagaaaaacaaacaagaaaaacacacgcgcaagcctactaactgcttgtctacagctgcgataggccaggacggaaggtgagcatcagtgctgccaacgccggaggctccatcctcctgaggaaccacgggcgcgggctcggcacgaggggtctcgacgaaacaggtccacgccagggactgacgaacaagctcgggcctggaggtactcttgtgagcggtgatcttctggctgcggcagacgcggcgacgcttggggcgacagacctctccctgggcgatcttgagctgacgcagctgcgcctccactgcgtctaggtccttcttcagctgcagattctcctgacgcagctccaggatcttcatgttgttctcgaccaacccgcgacgcaccatctgatggaagtcgatacgagccgcgtcgtacgcctccaccatgcgcgctagatgcatgatggtagcgtcatcctccgagctagcatcccggaaggtggcgtagtcgcgggctcctccgcgacgagggtggtaacggtagggcgagtgctgcaactcgtccgggtagcgctggtgaagagtaccgatggtgaggagtgcggcgttctggcaagcggcggagaaggaatctccacccgcggtgactgccaacgaagtcctctcgggtgagccagtgaggatcactgcagtaacctcccaagcagcgtggggctctgcatcgtcaccctcctgctccgagagctgcttgccctggtagtccactccatgcggataccccaggacaacgcacatgccccgcagctccaaaacgaagccagtcaggtccagaccaccacggttgatgctgccggccatctacaaacaaaaacaaaaagaaaagcaacattttaaaggtcagattttgacgataaatgaagcagcaggacagagagagactagaggattttcacaaataagacaggatttttattttgaaaatattgctaaggcttgggatctacggctcgtcctagggtcaagggggctctgataccaacttgtcacgaccggaattaacccaacgggcgttccttacgtgcgtgtattattccttgtcccaggaggcaaggtacaccaagagttgatacatttcagagtttatcaagcggaagcgtaaatagttaatttattacatgggcagcgaaggcccagcacacacaaagacaaacgagaaacaacggaagactagggcgacgaccacaggcgcttgacggcaggcacgagctagacaccaaagccttcatcttccaggggctcctcttctgggtttgggaaaaattgagcaagactgagtacaaccaccgtactcaacaagacacacccacaagggcagaataaatgcaagggagtactagggagttataatataaagggttagggtttgcagtaaacagcattaaaagacacttagttgctcaaagctattttgtaaatacggtcctagagctatacaatattattaaacaaggccgtgaacccacacgagcctgccttaacccaaggcctacgatgattcagaccgaactggcaacccgaccctgggtcccagctcgtcccaagccaacccagggcaaccattccacattttagttgttaaacaggttttaagaattaaaacactaacttgggtacattgctcggcttgcccataaccgagggcgcggctattcgaatagattatactctgatcagaggtgtacatctttacccacaagacacatcttcctcacatgtaaccacgtgccacataccaccacggtatacggacagaagacgtgacatagtctccaacccatcctagccatagacaagagtaccgacccaatcccacctacggccggaacccccgggacaggtaggcaagactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttttgcaacagaggcccgaagaccggtccttatatggccgaggtgctactatcaaaaccatgcaccccgagcccagcctaaaaccattttggggattttgaatagagggggcggtgtgaatccaattccacattaatcaaaccattccatagtgtccaggtgatgagaaaattcccaaagtctagagttgtaaaactacctaatgttgcctaattaaccagcgaagcatctacctaaaatcatactagtggtaccatgagtagagtgtccactagttggggttttgtttattctagggtgaacaaggaaataataataataacaataataaggtcataacaaaggtaaataggcatggctagataaaacagtgataacgcgggaatttaaataaagcgataatgcaataatttaaatcaaaataattttataaactgggattcaatatgttcaaggatgatgtgacttgccttgctcgctttcccaaacgtcggcttcaaccacgacgaagagcggatcttccgaagctgcagcgtctacacgaccaacggaaaagaaaagacttttactctaataaactccatataacaagcaggaacaaagcacaaaaatgggttcttgacttcttaaggaaaaattagagacttgaacggtcaaattccgagttcaaatggccaagttatggctatttgaagtttatatgctctttaaatgaatatttgcgaatttcttcatttaaatttaattaaaaaaaggtttattgcgtcagccgaggggagggggcgcgcggaccgggtccacgggagtggggcccacgcggcagccccacggtccacggtggaccgggcgcacccgggctcacaccggccggcgccgtgggtcccacgcgtcagccgcacccgagggcgcgtgtcacatcctgattttttgtttcaggatttataaattatttaataaattattaatagattttatattaaatgatctttaatttacaagtgaagttaaatgtgggaaataaaatttcctaaaaataaagcatggatggatttaatttttattaaattctccatgattaagtca

SEQ ID NO: 72980 - DNA, 6380 bp, Oryza sativa
aattgttgtttaaaagggattattagaaatgattttaaaagcttcgaagagaagatctaattttaatttgttaaatctcaatataaaattgggctagataaaattttgttaaatactttgcttaattctataattcctagatttttctgggatttatttgagctaaggaagtatttttaataaatggaatttcatttcatgaataatttaaattgaaaaatgtttttaaaagtccgttttggctttgggccgaaagccggcccaaaacctctcttctctctctccctcggcccaagtcggcccagttcgcaatcagtccgagccgccgctctcctctctctctcgctgccgctgacaggtggggcccgcctgtcggagccgtcttcctccttcggccgccgccgcccgaaaccctagcgcaagccgccgccatctccttccaaattcggccgcgtctttccttctccggtgaaatctttagaggggaaatgatcttctcgatttcctcttccttttctcttatggaatcaacggctaatttcgtttggaaattcgtggattcgaggtcgattcggatcggtctctccctcccgaaccctaatctttccttctcgtcgccggccgccgtgggcctttgccgccgcctcctagcccctttaaaaggatccccggtgtctcctctacccgccgccacccttgctttcgcctctcgccgtcggaagagccctagcgccgtgagacttcgcgccgccgtcgtcgccgtcgctccagccgtgcgccgccgccgtttcagtcgtcaccgtcgctcgggaaggccgccatcgtggtcgccaagtcgtcgccgtcctcgtccgccccttcgccgccgccgaagaccgccggagaaccgtcgccgccgtcgacccgatctccgccgccgcttctttctcgtcgccggcgctgtctgttgcttttccgccgccgttttggtcaccggtgagttcgccgcgccgcgctctacgtcctggtgccctccgttctcgtcatcgcgccgtcgttcgccggcgagcttgcgctcccgagccgccgccggtgatgacgtcaccgctgacgtcatcgtcgccgttcccgtgagccggtcgtggaccgattgatctcggccgtccgttttggataggatcgatctcggccgtccgttcccgtgaaccgctgccgtgcacccggtccaccgcaaaccctagccgctgacgcaataatccttcttttccttttcaaaaataaatcattattgcgtcataattcaattaaaatctatataagtgttttaatccgatttaatctttcaaaattcataactaattcatcttagctcagtttaatgtggttcaagttgcaaaaattgtgtaaaataaagatctacatattaaaattgtccataaattgaattaaatttatttaattctttttaaatgggctttaattagatttaatcttgtaaaattcataataaattcatatgaagtcagaatgaggccgttcaagtctcataattcatctaaaattatgatctacatgtttgtttactttttatgtattgtttatttggtttttattagtctttttctttgttttgcgtgttagcttgtcgtttccgtcgttgcgaaggttcgcgagtgcgctggaagtattcaagaagattaattgaagaccgattattgcaatgcaagtcacacagatcctaaacacaatcctttgagcatgttgatcctatatttaaattctctatttatttcaactgtgcatttattttcaaatgtcattgggtggaattaacctattctttgttatggcccttttgttcttgattactttattccttgataccttgggtgattataattggactagttgaactttatatatattggttcaactagatatcagatataattgcttagccatgcttagaaacattagcacactattgggataacttatgactcattattatttaatgatggcttaatgatagttcacgatggtcaatcgtgattggttaattaattacttgccaactaaaacttgataatggtgggttgtgagcacatggttttgagagtcgtgctcatgacaattaaggaccagttcgcgagctactattgtgaaacattaatcgtgccaaccacaagccagcgtgggcaacggctttacctttcgtatagcatggttcattgcagagcaccagactgagaagtggcggagataagcccacaggggtcgctggggagtccatgcctctggttttgagggggtgattatgatccaggaaaggtgcactgtggtgggttgtgttatgcgaggggtaatgtcacagctcctttccgaggtaccgtggtggtactgaggcacatggtggcatgttgtggggctgtgtcttgtgggtacagtggtacacctctggccagagtaaaactattcgaatagccgtgcccgcggttatgggcgggttgagcaatgtttttcgtgattagtctcacacttctcacaataattatggatgttatacctggtaataatttgcttagctcctggtttggagattagatctgtacagccgggtatggttgtttcagaatggttgggcctgagcagcatgggcgtgttgttcagtgttgattaaaatttctgattaattactccactgatttacttctcttaaatgttttgctaaatgctgcttttgcaaatgagactatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttatttttccgctgcagttttcttcatggtgaggactaagtgcctcttaagtaagtatttagcgttttaattaatttgatgaatctgtatattaaattgtcagtttgtgtacctcgcctgattcctggacgaggattttatgcacaaataagttcagaaatttattagtgaatttccgggcgtgacagcgcgggcggctgacggtcgggcccacgcggcagccactcggtgcgcccggaggcggccacgccggcgcaacggcgggaggcggcgtgcccgcgcccctatggtcgccggcggcggccataggcacggcggagcggcggccgaaagaggggagggaaaggggaaacgaagcggcggtccacggctcaccccgggtcgacggcgacgacggaaacggcaaccggagcggaggaaggcggcggcgcggctcgggtggacggggtcgacggtgctccggcggtcgcgaccgaaacgaagaggtggacgaggtcggcgaggatgcggcgaacccgaaggagccggcgccgaggtggaaggtggtccgggtcgacgacggcggcggacccgagctcggcggtgacggtggaaagagagagcgacggcgcgagctcgattccggtggggagagaggcgggtgagtggcggaaacggtggtggggagctcggggagggtttatatagggttgggagtgaaagagggcggccggaagagggggaacgggcgcgggagacccggccgccattaatggcgtcggcgacgttaggggaggggtttccaaacgaatccgggggagagagagagaaaaatggggggaaaggggagggaatcccggggaataattccccccactttattgcgcgcggggacggcggaaggcggcgggattcgcggcggcggcggcgctagggcgcgggggaggcggcgggaacggcgggagaaaggggatgacgggtgggccccacccgtcagcgagggtggcgggcgggcccgcccgtcagcggcgcgcgcgcggggaggaggccgaatgggccgcggggagaggagagggagggggaaggagatgggccgagccggcccaagggggagaggggcggaaaggactttttttagagcttttctttttataaaaccattttaactttgtttatttcttaatatttattatttgtgctctgaaaattccactaaaatttatttacgcattttagacttttaggaaatatacaaaaatcctccaagccttatttgacttttaactttgcacattttaattgttggaggctttcacacggattttaattattctatgcataatttagaggatgtattttagagtcgttttgggacgtgacatttatagacctttcgagtgtttttcacttgggtttctttatatattttttcttggtatattaaagctaaagcagtcggctggatgttttattaaacgtcacatctgctcagctacataatcactcggattggatgatatttgttgcttgactatatgtttagtttttaactaatcacatagtcgggggctacacctaattaagtgcatctagccgatgcacctgactttttctatttttcagcccttcacagtctttactcgggagatcaatgcagaaggaattgaagagctcggattatcatttcgtcgactgtaaaggtctcaggggctactatgaagattatggataacccatacctacacggcatgtatagtccgactggatatggggtgccatgtatagatagaatatctttaagaagacttgggttaaattctaaacttgtatatcaaggaaatacccaaaatcctagtcggttacgattgtattttatctgtaactatatattctgttagggatatggactgtattttgtaatacggaccccttcccctatataaggaggggtccgggtgcctctagaggcacgatttttctcctagatcatacaatcaataacacactcggcggatcaatccccggacaggagtagggtattacttcttgaataagaaggcctgaacatgtataaaattccttgtctcttaacacatccacttttccaacttgatagccaccccctttagtattgccgaaatcttgtttcgacagtcggtctcttttccttcgcccaagcaagtacctttgcaaacaaaaacattggaaactcattgtgtagcaacgtttgttcaaatatataacatgtaaatctaatgtagaacatatgcacctttggttgattaatacataaggtagtcatggttatatccgagctagttgtgtcctcatcaacatactgacaggacaaatatctggtaaaacaactttgacagtaaacaaattacagacccttggaacatgataaatgtaaaacttaggcctgacaacaatactgaatcttctgtcattaattatcctccatgtttggcctggggatcttctgtcttctttcaccccccaagctggatttagccacctcctcaggagagaggctgcacatgtctacccccatcttctgtatgaccgaaagtgaacaattagagggagaggagtcagagttcatatcactataagaagtttcattgaaatcagactcctacatactgctatcaataaagagttttgcaatacctgcaaattccttaatctttttaacagactttccccttggcttcccaatgcccattcttgggtccatctgcaattctttggttgcattaccctgcagaagtcttgagctttgtcttctgtagggactatagagaatggccttcccatctttcctctttgcaggtgccttggggggaagtagggcaacaggggccacactgattgggctagccacactgattgggctagatgggggcctcacattgattggtagaacatcctcaaccacccttttcggctgagggggtgaaatagactcaaaaggttgcaaaacccattcaggttcatgctggcccactgaaggagaggaatcaaagatggacttccttggcaggagcaatgtggagaaatagttggacattcttaaagcagcaggaataggcttgccctggatcaaagtctgcatgatgccctttgctttacagaggaagtcaatcttgtccaatattcccttcataggataaaagtaggggtgccttggagcttcatttctggcaattctattcagccgagctagaaattcctggacttgggggtctagaacaggatcctggactgatgtcatcctagctgaagggagaggtgtggccatctgctgaggtagaattagttgtcctgggttttcctcaatctgccccattggatggtcttggccccaggcatcttcttgttgttcatttgcagcctgctgttgctgcactgcctcatcccattctcgagccccctggttcccagggttgccaaactgccagacattaccatcatcg

SEQ ID NO: 72981 - DNA, 12469 bp, Oryza sativa
tttatttcttcttaattattatttgtgctctgaaaattccactaaaatttatttacgcattttaggcttttaggaaatatacaaaaatcctccaagccttatttgacttttaactttgcacattttaattgttggaggctttcacatggaattttaattattctatgcacaaatttcgaggatgtattttagagtcgatttgggacgtgacaaacctaccccccttaaacggaatctcgaccccgagattcggaagaactggcgaagagatcgggatgggctgccttcagctcgtcttcacgctcccaagtagcttcttcttcggcgtggttgctccactggaccttgcaaaaacggattacccggttcctggtcctgcgctccatggtgtccaggattttcactggcctctccacgtaggtcaaatcttcgcgaacttcaatttgctctgagtcggcctgctcggatggcactcggagacacttcttgagttgcgacacatggaacacatcatgcacgttgcccaaggaagcgggcagctccaattggtaagcgacttctccgcgtcgagcaacgatacggaaaggacccacataccgaggtgcgagcttccctttcgtctgaaacctgtgtacacctcgcaatggcgtgacccgaagatacacaaagtcatccactgcgaattccaggtcacggcggcggttatctgcataacttttctgccgggactgtgccacctttagattatcccgaatgattctgactttagcttcagcttctctcaggatatcagtcccgaacacttggctttctcctacttggtcccacaagagtggtgtccggcatttgcgcccgtacaacgcttcataaggtgccatttgtatgctggattgatagctgttattgtaggagaactcggcataggggagactcttatcccaggtcttcccgaaatctagtacacatgcacgaagcatgtcttctaggatctgatttagacgctcggtctgtccatctgtctgcgggtgataggcggtgctgaaattcaatcgagtacccagttcttcttggagcttcttccaaaagtgagaggtgaattggcttcccctatcagatacgattttcttgggaacgccatggagactcacgatcctagcgaagtagagttcggctagtttgttccctccataggtggtcttcacaggaataaaccgagctaccttggttaatcgatccacaactacccatatagaatcatatccaccttgggtttttggaagtccggtgatgaaatccatcccaatttcatcccatttccattctggaacttggagaagtggaaaagtccggccgttcgttggtgctctgccttgacacgctggcacacatcacaaagggccacgaactctgcaatttccctcttcatactaacccaccagtatttctctttcaagtctaagtacatcttcgtactgccagggtggatggaataaggactttcgtgagcttcctgaagtattagctgtttaagttctctgtcgtctggaacgcatacccgattcccgttccatagggttccgtgttcatcctctgtgaaaccagcggctttaccctgtttcatattcttgagtccatgcatatccggatcattctgctgagcctcgcggatttgatcgagcaaggtgggcttggcttccaacgtagccaagaatccgcgaccaactatgcttaggttcagggcttccatctgttgattaagttcgggcgggatgccacggacgttaagagtgttgcaatggctttttcgacttagagcgtcggcgaccacgttggccttaccaggatgatagtgaattcccacatcataatccttgatgagttctaaccatctcctttgccgaagattcagatccgactgggtgaagatgtatttcaaactcttatgatcagtatatatttcacagcgattcccaatgagatagtgccgccagatttttagagcatgcaccaccgcggctaactccaaatcatgggtagggtagttgccttcgtgagtccgtagctgacgtgaggcataggccaccacatgaccgtcctgcatgagcacgcaccccaatccttggcgcgaagcgtcacaatacaccatgaaatccttgcgagtatccggcaagattaacaccggcgaggaaaccagcttttctttgagagtttggaacgccttctcgcattgcgggctccacacaaatttctcttctttcttcaacaactgtgtcatgggtcgagcgattttgaagaagttctcgatgaacctccggtagtatcctgccaaacctaagaaactgcggacttgagtgactgtcttgggttgcttccaatcagtgacagcggtcactgtttcggggtccacagcaactcctttaccagatatcacgtgccctaagaatttgacttcggacaaccagaactcacacttgctaagtttggcatacaattgatgttcccgtagctttcccaacaccagacgaagatggtgctgatggtcttcctctgattgtgagtatatcagaatgtcatcaatgaaaaccacaacaaacttatccaagtattccatgaacactttgttcattaagttcatgaagaaggcaggtgcattggttaaaccgaatgacatcaccgtgaattcatacagcccgtatcgcgtggtgaatgcggtcttcggaatatcttcttcacggatggcaactggtgatatccggaacgaagatcaatcttggagaataccgtggcacctttaagctgatcgaacagatcatcgatccggggaagagggtacttgtttttgatggtgacttcattgagagctctgtagtcaacgcacatcctcttcgtcttgtctttcttctccacaaaaatcacaggagcaccccagggggaagtactcggacgtatataccccttttctttcaactcttccaactgtttcttaacttcggccagttcatttgctgccatacggtagggtcttttgtacaggggagtggttcctggagcaagatctatccggaactcaatctctcgcttgggcggcataccgggtagttcttccggaaacacgtcttcgaactccatgacgatggggatttctgacagtcttatctgatgaagttctgaacttctgacagaggttgggggtgcaaagaaaacaaccggttgttccggccctcggtacagagtgacagtgcgtctcgcgcaatccactactccttggaattgagccaaccaattcatcccaaggatcacatccaagttcttggtgtctagaagaatcagatccgagggaaaaggaatcccctgaatttctatagggacggcagggctataatactttgttgtcataacccctccaggggtggtgatgagcagagggttcctaagcctttctacccccaactgatttctccccacgaatggcatagatataaacgagtgggaagctccagagtcgaacaaaatggtagcagggatggaatgaatgaggaacgtaccaacgatgacgtctggagttgtcagcacgtcctcggccgtcacgtgattcacacgaccccgaatgacatccttcccgccgttgttggagcggggaggagcttggccttgctgacgccttggctttgggcatttatccgcaaagtgcccgggctcgaagcagttgaagcacagacgctgctgaccttgagcgtccctgcggccttgaccaggctgcacagttggcgtaggaggacggggtgcacgagtcccttgttgattctgctgttgctgcggctgtgggacacgcaccacgaattgaggtcgaggcgctgggcgaggttgctgctgctgttgttgctgctgcgaggaggatccccctggatagggattggtgtagcggaccctctggttagcaccctgttgattgcggaaattcgccaagcggcgcttgtgcgactccagttccttgtgcttggcttccaagcggatgctcttgtccaccagtcgttggaaatccggatagtccccagagactaggcggacggacagctcagggtccattcctgccaggaacttctcttgcttctcctcatctccccgcacatcctccggagcgtaacgggccagattgttgaattcatgcaaatactccagcacggagcggttgccttgcttcaactctcggaattcccttttcttaagggccacgactccagcgggcacatgggttctccggaaagcggcggtgaagcgggcccaagtaatcggctgtccctctggctgcgtagcctggaagtggtcccaccagagagatgcgggcccctgcagttggtgggcggcgaagatgactttctcctcatcggtacactgcaccgtgtctagctttttccccacggcatgcaaccaatccaacgcatccacggggttgttggagctagagaaggtaggtgggcggatgcggaggaactcggcgagtttagagtgttggggaggtggtggtggagcattctgttgtggtggattttggaggtggtggaggaaagcattcatcatgttggcttgctgggcgaggatttgggtgagaatggcgttggtgtctggtggtggtggtggaggaggaggtggaggtgaaggtgggttgccctggtggttgtggttgctgccttcaggttggttgccatcaccggtaacagtgtttctcctggtcgtcaccatctggaaaccccacacagaaccagcaaacagggaaagagctaacaattaaaactaaccacccacgactaccattattcttaaatttatcactgctattaaattggttcattaaagttcaagttgcttaggcaaacaaataaagacaggctccgacatagttatgccacacaccggcataaccatgccccacacgactccaaaaagacaaacgagaaagaacacacgcgcaagcctactaactgctcgtctactgctgcgacgggccaggacggaaggtgagcaacagcgcatcctccgtgctaccaacgccggaggcttccccctcctagggaaccacgggcgcaggctcggcacgaggggtctcgacgaagcaggtccacgccagggactgacggactagctcaggcctggaggtgctcttgcgggcggtgatcttctggctgcggcagacgcggcgacgcttggggcggcagatctctccctgggcgatcttgagctgatgcagttgcgcctccactgcgtcgaggtccttcctgagctgcaggttctcttgacgcagctccaggatcttcaggttgttctcgaccatcccacgacgcaccatctgatggaagtcgatacgagccgcgtcgtatgcctccaccatgcgtgccagatgcacgacggtagcgtcatcctccgagctagcatcccggaaggtggcgtagtcgcgggctcctccgcgacgagggtggtagcggtagggcgagtgctgcaactcgtccgggtagcgctggtgaagagtgccgatggcgaggagagcggcgttctggcaagcggcggggaaggagtcgccacccgcggtgactgtcagcgaagtccgctcagaagagccagcgaggatcactgcagtgacctcccaaccagcgtggggctccgcgtcctcaccctcctgctccgggagcggcctggcctggtagcccactccatgtggataccctaagacaacgcacatgccgcgcagctccaagacgaagccagtcatgtccaaaccacgacgggtgacgctgccggccatctaaaaacaaagaaaagaaaagcaacattttcaaaggtcagatttttggcgataaatgaagcagcaagacagagagagactagacagttttcacaaataacaaaggatttttatttttgaaaatattgctaaggcttgggatctacggctcgtcctagggtcaaaggatgctctgataccaacttgtcatgaccggaaataacccaacgggctttcctgacgtgcgtgcattaatccttgtcccaggaggcaaggtacaccaaaagttgatacaaatcagagtttaacaagcggaagcgtaaatagttaacttattacatgggcagcgaaggcccagcacacacagagacaaacgaaaaacagcggaagactagggcgacgaccacaggcgcttgacggcaggcacgagctagacaccaaagccttcatcttcaaggagctcctcttctgggcttgggaaaaattgagcaagactgagtacaaccaccgtactcaacaagacacacccacaaatgcagaataaatgcaagggagtacaagggaattataatataaagggttagggttgcagtaaacagcatttaaagacatttagttgctcaaagctattttgtcaacacgatcctagaactaaacagtattattaatcaaggccgtgaacccacacgaacctgccttaacccaaggcctacgatgattcagaccgaactggcaacccgaccctgggtcccagctcgtcccaagccaacccaggccaaccattccacattttagttgttgagcaaattttaagaattataacactgacttgggtacattgctcggcttgcccataaccgagggcgcggctattcgaataggttttactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccgcctacggccggaacccccgggacaggcaggcaggactgagcccctagcagcagggcaccaaccctctgccgtatgacatctcgactaccgggccgcagctcgtgtagccttcatttgccctggagaatgtccatcgacccccgacttcatccatctccaatccgtgtacttttgtttatgactagcctgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtgtgtccaattccaacataagccaaccattccatagtgtccaaatgatatgagaatatcccaaagtctagagttgtaaaaccgcctaatgttacctaattaaattgcgaagcatctacctaaaattaaactagtggtgccatgagtagagtgtccactagttgaggttttgtttgctctagggtgaacaagggaataataataacaatagcaataataaggtcataacaaaggtaaataggcatggctaaataaaacagtgataacgcgggaatttaaataaagcgataatgcaataatttaaatcaacataattttacaaactgggattcaatatgttcaaagatgatgtgacttgccttgctcgctttcccaaccgacggcttcgacttccacgaagagcggatcttccgaagctgcagcgtctacacgaccaacggaaaagaaaaaggcttttactctaataaactccacataacaacagaaacaaagcacaaaaatgggttcttgacttcttaaggaaaaattagagacttgaacggtccaattccgagttcaaatggccaagatatggccatttgaagtttatatgctctttaatggatatttgcggatttcttcatttaaagttttaattaaaaaatctcatttattgcgtcagccgggagagggcgcgcggaccgggtccacgggagtggggcccacgcgtcagcctctcggtccacggtggaccgggcgcacacggctgacggcggccggtgccgtgggtcccacgcatcagccgcacccgcgggcgcgggcggctgacggccgggcccacttggcagccgcgagggcacgcccgaaggcggcctcgccggcacggccgacgggagggggacgcgcccgcgccccgatggtcaccgccggcgaccaccggcgcggcggagcggcacccgagagagaggagggaagggggaagcgaatggagcggtcttcggctcaccccggtcgacggcgacgacgggaacggcggccgaagcggaagaaggcggcggcgcggttcgggacgacgaggatgacggcgctccgtcggtcggcgagcgaaacggaggcgcgaacgaggtcgacgggaacgcggcgaagccgatggaggtgacgccaagtggggaggaagtccggagcgacggcggcggcgaaccggagcttgtcggcgacagcggagagagaggaagatggcgcgagcacgaatgcgacggtgagagcgagcggcgaacggcggaaacggaggagagaggcacgggagacgtttaaatagggccgagaggaggagagagcggccggaggagatggaaaccggcgcggagatctcggccgccattgattgcgccggcgaactttgcgggcacaaaatcggacgaatccgagggagagagagaggggaaagtgggggaatcgggagagggaatcgcggggaatgattcccccctcattatggcgcgcggggacggcgggatgcggcggaatccgcggcggcggcggcgctagggcacgggcgagcggcggacgcggcgggaggaaggcgatgacaggtgggtcccacccgtcagcgagggtggcgggcgggcccgcctgtcagcggcgcgcgcgctgggaggagccgttgggccgcggaggagaggagagagagggagagaagtgggccgagccggcccaagaaaggaagggggggaaagaggacttcttttagggtttttctttttataaaccttttcaactttgtttatttcttctcaattattatttgtgctctgaaaattccactaaaatttatttacgcattttaggcttttaggaaatatacaaaaatcctccaagccttatttgacttttatctttgcacattttaattgttggaggctttcacaggaattttaattattctttgcacaaatttcgaggatgtattttagagtcgatttgggacgtgacaattcacccccacccccagcactaagaggatcaaagaggacaatctttctcggcacagaatcctggtccctgtacttagccataacaaaaacccttcccaacattctgtcagcatcctcccaaaaagtttacttaccaaaagaggtaactgcctggtgcacatgatggcgatcaatgaaatcaagcgggaaatctaggaacatgaaccagccttctctatggtagttagccgccctccaattaggacattggtcatgattaacaaaaataacagagtgaaccccatcatagaactcgggcggggagaggaccagagcatccctattcatggcagacctcatctggaagaaacctactacagacgggtaccagaagctgttacaaacctcatagtgtagctcatcttgaacgaagtttgcaatgagggcccgatgatgatcccagtcctgctccaaggggattggctctacaatggccacatagaagtcttcatggcgccgagcagggcgttgcgggacagtgaggtcaacccgcgggatgcggaagtcacctccagcatgaacaacaagaccatgcattaggaagcgcagcggattagggttgagattggccattggggtggagggaagctttgggtgggaagcactgtgcgtttgggagaagaagggtttcggggggaagaagacgagatttccggagaaatagttttagccttccaaacagcagtagtccgagccgacggtttcggatttttagggtgcggggcttttgtgggcttagtggtcaaacaataacgggctaaatggcccggcaagagacaggctcgacatctaagcggcccagaacaagaagcccgagaatgacccttttccaggcaacggccgcaaggagtgttttccaaatttgaattgggcgacaaattaggatcccgcatacctttggcatgcgtaattaactccattgccggaatgaacgacggcgagacgttagccaccttggaggttgccggagaagtgactgaaaccgttttactctgcttaaaccactcttgattacaaaggttattccagctattgcctcttgttgaccgagagaagatgtagggaagaccatttggattcagcaagacaatgcacggacacatattctaccaaacgacgaagcatttgccctcacggtggcccaagtaggctattgacgagtgttaaatgtcgattctataccgccaacatctgcataaagatcagataataaaacatccaacatagtgataggtgcttaatctcacatattccacaagtgttggtctatatttgtatgcagataataaaccctgaagttgggaggaaaattagactaatgtgaggagaattatgtaatcatacaaggaggggttgtgaacttcatcgaaacattagtgaatcaacccaaaactccgagaaatggacagaggagagcctagggagtccaccgactgaaggctaggccaggaggggccagcccaagttcgaccgaaccacctggttcgaccgaacccccctgatcaccgctgatcctagggtttggcgaggacgctccagatgctctcccaatgacggttgaggggcagttcggacatttccccttcgcgaaccgtcatacctacccctatataaggacatcatctcactcacttcaacacatacttccaagcttgagctaaattataagaggctttattgtactatattgtatactaaaataggaagagcgtagagtaggagtcggaagaattccggagttgtcggtaatcttctcctatttcttttattctatttattactctgaatttaatataatattcttcttgagtaatttagatttatcttgtgagaattatctcttggttagttcctaaatagcatacggaattattgttcactgtaatcaactaaaatatagtgattgctttgctgagttataaacactaaagtagatagtaattgcttagacgtggtgtttaggtaattgttgtccagtaattgctgcgtataccacagtacgttgaggtgggtgtagaggtggtgacaaccctcgagatcactgaagtcctccctgtccgggtacgtagtagagcgacatctgggaacagcgggttgccagttcctgaagtactgcgttaggattaaaattaagctttctctagacactgtttctcactaataaatcctctctatcctagcctatcatttgcttggtgtccttggatgaaccggaggaagctctgatcacacacgttcccttggattcgatacccttggaatacaccgtaggggaagtgttacatcggtatatctgtgcacttacggattttatctgtaaccgtatcaaataccaagaagcatttctagcaccgttgctggggaacagttgctgatcatttccgaacccagttcatcctcggatcttttttcattttttttattctaccttcacccctgttatcctagagaagtattcttgtcaactcttctcgaccatggagcaacctctgtttgagttgtctactcctcggggcgaattctatgagccacctccttcatcggagcccatttgtacaactggctatgaaattcgtcccgagctaattagtatggttagggaaaatcctttttctggttttgatctagaaaatccctaccatcatctgcgagactttgaacaagtccgctcatgccttaagattcgtggcatgagacaagaaactgtgtggtggaaattgttcctgttctctcttcaagagagcaaagcaatggtacacctctaccgttggatgtgtaaatggtagctgggaaaagctgcgagacagattctgttttgccttcttcccagttactcgtatcactgcccttcgaatagaaattctcagtttcaagcagatcgaaaacaaatcaatcggtgcagcttggtccatattcactaatttagagcagtccggaccaaccctgtccttacccgagtatgtgcttctccaagatagaggaacctctaacaatcgagccacttgctgaaccatccacttctgctagctcaattgatgagaaggttcccgagcagccgtccatcgagaatgaagaaattcagactccggattgtgccgcaattatgttcagggacggttttgacgaagactatggcaataccctgaactattttagcaagaggaaaccacccgttcctttgtcacctcccgatcctatggaactcgggttcctatgagaaattgtccgggaattgacatccataatgagcaatgaatggcttagggaggcagagctttcatccgaagta

SEQ ID NO: 72982 - DNA, 8883 bp, Oryza sativa
gtattccggataccatcaaattcccatccatccggaggaccatactaagactacgttcacacgtccatatggcatttatgcgtatcgtaggatgtccttgggactgtgcaacgctcctgcatctttccaaaggtgtatgatgtctattttctcggatttgatcgaagatatcatggaagtcttcatggatgacttcttagtttatggaaagactttcggtcattgtctgcagaatctagacaaagtcttacaacgatgccaagaaaatgacctcgtgcttaattgggaaaagtgccattttatggtctgtgaagtgatagttcttgggcatcaagtgtccgaacgaggaatcgaagttgatcgtgctaaaatcgatgttatagatcaacttcctcctcctgtgaacatcaaaataatccgcagcttcttgggtcatgctggcttttatagaaggttcaccaaggacttgtctacaatcaccagacccctgaccaatctgctagccaaggatgcaccctttcagttcgatgacgcgtgcctaaaatcttttgaagttctcaaaaaggcactcgtctccgctccaattattcaacctcctgattggactctgccctttgagattatgtgtgatacaagtgacttcgctgttggtgagtcttgggccaaaccaaagataaaaagcatcacgcaatctgttacgctagcaaaactctaaccggagcccagttgaattatgcaactactgaaaaagagctgctcgaggttgtttttgctatcgataagtttagatcttacttagtaggagccaaggtgataattgatactgatcatgctgctttgaaatacctgctcaccaagaaagatgctaaacctcgtctcttaagatggattttgctgctccaagaatttgacttagaaattaaagataaaaagggagtagaaaattccatagcagatcatttgtccaggctgcagatcactaacatggaggaacagccgatcaatgatttcttaagagatgatatgctgatgacggttcgcgactccaacccgtggtatgccaacatagtgaactacatggtatccaagtgttgatgtaaaaacacgaggcctgggagatctgcttaactccagtgcaagtccaaaacttgccttcgggtatgctagcgtgacagttgatttgatcctgcaatcaacaagaacaaggacaaagaaaccgcggttaaatccataaacgatagccgatcggccaggtgccgatgacatatcatttatcttcgagccgatgtcatatttgcatcgatcggcaggcattaataaataaaacaaaactaaatctactcgatcggctgtagatattaatgatatataatccttatatcgatatatacttaaatcaagtgattgggatagatcagtcgccatgccgagacagtataaatcacttagatcgaagtatatattaataatgagattatatatattcgtaacatagccgatcagatagatctagcatgtatcggctaatactctgatactgctttatactaagatatcaaagcaaatagaatatatcaaacaaaggcctaatatacttaaatgcaacaagatcttaacataaagggcagattcaacatatcaatgaagcacatagggtaaaaagtagttaaatcaggtaagatcggctgaaaccccaatgttaccctaatcggcaaccaagaagcaggctagaaattgagattctaatcacgacttataggatcaaactgaactgatgtagctataagtatgaaaaatagcacaatatctagacaatcaagccgttggatgtgtcatagagtggtagataccttatataatctaagccaacatcaatatttaacagaggttagccaattataggttagatagcgatattgccagagattatgtaagatatatgataactcgacgaattacataaacaagattagagtgtcatgaagatggaagcactaatcccgagaacgcaagccgccataacaagttttacctcttgttgaagatcgaaaccgatgcagctcaacccaaaagcaagaactcgtcgaaacaaaacgaaagtaaaatgggtggcgatgtgctgagattgtattgaacgtgtgttaattcgattacatgggggctcggggtctatttatacacgagaattacaaaacatgtccatatcggacatgactcttatctctaacaaactctaagataccataagtctttgcagcagacttttgcccaaacatatctctaaggaaattacataaaatatcctaattaatagatacaattgccttcttaggactctatccatgtgtggcaatcatcttgaaacatatcaactcaacctgatgatgtataccgagttgtattgtcggaatcgactgtatcggcttacctagtctgactcggacacagccgatcctgatcgtagccgatttggactctagccgattcttactctgtttttgaaatgatcttcgtctttgattccgcctcgatctaatcttcatctccaatgctgatattaccaaatttggtcgataacaccaagtacataccaccaggggaaaatcaatgaaaactgaagtatgaaagtcgccgtcacatatgggatgagccatacctatatcgggtctgctccaatggcctactacgaagatgtgtgccaactaaagaaggactgaagatcatagaacgatgccatgcctcaccttatggtggtcattacggtgcattccgcacccaggccaagatttggcaaagtggtttcttctagccaacaatgtacgaagactcaaaagaattcgtcagaagatgcaccagctgccagaggcaaggaggaatcactgctcgcgatgcaatgcccctcacatacaatctgcaagtcgagatattcgatgtttggggtatagacttcatgtggcctttccctaagtctcgcaactgcgagtacattctggtggcagtcgactatgtctccaagtgggttgaggctatgccgtgcagcgctgcggatgcgaagcatgccaagaagatgttcacaaaaatcatcttccctagttttggtacccccagaatggtcataagtgacggaggttctcacttcattgacaaaacctttcgagacctcctacaagaaatgagagccaaacacaatgtggccactccttaccatccacagaccagtggacaagcagaaacatcaaacaaacaaatcaagaatattctgcaaaagacgatcaataaaatgggaacaggatggaaggatagattgccggacgcactgtgagcatactggacagcatacaagacacccattggaatgtccccatatcagatagtttacgggaagccatgccgactacccgtaaaacttgagcgcagagcatactgggccattaggaattggaacatggattttaagcgagctggagaatggagaaaaatgcagatcgctgaacttgaggaatggagagaaaaggcttaccacaacgcaaagatatacaaagaaaggacgaagcgcaggcatgacaaaaggataaagatgaagaaatttaagccaggagacaatgtactaatgttcaactccagggttaagctttttggccacggaaaactgcgcagcaaatgggaaggaccgttcgacgtcatcgacacctctttgcatggggcaatcacacttcgcgacgaataaggtaacatatttaaggtaaacggtcaacgcctaaagattttccttgagccaaatgaaactttagatgaagaagtggatgttactgaattaatttattatgaaccatgatgatctcatctattgcatgcttaaaaccctgtatagttgtcatttttgtacttaaaataggttttagtgggcctatgaaaaatttggtggcatgtcgaacccaccattgttcagccgaacatgatggttcggccgaaccagggcggcgcccgatcagccccaattttgaacctcagtctcccccgctcgtccctagtctatttagatgcgtgtttggaggtagaacgttcggatcacaccagaacactccttcctcttttcctccacatttgcacactctcctctccaattcaacacaattcctcgaatttccactcatatccaccaatggctggcaaatccctaatcccattcatcggcccttcctctaattccacttataacctcaccggagagccgacaccagcgaatcaattgatcccgatggaagaatacaccatggaaggggtaattgcacagtgggagcagcccctcgcagcagtgctgggctcccctgcgaatctggagcccgtcggcgagctccttggttcggccgaacccttctcggccccaatcggcctcccgttcggcagcgcgatccctctcccctcgctatgttacaagaacaaaaatccggggggattcgcctgcacgacggccgactacggcagaactcagcttgttaaaggcacgatgtcttttccaagatgacgggaaggccgcaccgcctcccgccgagcgctatgtgggcgccctcttcaccaaggcaggggatgaggtgctccacaagtataccacacccaccgctactccatccaccccaaaaggggagcgtttctgcattcagggagtgtgaactcccggcggtgggtatggcaaaggtttactccggcctttgatggcatcggagaaggagagggcagcggaatcccgtagccttccacctaagaaggtgaagtatcgtttgacgccccctccaattgtgagggctctcggccaattcctagaggatgaggtgaagtcaccggagccctcgatccacaagctcgccgctcaagtgaagaaactccgcaaggagaacgtagagcttagggattgcaatgcggagctaggggtagaacttgctgaaattagaaataatttcgatatccttagtcgcggtttgcgcgctaagatcaagcgtgcgttcatagagatgggaaaggaaaataagtattatgctaattagatgtttcctttcccatgaataaaatagtagtaggtgcttagttttatttttgcaatcatgtaagcacttgctatgaataatgtggcacattggtgtttaccccaatgtttgccaaagtttgttttttgtttaataaaattcaggttttgaataagtgtgggggcgatatcccagcttctgacgtgcatatgctctgaaaattgttgaaatatctgaacacctggaagcactcaactctgcagaaaattgcagaggaatcgggcaccagagtggttcggccgaactaccaggttcgggcgaaccagtgctggccccagtccctctcatcttcacaggtaagcaggtgagcacgtcctttatctgtatatctccaccatggtatagtactagagctgcaaatttagaaacaattggttcaagcataagtgaaagataaaatttccaactattgaaattcttcatgtgattgatcttttatattcattattctcagctgaatttgtgcttgtgaacaccatccatgtttagggaaccttatacatctaggtaattgctttatgtgagatgattaagatgaaaggactccttgtaactttgttgtgactcttgggaatttgttttcaaaaataaactgttttaaaagctctatcctccaattgactttaccttatacctaccaaggccatatgcaagcggcggggaaggaatctccacccgcggtgactgccagcgaagtccgctcgggagagccagcgaggatcactgcagtgacctcccaaccagcgtggggctctgcgtcgtcaccctcctgctccggaagcggcctggcctggtagtccactccatgtggataccccaggacaacgcacataccccgcagctccaagacgaagccagtcatgtccaaaccacgacgggtgacgctgccggccatctacaaacaaaaacaaaaaggaaaacaacattttaaagatcagattttggcgataaatgaagcagcaagacagagagagactagacagttttcacaaataacaaagaatttttatttcgaaaatactgctaaggcttgggatctaaggctagtcctagggtcaagggggctctgataccaacttgtcacgaccggaactaacccaacgggcgttccttacgtgcgtgcattaatccttgtcccaggaggcaaggtacaccaaaagttgatacaattcagagtttaacaagcggacgcgtaaatagttaacttattacatgggcagcgaaggcccagcacacacagagacaaacgagaaacagcggaagactagggcgacgaccacaggcgcttgacggcaggcacgagctagacaccgaagccttcatcctccaggaactcctcttctggggtttgggaaaaattgggcaagactgagtacaaccaccgtactcaacaagacacacccagaaatgcagaataaatgcaagggagtacaaaggagttatactataaagggttagggttgcagtaaacagcatttaaagatatttagttgctcaaagctattttgtaaacacgattctagaactatacaatgttattaatcaaggccgtgaacccacacgaacctgccttaacccaaggcctatgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgattagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacctccgggacaggcaggcaggactgagcccctagcagcaggacaccggccctgtgccatgacatctcgactaccgagccgcagctcgtgtagccttcatttgccctggagatgtccatcgacccccgacttcttccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagaaggagcggtgtgaagccaattccacaataaccaaaccatttcaaagtgtccaggtgatatgaatattcccaaagtctagagttgaaaaaccacctaaagttgcctagttaaaagcgaagcatctacctaaaatcatactagggataccatgagtagagtgtccactagttggggttttgtttattctagggtgatcaaggtaataataacaataacaataataatagggtcataacaaaggtaagtaggcatggctaaataaaatagtgataacgcgggaatttaaataaagcgataatgcaataatttaaatcaacataattttacaaaccgggattcaatatgttcaaagatgatgtgacttgccttgctcgctttcccaaacgtcggcttcaacttccacgaagagcggatcttccgaagctgcaacgtctacacgaccaacggaaaagaaaaggcttttactctaataaactccatataacaagcagaaacaaagcacaaaaatgggttcttgacttcttaaggaaaaattagaaacttgaacggtccaattccgagttcaaatggccaagttatggcatttgacgtttatatgctctttaattgaatatttgcgaatttcttcatttaaattttcaatttaaaatcagatttattgcgtcagccgaggggaggggcgcgcggaccgggtccacgggagtggggcccacgcggcagcctcacggtccacggtggaccgggagcacgcggcttgcgccggccggcgccgtgggtcccacgcgtcagccgcacccgcgggcgcgggcggctgacggccgggccccacatggcagccacggggcgcgcccgaaggtgacctcgccggcacggccgacgggaggcggcgcgcccgcgccccgatggtcgccgccggcgaccaccgacgcggcggagcggcgcccgagagaggggagggaagggggaagcgaaagggtcggtccacggctcaccccgggtcgacgaggacggcggaaacgacgaccggagcggaggaaggcggcggcgcggctcgggttgacgaggacggcggtgttccggcggtcggcgggcgaaacggaggagtggacgaggtcggcgaggacgtggcgaagccgaaggaggcgatgccgaagcgggaggaggtccggggcgacgacggcggcggaccggagctcggcggcgacggcggagagagaaggggacggcgcgagctcgaatccgacggggaggagagaccggcgagtggcggaaacggtggagggaggcacggggagtgtttgtatagtgttgggaggggcagagaccggccggatgagggggactcggccgcggaagatccggccgccattgatgcgccggcgaagtttgcgggagtgtttccaaacgaatccgagggagagagagagggaaaagtggggggggaaagagagagggaatcacggggagtgatctccccctctttattgcgcgcgggggcggcggaatgcggcggaatccgcggcggcggcggcgctagggcacgggcgaggcgg

SEQ ID NO: 72983 - DNA, 26821 bp, Oryza sativa
ctaggagtatgactaatgatcttcttgagtccatatttttggctttgcaatatatatgatgtaggcatgtcaccagtttatccctaccaagcttcacatatcagccttagaataggggtaaattcttgcacactttgcgttggtgaggatccaaatgaaaatatacatctttgagagataagagagaaagtcaaatatgaggaaaagagatagtttgcgaaaattcataaaaatcccatgagtttgacagagaagcaagaaggactgaaatcaagatcgttccatcccaaaaatccttcttttatttattaggagagggcatgattacattttttttaacattatgctcatgcttgatggagcataaattctttttttttcataaccatgcctttccctcctttctttttttttctttcaaaaggatttttctttttttaggagaagaaagcacatgaaagcatggagaatttattttggtggtaatatgcatatggaatggaatattgcttagctcccagtgtaggagtttagcatgtgcatatatgtgggtgtatgatcttgatcatagagcatgagaagtatctacacaagtcataagagtttgacaaagttcaatggaaagtcaagcaaccaaaatgtatatagtttaatcatgatagcatatttttggctctggtaggaatttatatcaaatgaggaactttcaattttatcattttgaaaacaaatcatcggaatttaagtcaaactagtatcaggatcatagctactcttatttactatctcatatctcacaatagcttggacttaaatcagcaagtgcagcccatttaccttaggttcccggataattattggctacttatattcaatctttgagagagcacttaccaagaacccatatataagagatataaaacagagcaacaattcatcatttcaacaaagagaactagctagtcttacctagcatgactcaaacctatcctatctttttggtattttctattttgcaaatttttatgttttttttgagttttataagatgcaattggaaagcaagtatgcaattggaaagggaaatatgcaatgggatacaagttaccttagtggggggagagatgtctccctccaagcttgccttttgctcagggtccttgataaggattgaacccctgaaatcgaaagtacgcgtgaaggtcatcatgatgttactgcatcatgttgttgatgttggcgaactgagcattagcagattgttgccattcttgtgtttgagctatgtgttccgtgaggttgtactggatctcccctgtctgcacatcaagggtgtccattgtcctagtgatttcacccaagtcccaacgagaggaacttgagcaccattcacttggagatggaggcacaccacttgatctagagggttggttgtccccccagtggatgtcatgaggcgcatgccaccggtcctcactggcgcttgaccaggttgagactccgatgctatggcgtggagcttggatccatccaggtgcatccctagttggtgcccaacctgcctcatacatctgcacgggtgtcgaggatgatgaactttctcgttcgttccttgtcatgttgcgcgtctccctgtatgttccacctgcacgagattcttctatggtctgcaggggaatggttagttcatggcagttgtacaaatgataccccgcatttggcaacaggatttcatttgtaaaaccggggaaaaagtatatcaaaaattcatctgctccatgtttcaaaatatgcccttgcactagataggcctcatcaatacgcggacgagcggctgagataaaagcaatttggtcgctaacgacccctagcacgagcctaagtgtaggattatggatatcatttgttgtcaaagccacaactgcatacgtcgaaagacgtggttactcaacagtagttggaaaagaagtaaaaatgttttaaaatgaaaaatttttcttgggatccccctattacatggccctatggggctagttataaccccattacaggttcttactactaggggtttggttatatagggaatttacatggttgcccgtatgaaaaggacatttacacgggtacacagtgtaatttaggttcatgggccccctacgggccgttaggcgattgttgaccccattatcccctatgctttttgtgcccgaataggttttttgggcccccccggggcgaacttgctacggcaaagtcgtctcccttcggcatatacttttcgccctacatccttcgcccaggaggcctctggcttggtgaagtacccgtgagattccctgcctttcgccgttggtgtttcatagtcttcgccatgggggacttcgccctgactaaccttgacgtctcgggcttgaatccccactggtcgcatggtttcagcaggtttggtcaaagggcctcatgccatatcgccaacaagcccctcacgggcaagggtgagataggagcttcggccgagaccgtgcaaaccatgtggtatggtatgtggcgccccctttcgactggtgctcctgccccccattctctttttcaccgccacacttgtcattttcaccgcgcgcgctttcttcctctgttcttcctctcacggcgccccttggcccttcagacctttcactcgctctctctgttcgcaactgcacactcccttcgccatggctccccgcaagcctaacccctcttcggcgaaagggaccgaccccggccggattgacgacgacaccaccgcctatttggggatttctctgatagacaacggcgagttggcaaagttggtcagctctagggcgttggttgagggacaggctttcgccctggggaaagccgttgtaccgaagcccgtcgacaaccggacggtggtgttcgccgtgttttttgaggcggggctccggtttccatgcaactcgttgttgccggagatcctttgccttttctaggtggagctcccacagttgagcccgtcggcgctggtccggatcactatcttcgactgggcgtgccgaacttccgggtttgagcctaacgccgaactcttcgatgccatatttttcgccaccgtgaattcgaagacggtgattaccccggccgggatgaagaagacagtgttcgggagcgtgaactttaatgttcgccccgagcactccaatctctggccggtgaatgccgccatgtcgaagtgggaccgccattggatggcgaggtggtttttccacatcatccccttcgaggctggttccgagtcagcgaaggccctccggtgccggcgcaaggcgattgcacctaactggaaacccaagatcgccgtggacggtgctatgaaggcgtggttcgctctgctgcgtaaggtttgttcccgccttagctgtcatgacttggtggagactgcatgcttcgcatctttcccctctcccagtcatggcaagtcgcggttgaccaaggcgaagaggttgatggtctgtcaaagttggttctccctaaggggacgaatggtaagactgcactttcactacgcattcctgttcttggttattttgcttcgttcgacacttaatgtggctgcaccctctattttttttgcagtgttgaccctcaatcaggccgacgccgaagcccggaagatgatcggcgacgtgtcggtcgtagagtatagccagctcctgacacgataggcggtcggccgggcgaaccgggtttataacggcgaattgcctcccgggcgaacccccacaaggccgacgacgatgcagggccttcgcgaaagtggacgcgcggacaagtgaagcttgcccctaggaagcgaagggttcctgcttcctccgattccgacgccgatgatgaggacgacgtcgaagagcgtgacggcaagtaggaaggggaggaaaaagaggaggcggaggccgtggccgaaaaggccgcggacgaggcggtcgaaaaccgcgtcgacacccctggctacactcctactccaagtccaggtcacaacgagactggggtggaatcgaatagctcccttcttcatcgaaaggatttggagggggcgaaggcgctagtagcgttttcggcaggcaaggcggcgaagggaggcccagttaaaaagatctccaaaaagaaaggactcgtcgatgtcgctcgcgttttcagcgacgacgagtcttctgacgagactccgacttcgcccgctggccacagcttgtacctttcgaccgctcccattcttccgctcgacgctagtggggcaggtggtagcgccgccgctggggcttcaacctccgctgaccggatcgtgatggctgcggcgagggttttcggaagccctctgcgtcagccggttgtttcaccgctagtaaaggcgaaggggaagggggctgccgtcgaaacatctgcctcggagtactccctcgtggtgccccacttcgcccctggtgatttcgagacccgggcggatcttattcccttcgtcgagggagtaagcaatcttgtcttacctgcctgcacccagagcctattcaccgagttgaacgagttcgatgaagggtgttccgctattaaaagcttggcggttcgggtacgccttttcgctctctttttgattttcctctccttttttacatgtcccataattaacatttattctcctcgcccgctcctgtcttggatctagattcttgcggcccactgttcgacagagcgaactgtgcgggcccatcttgatggatttaagaaccgtcttcgggccaaggatgacgaaataggccgcaagagcttgaagatggaggccattgccaaaaccctcaaagaggcgaaggccgaaaacaagtggctccaaaccgaattggagaaaggaaaagaggctagggccgaggtcgatcgcctcaaggccgaactggagaaggggagagaggccagagctgaggttgatcgccttcaggctgaactgaagaaagaaaaagcccattccactatgctgaccgactattataacctcactaagccgaagatggaggctcttcgtctggaggtcagcaaggctgaggcgagcactgtggaggagtcacagcggttttcacgggagatggcgaaagccaccgaatccgcaagaacggcgtgccaaacgctccgccttgcccttactgacatgggtgcaagggtgcgaggagtccctgccgaagacgcctcagccttcaacttcttcgagtggactcagcaggctggtggtgcggtttcgaactgcgccactacatacagcgattgttgtgtgcacgtatcagcggccttcactatgggccttatgtagcagttcggctgtgagcacgtcaccgagttccctaactatacgaagggggactgggaggtaagtgcgcagaacgtttcgccgacgctccgtgtgtggcgaaagcagttctggcagaacgacggccgatccaccgccaaggcgcgcctgctggagcaattggcgaaggcagaggcggcagaccggtgtgaagaagaggacgcggcggccgaagggggtggaggcgatgcccaggatcacctagaggtgtgaggccctccgccctttccttagatttttgtagtttttcttcttccttttgtgtttgccgagagaggcgaatgatgtaaattcggcgggctggccctaaccctccttattgtagccgaaaaaggccccttggatatttggaatgtttgactcaatcttagccactttttatggtcgatgcctttggcgtatatgattacgccactttcgcattatgtaatatttgctcttttttcgcccattcttactatccaattcgtcttttgccctttctgcattgtctaccagggtgtttgctgaaaattgtgcattcggcccccttctgggagttggcgaagcaaaaacgagaaatttgtggcgttgaaggatctgctaaatgtacgatgcccgtttcggcatgtttatcgcgagatggtgataaacggccacagctataaggtttttaaggttgctggctggctacgggcgcaccccgggcgaaccttagaagattatgatcttgttcattcaaaacgtttggaggatatggctagcttttggcaaaaccatcagaagactgatcggcaggaggcgatctcccagcgtcgttacagtctagtctgtgtttcgcccccttctcctcttagggtcgtgtatgatattagtagtgatgacgaacccagttcgtctgaccattccttagagagagagagagtgattgtgggggcgaagatgtaatttatctgtaagctgggctgtaaaaccattgctttttcttttacttgtaccatatttttctttcgaagttaacaaagatgtgttttatttccttttcgctatgcattgtcactttgcgtgctttcgttgggtcagaacgtgttggccctttgcgtatattagcgaaataggttttggcttttcagctttcggcttccgttttcgatccattttgttctacattgtaggaagcactcgtgcattccttttgatcgagtgtaacggtgttcggttagttgttccccgaaacaagctgttgcggtttcaacgttcggcgagcgatgcttcgaccgatttgtttcgcccccatggcctttttcgctgatcaggcgtttgccttggggtttttccacaaattatcaatcacacaaataaataagacgaaggtggaggacacagagattttattatggttcaggcctccatggtagataatagccctacatccagtttttcgtctttttacattttcctcttttttttctttttttccttttttcttctttgccgaaaggtttacatagtgtcgaagggcttacataacgatacatacatttttacaatttggcgatttgggtgccacccgttctagacatagaaaagcttgagagaggcagcgttccaggaatggtcgaactcttcgccttccagtgtcaccagtcgaaaggatcccatactggacttgtccttgatgaggtacggtccttcccacttcaattcaagcttgccaacagctatcgggttcgcctttggcaaaggagatgcagcgaagcaagggttggagcaccccggagcaatatagctggctcttcgcttctgcttcatcctccgggagccaaccgttcttgaggtattttacgaacggggttcaccagtcctttaggtcttcacacagctctgcctggtcgattgccatgatgtccaggatctctatgggcacacttggtgcgtacaggacctcaaaaaagatgtctggcgaatgcgggcctccacaagcagtagatttcgccagggcgtctgcttcttcattctggcctctaggtaagtgttcgaccgttatgccggcgaaacacttttccatagatcgaacagcctcaagatacctcttcatcccttcttcttctgcctcaaaggatttgtcaacatgacttgccaccaatttggagtcagttcagatgagcaagcaccgaacccccaaagctttcgccttttttaggcccaacagtatagcttcgtactctgccgtgttgttggttgtgtcgaactttagccttgcggtgtactgaatcgacacgccccctggcgaagtgagcactgccgcaacgcctgcccccttgtgtgaccatgagccgtcggagtacatcacccaaggttgttcgacaggctagggttcaagggcgaatgtcggtgtccattcggccacgaagtcagctaggacttgggacttgatggcagtgcgggcgacaaaatgcaagtcgaagggagataactccgctgcccacttgctgagccggccagtaatttccttgccccggagcacttcgcccaaaagatactgcgatggcaccgtgactttgtggccctgaaagtagtgttggagcttgcgcgaagccatcactagggcgtaagcaagcttttccatttcgatgtatcgtatcttcgccccttgcaaagtttcgaagacgaaatacactggtttctggcctgactctgtttcttgaacgagggctgcagtgaccgccactggcgaagctgctaggtaaagtagcaattcacttcccagtgctgggctgaccaaagcagatgtgctctgtagatattgcttcagctcgtcgaacgctgcttggcattcgggtgcccaggtaaattttcccgcgcccagagggtcttgaagaagggcaaacctctttcggctgcttttgagaggaatcgattgagtgccgcaattcggcctgcgagcttttgtacttcacgtacgctcgacggggggttcatttgctgaatggcatcgattttttttggggttcgcctcgataccccttttagaaacgagaaaacccaacaacttgccctcgcgaacgctaaccactcagggtggtcgatctcctggatcaccctagccttgcacagcatttgcacctcggctttcgctgcttcttggcgattagcggacatcttgcgcagcttttgtttccttggcttggcatccggcttgcccgccagatgatgcatgatgaggtctgtcgaaacacctcccacctcgtcggggccccaggcgaagatatcaatgtttttcttgagcacctctaggatgatctcagcttctcttacgcccatgtcaccccccagtgatacaagtcttgtgggataggcgtcgtcgacctgcaccttgatcaccctgccgtgaggggcgggcttcggcacgtgcttcacccggtcatgcggttcggcctcaacattgtgcactgctctgttgattacggccaaatcgccctttgatgtagccgaatgttgaagccccttgaccacgatcactccttcagggccaggcatcttgagcttgagataattgtggtcggagatggcttcgaacttgttcaaggttgcgcggccgaagattgcattatagttgtacgggatgtccacgacgtcgaacagtatttgctcttcgcccctgttttcacctgtgccgaaggctaccaccaagtgtgcttggcctagaacttgaactgcttctccgctaaaaccacgaagccgccggtgcttgggtgagggctaagataggcaaccccatcgtcgaccgaacttcctccgtcgactaggattcgctgaacttcgaagccagtacctcggccaagatagctctatcttgatgtgggaacagcactccttcggcatcttctggcccgaaagagatctgctggttcaaatatcgcggggcccctttgcctgccgaagtgatgttgtgcaccattcacagctgcatcttcttttgccgtcttgacagttgattcggcgggtcggcccttgtaatcacttggattactctgcactgcacatcttgccactgttcggctgggggtgcttgttcttgaataccttcgtgaggcgcttcgactgctgctccttgctgcggccttggatcttgcacgttgccacgctgcagaatgtttcggcattgctcggtggtgtgcgaagagcatccgtggaaggcgcagtaaaggtcttttctgaccttcttgcgaacgggctgttgatggctgcttgcttgctgggcgttgaactccttgcggagtgcttgaatttcttcaacagccatcacggccttgcctacacggtcgtttctgaatttcctccaagtcatgggagcttgacctggccttggcgattatccttggttcgctggctgtggctagcgaacagcgagaggagccgattcggcgacctgtgcttgtgcttgggcttgagcagcagcgacagaggccttatcatactcagcttggattgcttgccgtcgcttggtatcctcttcgccccttgcgtatccgtcaatgatgcgaagcaggtgctcgagtgtctgcggctccttattggcgatttttcttatgagttcgccctcaagcaacacagccgaagcggcgttgatgacgaacgcctcagttatgtcctaaacatggcatcgggcttgcgagaagcaacgtatgtactcccttatcgactctcccggcctctggcaaatgccgagtagatgttgctgcggctttggcttctcataggtgcctcaaaagttaaggacaaagacgtcgcacaattgctcccatgagtaaatgctgttagctagtaaattgaagtaccaagagcgtgcgatgccatctagagcgagatgtattacctttgccttggtattttcgtcaccatgagcggcttcgatcgtggactcgtagatggacaggaactcttttgggtccgtttcgcccgagtatcgcggaatgggtgggaacttgaattggggtggaattggacgaatcttgattcccccacttagcggcagccccgtttcgccccccgtctttctcacggcaccttgctgcggaggaccgtttggatatggcgtggcgaagtgcgatgtgatggcttgcacgtgcagttgggccatagtgttcggctgcccggccctaaatggtgacgcttggtgtgccgccatggatgggtcgaacgaaggctgggtccatgccatggcgatcttgttcggcgcctgattcgctccgaagcttggtgtcggtgcctgtggtcggatggttggtgcttgagtagcattgctgaagtcgaactacggtccttgactccatggcgaaggccctggaccaggaaggttcgatggtagccaactgggtgcaccttgacttgtgtttccctccagctggaccgaaggggttgcttctgaaatgttttagggttggttgagctactgaagaaaagcttggagctgcgcctgcaaggccgaagccccttctgccattgcttgcgacatctgaccaagtggcggggggcgtacttgggctcgaccagccgaacttgtggctgtacaagaagggtcgggtgtactgttgcgaccgaacgctgtccggcgcagtacgctggtgcttgcacagcttgtgacggaagggcttgaatcggcgcttgcaggtagaccttgggtgggatgtccgccgaatattggagaatggggaccgaggcgaccttggcttgccgggccgcttcgtacgcctgctgttgctcttgcatttgacgaagcatgtcctagagtcgcgccatgttctgacgcatggcccccatgtcggcttcagcttgcgcttcgaggttggtgttgacttgtgcggcggtaagcgcggtcgaagttgtagcctgctgcggcgaagcagcttggggcaccaccacttcacttgtcgaaaggatctccgccctggtctggagcgcccttgtcgttgcagccgcctttgccgtatcaacagtgttcggcgcctgccccgtcgaagcggcaggagccgaaggtggtggttgcggcgtaggggccgaagtcgatggagccacaccagcttcggcaccaagcaccgaaggctccgctccctcttcgactgccatctccactcctgcttcactctccttacaccttgcaaccttctcctctgcgaccttcttcggtggcattcgctctcagtggtttccctcagaggtccccacggtcgacgcctgccgcttgtcgaaatgacaaccgcatacgtcgaaagacgtggttactcaatagtggttggaaagcagtaaagtgtattaaattgagaatttttcttgggatccccctattagggtttaggttttacggggaatttatatggtttcccttatgaaagggacatttacatgggtatatagtgtaattgaggtacatgggcctctagtgggccgactggcaaacgctggcccagtggcccctgggcttgatcggctgagatggcctcttgggcctccttgaagttgaacttgttatggcaaagccatccgccttcgccatacattcttcgccatatagtcttcacccaagatgcctccaaccttgtgggataccagcacgatccttcgcccttcgccgtctttgcttgataatctccgccatggggacttcgccctgacagactcgacgtcttgggcttgagcccccactggttgcatggtttcggcaggtccagtcgaagggtttcatgacataccgccaacaaatatagtgattgctttggtgagttataaacactaaaatagatattaattgcttagacgtggtgtttaggtaattgttatccagtaattactgcgtatgccatagtatgtttgaggtgggtgtagaggtggtgacagccctcgagatcacttcagtcctccctgtccgggtacgaagtagagcgacatctaggaacagcgggttgccagtgcctgaagtattgcgttaggattaaaattaagctttccctagacactgtttctcactagtaaatcctctctatcctggcctatcaattgcttggtgtccttggatgaactggaggaagatctgaccacacacgttcccttggatttgatacccttggaatactccgtaggggaagtgctacatcagtatatccgtgcgcttgcggattttatctgtgatcgtaagaaataccaacaagcatttctggcgccgttgccggggaacggttgctgatcatttccgaacctggttcatccttgtatcctttttactttttattctaactctacccttgctatcctagagaagtattcctgtcaaactcttctcaaccatagagcaaactctttttgagttgtctgctcctcgggtcgaattctatgagccacctccttcatcggagcacatttatacaactggctatgaaattcgtcccgaactaattagtatggttagggaaaatcctttttctggctttgatctagaaaatccctaccatcatctgcgagactttgaacaagtctgctcgtgccttaagattcgtggcatgagataagaaactgtgtggtggaaattgttcccgttctctcttcaagagagagcaaagcaatggtacacctctaccgttggatgtgtaaacggtagttgggaaaagttgcgagatagattctgtcttgccttcttcccaattacttgtattaccgccctaccagtagaaattctcagttttaagcagatcaaaaacgaatcaattggtgcagcctggtccagattcactaatttagtacagtccgaaccaaccctgtccttacccgagtatgtgttactgcaacatttccatacgggtttggataaggagtccgcattctatctggacataaccgctggaggatcgttcatgcacaaaacgccgtcggaaggaagaataattttggatcgcattctagaaaatacttccgtcatgacgaaatccaatgaacccagccggaggcatccgtgtccaagatagaggaacctctaatgatcgagccactcgctgaaccatccacttctgctagctcgattgatgagaaggttccagagcagccgaccgtcgagaatgaagaaattcagactccggatcgtgccgcaattatgttcagggacggctttgacgaagactacggcaataccttgaactattttagcaagaggaaaccactcgttccttttcgacctcccaatcctatggaactcgagttcctacgacaaactgtctgggacttaacatccataatgagcgatgaatggctaagggaggcagagctttcatccgaactaattcagataaataccgctccccgaatcattctttgccatttggaagggaacgacatcggtattctctacagtccaactgtcggggccaatctagtttctgagtcttttccattcgcgtatttaagcgataaggcagtgaccccaactgacaaattcttcaaacatccaaacggaaatatcattgaaggatttgggattgtacaagatatgcctgtctactttgaagactgggaggtgatcttggatttccacatctttgaaattcaagatttcgacatcctaatcgggctgcccattgtgcaacttctcattaacacacctcgattagaaatcctcaaaataacattgggagggaatgaattttcagttccattctcatgagcaaggatcgccttgaccgattccctcccagaaattgagtctgtggaggaggttattgcagttctccctcatgagtctctcgaggcccttctggaagatgaggtcctcgatttcatcaaagagtaagcggatcccggtgagactctcgacctgccaatcatggaaccgctacctcgacctccgcttaagcttaaacctctacctccaggcctacaatatgctttcctacacaatgacagagaagctcctgtcataatcagtgacaagctctatgaagacgagactcaatgtcttctcaccatgttgggaaagcacggttctgttcttggctactcgcttcaagacctcagggggattaatcccgcgcttagcacccatcgtattcttattgaccccgagagtactccttctagggaacctcaatgacggctcaataatgcaatgcgagaggttgtaaagaaagagttcttgaaactcctgcatgctgggattatctatcccgtaccatacagcgagtgggttagcccagtccaggttgtgcgaaagaagggaggaatgatggtcattgcaaatgctcaaaatgaactaatcctgcaacaaatcgtaaccggatggaggatgtgcatcgattacaggaaacttaacaaggctacaaaaaaggatcatttcccgctacccttcattgatgaaatgttggaacggctggcaaatcattcctttttctgtttccttgatgggtattctaggtatcatcaaattcctatccatccggaggaccaaagtaagactacgttcacatgtccgtatggcacctatgcataccgtaggatgtccttcggactgtgcaacactcctgcatctttccaaagatgtatgatgtctattttctcggacatgatcaaggacattatggaagtcttcatggaagattttttggtctatggaaagaccttcggtcattgtctacaaaatttagacaaagtcttacaacaatgccaagagaaggacctggtacttaattgggaaaagtgccatttcatggtccatgaagggatagttcttggccatcgagtgtccgaacgagaaatcgaagttgatcatgctaaaatcgatgttatagatcagcttcctcctcctgtgaacatcaaaggaatccgcagcttcttgggacatgccggcttttatagaaggttcatcaaggacttttctacaatcgccggacctctgaccaatttgctagccaaggatgcgccctttgagttcgatgacgcatgcctagaatcttttgaaattctcaaaaaggcacttgtctccactccaatcattcaacctcctgattggactctgcccttcgagatcatgtgtgatgcaagcaattttgctgttggtgcggtcttgggccaaaccaaggataaaaagcatcatgcaatctgctatgctaacaaaactctgactggagctcagttaaattatgcaactaccaaaaaagagctgctcgcggttgtttttgctatcgataagtttagatcttacttactgggagccaaggagataatctatactgatcatgttgctttgaagtacctactcactaagaaagatgctaaaccacgtctcttcagatggattttgttgctccaacaattttacttagaaattaaagataaaaagggagtagaaaattctgtagcagatcatttgtccaggctgcggatcactgacacgcaggaacaaccgataaacgacttcttgagagacgacatgctgatgacggttcgtgactccaacccgtggtatgccaacatagtaaactacatggtatccaagtacataccaccaggggaaaatcaacaaaaactaaagtatgaaagtcgccgtcatatatgggatgagccatacctatatcgggtctgctccgatggcttactacgaagatgtgtgccaactgatgaaggacttaagatcatagagtgatgccatgcctcaccctatggtagccattacggtgcattccgcacccaggccaagatttggcaaagtggtttcttctggccaacaatgtacgaagactcaaaagaattccccagaagatgcacaagctgctagaggcaaggaggaatcactgctcgcaatgcaatgcccctcacatacaatttgcaagtcgagatatccgatgtttggggtatagactttatgggaccctttcctaagtctcgcaactgcgagtacattctggtggcagttgactatgtctccaagtgggttgaggctatgccgtgcagcgccgcggatgcgaggcatgccaagaacatgttcatagaaatcatcttcccaagatttggtaccccagaatggtcataagtgacggaggttctcacttcattgacaaaaccttccgagacctcctacgagagatgggagccaaacacaatgtccttaccatccgcagaccagtggtcaagcagaaacatcgaacaaacatattaagaatattctacagaagacggtcaacaaaatgggaacaagatggaaggatagattgctggatgcactgtgggcataccggacaacatacaagacacccattggaatgtccccatatcagatagtctacgggaagtcatgtcgactacctgtggaacttgagcacagagcatactgtgccatcagaaactggaatatggactttgaaggagcaggagaatggagaaaaatgcaaattgctgaacttgaagaatggagagagaaggcctaccataacgcaaagatatacaaagaaaggacgaagcgctggcatgacaaaaggataaaaatcaagaaattcaaccaggagacaaagtgctaatgttcaactacagggttaagcttttcggtcacggaaaattgtgtagtaaatgggaacgaccgttcaacgtcatcgatacctctttgcacggggcaatcacactccgcgacaattcaggtaatatattcaaggtaaacagtcaacgcttaaagattttccttgagccaaatgaaactttagatgaagaagtggatgtcattgaattaattgattatgaactatgatgatttcatctaatgcatgcttaaaaccctgtatagttgtcatttttgtgcttagattaggttttaatgagcctagggaaaaattggcagctagctggacccactagggttcgtccgaacctgctggttcggctgaaccagggcggcgcccgatcagccccaattttgaacctcagtctcccccgctcatctatagtctgttgtgatgcgcattcgggggtagatcagtcgtatcagacccagaaccctgtccttcctcctctctcccacttttgcaaacctcctcttcttctcatctcaattccattgcttcatcaccctcaattcaccagtggctggcaaatctttgatcccattcatcggctcttcctccaactccacatacaaccttgacggagagccgacaccggtgaatcaattgatcctggtggagcattacacgatggaaggggtgaatgcactgtgggcacaaccccttgcaacagtgccaggctcccctgcgattctggagctgatcggcaagctccctggttcggccgaacccttctcggccccgttcggccccccgttcggtagtgcgatccctctcccctcgccatgtcacaaggacaaaaattcggggggattcgcttgcgcgacggccgacaacgggagaactcgtcttgttgaaggcgcgacgccttttccaaaatgatgagaaggccgctccacctcccgccgagcgctatgtaggcaccctgttcaccaaggcaggggatgaggtgttccataagtatgttacacccaccgctactccatccactccgaaggaggagcgtttccacattcaaggagtgcgaactcctggtggcgggtatggcaagggtttactccggccgttaacagcatcagagaaggagggggcagcggaatcccatagccctccacctatgaaggtgaagcataatttgacaccccctccaattgtgagggctcctggccaatatcaagaagatgaggtgaagtcgccggaaccctcgatccataagctcgccgcacaagtgaagaaactccgcaaggagaacatagagcttagggatcgcaacacggagctaggggtagagcttgctgaatttagaattaatttcaatagccttagtcgcggtttgtgcgctgagatcaagcgcgcattcgtagaaatgggaaaggaaaataagtattacgctaattagatgcttcctttccatgaataacatagtagtaggtgcttggttttatttttccaatcatttaagcacttgctacgaataatgtggctcattggtgttaaccccaatgtttgccaaaatttgttttgtttcatgtttaataaaatttaggttttgaataagtgtgggggagatatctcagcttcttacgtgcacataatctgaaaattacttaatgtctgaacacctggaaggcactgaactctgcagaaaattgcagaggtattgggcaccagagtggttcggccgaaccaccaggttcggccggaccagtgttggccgtagtacctcccagttttcacaagtaagcaggtgagcacgtcttttatctgtatatctccaccatgatatagtactagagctaaaaatttagaaaacaattggttcaagcatatgtgaaagataaaatttccaactaatgaaattcttcatgtgattaaacttgtatattcatcattctcagctgaacttgtgcttgtgaaccaccatccatgtttagcgaaccttatgcatctaagtaattgctttatgtgagatgattcaagatgaagggaatccttgcaactcttgttatgactcttgggaatttgttttcaaaaataaaatggtttaaaagctcaatcctccaattgacttcatcttatacctaccaaggtgtcacaccctgaaaattcaaaatatataaattgttgcttaattggaatttttagaaatgattttaaaaaaaccctagaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggttttttaaaatcctcttttggctttgggccgaaagtcggcccaaaacccttttctccctccccggcccaagtcggcccagaccgcagccgccgagcgcgcgcgttcggtcgctgacaggtggggcgcacctgtcggacccatcgtctacctccggccgccgccgcccgaaaccctagccgagccgcgccgccgtccccttcaaaatccggctgctcctttccttctccggtgaaatcttttgaggggaaacaatctccgggatctcctccaccttttctcttttggaatcatcggcttaatcgttttggaagttcgtcgattcgaggtcgaatcggatcggtctctttcctccgaaccccgaggtttccttcgcgtcgccggttgccgtgggccttcgccgccgcctcctagcccctttaaaaggatccccaagctcttctctacccgtcgccactctcgccttcgcctctcgtcgtccgtagcgccctagcgtcgtgtaagctagcgccgccgtcgtcgccgccgctccagccgtgcgccgccgtcactcctgttgtcgccgtcgctcggggaggtcgccttcgtggtcgccgtcgcatcgccgtcctcgtccgccccttcgccgtcgctgaagaccgccggagcaccgtcgccgtcgtcgagccgaaggtctccgccgtttcaacctcgtcgccgtcgccgtccgctgctcctccgccgttgctttggtcaccggtgagttcgccgcgtcgcccgcttcgtgctggtgtcctccgttcgcgccgcagcgccgtcgttcgccggcgagcatgcgcgcccgagccgcccgagccgccaccggtgatgacgtcaccgctgacgtcatcgggactgtccgccgtgagccggccgtggaccggttgatctcagccgtccgttttggatggatcaatctcggccgttcgtttccgtgtgccgccaccgtgcgcccggtccaccgcaaaccctagccgctgacgcaataaatcccttttttcttttcaaaaataattcattattgcgtcataattcaattaaaatcaatataagtgttttaatccgattaaatcttcaaaaattcataactaattcatcttagctcggatttagttggttcaagtctctaaatttttctaaaattgagatctacatgttaaaaatatccacatgtactgttcatgcttgtttatgtgctgttttggtgattttgctctttcctgcttagattctgacgtttccggagagtccgttttcgcaggagaagattttgaagagttctaaggccagcaaggcaagtcacacagatcccaaacaaccctttgagcatattgatcccgtttaaagctattgtttcttttcaactattgcatttattttcaaatgtcattgggtggaattaacctattgtttgttatagcccttttgttctggattactttattccttgatatcttgggttattataacttgactagttgagctctatatgttggttcaactagatgtattagatataattgcttagccctgcttagaaactttagcacactattgggataactttatgactcactattatttaatgatggcttattgatagttcacgatggtcagtcgtgattggttaattaattaatgtgccaactaaaacttgataatggtgggttgtgagcacatggttttgagagtcgtgctcatgacaattaaggaccggttcacgagtttcggttgtgaaacattaaccatgccaaccacaagccaacatgggcaacggctttatcttttgtatagcatggttcattgcggggcaccagactgagaagtggcagagataagcccacgggggtcactggggagtccatgccttgtttataagggggtgattatgatccaggaaaggtgcactgtagtggattgtgttgtgcaaggggtattgtcacaactcctttccgaggtaccgtggtggtattgaggcacatggtgacatgatgtggagttgtgtcttgtgggtacagtggtacacctctgatcagagtaaaactattcgaatagccgtgcccgcggttatgggcgggtctaacaatgtctttcgtgattagtctcacacttctcaccataataaatgatgctttaattgataataatttgattagctcctggtttggaatggtatattcctggtttggagatagatctgtacagccgggtatggttgttcagaatggttgggcctatacaacagggtatgttgtatagcgttggattaatattgtttaattattacttaacagtttcattaaattctgaaatgtttattaaatgctgtttatgcaaataaaaccctactatgccatcctttgttatcctgtgcacttgcatgtttgctgcgtggcttgctgagtatgtcatatactcaccttgcaatcattcatcagaggaagagttctacaatgatgctgatggtgtggaggattaggtgtagccctggtcaagctgcctgtggagtggagtcgtctgcgccgtttatcttattttccgctgcttagatctttattgattgagaggaactatatacctctgtaatgatattttattcgcttattaattagaataataattgtactctattatcaatttgttattgtgtgcctcggctgattcctggacgagggattcacacacatgtaagcgtttggaattttggatagaaattccgggcgtgacaagttggtgtcagagcccccttgaccctaggttatgccaaatggttacccatagaagccctctaaaaattattggaaaagtagaactgttctcctccccttctcttttaattaaaccaaactaatggcacatgcacttcataatctcttttaatggttctcattcaaaatctattccagtgttattagtactgtacatctattactgtactaatggctcattttaccagcaaaagttttacaatattgttttatttaatcttgatgcaaggaaataaatttagcatgttatttaatcttttggaacctgttgttcaaaagtacaaaatttgtaaccctgtttccaactgtttcaacttatcttgcaagcttggtttattttatttacttaccttttactttgattttctaactttattcaaattaatccaaaaacttgtgctattaattggataaatgtcttaactccctcctttcacttgtctttagatgccgcgctacaagcctgagtacttgtttggtgttgagggatttgtccaggagttgcgtacgatgtcctttgccataggatttgggactgctcctttttatgctcagattcctcatgatcgtcatgaagagaagtgccgagtcaaagtcaccttgaacagtaatagtgaagatgtcccctcagtgatgttcgaagctagaggaagaaactacaccatgcatgtcaggaggtggcaaggatcgccataggagagctccgcgatcgctatagtgatcagttggccgacactgagtatcgctaccatcctcgccaaccccagggaagtgaccgtggcagctacctagagactgaaggaattgagaatgatgctaccacaaggcatttggttgagatgctgtgggctgtggatgaaacccgtgcggagactgtattagcagctcaagatcgtgaagaccggaatcgtggaaagatttgcaagctagaggacaaggtggatcgtttggagaaggaattagccgcattgaagggagaagcaccaccgcagaaggccaggattcgtcttaccgcaaggaagagagctctttttgtccctcgctaccaattggcgccaaaggtccgtgtggtggaaaaagaagttaccccagttctagtagatcctccggtcatcaacgtaagtgatgatgaaggagaagaatcgaagcacactcattccaagattgagtggagagcaactcaagatgatgaagacgagccgaacgagccttcaatcaactccgatgcccggaagaactagaatgccatgtcaagccgttgtcttagatcgttgtgttagcttgtttgtttaagtttggttgtgtgggtcttgcgtgtaatttacatcagtggtgggatgtaagtgcatgcgtttgtttgcttctgagtgttaggaagttggtgagtttagtggtgtgagagtcttcagttttgtaataatgaaactcacttaagatcaataaaagttaaagtaattctctgtcctaagtagttttccccggtttctcttcttgtgtcctgcccatgccagatggtgctcactcacagcaatgggaatggcccccaacaacaataacaacaacaacaacaatggagagaatcccacacttgcccaagtcctggctcaacagacacaacttatgaacatgatgatgcagcaactccagaaccagcagaaccaggggaataaccatgcacctccccagaacaagttagcagaatttcttcgtgtgaggccgcctattttctctagtaccactaatcctgttgaagctggtgattggctgcatgccatagagaagaagttggatttgcttcagtgcaccgatcaggagaaggtctcatttgcatcacaccagttgcatggccctgcctctgaatggtgggatcactttcgccttaacaggactattgctgaacctatcacttggcttgaattcaccgctgctttccggaagacgcatatagcatcgggagttgtgtctctcaagaagaaggaattcaggtcgctcactcaggggtctcgctctgttacggagtatctgcacgagttcaatcgtctggctcgttatgctccggaagatgtgcgcaatgatgaagagcgctaggagaagttcttggaaggacttaatgatgagctttcttactcactcatgactggggattatcttgatttccagaagttagtggataaggctattcgtcaggaggacaagtacaatcgcatggaacagaagaaacgccggattgctcaattcaagacacaacaggggaataatcaaagaccgcgtcttactttaggaccccaatccatgccacagggaggttcttcgtctgttgttcgtccgcagcgtcagttcttcaacaacaatgctggcaacaacatccgtaatcaagctccacgccctgttgcagcttcgacacagcaacaacctgccaagaaggagcaaggcagcaagcccgtggtgtgtttcaactgtggagacccaggacattacgctgacaagtgtccgaagccccgacgcgtgaaggttgtccctgcccagagcaactctaccgcaccagcgccaaaggcccgtgtcaatcatgttgctgctgcagaagctcaaggtgctccagatgtgattttgggtacgttccttgttaacttagttcctgcaacagtgcttttcgattctggtgctacacattcattcttatctatgagttttgcgggaaatcatgggatggaagtagaagatcttagacgtcctttgatggttagtaccccaagtaatcaagcactctctttgcaacgtagcccctctgtcagaatagaaattaaaggagtaccatttctggccaatcttatcctgttagaatccaaagaccttgatgtcatcctagggatggactggttagccagacataaaggtgtgatagactgtgccaatagaaaagtaactctcaccagcaatgatggtcgagttgtaactgttcatgcattgtcttctgagtttttaaggtcgagactgaaccaaataactttggaagagattcctatagtccgggagtatcccgatgtgttcccagatgatttacctggtatgccgcctaaaagggatatagagttcagaatagatttggtaccaggaacaactccgatccataagagaccttatagaatggcagccaatgagttggcagaagtcaagaggcaagtagacgatttgcttcagaaaggatacatcagaccgagttcatctccatggggagctccagttatttttgtggaaaagaaagatcatacccagaggatgtgtgtggactatcgtgcactaaatgatgtgactatcaagaataagtatccgttgcccagaattgatgatttgtttgatcagcttaaaggtgccaccgttttctccaagatagatcttcgatcaggatatcaccagttgagaatcaaagaggaagatatacctaagacagcttttaccactaggtatgggttgttcgaatgtactgttatgtcttttggactcaccaatgcccctgctttcttcatgaacttgatgaataaggtgtttatggaatacctagacaagttcgtggtggtctttattgatgatattcttatctactcccgaaccaaagaagagcatgaagaacatcttcgccttgcactagagaagctacgaggacatcaactgtatgctaagtttagcaagtgtgaattttggttgtctgaagtgaagtttcttggtcacgtcatctcagccggaggagttgccgttgatcccagtaatgtggaatccgtaaccaactggaaacaaccaaagacagtttcagagatccgcagtttcctaggcctcacaggttattatcggaggtttatagagaatttttccaagattgctaagcccatgacacggttgcttcagaaagatgtgaagtacaagtggtcagaagaatgtgagcagagttttcaagagttgaagaatcgcttgatatcagctcctattttgattttacctgatccaaagaagggtttctaagtgtactgcgatgcatccaaacttgggttaggttgtgttctgatgcaagatgggaaggtggttgcctatgcatctcgtcagttacgtccgcatgagaagaactaccctactcatgatcttgagttagctgcagtggttcatgcgttgaagatttggcgtcattatcttttcggtactcgtacagaggtatataccgatcacaagagtttaaagtatatctttactcagccggatctgaacatgagacaacggagatggttggaattaattaaggattatgacatgggaattcattatcatccgggaaaggctaatgttgtagcagacgctcttagtaggaaaggctattgcaaagctacggaaggatgacagttgccattggaattatgccaggaagttgaaagattgaatttgggaattgtccgaaggggtttcgttgcagccttagaagcgaagcccactctaattgatcaagttagagaagcccaaattaatgatcctgatattcaagaaatcaagaagaatatgagaggaggaaaagctattggtttcttggaagatgagcaaggaactgtatggttgggtgagagaatctgcgtccccgacaacaaagatttaaaagatgcaattctgaaagaagctcatgatactttatactccattcaccctggtagtaccaaaatgtaccaggatctcaaggaaagattttggtgggcaagta

SEQ ID NO: 72984 - DNA, 2000 bp, Oryza sativa
tgataaaaaataaatatatatatatatttttgacaactttacaaaaagtaacatggtttaaaatgaaattaatctgaaccacccttcgatcttcgggggtactctcctcatcacataagatagcaacgtcgaactacgaatcttcttagtcccatccgggacggagggagtagtgcgcagtactgttaaacgccgttaaaagcttccagctctgaacaacagatatgataactgacgcggcgattacttgtgccactcctttcccctacatccactacacgtacgtacgtatacatggacacgtggcccgtctccaacccggtcggcccccgcctcgtccaaccaaaaaccgcgcacctgggaagggtccccccacgcatcacgcagccaagtgccagccgcccactctgccaccaccatccacccacgatctctctctcctctatatctcacgcggtctgcacggtcacactcactctcggtctcactccctggagctggagcgtattaaaacccttctccgtccattcgatcctgccacttcctttctctcgccacgatctcctccatctctctctctcttcctcctcgccggccgagtcagctatctcgccgccgcctgagtacgtacgtccgtctcggtatggccatggccagtggcggcaccgtctgctccatgtgcggcgacgtggggttcccggacaagctcttccgctgcgcccgctgccgccgccgcttccagcactcgtacgcactcctccgtatttgcctcgttaatttctacctctctccctattgattcctggcgtctaggtaggtacatagtgatcagaactgacgcgtcgtggcaacggatgcatgcatgcagctactgcaccaactactacggcgacggggcaccggtggaggcgggcgccggcgtgtgcgactggtgcctcagcgacgccgccgtcgtcgccgggaagaaggggccatcgtcggaagggaacgaggagccgttctccagggagtaccgtggcaggagcaagcaggcggcgtcgaccggcggaggcgagcaggagggcggcggcggcggcggccggagggtctccaaggccggcgctgtccgtaggtacaagcttctcaaggacgtcttgtgctaaagagctatggtctaatacggaccatagctgatggatcaatccttcattttcactgcgtcaccccgtcatgtacaaaactagctctagctagtaggtgcccatcgctaggtaattagatcatccctgtgtaaattgtccccgtgttaattaaccgcgcgtgtgtgtatgaatgtatgatactactccatcctagctaattaaagctatatgtatgttttcatagacatgtcatgtttgacgagaagtatcaacttgacaactagtgaaaggaggagctagcctaggtcttgtatgcgtgacattcaccaactaattgtcgtcaaaccctacttgcaatacgtgcggtgcttcccgtcattcattatcgatcgtcatcggatcgaggaaacgagctagactgtcctcaactcgatcgatcggttgatgtttacgctccaaatcgcgatcagtctccatccacatcgatcgtcttcaaacgatcgcgaaacacgaaccatacacatcagtactagtacttaattaagacttcaataattaagcactattacacgtctgcttgattattagtttcatgcatgaaagacgacgatccatcatccatcccttcctctggcacttgcgatatgtacgtggtactcggtagttgatcggtacgtactaatccagaagaagactctagaaggcgatcgcgttgcatgctcggcaccctcgccttttttttcttctcctcggcggcgtgccgatgcagaggaatcaaatcaacaactcgtacaagtacggagtatgctgcaaaatattaaaggactccaaagtggccgacaaacaccatgttatattccccccacttgtgggttagcc

SEQ ID NO: 72985 - DNA, 1925 bp, Oryza sativa
ttataaaaatcccatgagtctgacagagaagcaagaaggactgaaatcgagatcattccatttatcaattactcaagatggtaagatagccactgataaagttcacaggtgcaggtatggttttgaatgatttatatgcttgatttatatcttgaagaaattcattctacactaacctttactcagggacgagcaaagggctaagtgtgggggtttttcttggcggctgttaaatgttgattctataccgccaacatctgcataaaattcagataataaaacattcaacatagtgataggtgcttaatctcacatattctacaagtgttggtgtatatttgtatgaagatgataaaccctaagttggaaggaaaatcggactaaagtgaggagaattatgtatccatacaaaggagaggttgtgaacttcatcgaaacatcagtaaatcaacccaaaaattcgagaaagagacagaggaaggtcctaggagtctaccgaccgaaggccaggccaggagggcccagcctaggttcggccgaaccctggtgatcaccgttgatcccaggttttggcatgggcggtcttgatcatctcgtgatggtggttgcggagcatttccgacaattcgcatagtacaaccgtaatacctacctctatataaaggcttcactctctcacttcacacacacacttccaagtttgagctgaattataagaggctctattgtactatattgtataatggaataggaagagagtagagtagaagaagtcgggagaattccagagttgtcggtaatcttctcctacttcttttattctgtttattactatgaattcaatgttatattcttcttgagtaattttgatttattttgtgagaattatctcttggttagttcctaagtagcatacggtattattgttcacaataatcaactaaaatgtttattactctgaattcaacgtaatattcttcttgagtaattttgatttattttgcgagaattatctcttggttagttcctaagtagcatacggtattattgttcacaataatcaactaaaatatagtgattgctttggtgagttataaacactaaagtagatattaattgcttagacgtggtgtttaggtaattattatccagtaattgttgcatatcccacagtacgtttgaggttggtgtagaggtggtaacagccctcgagatcacttaagtcctccctgtccgggtacgtagtagagcgacatctgggaacagcgggttgccagtgcctgaagtattgcgttaggattaaatataaactttccctagacactgtttctcactagtaaatcctctctatcctggcctatcatttgcttggtgaccttggatgaaccagaggaagatctgaccacacacattcccttggattcgataccctttgaattctccgtaggggaagtgctacatcggtatatccgtgcttgcggattttatctgtgatcgtaagaaataccaacacttgctgagtattgtgaatactcatccttgctcaatttcacccttttttagatctgggtcaagaggaggacccttatgactactactatgatgacttcgataatttagaaaaccctcagagtttgttccttcctagtcaaactttattagacttccgctgtataatagtaaccctatgtataattagttagacaatcagctttgtaaatcccaagtattgtaaactttacctatgcaatgaagaaccagctgtattatatgtatgaattatttactaatccagggcttgatacattaatcatggtcggatccaagtcattagttttgggacccgacagaactggtatcagagcatatgtttgactataggatgaaccttaaggatttctaacaaagttaagtttgaatttatt

SEQ ID NO: 72986 - DNA, 1628 bp, Oryza sativa
tcaatgataatatctattatattattaagacagctcgaaaagaagacaccacgttcaccgtggaggctagaaattcccacgttaatcgaagaaaatataattatttacaccgttggattgtaagaggcatagatttcaatgtctgagatttaagacaaacttggcatgttaattaagagatacggagtaccgtacgcgtgtagaattagaatcaatctctagctaggacctttacatgcaaacggactcaaaagagttttgtccgatttcctaaaccaattaaccagagttagagatgaattaggctataatacacatatataaataaagcagcgggcaacgaaccactatagaacagtaatttggatgcgtttttgttgatatgaagatagatgctagcagcgagcgacggaaatccgaagcagcgggtcaagccgtgcggctgcacagtgagccgtatttgggtgatgcacacgtcagcaaccagaatagcatgatggcatgtgcacggatttttatttgattttgaaataacacaataaaaaatgaaagaagagttcatgtagaacacaattaaagattaattgaaatccataataaaaaataaaatagatttagaaactagaaaaatcaaatataagagttcaataagagttcaagtaaaaatacattttacgaacaactgaaattaggaataaaaaataagaaatattagaagaataattcatatagacatagtatgagattaataaaaaaatatgagattaataaggaatattaaaagaagagtgcatataagaactcaatatgagattaataaaaatttggaataaaaataaataaatccgaaattagcaaaagaaaataaaagaagagttcaagtaggaatataatttaaaattagctgaaattcggaattaaaaataagcaatatttaaagaagaatccatataagaacccaatacgagattaattaaaatttaggataaaaaataaaataatatccaaaattagaaaatttaaaagagagttcaagtaggaatacaattttgaaacaactgaaattgaaaataaaaaataaaaacattaaaagaacacaatacggtaataactaatttttttaaaaaaaaattctgaaattagaaaaagaaaaataagatttcaattaggaatacaatttataaataactaaaatttttgataaaaataaatattattgaaataaaagaccatctaaaacacatgacgagataaattaagtaacatgcatataaaagagtagagtggtggcggttgatacgacatataaaaattattaataaaacaccaaatagaatcctaatgacaattaaaaggagggacgtcaggcaggccatgaagcaaacgagtaaggcggttaccgggacttctagaaagtaaaaaaaaacaaaccccattgataatcatattcgatttttaaatctcaaagacaataaaaaggagaagcagcgggcggggtacataagagtatagttgcagagccgccgacggctgacaggacttctagaaaataaaaaatgaattccaacgatattgatgttcgatttttagaatcacaatgacaataaacagtagacggcaaacgggct

SEQ ID NO: 72987 - DNA, 1387 bp, Oryza sativa
aggtgatgagaatattcccaaagtctagagttgtaaaaccacctaatgttgcccaattaagcggcgaagcatctacctaaaatcatactagtggtaccatgagtagagtgtccactagttggggttttgtttaatctagggtgaacaaggtaataatatcaataacaataataataaggtcataacaaaggtaaataggcatggctaaataaaacagtgataacgcgggaatttaagtaaagcgataatgcaataatttaaatcaacataattttataaactgggattcaatatgttcaaggatgatgtgacttgccatgctcgctttcccaaacgtcggcttcaacttccacaaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaacggtccaattctgagttcaaatggccaagttatggccatttgaagtttatatgctctttaaataaatatttgcgaatttcttcttttaaaatttaattttaaaagggtttattgcgtcagccgaggggagggggcgcgcggaccgggtccacgggagtggggcccacgcggcagcctcacggtccacggtggaccgggtgcactcgggctcacaccggccagcgccgtaggtcccacgcgtcagccgcacccgaaggcgcgggcggctgacggctgggccccacgcggcagccgctcggtgcgcccgaaggcggccacgtcggcgcggccggcgggaggcggcgcgcccgcgcccctatggtcgccagcggcggccatgggcacaacggagcggcggccgagagaggggagcgaaagggggaaacgaggcggcggttcacggctcaccctaggtcgacggcgacgacgaaaaggcagccggagcggaggaaggcggcagcacggctcgggtcgacggggacggcggcgctccggcggtcgacgagcgaaacggaggggtggacgaggtcggcgaggatgcggcgaagccgaaggaggcggcgccgaggtgggaggtggtctggggcgatgacggcggcagaccggagctcggcggcgacggcggagagagagagcgacggcgcgagctcgattccggcgagaggcggaaacggacggaggaggtgcgaggagggtttaaatagggtggaagggggagaaatcggccggcagggaaagaataagcgcgggaggtccggccgccaacaatggcgccggcgagatttgcgggagcaaaaccgcccgtttgaacgcgagagagaaagggaaaaatggggggaaagggagagggga

SEQ ID NO: 72988 - DNA, 1411 bp, Oryza sativa
aagatttcaattaggaatacaatttataaataactaaaatttgtgataaaaataaagactattgaaagaaaaaaccatctaaaacacatgacgagataaattaagtaacatgcctataaaggagtagagtggtggcggttgatacgacatataaaaattgttaataaaacatgaaatagaatcctaatgacgattaaaaggagggatgtcaggcaagccgtgaagcaaacaagtaagacggttgccgggacttttataagtaaaaaaattaaaccccattgataatcatttcaatttttaaaatctcaatgacaataaaaaggagaagcagcgtgtggggtgtataagagtatagttgcagagccatcgacggttgacgagacttctagaaaataaaaaatgaattccaatgatagttatgtttaatttttagaatcacaatgacaataaagagtaggtggcggatgggatgttgaggtgcgtagtggcatcgtttgataggacttataaaaattataaaaaataatgaaactacaagtccaatttttaaaggttcgtaacttctaaaaggtaaaaaaaatgataatcatgttcaatttaaaaatctcaatgacaataaagaaggaaggcagcgggcgagctatagaggagtacaatggtaaagccatagacggtttggcgggacttttagaaagtaaaattgaacctagacaataattatgttcgatttttaaaatctcaatgacaataaagagaagagacattagacgggccgtagatgagtataatggcaacgtttgacgggacatctaaaaattataaaaataaaacccaacatgacaataaactctagaaactataaaatctaatttttaaaggttccaagaagaataaaaagaaatagtggtatatcgagcaagcaaataaagaacgagatgacataaggggtagcaactggtgtgacttttaaaaactagaaatacgaggatgataagggttggtctttcaaagtcttaagacaataagatagctatctaataaattttaagtaaaatcatataaaaaatatgtgatttttttaggtgctagccgcgcaattgtgcaggccatccagctagttcgtttcattttacaagtcgctttggaaaaaatatagtaacattaatttttcaacacaaaacaaatatattattataatgtattcattattagttttaataaaactaatttgatgttatagatgttattatttttttataaatttgatcaaacttaaataagtttgtttagtaaaaaaatatcaaaacacgacttatatatgaaacgaagagagcattagttagtgggcgtgtacttcaagacttcaagtcaacccttgtcaatgctaaactgggatcaaactcaggaagtt

SEQ ID NO: 72989 - DNA, 750 bp, Oryza sativa
tacagtagctcatcatcttagaagtagcttccatcgtgaatgcccttatgcagttttcccgtccaatttctacactgaggtagtatatatagtaggggcaatttgcagggaaaatgatggaagacattgactagaaataaaacagattgttcttttttttttccatcaatagatgaatcacaaaagttggcatggtatgaaaaagtagagaaaaattaagcctctcattgtatgcttctcttatttgccgaatccaaaatttaaattttaaaacttaattttagagttatttataagtttctttgttcatactggcttttaaattgtgaattatttttgttagtttgttaattttttaaggacttatcaacccgtaactcagaccaatcaaaacctaataagtaatccgaaatctcttcaagtttactccttcgggagtccaataagaccggcatgcatcaacatgctactcatcggtcgcacctcgcagtagcgcaactgaaacggctgcctcctgtacgtgcatgcagatgcagccgcatgtcgtctttggccgtttttgcaggtgacgcagcggatcggcagaagcaaatgctccaatcggaacgtactaatgcccctggcccagccgtcgtcgcaccagtgccgcacggcgaggcgaaccatacacaaacgggcagtaaatagttagtgggggtaatcatgtgagtttgtccgctgggatcgggtcatatggtgacccacgaccag

SEQ ID NO: 72990 - DNA, 26052 bp, Oryza sativa
tatggacgcaacccatgtgtagtccccaaacaatccttgggagcatccttctcatacatgaaagtggtgctggtcactgataaagcatcctcctcaaagatatgtggacgacttaggtcatcatcatctagctccaaagctgcagcaaactgtgccatagaggtcttgtactgctgcccctgaatggtccacttcacaaaatgaagtcccttcctggtagtgccgaagaaagcgatggagtagaattgaccaattacttcctcattccaggaatactgcaaggccaacagatctgccacatgcttgtgcacacacaccttgcgcacctcattgaataccaagttgttctttgaggacatgtactgccagtcaagccacttcatctctaccactggatgagatcttcccatgatcactgaattataccaatcaacctgcaccaaggtcctgaatctgtcatcctgagagtcaacaggcaatgtgtcaggactgaccatcctatcctttgcacactttagcagattcttcagatagttcaccctctgacgcctaagggtaggatcaaacaacctcttctggaaaaagctcaaaggatggctctcagtcccaggctcattctcattttcatcaatatctgattcaaaggcaactggagaggaggaacggggagcatcacgaatgacaatgctagcagccctcctagtttgaatcggaatttgactcccactgtaaaaatctccaaccttttctttgcccaatcttctcctaggaccacaaaccggggggtctcatgtcagcgggaacatcctgtgaaagcttctggcgcttctctcgagcatactgaccactgcaacaagaatcaataagtttggagtgcaatggttaaggaaaaataggtggaatcaaaggttgcaggctggctggattgagaccggaagttccggactcatgaacaccggaacttccggcctgcaaaactgaagaacagtggattcaaacaggctagtgcatgtgataaaatcctatagatcggcaatctacaaggtagcaggaacaattctatccaaaaggttttctccctaggttcacatatttagagatcgaggcaaaaacatgatgaaccaaaagagaagatcaaaaaggctaccttgagtgaggaaatcgcaaatcgatcgcgggaagaacctcctagccaccaatgtggttgattccacggagaggaatcaaatttccacggttggaagtgaaaatcgccgagaggagcactgtagcggcggctagggtttgggaatcggggaggagaagaagtgaggagagaggtgatagtctcgggctccccctgggtatttatacccccgacccccggaagttccggactggggtgaccggaacttctggcctaacagaacagagggcagtcaggcctaagttcaaaggaatagatgagaattcaacgattagaaatggaaacctatggacaaatagagacttatgatgcatatgaccagccaacaatcaacaaaacataacaatggtcaatacacatcacaagaggggaataaaaaccaaatttttgcaagaaaaacacacacaagaaattttcgcaaaattttcacaaaagagtttttggatataaggggaatgtttgagctttattcctggtatcaagaccatcttctacccaagaagtgatctcaagacacaaaagctctctttttttttaatttacattttagtgatacatgtttggctatgaattagccaaccacccatcacctaatgttgcgagaatctaagatattgagctcactcctaagctcgcaaaatcttttctcatctaaaggcttggtgaaaatgtcggctaattggctttcggttctcacatgggtaaggcatatgtctcctttagtctcatgatctctcaagaagtgatggtgaatatctatgtgcttggttcttgagtgttgaacgagattgttaggtattttgatggcactctcattgtcacataggagtggaatcttggagaagttgtagccaaaatcttttagggtttgtttcatccaaaggagttgggcacaacaagaaccagcggcaacatattcggcttcggtggtggataaggcaatggaattttgcttcttagaggaccaagaaacaagggaaggaattgacaagtcccgattgtgctttttctatcaactttacaccctgcataatccgaatcagaatagccaaaaagctcaaagtcacaatccttaggataccacaagccaagattaggagtatgaactaaatatcttagaattctcttgacggcaatcaaatggcactctttaggctccgcttgaaaatgggcacacatacaaacactaagcatgatgtcgggacgagatgcacataagtaaagcaaagatcctatcatggaccgatataccttttggtccacacttttaccattatcgtcgaggtctaggtggccattagtaggtatgggcgtcttgataggtttggcatcctccatcccaaacttcttgagtatgtctttcacgtacttagtttgagagatgaagatgccctcttgtgcttgcttcacttgtagcccgaggaagaaggtcaactcgcccatcatagacatctcgaacctttaagtcatgatactactaaattcttcacaaaaagaggcattagtagaaccaaatattatatcatcgacataaatttggcatatgaataaatcactcttaaattttttagtgaagagagtagtatccgcctttccaatttcaaaaccattttttaaaagaaaatcttggagacattcataccaagctctaggggcttgtttgagcccgtagagcgccttgtggagcttgtacacatggtttggcaactttggatcctcgaaccctggtggttgctccacatagaccaactccgagataggtccattgagaaaggcactcttgacatccatttggaacaatctgaaattatggtgagcagcataggctaaaagaattcttattgactcaaggcgagcgacaggtgcgaaggtttcaccaaaatcaagaccctcaacttgggtgaacccttgcgcaactaaccgggctttgtttcttacaaccaccccatgttcttctttcttgttgcgaaaaatctacttggtgcccatgacgtccatacttggttgcgagtgaagttattcaactcctcttgcatacccatctcccaatccggatcaccaagcgcatcttccaccctggttggttccaaagaagagacaaacgagtagtattgacaaaaacttgtgacacgagagcgagtagttaccccttgtcttatgtcaccaagaatgttgtcgacgggatgatctctttggactatgtgatgtatccttggatggtgcactaaggggacatgagcctgatcagtatgctctaaagtgcccgcagcatcgatcccatccacttacgccgttggcacgtcttcactgtcactggtccggaggttccggactggataacccggaacttccgggcctggagatgtccggatgttccggtcaataggacccggaacttccggctctcaataggacccggaacttccggctcagcagacacagcacttgtagggctattggatgtcgatgacggaggttgatccctatcttcttgttcatcctacgtctcgacttgtcgtatgtctccaatagccttggtacctatagcttgacttggatccacatcacctacaacatgtacaacaacttgctctccttgggagccattagattcatcaaatgtcacatccctagtgacttcaacaataccagaggttttgttgaagacacgataggcatatgcatttgattcatagccaagtaagaatccctcatccaccttaggtgagaacttagatgagcgagacctcttactcaaaataaagcatttgctcccaaagacacgaaaatatgaaacattaggcttcttaccactcaagagctcatatgaagttttctttaggatcttgtggaggtaaaagcggttgatggcatgacatgcggtactcacggccttcgcccaaaagacatccgaagtcttgtactcatcaagcattgcccttgcggcttcaatgagggtttgattcttcctttcaacaatgccattttggggaggatcatagggggcggagaactcgtgcttgattccttcttcatcaagaaattcttcacttgagtgttcttgaattctccaccattgtcgcttcgcaccttcttgatagtaagatcatagaggttttgggcttgctttgcgaaacgcttgaagacatcttgagcttcgcttttgtcatggagaaagtacacccaagtgaagcgtgaaaaatcatcaacaatgacaaaaccatacttgttacctccaatgcttatgtaggccatgggcccaaataagtccatatgaagaagctcgagtggtcgtttgtagtcatgatgttcttgataggatgtggacttccaacttgcttcccggcttgacaagcactacacacacgatcgttctcaaaagaaacattagatagaccaaggatgtgttccccttttagaagagatgccaaattcctcattccaacatgggctagcctacggtgccatagccaacccatagaggatttagcaatcaagcatgcctccagattcactctatccacgtcgaaatcaatgagatagaggtcaccttttaacacacccttgaatgctatggatgagtcatctcacctaaaaacggttacatccacatcggtaaacaagcaattaaatcctaacttacacaattgagaaacggataataaattgtagcttaaagaattgacaaggaggacattagatagagattgattcttggaaatggcaatcttaccgagacccattacctttcccttaccatcatctctgtcgcgaccgagaaaaatacattttcccgaacgctagtgtattaatccccgtcccaggaaaagccggggtacaccacacaaacatgatataaaagacacatctttattatatcgataatatttacattattacaaaggcacttaaggcctgacaatcaaaaataaacagtagcggactagcgggcctacggctccatcttcacaggcgctcaactagggtataagccaggactccacctacgacatcttctccaaagcttctcttactgaagggggggaaagattgagcaagaatgagtacaaccaccgtactcagcaagccacaccggagatgcataattaatgcaagggagtacaaggggataataatataggggttaagttttgcagtaaacagcatttaaaagtcacttagttgcttaaagctactttgtaaacacggtcctagagctatacaatattattaatcaaggccgtgaacccacatgaacctgccttaacccaaggcctacgatgattcagaccgaactggcaacccgaccctgggtcccagctcgtcccaagccaacccaggccaaccattccacattttagttattacgcaggttttaagaatttaaaacactaacttgggtacattgctcggcttgcccataaccgagggcgcgactattcgaatagattatactctgatcagaggtgtacatctttacccacaagacacatcttcctcacgtgtggccacgtgccacataccaccacggtatacggacggaagacgtgacatagtttccaacccatcctagccatagacaagagtaccgacccaaccccacctacggccggaacccccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactcagccacaaactaagccttacccactagacatgtggaagtacggtagtgctttgcaacagaggcccgagcttaatccttatagtacccgaggtacgactaacaaaacccaaccacgcacctcgagcccagcctaaaaccattttgggggttttgaatagagggggaggtgtgtgtccaattccaacataagccaaccattccatagtgtccaaatgatatgagaattcccaaagtctaaagttataaaaccacctaatgttgcctaattaatcagcgaagcatctacctaaattcatactagtggaaccatgaatagagtacccactagttggggttttgtttatcctagggtgaacaagataataataacaatagcaataataataaggtcataacaaaggtaaataggcatggctaaataaaacagtgataacgcgggaatttaaataaagcgataatgcaataatttaaatcaacataattttataaactgggattcaatatgttcaaggatgatgtgacttgccttgctcagagagaacggccttccgaaccttcggcgacgaccacgaaccacgcttcgggaacctcaggaacgacagaagctacgtgaagcacacaagcaaagctacaagcctataaagaagcaataacaatgcataaaaagaaagcacagggttctttaggttataacaaacattaggagacttgaacgggtcgattcggagttcgtatgaccaagatatgatcatccgaagtttaatgctgttacatggagatttgcggattattataattaggttttgcaactataaaacatgtgtaagcgctagcctggaaaagataggaaggctgcgccgttgacatgcggaccccacatgtcaacctaaaggaccgcggtagaccgagtacacagagacggtccacgggtcgacagaagcagatcccgtgtgtcaaccgaggcgagtggccgacaaacggactccactagacaccacacgggctgcacacgtggaaaccacgcggctaccgagcgggcacactaacacggtcaccacacgcacaagcgaacgactaccgacaccggtacacgggtaccggggtcgacaaccgcacaacgggcacgggcgacaccgaaaggacgaggacggggcagcgagaggagagatccttaccaccacgcgacgaggcgagggaacgacaacgacgaacgggcgcggcggagacggacggcgagggaacgacttcagcggcgatccttggacgaaggcgagacgcggccgacacaaggcttgacgacgcggagccgaggacgaagacgacgacggggcggcagcgacacacttgacggacgcggacgacggacgagaacggcttgacggagggacgaacgccacgacgaccgggaacgacgagaggacgacgacaggaaccggcgaggaggcgatgagggcagccggcagcagctgcacagagacgaggacggcgcggaacacgccgctacgatgatgacgagggtggcggcgcagcgagacgacgagccggcgaggacgaacgaccgatcggaggagtcgtcaacgaggacgaacggagacgacgacgatggaccgcggaggggttcggtcgaaggggaggcgaggccgagggcgaccttgccgctgcgatgccggaggtggagacggcgacgtcggccggcgcactggcacggcgaaaggggctgccggagtgggtgccgacgagaccgagggagaggcggcgcgcgcgacggcgttccgacgaaatacgggcgacgccgtggcttggccggggaagaggatggcgttccggtgccgggagaggtggtggcgacgtcggccggcgcacaggggacgcggcagaggcggccggaagcggaacagtggcggcaacgccactgttgccggcggggatgcacttccggaggtcttcgcgggaaacagagggcaggccggcgaagaggaggcggctgcgacgctggaggaggcgacggcacggccggccggcgtgctaacgcggcggcaggggcggctgaagacggccggcggcacgggagagaggggacgacggcggggaggtggctagggaccacgggagatcgcgggagggggctaaaacgatagaacggagcgaggggattccgttttatagcggagggaagcgagccgagcacgggaggagcggggaacggcggcggaaatggcggccggcggccatggaaggcagccgaggaaggcgcgggcgttcccgacgattgggggcacgaatcaagggggaaattagggggaattgaagaggaaggaaaggggattaattcccccttatcaattttggaattcccggtttgaatcgcgtggatttaggggaggaatcgacgctaggtttcacgggagagagaagagagagagaggatgccgggcgggaggaaggagacgaccgggtgggtgggacccactggtcaggcgcgcgtcgtcagcgcgcgcacgtgcgcggcacgggcgggagggcgccggtcggcttgggccgggcggccggcccaggaggagaggagggggaggcggcctgggggagagagggaggaggagggagtgggccgaggggaaggagaggaggcccaagagaaggagggagaggaggagagggagaggaatagagggaggaagagaggactttggccgcaggccgagagagagagagggaggttttgggccagacttggcccaaagggaggagggggattatttttaggttttctttttaataaactttgataattgttgttgttgtttaataaatatttccggtgctctgaaaattcaagtaaaatttgagggctccttttagaccaaggagaatttaacaaaaattctccgaaccacattcgaatttttcttgtacgtattttagtgtttgccaatttcttttcgaattttaattaattctattattccttttagaaaatgatttttatttcgggatgaatttatcaggacgtgacaatctccaaagacaatattttcacgacttccaccttcctcatcaagacttgtaaacatactcctctctcccgtcatatgattggtgcagccactgtccacaacccaacttgaaccaccggaggagtacgcctacaaaaaaaatcaagcttgggatttaggaacccaaacttgtctaagtttgggtcccttgatgttagttaccaaagcctttggcacccacacacaagtgcggtactcatcattgtaattcccattaaaataagcaaccaccttgccctctgaatttttggaaattacatatgaatcatagtaaagaccctctggccggaacttcctggtattatacccggaacttctggtcatccccttcggcctatcagaagcccggaacttcctgtcaaaatgtccggaacttcctgtcttacagggcaggaacttccggtcattttgtctggaactttcggttgtctgaccaatgaaggaatgagtcacctcacttgcttgtggagctttaccttctctcacaaacatcaagaattctttcccatttaccatcacatggttagacacaggacttccatgtcgcgaccgagaaattttgcattttcccgaacgctagtgtattaattcccgtcccaggaaaagccggggtacaccaaacaaacatgatacaaaaggcacatctttattatatcgataatatttacattattacaaaggcacttcaagtctgacaataaaaaataaacagcagcggactagcgggcctacggctccatcatcacaggcgctcaactggggtataagctaggactccacctaagacttcttctccaaagcttctctattgaaggggggaaacattgagcaagaatgagtacaaccacagtactcagcaagccacaccagaagatgcatgattaatgcaagggggtacaaggggataataatagggattaagttttgcagtaaacaacatttaaaagacttttagttgctcagggccattttgtaaacacgatcctagaactacacaatgttattaaataaggccgtgaacccacacgaacctgccttaacccaaggcctacgatgattcagaccgaactggcaaccaaacccaggtcccagctcgtcccaagccaacccaggccaaccattccaaattttagttgttaagcaggttttaagaatttaaaacactaacttgggtacattgctaggcttgcccataaccgagggcgcggctattcgaatagatttactctgatcagaggtgtacatctttacccacaagacacatcttcctcacgtgtaaccacgtgccacataccaccacggcatacggacgaaagacgtgatatagttcccaacccatcctagccataaacaagagtaccgacccaaccccgcctacggccggaacccccgagacaggtaggcagtagggatgaaaacggagcggatagtttccgtccgctccggacaaaaacggatacggatacctttcggatcggataattctcggatagttcggatatggatacgaatacagatattttctcccggatatgaatacgaatatggtaccagggtttccgtcggatacggataataattcggatatccggtgaacagtgctattcggatatccgcaggacccatgagacataccccatttctttctaactctataaccttcaatatacctttatagattttaatagtagtttatctcttaacactagtccatactattaatattatttaaattttaaaaaatatttataaattataccttattttatataaaatgagctaattatatatgttgatatttgtttccattagaagttgagttggttttcgtgttccaagaaaaatttgtttccgtattcaggtccgatcatattcgattcttattcgtattcgagataatccgtatttgtttccgtattcgagctatccgtattcgttttcgtatccggtaaaaaatatgaaaacgaatatggtatgagcattatccgtccgtatccgctccgttttcatccctagtaggcaggattgagcccctagcagcaggacaccagccctgtgccatgacatctcgactaccgggccacagctcgtgtagccttcatttgtcctagagatgtccatcgacccccgacttcgtccatctccatccgtgtacctttgtttataaccagactgagccacaaactaagccttacccactagacatgtggaagtacggtagtgcttcgcaacagaggcccgagcttaatccttatattggccggggtgctacttcccacaactggcatgcacccaaaccccaccggaaaacaggttttaggggttttgaaagaggaagagaggtgtatgtccaattccaccataagccaaccattctatagtgtccaagtgatatgagaattcccaaagtctaaagttataaaaccacctaatgttgcctaattaatcagcagagcatctacctaagttcatactagtggaaccatgaatagagtacccactagttggggttttattttcctagggtgaacaaggtgataataacaatagcaataataataatagtcataacaaaggtaaataggcatggctaaataaaacagtgataacgtgggaatttaaataaagcgataatgcattaatttaaatcaaaataattttataaactgggattcaatatgctcaaggatgatgtgacttgctttgctcagagacaagggccttccgaaccttcggcgatgaccacgacccacgcttcaaaaacctccggaacgacagaagctacgcgaagcacacaagcaaagctacaagcctataaagaagtaataacaatacataaaaagaaagcacagggttctttaggttataacaaacattaggagacttgaacgggttgattcagagttcgtatgaccaagacatggtcatccgaagtttaatgctattatatggagatttgcggattattataattaggttttgcaactataaaacatgtgtaagcgctagcctagaaaagacaggaaggctgcgctgttgacatgcggaccccacatgtcaatctaagggaccacggcagaccgggtacacagagacggtccacggttcgacggaagcggaccccgtgtgtcaaccgaggcgagtggccgacaaacggactccactagacaccacgcgggctgcacacgtggaaaccacgtggctaccgagcgggcacactaacacggtcaccatacgcacacacgaacgactatcgacaccggtacacgggtaccagggtcgacaaccgcacaacgggcacggggtgacacaaaaagaacgaggacggggcagcgaaggagagatccttaccaccacgcgacgaggcgtgggaacgactacggcgaacgggtggcagagacgaacgggaacgacggagacgatggcgaggggacgacttcggcggcgatccttggacgatgacgagacgcggccggcacaaggcttgacgacgcggagccgaggacgaagacgacgacggggctgctgcacacttgacgaaacgcgggcggcgaacgcgaacggcttgacggagggacgaatgccacgacgaggaggaaggaggaagacgacgaccggcggggaggcaatgatggcagccggcagcagctgcatggaggcgaggacggcgtgggacacgccgcagcgatgcccacgacggtggtggcgcagcgtgtcgacgagccggcgaggaggaacgaccgaccggaggagtcgtcgaggaggacgaacggagacgacgataacgaacaccggcggggttcagatgaaggggaggcgaggccgagggcaaccttgatgctgcaatgtcgaaggaggagatggcgacgtcggccagcgcacgggcacggtggaaggggctgccggaggcgatgtcgactaggaggaaggagaggctggcgcggcggcggcggtctccggacgaagacgggcagcggtcggggtggagggtgacgccgtggagacggggaaggagacgacgatgacggctgccgcaccgatgaggaacagtagccggccggaggtgggaaggtactaaacaccgacaaggagaccgctccggcgagcttcgggcgaggaggaggtgaggccggagatgagggcagcgtcgcggatgtcgcgaccgagaaaattgcattttcccgaacgctagtgtattattccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaagactccacctaagacttcttctccaaagcttctcttactgaaggggggagaaagatagagcaagaatgagtacaaccacagtactcagcaagccacaccggcagatgcacgactaatgcaagggggtacaaggggtaatgatataggggttaagttatgcagaaaacagcatttaaaagtcacttagttgcccaaagccattttataaagacgatcctagagctacacagtattattaatcaaggctgtgaaccctcacgaacctgccttaacccaaggcctacgatgatccagaccgaactggcaacccgaccctgggtcccagctcgtcccaagccaacccaggccaaccattccacattttagttgttaagcaaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacctccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgagggttttgaatagagggggaggtgtgaatccaattccacaataatccatccattccatagtgtccaggtgatgagaatattcccaaagtctagagttgtaaaaccacctaatgttgcctaattaaccagcgaagcatctacctaaaatcatactagtggtaccatgagtagagtgtccactagttggggttttgtttaattctagggtgaacaaggtaataatatcaataacaataataataaggtcataacaaaggtaaataggcatggctaaataaaacagtgataacgcgggaatttaagtaaagcgataatgcaataatttaaatcaacataattttataaactgggattcaatatgttcaaggatgatgtgacttgccttgctcgctttcccaaacgtcagcttcaacttccacgaagagcggatcttccgaagctgcagcgtctacacgaccaacggaaaagaaacggcttttactctactaaactccatataacaagcagaaacaaagcacaaaaatgcgttcttgacttcttaaggaaaaattagagacttgaacggtccaattccgagttcaaatggccaagttatggccatttgaaggttatatgctctttaaatggatatttgcgaatttcttcatttaaaatttaatttaaaatcggatttattgcgtcagccgaggggaggaacgcgcggaccgggtccacgggagtggggcccacgcggcagcctcatggtccacggtggaccgggcgcacgcgggctcgcactggccggcgccgtgggtcccacacgtcagccgcacccgagggcgcgggcggctgacgcccgggccccacatggcaaccgctcggtgcgcccgaaggcggccacacaggcacttcggcggaagacggcagcggccataggcacggcgtatcggcggccgatagagaggagggaaagggggtaacgaagcggcggtccacggctccccccggtttgacggcgacatcggaatcgccgaccggaacgaagaaagccgccggctcggctcgggtgtacggggtcgccggtgctccggcggtcggcgaccgaaacggagaggtggacgaggtcggcgaggatgcggcgaagccgaaggagccggcgccgaggtgggaggtggtctggggcaacgacggcggcggaccggagctcagcggcgacggcggagagagagagcgacggcgcgagctcgattccggcgggaagaaaggccggcgagtggcgaaaacggtggtggggagctcggggagggtttaaatagggttggaagggggagagagcggccggcggggaaggaataggtgcgggagacccggccaccattaatggcgccggcgaggttaggggagaggtttccaaacgaatccgagggagagagggagggaaaaatggggggaaagggggaggggatcccggggaataattcccccactttattgcgcgcggggacggcgggaggcggcgggattcgcggcggcggcggcgctagggcgcgggcgaggcggcgggagcagcgggaggaagggaatgacgggtgggccccacccgtcagcgagggtggcgggcgggcccgcccgtcagcggcgcgcgcgcggggaggagaccggttgggccgcgggggagaggagggagggggaaggagatgggccgcgccggcccaagagggagagggagggaaaaagactttttagggtttttctttttataaactcattttaactttgtttatttcttaataattattatttgtgctctgaaaattccactaaaatttgagggctctttttagaccaaggagaatttaacaaaaattctccgggccacatttgaatttttcttgtacgtattttagtgtttgccaatttcttttcgaattttaattaattctattattccttttagagaatgatttttattttgggttgaatttatcaggacgtgacagcggagccgagggacgcgacggcacggccgaccgacgctcacgcgcgggcgcacaggcggctggaggcggccggcgcgggggaaagagaagggcgacgacagggaggggtgatacgaccacggggaggctcgggatgaggctaaaacgatagaacggaaggagggggttccattttataggcgcggggtgggagccggcaatgagagaggccggaacggaggcgggaatggcggccggcggccatggaaagcggccgggtttggcgcgtccgttcctggcgattgggggcacgattccagggggaaaatgggggaaatcaaagaggaatcaatggggattaattccccctatgtaatttggaaagagccggcttgaatggggtggatttggaggaggaacaacgctagggttcacgggagagagaggaaggaggccggcggctagaggtcggggacgcgcctgacaggcgggacccacgcgggaggcgcacggtcaacgcgcggcaacaacgcgcacgcgcgcgcacatgcgcggcacgggtgggaggcgcggctcggcttgggccgggcgaagccgaggcggcccaggaggagaagaggagggagtgggccgggaggggaaggggaggccaagagaaggagggagagaaggagagggagagaaagagagggaggaagagaggactttggccgcgggccgagggagagagagagggaagactttgggccagacttggcccaaaggaggaaggaggatttatttttagtttttatttttagtaaactttgttaattgttgttgttgcttaataaatatttttggtgctctgaaaatttaagtaaaatttgagggcaccttttagaccaaggagaatttaacaaaaattctccggaccacattcgaatttttcttgtacgtattttaatgtttgccaatttcttttcgaattttaattaattctattattccttttagagaatgatttttattttgggatgaatttatcaggacgtgacattccacccgaaaacccgagcccgtgtccatccttgttaggatgagcggtgatggtcttgtaaagggcatcttttgaatggtaagtcttcatgcatccatatttcaccaatgtacccaacctttcattctctttcttaagagcttgcatagcatcaacattagtagcataagaggtcaaatcaatattgtaacacctagcacaaccattactagtagatggattggaagaattagaaaccacatttggttgagaggtgctactccaaagagtgtctaattgaacttcaagatctttatgacttttgtctaaaatagcaaatttttcttgaagagtttcattgacatccctaaggctagctaaagaaccattagccaaattaagctcattagctagttgttcatttttagcacattctttagctaatctctcctctaaggcaatgtttcttttcttttcaagaataagcaattcttcttgcctttcgagtgattgttctttactatccaaagctctcattaatttagccaagtgttacatagcgggtttgctaaagctcttaagcacatcatctaattcattatcactttcttcatcactagaatcatcatcaagagaagtgtgagaaggcttttgagtcatcaccttgcggccttgggccatgaagcatgagtagtggtaggagtcgtcgtcgtcatcactcaagttgttgaagagacactctttgcttgaagaggatgacttgaaggcgacggtagcaataccaccctctccttcaatcttgtcttttggcttgggtttgggcttgtcctcggaagcttcttcatcttcggagtaccacacctccaccatgtgtgccttcaccacatgagcacgctccggcttcttcttgtctcctttagccttagcttcatttgttttggggcaatcggcaatgaagtggccatattcgccacaattgaagcaagctctctctgattgcctctttcccttgtcatcatccttccttcctttgccatagccactcttgagaagaaagtgcttgaatctcttgacaataagagccatctcttcatcttcactttcttcacaacttgactcttcttcttgttttgcgttcaaagccacttcttgatttttgatcatggcggcattcttcaccatttgcctcacttcacgagcttcctcttcttgcatctcatgagacacaattcttccaagaatgtcacttggggtgagcctcttgaagtctttcctctcacgtatcattgatacaagagtgggatttcttggaccaaatgcacggagaagtctcttgaccacaaagtgatttgtcatgtcctcactcccaaatcctttaatcttgttgacaaggatcatcatcctatcatacatctcttgaggtgtctccttgtcatccatcacaaatcttccaagccttccttccaacaattcaatcttgtcctcacgaacggcgggtgatccctcatgagccaattgcaaagtatcccatatctctttggcctcctcaagaccatcaaacttattgaactccttcggactcaaggcggagagaattgtattggaagcttgagcattgcggtggatgagttgctcttgctccgaagtgagctccatgtcatcattgggtacatcaatacctgtacaaacaactttccaaatacttggatgcaaagagattagatgcaacttcatcttgtgcttccaagcggcataatgtgtcccatcaaaatgaggtgcacgcccggaaggcacggagacaaagttatgaggaggaacattaagtttgatgtaatcaaagtgaatagtagctccctttgatccagtctccttggtgctagaagcgtctcccttctcctccaaatattcgtctccctctagatgcgacatcgtggatcacttcaagcggtgaagcttgaatcaagagcaacctgctctgataccaattgaacgtgctgatgaagcctggggggggtgaataggctgtccctgaaaactcaaaaacaaatcgcaacggtaaaattcaagcagacccggaacttcctggtaaggaacaccggaacttcctgtgttcttaggacaggaacttccgggtaatggaacaaagacgaaattcaaatttcgaaataggagactaagccaatcttaacaagatgatgcacaggtattctaagcagaagatagatcacagaatcatccacagaaacatcacagaaagagacaagagtgattttttcccgaagttcggatcttgcgatcctactctctgttgaggagctccaaagagctgggtctcaattaaccccttgcctcagttgtgcaaaaacccagaggaaatccacagccttcaaccctaaacacccctaggcaaatttctagaattgagtgaccaccaagatccaactcaacctacatctagaaattcgccacaagtgtaggttgctctacttggaaaacctctagaatctcagcacaagaacttcattaacttacctcgttccctttcggaggagaggagatcgttcacaaacttacccgggacatccacaatatgcaacggattctcgcgggcgacacctaaccgtctaggagatcatctccaagagtaataagcaccgagatgacagcccacgagatattcaagtgctcacccaagatcctagtcttcacacatattcaaatctgcttctctcactctcaatctctctttctcacaagaattaggctcaagattgagtggagaaggcaagaaacacttgggagaggctagcaacagctctagggatgaaaagtgaaagtggaatggccaagaaataagctggaaacaagttggttatgtataacggctaggtgacgtcatctagccgttactcacaattttgaactggaagctagacaggaagttccggacctggaagacaggaacttccggacaacactttaggaaaatctttcaccagaccggaacttccggacctggaagacaggaagttctggactcgctatgctggacagatggagtatttgcaaaaataactcctagggaaacttgtcacttaggtcacactaagagcacttgacatatctcagagaaccacatggaacccctcttaatagtacggtttttcctaaaactcgattgcaataaatatactatcctatgcactcctcgagttccggttcgctttgattttatacttttttggggggtgtccaagcatcttatcttccacaccttggactaatgcacctgagagtagctcaataaactcattagtcccttaaccacatttatcattaatcaccaaaacccactagggggattaatgcactttcacctatgtagttcatgggaaacacatggcgatcagatagcaccaatcaaaataatagtcccgttccttaagaattactacatccgtttcaggttataaggctttctagcattgcccacattcatatagatgttaatgaatctaggcatacatatatgtctagattcattaacatatatatgaatgtgggcaatgctagaaagtcttataatatgaaatggaggaagtactccatagagaatctcacagtccgatttttgctgttgagcagcttcaagcctccataagtaagaaacatgtgctactaattgatgatgccacagatgttgagggatactattaggagagtgaattcacatctaatagaaggctttacatgtactgatgcagaaggttatgtactctataggaattatactgaattaggaagaacaacaagtcttttaagagagagaggctaaatataacgaatactactttctttttttaacgaaagactgcaaaaacagtatccaaatttaggtagttcagtaaatcacaaaacaaaatatagcaatgggcaagaatcatcatacgactcgtaagacaaggaagattattgccataacctagccgaatgctttggtgaccacctctcgccgaaggagactggggtagaggcggaggagagcgacacgtccatgaggcttcaaacaacttgtccgctcttgctcctcgagccgatgatgccgcaccgatggcggcggcgctacagcgaccgtgaggaaggggctaggggctgctgctgctagaggtgtgtatgggtcgatccattgcagatttgtgggccacaatgacaccgacttagctccccgcaaaaaaaaaaaatgacaccgacttagcttggaccatttccggatcggcccatatgattttgtgtcgtggttttggcagaagacggcttggcccgttcaggatcaggaggagcccaagaaagatgaaagcccaccataaggcccataaccgaggaaactatggtctgtttgttagagctcaactcctaaatttagctccaacggttgagtctggagtgaagttgtagagctgcctaaacccagctgcacttctttaattcattttgtgagagcgttccacccagcttcgctcccattttaggtggagctaaaattgtttagctaagctggagctggaactgtgccaaacaggccctatatatatgtgcaaatcatctaaactaaaaccctcctagcctcgacagcgattcgggggcagcgtggctatttcccgtgctatccatgttgcccccgatgctccacgctgctggatttcagctagtgggaggttgcctcgactccggtagttttgcaaaaacacccttgatattattgataatttgtattcttacattgttgtgctgtggattcttacatttaggcccttaaagacttgaaatatcttataccaaggccccgctcgatgtggggttttgtagatagattttggttgtacgagaaacctcattagcacatgattatttaagcattaattattataaatttggaaaatggatttatttgtttttttataaccacttacatatagaaactttttatcaaaaacacaccattcaacagtttgagaagtgtgctaacggaaaacgaggaagttgaagtttggagttgagaaaaagaattgggcccaagaagagaaaaacagaaaataggattgcgcttcaaataacagcaagtgagaggtctttttgtaaaaacgaacaaccctaccgcccggcgctcgtccccaccacgattgattgccctgccctgcccttcccctctcctctctcgctctctcccctaccctcgcgacgggtgcatcttgtcttgccctcccccttgcccgcttcttcccatccgttgccgcctctcttttgctcttgtagccagcctgcacatccccttctcttaggaggtcaactgccagcaaggagtcagaggtggagcgtcgccatagtcccttaggttgacggcggaggaggcaacgacgacgacagcggtctgatgccgcaaggtaggggaagagcaaatcgggaggagacaggagacatggtgcctagatccggagaagagggtccatattaaggccggcggcggagggggtcatcagagatggccggggtcggagatgttcacgtcggtgttgttgcccgtgatgaagaggcccgcagccaacccgagcgccagtgtctcaccagcatctgaccgagtgccacccgctattggctgaggtggccatcagctggtggagcgagaaaatggacatttggccactttcaaaactgggtttcgctattatgccatcctcaaaacgtgattcgataaaataccatttttgagctcgcgttacttgccaaagtgccatttttgctgttttattcatttccaaaacgaatttcgctcggttgtggggtgatgagatggaaatgccttgttgacaggtaggaccccgggcttgttatccccttgcagcgagctcaatctttgtattgtacagcaaggaatggaaacaaagaattgtggactgccgcggaacatctcatcgatggtgatgatgatgcctatggccagcggcgtgcctaggcggggtcggccacgaggctgaacacatcgtccctggccgactccttccgtcggacctacgcgcatggcgttcctgcgtgaccacgcttctcctccagccgcggccgcatgcgccgcatgaaatcgaactctcccggcagtgactgcgatcatgggcgcgtgcggcggaccaccaaggccgacggcttagtcggacccactaataactacatccacaacgaggcggcggcgatgcaatgcctgcatgggagatgccttcgtcttcggcgacggcgaggcgatgcctgcgttggatctccggcccggcgctccgcctcttgtaccgccccaacggctcgcaacatccctttgccctctccgtctgcaccagcctcggcccgctcggatcccccacacgcgcgccgttcgccatctccaccgagttcaacctcctctgctccaacctgcccgttttctccctcctcttcaagcctgcatcggcgacttctcgctcgccaaatgcgatgaccacaatggccacagggcgcggcaaatgtggccgccgcggggaagagcggttgtggggtcaacgcactgttgtccgggatgtgcctcacgacctggagcgtgctgccgttgtggagcaaggcgagcctacggttccagtgggggctgcaggtgctgccggagctgaaggctgccctcgcggatgatgggtaccgttggtgagtaactttgaggagttcttgccagtaaacgaggcctcgcggcggcagagcgagtccatggcggcggtgacccgcgctctagctcaccagcagctgctgcctcctctccagctccacgaacctggcgctcaccgcgtccccctccgcctcttccgccgacaaggccatggggcccacctcgaaactctagccgccgccgccgccatcgaccccacgggcctatgagataactcgggcggcggtgttgtgtgccgtgctccccgcgcttgagacacaccgcatgggaaatttcgtctcatcaccaaacagaggagcaaaaatgatttcgaaattatacaaaatggccaaaatggtaaaatgacggtgagcacgtgctccatattgacattttaacgaaatgcgtttttgagatggtattctagcgaaaccatgttttgaacgtggctaaatgtccattttctctggaagagcagaggttgacagatccaagcagcgtgaccacgccagtcgccaccgagctccgtgcttagcttcctcaccaccagcaagccccacgtcgacattcagtcccctcgagctgttagctgcatcgtcagatctgtggactgtcaccagcgcggacgttagcccctctcttggttgcctcctcgccgtcgtcgacgcgcactgagcagctgtgctctatctcctacgccgatcatgcatggcaggtgcagaagcacaaactaggaggttctatgggaagtgggaactcacgcggaccatggcaatgacacagtcgctgcaatattcaaccgcaactccttggacgcgcgactatgactctttttagatgggactaaaactttactatcacatcggatgtttgatactaattataaatattaaacataggctattaataaaacccatccataatcttggactaattcgcgagacgaatctattgagcctaattaattcatgattagtctatgtgatgctacagtaaacatgcgctaattatggattaattagacttaaaaattttttcacgcgaattagctttcatttatgtaattagttttataagtagtctatatttaatactccaaattcaaccaatacgatagggactaaagtttagtccctggatccaaacgctacctacgtctcaggcgcccgatccgggggtggaaaaatcggacgcccacgtcaccatgcaaaactactttcaactattttttctcttaaattatttatccaaatcatgatccgattacaccattaaattcgttgtaattaaatctttgaaacaagatctgttgatgcgaaaacacgaggcttgggagatctgcttaactccagtgcaggtccaaaagcttgcctttaggttcgtgagcgtgccagttgatttgatcctgcaatcaacaagaaagaaaagcaaagaaaccgcggttaaatccataaacgatagccgatcggctagttgctgatgatatatcatttacctttgagccgatgtcatatgtgaatcgatcgacaatcatgaataagtgagaaggaactaaatctactcgatcggccgtagatattaacaatatataatccttatgtcgatatatacttaaatcaagtgattgggatagatcggtcgccatgccgagacaatataaatcacttagatcgaaatatatattaacaacaagactatacatatgttcatagcatggccgatcaaatagatctagcatgtatcggctaatactccgatactactctatatttgtcacgtcccaaaacgactctaaaatacatcctctaaattatgcctagaataattaaaatccgtgtgaaagcctccaacaactaaaatgtgcaaagttaaaagtcaaataaggcttggaggatttttgtatatttcctaaaagcctaaaatgcgtaaataaattttagtggaattttcagagcacaaataataattattaagaaataaacaaagttgaaaaggttttataaaaaagaaaagctttaaaaaa

SEQ ID NO: 72991 - DNA, 656 bp, Oryza sativa
gcccccatccagatcaatgcctcgtcaaccgccgtcgtcgcaggtcggccttgccccatccgaattgactcctcgcagagactgggtggtggtggcggcggcgggccattgacgggaggacgagggagatggactcgccgggaggagggtggagagagagagagagaggcatactagaaggacaacgtctccgcttgcatctgtgtctgctggccaccgcctgcctcctccgcgctcgacggccaccgccgccgcttccccttccgcttccacacccaccggctgcctcccgccgtcggccacttgcgcccgctacttgggcactcctcctcccctccgccccttgcgccgcccgcaccgctcctccgactgcgccgccacccgtgccgctcctccgaccacgccacccctccacctagctactcctccgactgcgccgtccctctgatcggccctcgtcctccccgtcgtctcggcggtagagaagagataaaggtggggggatttttttttagagtggtgaaaggtgagtataaatatgtggtagttgtaaaatattagtacaatataggatgttggtatatggaggatgcaatatggatgatctattggagtgaaaagtaaaatggagtaggaatctttttggatgactatct

SEQ ID NO: 72992 - DNA, 10485 bp, Oryza sativa
tgggacccagggtcgggttgccagttcggtctgaatcatcgtaggccttgggttaaggcaggttcgtgtgggttcacggccttgattaataatatggtatagctctggaatcgtgtttacaaaatagctttgagcaactaagtgtcttttaatgctgtttactgcaaaccctaaccctttatattataacccccttgtactcccttgcatttatcctgcacttgtgggtgtgtcttgttgagtacggtggttgtactcagtcttgctcaatttttcccaaacccagaagaggagcccctggaagatgaaggctttggtgtctagctcgtgcctgccgtcaagcgcctgtggtcgtcgccctagtcttctgctgtttctcgtttgtctttgtgtgtgctgggccttcgccgcccatgtaataaattaactatttacgcttccgcttgataaactctgaaatgtatcaacttttggtgtaccttgcctcctgggacaaggaataatacacgcacgtaaggaacgcccgttgggttaattccggtcgtgacaatattaggatgttaaagcaagtaaaatatatcaaacaaaagcttaacatattcaagtgcaacaaaatcttaatgtaaagggcggatttaaaatgtcaatcaagcatatagaatataaagtagttaaatcaggtaagatcggctgaaaccccgatgctaccctaatcggcaatcagaaagcaggctagagattaagattctaatcatgacttataaggtcaaactcaattgatacagctataagtatgaaaaaaggacaatatctagacaatcaagccgctgaatgtttcattgagtggtagatatcttatataatctaagtcaacgtcgatattgaacctaatcggctgccttctgttgacagacgtttgccgattgaaggttagatagcgatattgctatgtaagatatatgataactcgacgaattacataaacaagattagagtatcataaagatggaagcactaataccgagaacacaagccgccaaaacaagttttacttctagttgaagatcaaaaccgatgcagctcaacccaaaagcaagaactcatcaaaacaaaacgaaagtaaaagggtggcgatacgccgagattgtattgaacgtgtgttagattgattacatggggctcggggtctatttatacctgagattacaaaacatgtccatatcggacacgactcttatctctatcaaactctaagatactataagtctttacggcagacttttgcccaaacatatctctaaggaatttacataaaatatcctaattaatagatacaattgtcttcccaggactctatccatgcgcggcaatcctcatgaagcatattaatcttaacccgacaacatataccacgtcatattgtcggatctgactcgatcggctaacttcatccgactcgaactctgccgatcccagtcgtagccgattcggactccagccgatcctttctctgtttccgggacaatctccatctcgaattccgcttcgattccatcttcatctccgatacttggattaccaaatttggttgttaacaagaccacacatgaatatattctgacgaatttttttaagcttattattgaattatttttaaatgttgcacgatgttccaccaagtatatcggaattgtttcactaagtagatcgaaaatatttcaatcgtttaaattgacgctgtttcaccttatataaaaacaatgttttagcaaatagcgaaagaatgtttcaattcactgcaacatttgatctatatatagtgaaatattataagtacactaggtaaaatatttttggtagaacaaaaaatgaaacaaattcccttaatagagggtttccataatatgtaggtgatttgttgtaaaaaaatgtttcgattcactgcaacattagatctatacatagtgaaacattgtgagtacactaggtgaaacatttttttggaaaaaaatgaaacggattctcttaatagagggtttctaaaatatgtgggtgatttgttgtaatggcgtgtgtgatggggacacatggcaggtgtgcaggacgacacgcgtgtcaaggggggagcgtccgatttttttctcctcccggacgcccaatttgcaacattatcccaacttctccattgcaattttagacgaacagagaaattgcatctagatcaggcgtgtaaagttttggcgtgtcacatcacattattatatacgctgtcccatgaggagttcgggcactaataaaaaactaattaccctctcagttaagaaacccggagataaatttattaagcctaattaaaccatcattagtacatgtttactgtagccccccattgtcaaatcatgaagcaattacgcttaaaagatttttttcgcaaagtaggcgcaactatgccattaattattttttaagcttatatttaatacttcatacaggtgtttaaacatgtttaaacgttcgatgtgacagggtgtaaaattttgagccagcatctaagtgtttcccattgattggtgtcaggcaaggcaatgcagctagatgagaatgcattagatggctaggcaagacagccgcatcgatacactaggtgatgcccggaccacgtatcgcgcgcgggcacattattggtcacagtattaaatttataataaaccatggcaataataatttttaagtaccaaaagaaaattacatatcgagtcataaatctttgtataaaaaattatactatgaagcaatataccactattgaagtgcgaaaagttatttaagtttagtcagtaaatcttgagatatcctcatgtatcttgaaaattacaatttctttcggaatatgatatgcaatctagagggtctagaaggtatgaatatgtttctgcagatataccacctggcataagagcaagaagggcacattcgtcaactgctgaacaaagatccctacatacttcctccgtcctaaaaaaaaaaaaggcgaaccttaggtttgcgtgtccaacgtttgaccgttcgtcttatataaaatttttttatgattaatattttcattgttgttagatgataaagcatgattaatactttatgcgtgacttacctttttaaattttttttcatattttttcaaataaaacaaacggtgaaacgttggacacgtaaaccaaaggtttgccttttttttttgcgacggagggagtaggtctatgcctaaagcacctacattaccaaaagaaagcacacaatgtttacccagaggaggttgactatcattctacaacctcaggaaaggacataggatggaaaacagcaacagggcttggcatgatgccaatgtcaaattcctctgcaaaaggacacatacttcagtaacttcaatagcaaggattacatgacgtaataatttaaaaatgatatggtgaatagtaggaattcattagataataagaactatgaaatgataaaaacttttagtatcaggaatacatgcacaataatagacaatacatggagtatccagttcagatattatatccatgattggagtcaaagaatttaacagagtgaagagttggtgataatcaaataaaatgaatttccagaaacatgttctccctttttttttcttttaacctgaagaaacatgatttctgttcggaaataaactgccattcacaatacacctgacaatctgttcaggaggaaaaatatattttagtagggtatttgtagaatgaatctacatgtcatatcataatacagcactaaaacatgtataggtatagctagtaatctaaaggtgtaaattaccaaagggctaaaatatgtaggaaagactcaccaaaggacacgtgaaccgaaagcatgataaaacaaagcgagtacagtaaagttggcaaacaccctgcggatgcatgatttggtagaaacagaatattacattagacaggatgggtatgttgcctgacttgcctaatatctctgaaatgtattttcagcaagcaatcaagtaaataaaatcatattttgttcaaaatgacaccatatacagcttgctaccatattcatgaagccttgatttcagaattcagtaagtaataacacaacaatggtttagcaagaaaaaaatattaccatgcatgctagaagagaccatatggacatgaaatatgattttactgctaaattatggtttgtcttcatggagctgcacagatcaatataatttgttaacatataaaatgaatcattttagtgtatggggcacgtagagtaagacttcaacttctagactggatttcgcaggcaggaaagaatatgcatctctcgaacaacacaacacccatacgcatctcttgcccgtgtcatataaagaaggaaaaatcaaaactacaaatccatgttagggagcaggttttcagtacgtagaaacataagctatcatatatatttttttacagaggagaagaagcataattacctgagaacctggcaagtccaataaaaaatccaacaatacgacgatctgcagggctgtaaaacagagaggatccctcaattattttaaataacccctaataaaaagttaacaatttcaaatcgagcagagcagtaaaaaaacataagcattagcctagaagttaattaccagaatacttgcttagtcaaattataaattgtacgaacatggtgatctgcagggctggaaaagaaaagaggatcacataattaatgtaaagaaccccaaataaaaaatgcatatatttctgatctaaaccatggcgacacaataaaaagtgtctccgtgtgcgctcgccggtgtccgtaggcctctccttacatgtgtcctcgacgaaatcgctggctgccgaagttctgaccgcatcgtctcccccaaaatcgtcgggctgccggcaaccaggtcattacctggcgtgtgcgcaaacacgaaggatgagaagtacaacttcaaattgagacaaaccggcaagaagcaagacaagaagacaagtcatagaggtcaaaacctaacttgctacaattgtcacgaaaagagacatattggtaaaaattataccataggtaatactcctaagtttactattatttttgatgattatgtgcttaggaaaaataggcaagacaatgtatttgctagatatgttggtttacctagacttgcacctagaaggaggaccatttgggtgcctcgcaatttggtaactaacattgatggacctaattttgttggggaccaaaatatgctcaaatgagaatataggtacatgaaaggcattggtgttttggcctatgcgagaaaatgtgattctcaccaagttcaagaattggagccaataataaggatggagaattcacatcaaggaccaatgctatctcggtaacatgcttttggtttgaaaattcttttttatagctttgtgtagtttgcaatgcattctcataactctttccaaaattaaatctctctctcttataaaaatcatcatatatgcatgttgagcataataaatgtggcatatgaagctataggtttgatcatattcatgtatcatatttttctcgtgttgcttttgtgcttattatcaagcatatttgatcttagctcgatcttgtgtttattttcctatctttattgagttgaagggaatatcacattaagggaaagttgtcgcgcccggaaaaataccttttccagaacgctagtgtattaatccccgtcccaggaaaagccggggtacaccacacaaacatgatataaaagacacatctttattatatcgataatatttaaattattacaaaggcactccaggcctgacaaacaaaaataaacagcagcggactagcgggcctacggctccatcttcactggcgctcaattagggtataagccaggactccacctagttcttcttctccaaagcttctcttagtgaagcggggggagatagagcaagaatgagtacaaccaccgtactcagcaagccacaccggcagatgcatgattaatgcaagggggtacaaggggataataataggggttagattttgcagtaaacagcatttgaaagacacttagttgctcaaagctattttacaagcacgatcctaggaatacacaatatcattaatcaaggccatgaacccacacgaacctgccttaacccaaggcctatgatgattcagaccgaactggcaaccagacccaggtcccagctcgtcccaagccaacccaggccaaccattccacattttagttgttaagcaagttttaagaagtaaaccactaacttgggtacattgctaggcttgcccataaccgagggcgcgactattcgaatagattatactctgatcagaggtgtacatctttacccacaagactcatctttactccgcattccacggccgtggaacccgttgtaaagaatgtgtcataacccctttacccatcctagccgtgacaaaagcaccgagccaaccccgcctacggccggaacccccaagacaggtaggcaggattgagcccctagcagcagaacaccggccctgtgccatgacatctcgactaccgagccgcagcccgtgtagccttcatttgccatagagatgtccatcgagccctgacttcgtccatctccatccgtgtactcttgccaggactagactgagcaccgagttaagccttacctattagacatgtggttagtacagtagtgctttgcaacagaggcccgaagaccggtccttatagtggtcgaggtgctactagcagaaccatgcacctcgagcccagcctaaaaccattttgagagttttgaatagaggggggaggagtgtgttcaattccatcacaagccaaccattccataatgtccaaatgacatgagaactcccaaagtctaaagttataaaaccacctaatgttgcctaattaatcagcgaagcatctacctaaattcatactagtggaaccatgaatagagtacccactagttggggttttgttttcctatggtgaacgaggtgataataacaattgcaatgataaggctataacacggattaataggaagtgctaaataaaacagtgataccgcgggaatttaaataaaacggtaatgcaataatttaaattaaaataattttataaactgggattaaatatgctcaaggatgatgtgacttgccttgctcagagagaacggccttccgaaccttcggcgacgaccacgaaccgcacttcgggaacctccggaatgacggaagctacgcgaagcacacaagcaaagctacaagcctataaagaagcaataacaatacataaaaaaaagcacagggttttttaggttataacaaacattaagagacttgaacgggtcaattcggaattcatatgaccaaggcatggtcatccgaagtttaatgctgttatatggagatttgtggattattataattaggctttgcaactataaaacatgtgtaagcgctagcctggaaaagacaggaaggctgcgctgttgacatgcggaccccacatgtcaacctaagggaccacggtagaccgagtacacagagacggtccacgggtcaatggaagcggaccccgtgtgtcaaccgaggcaagtggccgacaaacggacttcactagacaccacgcgggctgcacacgtgaaaaccacgcggctaccgagcgggcacactagcacggtcaccacacgcacacacaaacgactaccgacaccggtacacgggtaccggggtcgacaaccgcacaacgggcatgggcgacactgaaaggatgaggacgggggcagcgagggagaaacccttaccaccacgcgacgaggcgtgggaacgaggacgacgaacgggcgcggcggagacggctcggggacgacggaggcgaacggcgagggaacgacttcggcagcgatccttggacgaaagcgagacacggccggcgcaacgcttgacgacgcggagccgaggatgaagacgatgaaggggctgcagcaacttgacgaaacgcaggcgacgaacgaacgtggcttgacggagtgacgaacgccacgacgaccgaaaacgacgggaggacgacgaccggaaccggcgaggaggcgacgagggcagccggcagcagctgcacggatgcgaggacggcacggaacacgtcgctgcgaggatgacgacggtggcggcgcagtgagacgacgagccaggtgaccgacgggacgttgacgacgaggacgaacggtgacgacgacgacggacagcgaaggggttcggatggaggggaggtgatgctgaggacgatgtcaccggctcgccgctgcgatgccggaggtggtggtggcgcggccgacggcgcacgggtggaggaagggccgaccggggaaattccggtgaggcggatggagaggccagcgtggcacgacggtgttccggcgaaattcaggcgatgccgtggcctggtcggggaagaggacggcgttcctgtgcctggagaggtagtggcgacgtcggccggcgcacaggagacgcggcagaggcggccgaaggcggaacagtggcggcaatgccactgttgccggtggggatgcacttccggaggtctccgcgggaaacggagggcaggccggtgcaggagaggcgactgtgacgccgggggaggcgacggcacggccggccggcgtgctgacgcggcggcaggggcagctggagtcggccggcggcatgggagagagagaagggtggcggggagaggaggtgaggccacggggtagctcgggaggaggctaaatcgatagaacggaggaaggggattccattttataggtgaggggagggagccggccatgggagaggcggggaacgatggcggaatttgtggccggcggccatggaaggtggccggggttggctcgtccgttcccggcgattgggggcgccattcaagggggaaattggggagaattgaagaggaaggaatgagaattaattcccccccaatcaatttcgggaaccccggtttgaatcgcgtggattttggggaggattggcgctagggtttgcacgggagagagagaggaaggaggccgagcgggaggaggacgactcgggggtgggacccacgcggtcaggcgcgcggtcagtgcacgcacgtgcgcggcacgggcgggagggcgccgctcggcttgggcccggaggcggcccaggtgggatggggcggggagacttgggccgagaggaaaaaagaacggagggcaggcccaagagagagagagggagagaaggagataaggtgaggaggaagggaggactttggccgcgggccgagggagagagagagggaggactttgggccagacttggcctaaagggaggagggggattatttttttggaaaaagtcgacttagactcccttaattgtaggccgaatctaattcgtacccctcaactagaaaaccggatagaacgaccccacgaacaattgaaaccagtgcaatttgactccctcaccggttttggggggtggttttgctgacatggcgctgatgtggcggtgttgacccggtcttcgtcccacatggcgcttgcgtgggattagaattaaaaaaatatctgtgagacccatatgtcattcacaaaaaaatacatagttggacccactaacatgtggggcccatgtcacgaccggaattaacccgacgggcgttccttacatgcgtgtattattccttgtcccaggaggcaaggtacaccaaaagttgatacatttcaaagtttatcaagcggaagcgtaaatagttaatttattacatgggcggcgaaggcccagcacacacaaaaacaaacgggaaacagcggaagactagggcgacgaccacaggcgcttgacggcaggcacgagctagacaccaaagccttcatgttccaggggctcctcttctgggtttgggaaaaattgagcaagactgagtacaaccactgtactcaacaagacacacccacaagtgcaggataaatgcaagggagtacaagggggttataatataaagggttagggtttgcagtaaacagcattaaaagacacttagttgcacaaagctattttgtaaacacgattccagagctatacaatatttttaatcaagaccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgcttggcttgcccataaccgagggcgcggctattcgaatagattatactctgatcagaggtgtacatctttaccctcaagacac

SEQ ID NO: 72993 - DNA, 3702 bp, Oryza sativa
ccatggtgaagaacataatgctaatgtttatttagatggttttgtgatggccagcgttgttttattgatattattggccggagaataatcatggttatggcgggaagtactaaaaaactaaatattttcctctaaatctatatgattaagatagttgattagaagaagagtaggtgccatgatcccagccgtagaagtcagaagaacggttaagattgagccaaatctaccggtggagttggccccaactccaggggatctggacccctaactagtttacgaagagattatgcagggctcaagaaaaggatatggatacaaatacaaaaggctaaggggcgattgatcgcccctagcgatcagccgatcccccctccctcaacgtggttttcttttttggcaccgcattatttttctattttagtaaatttatacacctaaaatttgtacccctaaagtttacacatcaaatgtttagaaacccaaggtttataagtcaaaagtctatatatccgatttaaatttaaatttaaattcaaatattttttaatatagtatttctatacatctaaagtttatacacctaaaatttataaaacctaaagtttataagttaaaattttacatacccgtttcaaatttgaatttgaattcaaatattagtttgtagacccaaagtttataagtcaaaattttacatacccgttttaaatttgaatttgaattcaaatattatttatagacccaaagtttataagtcaaaagtttgcatacccgttcaaatttgaatttgaatttaaatattagtttatagacccagagtttataagtcaaaagtttacatacatgtttcaaatttgaatttgaatttaaatattagtttatagacctaaagtttataagtcaaaagtttacacacccatttcaaatctgaatttgaattcaaatatcaaatattttttatatatagtatttctatacataattttttttaactttgtttttttattttttaaaaaatttatgatgtaataggaagagaagaaggggaggaggaaaggggagaggaggagcatataggagggatggggggtgatcgctccgcctattagccacgcccgatacaaataccattgtccgaaacattgaatttctcctttccggagtactggggtcagtgcatgtagaaaatccgcgttgccctctcatagcatctccatgcaaggtgctacataataaaagcatctttataaatatcctcttctccaatttagaaattcatataccttatggaatattcttttatctaagagccgtgggatcgctgagaaattagggccgccacgtcagcgtattagtctaacagcgatcatgcatcttgcctcttcgtgcatgcacgcggccgccgttgaggaaaaaaaaaaacagcctcgtgcgtgcgttcctaggcctccaatcttattgggctgtattacctgtgccggcccttccttgttcatactaaagcaccacatgtctacgagacccatcggttaccctaaaaaggataacccaaaaccaaaaccaaagtttaaattttaaaacttaattttaagatatttttaacgtaatttattttttcatattagctttaaatcagttttatgcacaaattatcgttttttaataactagaaaaaaatccgtgcgttgtaattggtgaatgctatgttaatcttattattgttatatgatatatatatagagagagagtgagagagagagaataatgagctgtagttagtagtccgatcatctccgattagcatgcgagtattctttttttaaagagatttcttatatgagttcttatgtatttcaaaaaccgactcaaatgcggatatgtatttctaaaagcgaacaaaattaaaagccgactcatacacggatgacgtaccaaagtaccgacaaatacatcaattttcataatagtagagatagagattcgctatcagcgttgcggtttttttttcgcacagaagaaaaagggagtaaatattgcagcagctgaggtttgaaccctgatctccaagatacatcaaaacaccattcaccacaaaaccacacaatgcatcatatgcttataggtctattactcttttcatagtgtttcatggcctcggcatcaatgggcttggtgttatgatattgggcctcaacgccaaggtccatggcgctgaggtgaaggcctatttttaagttatagtttttggcaaggtctacttatagaataagtttgttaaaaatatcaaaatgtcaaaattacggttcaatgtttcagcgccaaagacatcggcgttggcactctcgtcctgtggtagctaagtcacttatgtgaaaaggatttgtgtcaaagagattggcactacggacctatttataatttctttctaaaaaaagtcaaatgtaaataccttttcttataaatagaccctcagttctagtcttttttggatggtaaggatcctaatttagaggaaaaacatagcaattttgaaagatttcaactatagaaaaattttaagtgaggatctttgaaacaaaggattgaatcctgccatatccttttagcattcctttgaatcaaaggattaagaaaatagagaaataggaaaaacatatgattattataggaaaaatataggaatgattgttagattgaatctcagaaaaaacatagaaattatatgagagagataaacacataggaaacgtttcatgaagttggacatcatgttaaaaatcctccaaaacttgtttggattgagacattccttaagaatttcttatgagtttcataagatccaatagttttcaatcctttgtttcaaaagggtcatatatgcagatacatgcactgtgcgtgtacttgctgtgtgtttcgtgcattagtaggagacgagcacaatggttcccgcccccgtctcctcgcgttgcactcgcccccaccatagccgctgccatcgcacttgccttcgccagttcgctgtagtagccttccctgtcgcagtcgctgctattagggccggatccaagcatcatcagcacgcaggttatcatcggccctgtttggatcctccgggctattaaatagcactctagaatcttactatttaaaagtattaaacgtagattactgacaaaatttattccataatccctgggctattttacgagacgaatctaacgaggtatattaatccatgatttgctacagtgatgctacagtaattatccgctaaccatggattaatatacctcgttagattcatcttgcaaaatagcctacgggttatgaaatatgttttgttagtaatctacgtttaatattcctaaatagcaagattttggagggctatttaatagcccggagaatccaaacaagatcatcgtcctatttggctttcgggggccagcccgcctcctccccgatgcctttgcatcgctttgcactctccgcgcccctcctgtgtcttcacgcttttctactcctcctccctcgcccaccatgcctccaccactgacgatgggcccatgagccctctcctctgccgccgccacaatcgtcaaatgaggcaataggaagggggatagaggggaagaatacatatttcactgataggtgggccccactaactgactaagcaagtcaacgctctttaaa

SEQ ID NO: 72994 - DNA, 7127 bp, Oryza sativa
aggaaggcacaatagacttattcttattcagccagagagtggcccacaatctatggcccaggcccaggtcctcttctaactcttcccccacaagccacacaggaagattttttcacggtgcggcggcggggccaaaccccagatagaaccctgcgccgcgtggtgcctagccccgggccgccgccgccgtggtgctgcccggggcttgacggcgtcgctcctcagttcctgcctccgccgactgtttcttcttctttgaggtaagccggaagggagtgggggagatggatcttgtagctatcgcctctcgctccttgcctctaaccctattcgcctcattcgctctctcgctctaatctcgcccccaacccgacgtcctcggcagcggcggagtgagtaatttgagtgggtttgccctagtttgggggatttgatttccctctcttctctttactttgtctgtttgatttcgttggacgtttgatgtgcaatcgatgcttctgttccagtccaaggaattttattccgttgaatattgaatcccctggtcaggtttcaaagaaaagaaaaatccccagttcttttcctgccaagacgcctttcctctggatttcgatttcatttgaactgatagtttgattttaccccagtgggtgactttgacggcaagcagccctgatttttttggcagagttacatatctcctgaattcccactttgatttcatctttactttttttttcgtgggatgctctctttggggatctcgatttcgagagtttagttttacttcatttcattacttcattcagtggatgattttggttttaaatggattgcgtgtttgacatgggtattcctccttgcagagcaagctggtaaagcaaagtagtatacgatctccagtccaaacatccattcgtgtgagcagtcaaacagttaatccttaaggtatggtgcaatgtttttttttctagttattgacaagtttggagtagtctctgctgtcctgatttaatccatttggttggcaatggcattaaaatgagttaattgcaatgtaagataagttgcaatctttttgacaaaaaagcgattcacaactgtagttacatagtaagtgcaagaagattacaagataacaagaatgcaaaagttaatggaacctatgttggttagtctatagtggctgtagatacatcactacctttatagaaatttccagatttgcatagtatagagtaaaatacatggctgatccttaaagttggacgaggatatatggaggactttgagatcttccattcttcgacaatgaaagatcagccatatggcatatctagatatggttcatcgatttgtataaatgcatatctaggtccctaatctcagtttaatgttttcccaaggtccaaaatacatacgacatagcttgggtgctgacgtagttatccactacagtattttgcatttagacccctccacctcaatatgccccaccccgaccccccaccgtttccaccatacccgtggccgtggggaaggaggcgaagagacatcaattaggcagtatttgatcatcagcgatatgaggtcctcggagccgggatagatggtacgatagggagagggtgatcccgtgagtccagtatggtgtgattgtcaccttgacctcagattgtgggaggatcacatcgacaataaatgccacacctgactcacgggatcacccacttcgtaataagctatttatcttgacctccaggacctttgattgctgataatcgccacagctataatcactatctcttcatctcctctcccactggtgcggtaggagtcaatttggaagtggtgagagtcaatttggggggtatactgtagcggagggacctaaatgtgaaatctgtgccactgtggacaactacggtcagcgcccgagcggtgtcatctgcattttggactttgggttatacattaaatcaaaatcagggacatagatgtgcattttacaagttaatggacctagatggcacctctgtccaagtttaaggactgtccgtgaaggattttattttttttaatcataatatgatgatacaaatttacccccaatattaatgtactcatagtttgttcactttttcagtatggtttctgtatacgaagaagcacgggaaaggtggacttggaaaaatcaagtaacagaagaagggccttatggctttaaaattctctcccaaataagacgccaggaccatggtatgtactataatattgaagaccatgattctgcttggtccttctttgtattataatgcaaaacgattttatattttacttaactgattcttcgcttaaaaagggcaaaattttctttagactaactttttgacatttcctataggatactcttagttttgtggttctttgagcaatatttattcaaactcagatcttgcaaggtggctaagggtaaaatcgtcttttgtaaagttttatctctccattagaagaggatatattaaaataatggttgggagtgtcttttggcaaaaaaaaaaagattgtcctaaggcaaaatgattttcacgacaacagagcgttgataaactaaagcaattaaagctatgaatcacttgtatttttctagtaccgagaaacccagttgcttgtagactagtctgaactgaagctagctacatagtgcatgctatgacttatacattatcgaaaagatcgaagcacgaactgcaagcacgttaccatatggtttctgaagaaagtacaaagctacataacctcatgttgtgcaaaatcaaactcaaaaagagcctatactgtaaatgtaaatctaatcacatcacaatcactgaccattgaaatctgaacatggtgcatcaaattttgcccttagaaaatgtaggttgcgtttttttttcattttgtaatgatgcattgctttaacttattgttgtattactcccaattgcagactgctgtaccttctctgctatggcttcaactctcgaggccaatgtaagagttcagcatggaaggaacgatcaattttccatacctcacctgcaatttatagatgctcaatcaaaaatcagtgcaccaaataccaatgagacaaaggtactgaggcttttgaaaagtctaaaagagagagacggtggggtttacttggatgaagactatgatagtgaggtaccttgtttaattcacttctatgcctattttctaaacataatgtagaaaaaatgtgattgcctggtgcctatattaagcatactatgttttgtttttcaggggaatctccgagccttagatgctaaagtttgcagggtatggaagttcaatctctaccatgtgaaggacattattcatcttcgaagtgctcttcatcggctgcgcaggcaagggcctttactggctgttatccgcatcagccgtaattatgatgagtgccgcaagtcaggccatgtctacaaatatgatcctgcccgaatctgcacatatgatgatgggaaacccaagacgcacgcgttgtgtgttgtttcgtttgtaactgagaagggtacaccatgccttgagtgtcaggactctcacggcacagcttggggtattggcggttacttaactgtggaaatcaggtcactaaaagagctatacagtgttagagttacgtagctggtggctgtcaagtcaatgcaactcaagactctacgtatgcactcattttctatcattttaatacttcctgcttacagtacgtggccaatgcaaagatttcatggctcagaagaaagggatctttggaattaatactttgtatttaagtgataatggcctgttgcttctcttgaccttttgtcccttttttggatgtgagagttatggaagttagatttggggaacagaagattttgtgattctatcaaagcgagatcatttctttaatttgaatatccacatgcctaagggtatggttgtagagtgcctgaatgctgatatacgtggaattttgctcatttgatcatcaaccagcatgcctcttgttctctaaactgttaacgtggaatgttacaactcgctgatatttttagtgtactgtatagtatacattatatatgatctccggaggtttcgttggatttataccttcagatttcagagcaaggttaactagtacatcaggctgagtgtatggatgatacaccagcgaacaaactttgatggatgagcaaggtactttaagcgttaggcagatggactgtattgcacatcatatgctactatttcacattcagcacatgacatactccagaatcttaatatatctcagtttaagtttcagattgtaaatatgcacaacatatagatgaaaaactcactacattctgactatcatagagttgagaagtaactttcttgcaggtataattagaacacatgatcctgatcggcatttgaatcaggagcacttcagaattcaaatctgaatatttcagattcacattctaaagataaacatgaccaaaacttatacatgatgatctcccccaatgtagttggttcttaattgtaagtgctagtagtcaaacctgtttgtatgtgctagtagtcaaaccaatggatgcactccatatttcttaagtagttcgattgtcgcttgattaggtaggaatattctaactaatataacgtctttcatttcaagtagaaataaacaataagatgaacgtttatgaactgaagagagaataggaactaggataatagtccaacaaaaattctaaatactattgattgtaactttcccttggaagaaagtacggctcatttcccttggaagaaagtacggctcatttgtaagagcaggtacaatagcaggctataagccagctgcaaacatattttaaagagataaataaggagagagaagggcagcgggctacagatttgtagccagctgtagcacggactccaagacgcagtgtgtgtatgataggtgggaccatatattaatagtgtagtatgtaactattgtattaatgagctattagattagctatagattaattggagctagtagttagctacactgttaaacttgctctaagtttacggtagttcacacagatcaatggagtagttatgtaaatgacaggctaatgcttcagtggctactggctagattgattaatcaaagatcccatttcccttgaagaaagtacggctcatttgtaagtttatggtagttcacacagatcaatagttatgtaaatgacaggcttgttttcagtgataagatactagtgcgttcgttccagtgacattgggtgagaaaacatctcgttttccgcatgcacgtttcctaaactactaaacagtgcatttttttgcaaaaaaaaaattctataggaaagttgctttaaaaaatcatatttgtcagggttacggataaaatatactctctattcttgaatatacgttgtatactgatatggtatacccgcgcgtatacggatatttcctgtgtacgttaaggaaatctatcacgtgatagaagtggagtccatagatggaaggagtcctactcgaataaaactgggtcgttaccatatcgtgtggggtccgatatccctgagtcctacttggagatcgactgacccgcggtataaaagggaccccccgagcaggacctaaggcattgaatcttaccgccaacacacccaccacagcctacgaagccagagcctacaagagccaagtcgccgggtgatctagtcgaaccaactcgactatgatctcgtcggtatcgccgagttctgttattccctttgtaatctatagtttccactatataatcccatatcaactggattagggctattacctaccaaggggcctgaaccagtataatccttgtcttttgtttgcttgatgtcgtattacgtagatcctcgtaccagcgtaccccaatgccctctatatccggtctacgggtatcccccgtcgacaatattaatccatttttgcaatttaaaatagttaatactcaattaatcatacgctaatgatctatctcgttttgcgtatcttcccaatcttctcaatcccctccttctcaaactcattatgcttctcaaagatcccattttttcggtggggacaggactgtaagcttgtttacctgtataatgtgtatttgacttcgatgtatgcgtctcgtcttagtttgaatcacacccatgtgcataattgcggtgttaagcgtgtgagggtaattttttgaacaaggatgatccaaaaactgctattccctccgtccaacgaagtctttttttattattattttctgtgtccaacgtttgatcatccgtcttatttaaatttttttaaaaaaaatagtcacacataaattattattcatgttttatcatctaataaaaataaaaataaaaatactaatcatagaaaaattttaaataaaataaagagtcaaacgttgtataaaaactgaaaaatggagtctttataggatggagggagtacttcattgcagcaagccgacatgctttgctccctggcaacaaaaataaataatgaaatacaagctactttattccaggtttatgtgtaatttttacaggaaaactgtcatattccgatgcttgaaaggaggtggcctagtgaaaattggtgcacgtcccgttttctttactggagtacgtatttaatcgaagtttaggtttttgtttgttaatatgcttatgaaacccacaatttttaaattatcccttcctctctcttgattgtctcagggctacaaagagaaggttaggttaagtttaagctcgagcttattattataccgaaattgttaggctgacactgttgggattttcatgtcagcttgctaaaagtcaaaatgcttgctgtatggcagcagcttattcagatcatttggtcctatgtatcttcttcgattcattagtactattatgcaacccctgtgctacatccgtatttcagaggggttgtataatatctataagaagtggagacataaagatataaggtgggactttcttctcattcatcattctgtcatcctc

SEQ ID NO: 72995 - DNA, 25298 bp, Oryza sativa
  unsure (1)..(25298): unsure at all n locations
aattgataattaaaacatgattaaaggtgggttgtgagcacatggttttgatggtcgtgctcataacaattaaggaacggttcgcgagctactgttgtgaaacatttaccgtgccaaccacaagccaacatgggtaacggctttaccttttgtatagcatagttcattatggggtgccagactgagaagcggcgagaagtccgtgagtgttgctggggagtccatgcctctggttgtagagggggtgattatgatccaggtatggtgcactgtggtgagttgtgttgtgcgaggggtattgtcacagttcctttccgaggtaccgtggtggtattgaggcgcatggtaacatgttgtggaactgtcttgtgggtacagtggtacatctctggccagagtaaaactattcgaatagccgtgcctgcggttatgggtgggtctaacaatgtttttcgtgattagtctcacattactcattattggtgataatactgtgacaattaaattgactcctggtttggaatggtatattcctggtatggaggtttgatttgtacaaccggggttggttgttcagatgaggttgggcctatgcaacacgggtgtgttgtatagtgtttatttaatattgcttaatttacttaattgttttactattctctcaaatgtttattaaatattgtttatgcaaatgagctttattatgccatcctttgttatcctgtgcacttgcatatttgctatgtggcttgttgagtatgtcatatgctcattcttgcaatattcattcatcagaggaggagtacttcagtgaaggtgatgatctggaggattaggcttgttcgggtcaagttgcttgtggagtggggtcgccatagctgttccgccttttgtttttattttccgctgcgtagaattttattcttttgagaggaattatccacctctgtaataatttattattttgcgaatattaattagtagtttgacattactctattatcaatttgttattgtgtgcctcggctgattcctggacgaggatttaacacacatgtaagcgtttggaattttggatagaaatttcgggcgtgacactcagccagtcttgtctctctcggatagcttcaccaacctctgagacttcgtcaagctcagtactcgggggctactatggggtacacggtacctaggtacccaacgacaagccttggaccgccaccacatggggtgggcccagtgccctaagcccatgtggcatacttgtatacatagaaggagataaaagataaggaagtctatcctatctcttgtaaatagatggcaaggtatccattttataagggatactttgccatgtatgggggggggagccctagctctatataaagggcgctggcgacaatcctacggaggctttttgaccatttttccaccggatacagacaattcatcccactggacgtagggtattacctcatctcgagggcctgaaccaggataatcatctgtgtcaccatctctccttgatctagcgcaccccataaaatatattgccaatcatagaatcgacagaatttatctagcaaggtgtcgactagggtttggttatttgctagtcgttgctaaagttgggtagcataacgactaggtttggtatcttcttgttgatgcgaaaacacgatgcctggaagatctgcttaacttcagtgcaggtccaaaaaaaaatcttgcctttaggttcgtgagcgtgccagttgatttgatcatgcaatcaacaagaaataaaaataaagaaactgcagttaaatccataaatgatagccgatcggccagccgccaatgacgtatcatttatctttgagccgatgtcatatttgattcgatcggcaatcataaacaagcaagaaagaactaaatctattcgatcggctgtggtattaacggtaaataatccctacgtcgatatatacttaaatcaagtgattgggatagatcggtcgtcatgccgagacagtataaatcacttagattgaaatatatactaacgagaggactataagcattcataacatagccgattagatagatctagcatgtatcggctaatactctgataccactctatattaagatattaaagcaggcaaagtatatcaaacagaagcctaacatacctagatgcaacaagatcttaacataaagggcagatctagcatatcaattaagcatatgaaatataaagctaaatcatgtaagatcggctgaaaccccgacattaccctaatcggcaaccaaagacaggctagagatcatggttctaattacgatttataaggtcaaactcaactgatgcagctataagtatgaaaagaacaacaatatctagacaatcaagacgttggatgtttcataaggtggtagatatcctatataatctaagtcaatgttggtatttaacctaatcggttgccttcccgcaatagatgttagccgattgaaggttaaataacagtattgccagagattatataggatatatggtaactcgacgaattacataaacaagattagagtatcataacgatggaagcactaatcccgataacgcaagccgccacaacaagttttacctctagttgaagattgaaaccgatgcagctcaacccgaaagcaagaactcgtcgaaacaaaacgaaagtaaaagggtggtggtgcgccgagattgtattgaacgtgtgtgttagattgattacatggggctcggggtctatttatacccgagattacaaaatatgtccatgtcagacacgactcttatctctaacaaactctaagataccataagtctttgcggcagacttttgcccaaacttatctctaaggaaattacataaaatatcctaattgatagatacaattgccttctcaggacttaatccgtgcatggcaatccacatgaagcacattaactcaacccgacaacgtgtatcgagttacattgtcggaatcggtttaatcggctaaccttgtccgactcgaactctgtcgattctggttgcagccgattcggacttcagctgattcttgctctgttcccggaacgatccatccttagattccgcttcggttttatctccatctccgatactaaaactaccaaatttgatcgttaacacttctctagccggtgtcaacagacaacatatcgactagagaagtaggaggctcatgcaggtttagcgaggcggaagtgttactccgacaaccgtgggtggtgacggagcggcttggatcacacatagcccgagagctaactgtgcggcgtgctgtggaggtcgagggaatagtaaagctccaaccacagtacgcatagaggcgtggggtgctaggagcagcacatttgaccttgctgggctttacaaccaacagtctgatgtaagggccagtagaccgggcaaacatccccatgaaaggcgtaaagttccaaccggcggctctttaggggctaatgggtattttggaatgaaagaagatatgcgataatcaaatataagtttaaagtaagaattcaaatataagtttgaatcaaatataaattcaaatggtaattaaggaaattcaaataaatcttaaaatagcaagtctgatatcaaaatgtagagtttgaatttagatgaatttaggtcaaatttcattggaatcggatatatggtttaggagatatgggcttctaaataataggatttggattaaatctagaaaatactaaaggttactccctccgtttcatgttataagacgttttgactttggtcaaagtcaaactgttttaagattgatcaagtttgtgaaaaaaagtagtaacattttcaacataagacgaatttactatgaaaatatattcaattattgatttgttgaaactaatttagtattataaatattattatatttatctataaacttagtaaaactaaacagtttaactttgaccaaagtcaaaacgtcttataacttgaaatcgagaaatggagacagtactgtttatgggcccacttgtcaggcttttcttttctctctctttttcttgtccttcttcctcccatcaacatattctctgcttcttgccagggaactgagaggagggagagaagggcgctggtgctccggtggacagggaaaggtagcgtcgncggcagatgatgttcccgagcgacgcgcatctagggagggtggcttcatacacaagcactgagagagnaggccggaacggcgagggcaagagctcactccggcagcaaaagaggtagctgtggtggcttgatcatggaatgggtagggaagaggggaaagtaggaaaatggattcacttcattgaggcgaagctattggcgcgagtatttggtcggcaatgctccggtgagggagatcaaccgatggctagcatgggagagagagagaagaggagagctcagagagctcggttgtgtggaggggaggggcgagcttttcgccgtctatttataggcgtcaagaggcggttcgcagaggaagagaggaagggaaacacggcatcggcggagtggggaaagagaaaacggctgacggctttgtctccgattggtcgaccgcgtctgtttgacgtagcggctgagatcagggtagtgacgcaaagctgcgggcggaggtggaggaggaggagcacggcacggcgatggcgcctctggcttggcgaagcagcggcgacggcggctccaactcgatgcgacggcgcccatggtatgttggcgacggcgcccacgggacagggaggaggagcggctgcctctgctgagaggtttcggcccacaactgaaataaaaatattttttaaatttttgttgaagatttagatgattaggtttgaacacaatttgaatttggaggagattttcaaaagataaagtttctaatttatatgagagtgattttttggaggtggaatatatttagaagcactcaaataagaaataggaatattttgcactataaataatagggcttctaatttggatatatttttgggaacgtggtagaaaatacatgaatgaagataaataggattttatccccacaaatgggtggtatggatttagagaaatattttgtggctaataggagatttgaattttggatgaggagtataaattggaattttcttagcacaagagcaatcattctaatatttataatattgctaatcttgtgccgagaagtattagattatggaaattggaacgggaggttagatcaaaataggagcttgagtaaagaataaatgatagaatatttcggatggagaagaattaaggatttttagaggtaaacctagatcaagggtttggtaaagaaataattccaattggaattcctctggtttaggattaaggacaatattggaggatttcttggaccaataattcataaaagtaaaacgggtttttaatagatttgcaacaaggaattttaatcgaaagaaagtaataaaaccaaatcaagaaataactcaatttaaatgaagatcagagaagaactaaaatgtcaaagagagggcttatacaaacaaatttttaggaggttacctctaattataatttcttaggttttggaagttatgaagaacataagaatcggcataattcataattaacaaatggttaattttcaggatgttacaagttaccagtgacaacgtcgcggaagaaggcggcgaccacagctctacccgtcgccgcgctcgaccgccaccgctccactcccgcgctcgcctaccatcgcttcacccgccacccgccgcccgctaccatgctcgcttgccgcccgccggctctcctcccgctgcctgccgcccgcgtccgctctcgcccatcgccgctccgctcgctgccagcctccctcactgaagaagagaagagaagagagaagagagaaaagagaagagaaggagaagaaaagagaagaaaaaagatgtgccgctgacatgtgggccccacgtactttttttaaattttttttgctgcctaagatgtcacgtcagcgaaaccacctatatatactaccataggaccttgagtaaacgatttatgtgagtttaggggtacacatttctagttttgaggttaagggacctcaaaaaatctcgctattaagttgagggacctccggtgaacttactctaaaaccaaatcccggaggaataagtacacgaaggtccctcaacttgtcatcgaattacaaaatcatcccccaaccgcaaaaccatatatatgacatcctttaacttgcaaaaccgttcgctttacatcctttggaggttttgaccccggttttatccgacgtgacgggcgagtaagcatgggacccacatgtcaggacgccacatcattaggctctctcttttccctcctctcccttcctcctcctctctctcactctctcactcatctcccaccccccacgcccaagtgctccccgccgccgttctggccattggccggcgagctgatcagtggagtgacaccggaggtgttcgacctgtgcagatcatggccaatttcgtcagagtgccagagttcaggtgaagagaagaaataaatggttgatgaattgagttacctagtgggagggaggcagaaggtgatggtgtaggcggcggcgttgcaggtgaaggtgctcatgccgtcgttgtaggcgtagctgtaggcgcgcgggcacgctgacttgaagatggtcgagtacgccgtcggccggctgtcgatgcataaaacacagactggccggagaggtttgctttactctagtgcaggtccaaagagatcgctttcgggttcagggcgtgccaattggtttaatcctgcaaataacaagaaacaaagaaaccaaagttaaacccgtaaatgatagccgatcggttggattgccgatgacatatcctttgtgccaggccaatatgatacagatcagatcggccgtaatgtgatgaaagagataattgagtttgttctatcggctgtatatgtcaataacacataatatgtgtttcaaagtatgcttaaaccaagtgtttaggaaagatcggtcagcacatcaagacagtataaaccattcgagtccaagaatactttaaagcagggattatatgtactcacagcatagccgataggcaaacccaacgtgtatcaggtagtactcagataccactttatactaagatatgctaaacaagaatcaatctagtgtcagggtgacctaacagactgatggcaagcttaacatatttggtccaagcgagatattaatataaagggcagatttagcgtatcaagtaaacacatatgaaatgagataactaaatcaggtaagatcggctgaaaccccgatgctatctctattaacaatcataggacatgctagatattatggttctaaatgttacttaacagatcaaacttaactgatacaacattaagcacatggagaaacataggatctaaacaagtccatgagagccttttcgagatggtagatatgctatataatctgattcgacacagctatctaaccctatcggctattttcgatgatagaggctagccgacacggttatatagcaagatcgatctagattatatagcatactagagaatgccccgcgcgtgctgcgggacttggttaacatcaatttgttagataagaggtataatctcaagaagaaatagaagaaacaaatagctttcttggagaaattcttttttagcagccctatcgaaaatttgtagataatttaggtagtacatgtcaactgaaggagcgttcagccataaaactcttttatacgattgatgggctagatacatgtagatgtgtgtggagatgggccaatgtgttcatgtgggctacatttggcactgaggaggctaagagactcacccggttggtgactgatgggttgggctctatgctgcattccatccaacgtctgagaaacaatctaatacattcatccaacggttcacaatttgatgatgatgtggaagcacgaggcttgagcttttggctttaactttatagaaagaagggatatgataactctgcggttttgcataggcagggctagagtgtcatgaagatgtaagcactagccctgagaacgcaaaccgccataacaagctttacctcttcgtcggagatcgaaatcgatgtagcccaactcgaaagcaagaactcgccgaaaacaaagaaaagtagaaaaggtggcgatgcgtcgagagtgtatttaacttgatgttatttgtttacagggtcttgggccatattatacccaaaatacatgatatgtccttgccggacacgactccacttcttttacaactcaaaaatgcgagcaagtcccttagacggactcttaccaaaaatatctataaggaaactattaaaatatcctaattaatagatacaattgccttcttcggactcaatccatacttggaagtacttgtatagcacttcaaccgatcccgacaatgttttcatgatcatcttgccaaaatcggctacatcggcttctccctatctagttctgtatcagccaatccagacggaagccgatgcagtccgtagccgatgcgtactctgtttctgtgatcatcaatttcctcccaaatctacttcggttttgatttcagatccgatctatgatttaccaattttggtcgttaacaccggcacgtcaccggcgtcgcgtacgcgccgctgcagcagtactcctcctccccgaacgcctcgcacgcgctccggcatgccgccatccacctgccactccttcgaactcactgcacatatgctcatgtcaacacaaacacgttcgccatgtacgacatgcgtgcatgacacacggatgtgtgacacgcttgcttgggcgaaggaaaagagactgtaacatcccgccactcccaggccgggcccgcttacatctggcagctttcatagatcaatcaggcttaaccctggagttctttggagatcggcttccgaaaaagaagttgcaacttgtttatatgagtattctattaatcttattaagccctaggccgggatgtcacagagaccgagcgtaatgaatgcatggatgatcaaagctgattggggaccaaaccaagaccctctccaagtctacttctacctcatcacgtcacttttggtccacagaagacaagatataaaattttacacgttttggattcggattcgggccttctggcagcatcaacttcaaatggacctagccgctgattagaaggaatttcggggcccatgagtacttgttggaaagcttatggagtctactttcagatggttttggttccacatcaaaattcctaccgagctgccggcaatctgcaaaacaagccacctatctcatccagtccgaatctgatttgggttttgggccttgtaactgtgtcgcgggcttagtccaagggggtgtgcgccctggggcaaccctaggatgtctctaatcatatttagtcagtagccgtcatcgtttagagtcgggttttacttagattaatctgtcaaaaacagtttcaccgctagatcagtttatggaacccccaaattcgagtgcttaatcattcatatgcaattttgttgcaatctatcttggtcttgcttgtgttcttcgattcgcatatagggattagccttctcggcgaggtcaaccgggtttcggcacgattgataaccagaggagacgtggtgctgcgattacagggctcagtagcgtgattgttcaaagccggatcgagttgtgtcgcccctccacccaaatcgactatttatcaatacctatcggaagatcgggagcaatagtcaacatcatttggtatcagagttgagcccttatttaaggggatgggaatgatgaggacatcctgtcacgcccagaaattcacgaaccagaatttctaagctgaatgtgcattaattccctgtccaggactagccagggtacacaaacgacaattgttgacatacagacccacgtcttataaaaatatagaagattacaaatgcgcggaaaagataaaacgagctaaacttggaagcttgacttcagtagcgggcgactccactccacaggcaacccttgacggcagcgacgaaaccaacctttatgagacagctccaactgggaagaacttccgctctggtgtgggggaaaagagagcaagactgagtactacccactgtactcagcgagtcataccggaagaggaggtatgatgcaggatataaccaaaggaggctaaaggttcatttgcaataaagtaggcatttaaaagcagtagttgaaaatagtaaaacaattgtagtaagtaatcagtattaacccatcactatccaacgctacaccacgttgcaacaggcccaacaaaccacctgaactacaccagttcattaaactaaactaggggtgagactaatcacggtgaatcaggttgatcgcccataaccgcaggcacggctattcgaatagtttttctctggccagaggtgtacaactgtacccacaagacacgattctacacatgtcgccatgccccaaagtatcaccatgatactgcaaagggggaaatcgtgacaagaccctccgcataaccctcccctaaccatccacaccacgctaaggtttcacccccacccctcaaaaggcagtgggcggtcccctcttgcgccgcggtgaatccggcagctggacaaccggacaccccggccaacccaacttcatcacgcccaccctcgccaccggtgccttggaaagggtcgagctatacttcagatcaagcagttacccactcccgcttgtggtaagcacggtaagtctcccagggtttcccgtgaaccggtccttaactgccatgggtgcgaccagccaaaccatgcacccacagctcaccattcagtgtattttaattaactaacaccactgcggtggcaccaatccaaagctatgctaatagtcaaagtctatgtaataatgtgatccccatttgtgtactagttgaactagacatggctaagcgttttcctaaaccaacatctagttattttgatacccaagctatcaatggcataaggtacacaataaatggctgagtaataggacccatcccacatgacattgtaaaaggatgcaatatttaatagaaatgcgggatatttgtaaattgggtacaatatgatcaattgtaatgcatgacttgccttactctcgcactgatgagatctcagcaacgtcttcgagaaatcgcggatcgacgaaacagccgaaatctacgggacaaacaaagcacacaaacaaaacatgctataagactactgaaacaggaaacaaaaccatttttaatggattctagggatttttatgaatttactgagacttgaatagacttaaacggagctcgaatgaattacttatgaattttagaagataagttgtgtttttactaataaagaaaagtcatcaatcaatttattgcgcaataaagcccagggctgacgccagcgaaaggggggcggcgccagcaagcgggccccgcatgtcagcggcacaaagggtggccggtctaccgtggaccaggtccacggggaggaggggtggtggtgtaccacgtggcgccgacgtggcaccacgtggctggccacgcgggccatgggacggacggccacgatcggtcgagggccgatagggcggctggggacgggcggcaccgaggccagcccgggcatggcgcacggtggcgaccggccggcggcagcggccggcgacgcggacgggcggcggcggcaccttaggagagagcagaaatagggttaggagtagggaaggcaaccacggcggacgccattgacggtcggaggcggaggggatggggaagctcaccggcgttcgggacgaagggggctccggcagcgattgatgacaatcgggcagcgaccgaggtgcaggcaggctcggtgagcgcgacggcggcgattgcgcggcgcggcggcggctctagcggcggcggcgcgcggccggagatgggtggcggcggcggagctcggcgagcgcggcgccacggcggtaggaagcacgggaaagggcggcgagagtgggaaacgagagagggggcccggggagggtttttatgggcgagggaggggcggacgtggccgggaaggtggctgatttggccagcgacgtgggggagtggagggagagagaggggtgttgggggatttcaaatcccccaccacttgcgggcgcgcgcgtgcgggagaggtggagatgggcaacgacgtgggcgcagggtgcgggcgcgaagtggagcggagaaggcggaagtgcggggcggttggagcttgggctccaacggccggaggtaggagacgaccgacaggtggggcccacctgtcggcgtcccagagagaggagggagggagcgggccggcccacaaggggaggccgagcgcggggtgaggtggggtggactggcccgacggcccaagaaggaaaaagaaagaaaagaaaaagaaggaaatggaaaaaaaggatttcctggggtttaaatattgcggttaatgaattttaattggttaaaattacttatagggctctgaaaattcctctaaaaatcatgttaatgtattggagcatggggaactcaagaaaaaatccaccacgccgaattcgattattaaatgcatttattaattgaggattagctctaggttaattcgaatcatttcttcggccgatttatttaacaaatttttaaagcaaggaaaaggggaaacttcagggcgtgacacatcctccactattaactgctggtaaagacgcaacaaggggccaagtggtccagttgtagtcggacggcaaccgtgtgagcctctgaataatcccaccttgcttagcttgggaggaggaagccaccttaaaagggagagccacgaagccctattagactagtcttttagggagattgggcatttccccgaatggatgtgcctaagaactgttggggttcgggcaactttaattattgggcctcggccaacctcacctgggccggatgtattaggtggtggcacggctgccgccgcactccaagcgatcgccgcagtcgctggtctagcacgcggtcgcgccaccaccgtcgaccggcctgcctagggagagaggagcagggagggagacgtgggtcctacactgactcacccgctatgtcggacaaaaccgtgatcaaaaccaccgaaggatgtaaagcgaacggttttgtaaattaagtgatgccattatatggttttgcggttgggagacgattttgtaagtcgatgacaagttgagggaccttgggtgtactttttccaatcctggagtacagtacaaagaccgccactgcctctcgtggaatcgtggcccgtgggtatgtgtcaacgatcggcatcggctgctctactgttgctgttttgggctgagccacgtgagctgctgtttgccgctcgcgtccgccagtagaggatgaaagcccataaagcccaccactaccgtctttcaaagcccacaaagcttcctcgtgttcgagtccgactgcctgtcgtgcttggtaccctatatatgttgagtcttcataatctaaaatcgccaggtctggctaatttttccataataaagaggtttctgtttttttactcaatttttcccacatagaagattgaaccctgttgaaagctcacccggacaaaaggtcaagtagattttggtcaagaaaagatcaagtagattccatcatgcagatgcgatcgtctccgcccatagttcttacgggaagaagtgaaaggttggtgtttctttgaaatttgtgatttacatcgagttactctatgatccattattgctcctaataagtttttttttaattacacacaaacgcacgcgtgcacacaccattacacgtagcaccgcacaaacatcctcgcaaatacgtaccctagaacacactcaaagagatgaaaccaaatgtatatacatgatctcataagaaatcatctacatgtacgtaatatttgtaggcatcaggatttgaattttggtgggtgcctcctaaagagtttgatctgtaagaataggtgaaatcgaagcttgggcccttttgctctgatctagtaattgagaatacatattagtattttaagtactctacgctagtgcatattccccaatggctttaccacatgttaagatagcttgacccactttatacggacgctatccatataatcttttgtgcgttgtgtttacacaataatgtcgcacattggagtagtttacctacgattgcttaaataatgctaaaagacccgctgcccacccaaaagtccgcaactctgtaaccgatccaggccgcagccgtggcccaagaagcccaaaaggcccgctgcccacccaaacgggtcgagtgacctgcgcacccaaactgagggcgtttagttgtcgtcgacaggttgcggccgcgaggggagcggagaaagggggggaaaaaagatggaaactaaccctaatctcgatctcgacggcgagggcggcgccggcgccggcgcctcgtcgggccgttctttgctgccgaaaggaagtggtaggttccgccgctcgtcggcccgttgttcgctgccgaaagggagtgataggttccgccgctcactatcgccggtgaactcgcggtcgctcctagaaggacgggatgtgcgggacgctgttttccccaacaaactcttcgataaagccttcggccagcctcttccgtaagttcattcatgccctccctctccacacccatgaggccatgagcatgacttaacctaagaatcgattgctgccgcagagcgcccgtaacgccgtctctggtaccatcgcccgcttacatcgtgcgccccaacctgccgaccccttccgagccacacggattgaatttcaagttgtgcatgtttacccttagctctattgattgattgagtgattgattttactcccctttatattgatttccttgttcttttattcatctgaagtgccccacttgttggcgatgggaagatgcaaatggatgtggagggtgccccacttgttggcgatgggaagatgcatatggttgtggagagtaccccacttgttggcgatggcaagatgcatatggttgtggaggaggaaatgacaacagctctggctgttcatcagccttcaagtcagagaagtcagaggtacttagcacatcttctgccataaatcattcatatataattagaagtagcttaacacatgatctggaaattcctttaactcaggatcatagtgattgagatgatggcagatgttggctcaccttcctctcctggctccccctactcccctagttccccttcttctcatcgagacgctccctcggtccgcttctcctctcgaggcatccgtaaccataagatgtaagttggttctcctatgtgcgttatgtttttgcatatattagcacatactgctgattattaacattgaaattaagaataatagactaaaaattaaattcgtaatgaaacagcacttgacaccaccatttttgagatctgaagttttatgattcatatatgctacttcctccgtttcatattataagactttctagcattgcccacatttatatatatatattaatgaatctaaacatatatatgtctagattcattaacatctatatgaatatgggcaatgctagaaagtcttataatatgaaatggagggagtagaccctagagatggatggtggtaatgcagccgttgcttcacttatttgtgcgctcacttgttaatcatgttcaccagctggcctcatttctcccactccgatgtgtccatccaagcatgttctactatcactctaggctgtgaatatgttgggtgggggattggccatctggtcagtttgggaagtgaaagttacacgaaccattggtactttgggcagatagtaaatgttgggacctaggagatccacggatagaacagtttagtacatataaatgtttgatatatctaaggcttataatttatttaggtctgtaatcaaatggtatatatgttattgacatgagaaaacattttgtagtcaataatacagaggggtgagatttatcatgttaacctttgaaacttttgatgaaatgttttaggcctcagtgtgatatagacagatcagacactgaagaagatctatattcatcgtgtgaggaggatccctacttcaatagccttgtggatgatttcatcggtgcagttaccagcaccgatctacttgcatcatcacctgaaattgactatatggcagctaatcaaagtcaatctcttttctatgctgaaagtgcattaaaacattataacaacaatgatgagaacaaggtaacttttttgcatttcttttgttgtattttctatttatgtacgaatctggctgctagaaatctgtttagatttgtttcttacctcatgctatggtgattagccctctctattcttgtcatggctttgtcatttatttgtagttatctccaattgttcccagcaataatcagattaactcttaaattaaaagttgtggtaggtcggtgaaatctaattcaattttaacttagagcatggacttagcacgccacacagttgtttgatccttttgaatttttgaaacaatattattttttgtattttacttatcttccaaagtttgtatatggctttaattattttgttgtgataccgctatccaagattcttagtattttttttattttccttaactagcaaagtacttgccttgcaacggatttcaaaagatatgtccgaagttcttcacttggaaattgtatttgccaaacataatttgcaagcaaacatccagcaaaaaaccaagccacacacacaaagatatatttatctagacttggaagatctcactaactccaactgatggcagattcaccaccaccactaggttcttttatatagtagagattttacatgtatatgtgttaaatatttgtttactgacttttattgtctttctatttgaaatatagataaagtatgagttaatcagtgccattacaagcaatgcaattatagaccggagtggttatggtcatgtaaactttgttgcaaaaggggatctacctgattcagtggatgagttctttttcgcagaagtacgttgggacattgattcttatgtgccagtttgcatggtctccttagaagggaaggaaaaatctggttagttcgaaagataaccgaaaactctattaatctgttcttttcttctaaattttaacatgtatatgtaattgatgtgtacaggtggttaccgtgacattgaagtcgactatccaagagaggttttgtgggtgttcccgtcgataagaatcattgctatgcttgtggcgatggactcaagcatccagaggatggaacgttatatgagagtggtcatatcgcttccggcagttattatgactagcagttttattgaaattgcatttttagaactttatttagctagactagaagtgtgcaatcctttatatctatgctaaactaaattagtacggagtatactcaccattctactttgtatacatcttgtttgatttgggttgaactccgagttgtatgtgatacacccgaagacgttattatcgttgcaaatattgaaaaagtcatagaaggtggcaatccactcctgggagtggggatggatatatgttgtcacaagtatgatcctatggacgggactagcaattggacatgattttaggtagattgttgaacggtgtttcattacttgttaaaaaataaaatatttatgtttcatcagttagtgtaaaaatgttttaaccggatgtatttgtttattgattacacacaaataaaccaacagtagtggacataggggttactgggttattcccgggaataccaaaaatttgtgaagtaaaattgatatatatgggtatacacatatgtaagtatttaattagatctaatacttcatcatcgatctgttttttctcaacaaatctattcttctggaatattgactcacatcacttctaactagttaactatctcaaatcccctaactctatcccactttttataaacaaccacaacaactctatcccactaaacaatatggatgaaatacttgcgattgttcagtaaatacccagatatataatccgcatccgccaaaccaacatgtgaaacatcaaagaaaactaactgcaacatcgagaaaaaaaaatgttattcaacacatttaagacggcagagggcgaggcgtcacacctttaacgagacaatgcgcatcatgtgcaagtgtaatatctgaccggatagagtaaaacacttgaatacaccgagatgcaacaaaaaaaaatgataacaacaaaaatctttagactctggtaagatcctaccatctaacttcttcctctatttcgatggtcggatacgttttcttactctagtccagtagccagaaataagctacttgtggatgcgacctagttgcggcagcctccctcatctccttatccatagccatcaccatcacactcacacatgagcctcattgcagtggatattgtctccacttcgtgcccccactgccgccaccagctttgtcgtccgctcgtcatcactgcgagtcttcatcgtcattgccaaaagccttatctaagccatgcacccccatcggcaccgcaagctttattgtcgtatcacccactccggtctccactccttaatgttgttggaaagtttgtttttgggatgaaatgattggggtgagagagaggacacgtaggagatggagaaaagcaaaaaagattatgttagcgtggagctcaccacgctaaccatccaacactcaaatatggcaaatgattatattagaggagttgggagttttcattctgaaaaaaagggaatatgatacgttgatggatattgacagcttcgatctcatgtttgccatcgctcgatgaactcacttagaacatgctcaatgtcgtgaccttaggccattcacagtgcaacatgtttctatgaggagcctcaatatgccacataggacgagatatcgagtatcaattctctttatcccatggtgcaaaggagctctagctgtggctttaattttttatgtcagcccataacattttatatttaagtcctcgtagtttttttaatttagagaatggttcgaattgtacacaaaacaccctaaaaaagggaagcatgtataaaatctatcatttctcattttccacattccccctctagcgccgccgacgcctctcccattccaacccccaccagcacctctcccctccccgccagcgacccacgttccactctgtccagtcgccatcgcctctaccctctccctggcaccgcctcgatccgggcggctgtcgagcagatcaacgcagaaatgaggccgaaggcatctccggcgccacggcaaggaagttgcagctccgtcctctcttccttttccagtaggcggcagcgggggcgataggtggcagatcaaaaatgggctcgacgacggcgggatcggtggctcgctggcaagaaggcgaagacgacgaggagggctcctatggtttagatccgaggtcattgtgaaagggacaacgtacggcgacggtcccatgtctcgccgtcgctgcccctttctctggctgccggacttgggagggacactgggttggttgtgggcgtgggggtgtgggggcccccacgcatcacgagggcacgaggaggcggggacatgacctccccaacgcaagttcttcctgtcgcttcacctttacgcagcctcagcctgacaaaacctgacgtgtttcgcgtagcaaccttgggacatggcaaccgaaacccttgctggcgcaccgaggcaccatgaacgggctaaagtgatagctgtgatctctagctaggcccgaattcctgtttaggggctcaagtgccaacatgggctgtgtttagtttttaaaattggggagaagtttaggaaaagttggtagtttagaaaaaagttgggagtttatgtgagtagaaaagttttggatatgatgtgatgtgatggaaagttaggagtttgggaaaaatttggtgtgaactaaacaggattttgtgaaacttgaccctcataacgaagaaggattataacgtgaatgaatgttttgaggagatccatctgataaccacatgattacggccccgtcgacgctgtgcaccaaacacaataaagacatggacgcttccagaaggagccaactaggcaaccgccaaccgatcggaaaactctccgccacgcgacgcaaacgaatcgcacttcgcagaggcgaagcgaagtagcgctgccttgccttgtcgcccttccccttcgactccattccctcccgcttctcgcgcaacgctatcccgccgccgccgcgtgtctccccaatcccaatcactagcctcctccgtcgaccgtccgccttcccctgagggcggcctgcgtctgcgtggctgcgccgtgccgccgtcgcgcccccgcagcttcttgcgtcttgctgcgcgccgtgccacccgccggcgcctgcgcctgcgccttcctttaccgggctaccaccctgcgccgtctctgactccccggccggcggtcgccctgcccgctgctcctgcacggcgtggctgcaccctagcccctgcccataactccattgtaacaccgcccccagctcgattgccgcctgacacaaggcagacagaggtatgaatctggccttgaattgaatagttgtgagtcttaatcggtacggaactatggataatgatgcaaattgtagtgaatcggcaatgttaatcttagaagagtagattgtggtgcagattaaagaaattgtgttgtacttattttatctatgtaagatctttaatatttgaattatttatatttatatctttgcaactttcaaactttaggtgttgattttagtcgatttgtgatgctatgagatacaattgctttattatgtcataatccgagcaaattttgtgggctaatggcgttattaaattttggaacatgaagtaggaacacccaacaagaaattcctggagctgccattgcggcgctgccttccatggagaccgagggctggcctgccctccagcctctgctgtgcctcgcctggatcgccactacactccccatcattgtcgccgcgctgccaatccccgcagctgctggtggtcacctccttcgccggctgctctcggccttctcctcccgcggcaagaccgtgaggccctcccccgcctcatcctctggttcctcctcttctaaggcggtaagatcggttcaaggtgccgcagcacctatttgctgcttcgccttttctgttatcattcgacaatcccatggagttagtatgattccttggtaaacgaagcttggttagaccttgataagttaagcgaaacttgttcaaagcaaatataggtttgggttggtttgaaaaagatataaccgtggattgtttaaggccaaagtagctagctactgttttgtagtgtttagttgatgcaaatctgaaatattatcgattgattgtgagaagatgatacatttggaagaaattagttcttaaatgtttgggaaccacagttctggacttaaacaatttttttaattggtgtttgtctacaggatatacagccagcttttcttgtcaacttggagatttagttatgctaacttagctatacgaaaaatacataccaagccagttttgtgagtaaaaactaacattatatagtaggatcgaattgattcctcatcggcttttcttgagctatttttcatccaattgatgatcaattgcacatgagaacacgcaccaaatttgtagttcttctcatattcaacttctgtataatgctgataatctcagatcgatcttttctaatctgcagaagttcactgttccacaaaaatacttcatgcatttttatgtggtcggagtgctggcaacaacaattttgcttctggcaatatggttctatgcatatatgaaaatgacaccattattgcctgagtcatcaagttattccacaattgccagccatcttgtaggctcaaattcattctcttttggtcgtgttcactcgcgcaccatgggacacaagtatcatgtctggcgaacagtatttgtacttctattgatggaaattcaagtgctgagacgactatatgagactgaacatgtgttccactacagcccttctgctcggatgcatattgtaggatatttgacgggtctattgtaagctccagcttgctttacatcctttatgttctatatctccatggcacatttgttgtgaaaaatatcccacttgattagttatcatgtcctttactttattctgttgttatgttacatgattttgcttaaaggtttctaaataattcttgtatgcagtttctgcagctcatacatgtaggctgtccacaaaatatacacacatctaatgagttaatttactgcatgatttgtcattgacctgaactgatcaaaagaaataccacttcggtagaaaatagcccaagtgatgctgataactgaattgttcaattcttgacattttatttgctttcttctgccatagtgcttatattaggaagaggatatgcattcatgctacccatgatatttttttcatactattgttgttgttcttttgttttcatgtataacattttcagattgacttatagtttggtttttcttcatgccagctattatgtagctgcaccattatctcttgctagctcttgtatccctgaagcagcagagtatcttcaaggtcaagtagctgagttcatagtaaagggtcgtgcgagaatgccagatcttgtaattgattcatcatctctactacagcctcttctgaagttggggtggacccagtggataggtgctgttatattcatttggggttccctccatcagatccgttgccatgcaattcttgtaagatctatatgctctctaatgtccctatgaccctagatatactagcaagtttcttttacatatatgggcagcatcagaaatcttcctaaaaatgaaaagaaaagaaagaaagaaatccacctatatatgctgtaagttggaactgtcaaactgcaaccataacttgttagtgtaaagctgaaggtatggcttgctggaagtgttctattttttgagagggtggagcccaccaggctttaggaaccccatttacacaaattgcttggtcaatcaacatcaggaatccttcatgaaatgccaatcagattcaatgggttatgcattatgcttgttcagaaactgtggtattatgcattgttgtcttggaaacttctaggctgcggtctatattttgaatttcatggtttgttttttattgcttttacagggaacgttgcgtgagcacaaagattctgatgaatatgtaattccttgtggtgactggtttaatcgagtctcttgccctcattaccttgctgaactagtgagtgtcttttctatgtcctcattttcagtatgtggcatatactgttttgcaaaatatggcaggtcttgttaatctgcttatttaacaacgtcaagttagattaggcctgtccatattgtcttgggtttgtcaataaaaatcatcttggggaagtttggacgggttccaattggtggaagcactagactgattagctcctggtccagcttcaactcctggctggaataggttgggggaaaaacagagaatttgcatgttgcttttgctgggatttagagtttttacactgaagctgaattccagtgcagacttctcatcaaatttgttctgttacctatttcatcactgtagttctctgagtgcaataccatgtgagagtgaatatgtccttttagtatcacccgtactgggaaatgcaaacattctttgcatggcttaaatatgataaaacaggataatattttctgaactttcatattatttcacttgtgtgaagcaactagatgactctaacatgacagcacatatgtttccatgtagcagaattggtgctgtttgacttgacagttgatgcagtagggcactgagctactaaaagagctcctgttgttttaaattattatggcattaacatttacagttactttggcttgtaggtaatatattttggcatgttggttgctagtggtggagaagacattccagtgtggttcctgttcgtatttgtggtacgccctacagtaactttttgaacaaagatagtcagaattcaactaacgcgcaattatcttctacatttagtttcttttgttttttgttccagtagattgaactatcttttttctttttcatttttgcagatcacaaacctgtcatttgcagcagtagaaactcacaagtggtatcttcaaaagtttgaagactatcctcgctctcgctatgccatcattccatttgtatgctagtgtctacgaaatggctacattatgcaaagcttatgtatttgcacacaattacgacatgtaacttagcttgatgtaaatgtgataacaatcatactacgtaccaccgtagaggctggaagtgttgtattgtataacgtagccacgcagaatgtacctgtgacacttcatgctgtgtgttatgctacacacttggatatttatcaacattcttaagcatcgggaataaagttcttgcagaattggattggaaaatcttcaagctgtgacaatctaggcaatgtcagttcctgatttgtgacttaatatcagagcacctatgtacgttaccagtagtaatctttgtgcttctacatatttaaattacatgccaattatgtcatcgatgaaacatgtttggtaatttaaacttaaatgttcgcaactcaaagtgatctagggtatgttgtgctcgtcctttgtagaaggaaaaagaagtgccgtcatgtttagagacctaaatacctgatctggtctggaaaacggaatacttcaggatttatcagagcgataccatttcaactttaagcaagatactttat

SEQ ID NO: 72996 - DNA, 743 bp, Oryza sativa
atcaatagtagagataaacttttggtctttagatgtgtagacttgagatgtataaaatttggtgcgtaaatctatatctacatctatatacctaactatacctaactaaaaaataagtaaagcttaactatacctaactaaaaaataaagcttccggtagggttttctcgtccgtcaattttttttcacacgcggtatttttctcacgcacggttttttatccgattccggtttttttacgtgcgttttttgcccagtttttttgtccgattgttttttagtgggcccggttttttaattaaaaaataagtaaggcttccagtagggttttttcgtccgtcaattttttttcacacgcgcggtttttttatccgattccggtttttttacgtgcggtttttgcccggttttttgtccgattgttttttggtgggcccagttttcccccaccgcgtccgattttttttgggcccggttttttatatacaaaagaaaaaaaaccacaggaatccatgttcaccaggttcacccacaaaaacacagtagtccaggttcacgcacaaaaaacacagaagtccaggtcacacacaaaatatagaaaaaccagagtccaggtttaccaggttcacgcaagaaaacaatatcgcatacgagtcaggttggttcgcccacaccgttttctgcttctgtttgcccagcccaagtcaggagttagattctatcccgagtcagattctatcccg

SEQ ID NO: 72997 - DNA, 948 bp, Oryza sativa
tgggtgagtacgacttacccctctagacctaaaaaccaaacatctttcacccttaactatcaataccagataaaaaaccaccacgggtagctttataagcgattttgatcctacgtggcagtccagtcaacaattcttctattaaaaagttgatagggcccacctttcagatctctctcctcattatctatttcgctcctcattatctatttcgcctctcagacccctctctcttgtcagatgccaaggaggagacgcgtcagcgactgcgtgcgtctcacggcggagggccaaggcagtggccagcgacagtgaggaggcaggagtggcagagcggggcaagtggcatggtcttagtcgagccatgtctcgaggtaggcgtgatgcaatatgtggctgcagggagggcggttcaccaccgcatccgcctcgaatcgcactaggcagacacggcagttcgtcgtcagcccgtccccatcggccgccgagagagatggaggtgaggggaggaataagaagagaggggattagggaaagagagtgagaggggaggagaaagagatagagagggtgagagactaataggtggggcccgctgattttttttaaaaagaaattactgattggactgacacgtaggatcaaaaccacttcggcttgagtgggggggggggtaatttccggtattaatagttgagggtaaaaaatatatggtttttgggtttaggggtacttcgtactcacccaatagtttagaggtgtaattcggacttttcgcaaaaaaataatgacatcaatttttatgattcagatgttccatcaactctcacgagtacaatgcatggaaaatcgaagtataagaaaatatgatttccttgtgtcatgaactcgaatgttccttttaagtcaattccattgatttttcgttaaagtactaaaaaatattaa

SEQ ID NO: 72998 - DNA, 713 bp, Oryza sativa
actgcaagtagttcatcacctgttctattttccagcaagtacaagcacaaattgaaattacagacctgataaaacagattggggcactgacgagcctctaggtacataaactaaatatcgctgaggcgactatccaggaaatcatctttaatgttaatgatagctccggaggggaacaagcatgcagttcaacaatatgttgcctcatttgtagaagtcaaagtcagtctcaggcttcttgacattggttcggtaacccttctcgaagtccttggggaggataacataccgatttttgcgcacagcatgcataccagcttcttgacagatagcagcaatctgaaaaacagaacatcacaatgaatttcagaacagcacaagggaaagcgaatataaatgcttacagtatttattgagcaaaagctgagcagagagtaaatgtgcatgtgtagctgccagcaacatttatgccaaagcacagaattacaaatgaaaagaaaagtttgatgatgaacaaggctttaaggaacctctagggttacaaaaattattagaacatataaaggtaatctattagaggtggtactttcacataatgaaaataaaaaaaaaggtgtggtaaactacagtcatgtaatgaataaaatagaaccctaagatttggaaggttctcgaggggaaacatatatcttagattttgatgttattaactt

SEQ ID NO: 72999 - DNA, 651 bp, Oryza sativa
aaatcgaagcatagaattcacagcttggaaagcaaacatctaaatttcagacggcaaaacaaaaacagatacatctaaactttgtcatcaattttctacccaaggcacttgtgatttaggtacttgagtattaaatttccgcccccttggttacgcagccacaaaacctttccacaaggatgctaagcaaacgaagaatagatatacaaagaatgatatataccaattgggcacaaaagaactaatgcacagaaagttcaacagcctcactcgcgacgattacaatgacgcgatgggagatgtgtttcaactttgatgtaaaatactcggaaaacattaatgcaaaataaaatgcctgaacatgtcaactttaagaagggaaaaattgacctaaagaagggagatgatgttagatcatactatcagagggtagtattgcttgccccattattattcgttggttatatgtaacacctgatgcccaggaaatagcacaagcatattgaaatcatcaaagaataaaaacaaattatatgcaggaggcgtgccactggggctaattacatattgtactttctaatgcctaattacatgtatgttttcatcgcttcaagcatgaatttgtcacggttatccataggacaaaacatg

SEQ ID NO: 73000 - DNA, 1089 bp, Oryza sativa
agggagagaaaggggactttttatagtttttctttttataaaatcattttaactttgtttatttcttaataattataatttgtgctctgaaaattccactaaaatttatttacgcattttaggcttttaggaaatatacaaaaatcctccaagccttatttgacttttaactttgcacgttttaattgtgggaggctttcacacggattttaattattctaggcataatttagaggatgtattttagagtcgttttgggacgtgacagcccacatgtcatcctttctcctccctctctctcttttctctcccccttttctcttccccttcagacgccacgatggcgccggcggcctcgtcgtcaccggagctggagtgtcacgaccggaaataacccaacgggcgttccttacgtgcgtgcattattccttgtcctaggaggcaaggtacaccaaaagttgatacaattcagagtttaacaagcggaagcgtaattaattaatttattacattggaggcgaagacccagcacacaagaagacaaacgaaaaacagcggaagactagggcgacgaccacaggcgcttgacggcaggcacgagctagacaccaaagccttcatcttccaggaactcctcttctgggtttgggaaaaattgagcaagactgagtacaaccaccgtactcaacaagacacacccacaagtgtagaataaatgcaagggagtacaagggaaccataatatagggggttagggtttgcagtaaacagcattaaaagacacttagttgctcaaagctattttgtaaacacggtcctagagctatacaatattattaatcaaggctgtgaacccacacgaacctgccttaacccaaggcctacgatgattagaccaaactggcaacccaaccttgggtcccagctcgtcccaagccaacccaggccaaccattccacattttagttgttaagcagcgttttaagaattaaaaacactaacttgggtacattgctcggcttgcccataaccgagggagcggctattcgaataggttatactctgatcagagggggacatctttaccca

SEQ ID NO: 73001 - DNA, 7911 bp, Oryza sativa
  unsure (1)..(7911): unsure at all n locations
agtggggcccacgcggcagcctcacggtccacggtggaccggatgcacccgggctcgcaccggccggcgcggtatgccccacacgtcagccgcacccaagggcgcgggcggctgacagcggggccccacgcggcatccactcggcgcgcccgagggcgcccacgccggcgcggtcgcggtaggcggcgcgcccacgccccgatggtcgccgccggcgaccaccggcgcggcggagcggcagccgataaaggggagggaagggggaaaggagcggatggtccccggctcaccccggggcgacggtgccgacggaggaggcggccggaccagagggaggtgccggcgcggctcgggtcgacggggtcaacggcgttccggcggtcggcgaccgaaacggagaggtggacgaggttggcgaggatgcggcgaacctgaaggaggcggcgccgaggtgggaggcggtccggggcgacgacggcggcggaccggagcttggcggcgacggtggagagagagagagagcgacgtcgcgagctcgaatccggcgaggaggaagggcggcgagaggcggaaacggacggaggaggtgcggggagggtttaaatagggttggaagggggagagagcggccggaggggaaggaaaccggcgcgggaggtccggccgccatcaatggcgccggcgagatttgcgggggcaaatccgcccgtttgaacgcaagatatagggaaaaatggggggaaagggagaggggatcacggggagtgattccccccactttattgcacgcggggacggcgggaggcggtaggattcgcggcggcggtggcgggagcggcgggaggaagaggatgacgggtgggccccacccgtcagcgagggtggcgggcgggcccgcccatcatcggcgcgcgcgcggggagggaggccgaatgggccgcgggggagaggagatagagagggggagggagatgggccgaattcggcccattagagagaaggagggattttagggtttttctttttataaaattattttaactttgtttatttcttaacaattattatttgtgctctgaaaattccactaaaatttatttacgtattttaggcttttaggaaatatacaaaaatcctctaagccttatttgacttttaaccttgcacattttaattgttggagactttcacacggtttttaattattctaggcataatttagaggatgtattttagagtcgttttgggacgtgatatggaggccccctcctcctcctcctcctcatcctccgcagagaggcgcttctcgtcgtcggagtcatcggagttgtagtcgtgggcgcgcttccggagcagcttgaagatccgcgacggcgacgacctcacggccgccggcgacgggagagagagagagggagggagagaagcgagcgggagagggagagagaggccaccccacgcgcccctcgccgtcgtccaccccgcgcgcccctcgccgtagtggaggagccgtcggccaccccgcgcgcccctcgccgtggtggaggagccgtcggccaccccgcgcgcccctcgccatggtggaggagccgtcggccaccccgcgcgcccctcgccgtggtggaggagccgtcggccaccccgcgcgcccctcgccgtagtggaggagccgtcggccaccccgcgcgcccctcgccgtggtggaggagccgtcggccaccccgcgcgctgtcggcggctccgcgaggatccgcgacggcgacgacctcgcggctgccggcgacgggagagagagagagagggagggagagaagcgagcgggagagggagagagaggccaccctgcgcgcccctcgccgtcgtccaccccacgcgcccctcgccgtggtggaggagccgtcgtccaccccgcgcaccgtcggcggccccgcaaagatccgcgatggcgatgactccgcggccgccggcgatgggagagagagagggagggagagaagcgagcgggagagggagagagaggccacaccgcgcggcctgcgcccctcgccgttgttcacccagtgcgtccctcgccgtggtggaggagccgtcggccaccccgcgcgccgtcggcggccccgcgaagatccacgatggcgacatcctcgctcccggggtgggggatggggaggggccgtcggcaccgccgtccagctgcgacatggcatggatcgccatcgacgtcgtcaccgttggagagaggggaagggggaagaaacgttggggagaggaggaccatgtgggccccacagtcagtgggtccttgtattttttggtgtgtgaatgacatgtgggtcccacacatctatttttaattctaatattacataggcgccacgtcaacgccacgtgtgaagaagactcggtcaacactgccacgtaagtgccacgtcagcgaaaccaccctccaaaatcactaagggagtcaaattataccggtttcaatatttttgggagtcgttctatctggttttgtggttaaggggcacgaattagattcggacgacttttaagggagtcaaaatggactttttcctatttttttctagtttttctttttaataaactttgctaattgttattgttgcttaataattattttcggtgctctgaaaattcaagtaaaatttgagggctcattttagaccaaggagaatttattaaaaattctccgggccatattcgaatttttcttgtgcgcattttaatgtttgccaatttcttttcgcattttaattaattctattattcctttttagagaatgatttttatttcgggatgaatttatcaggacgtgacaaaagcattgcatttcttacatatgcactacaactcttagaatgtgaacaaagtgatccaagtggtagaagtattttcaaaaggcccattttgacctaaagttaaaatgttgtgaaaatgataaatattcaaaactactagttggacactctttcaaaaggtctttgatatgttttccaagctttagtttgcaaaaaaaactatttgtaggatcttgttttggagcaaaactatttttctctctacaaagatttataaagggaatttgaaatggatcccaaaccaagttagagagagttgacctttcaaatgtttttggtttttgaatctcatccaaaagaccaacctattaaaataaatttgatgcgaaaactcaccaaaaatcttaactagaccatatatggtcactttctagcacttgggtgagtttatttcttaaacctgaataattgcatcttttttggctcaaaatcatatttgaacttcatgcatattagtttatctcaaataccatttcattttcttcttttcgcatttttggaggaaggtattttaaaagagagcttttgtagccttttgctaaaacatggcctttactatcaaatcttgaattcatggagcaaaaaggagaattgcatcaagggggagcaatctgaatcaaacccatatcccccttgcttccaaacatgaatttttcaaaaaggttgcatccataccatttcaaaagagcctattttggacaaaagtcaaaaatcttatttaaatggcccatatttgtgaaaatcctttcaaatgtatcccaatttgtatttcaaatgtttttcaaggcctttggagtcaaaatttccatttgtgaaacaaaatagcaaaattggtctcaataggatcttttaggatcttgttttggctgaaaatgttttattttcctaaatcaaaatctattgagtttttagaaaagttttctatacaaaagttttagagttggtcattttaaacatttctctagttcaaagttttcccaaaataccaaccattcaaactctacaatcttttgaatttcagctaaaatcttgacttgactatttttggcctaaacttgcatatggtgtgttaagcctttagagccaaagttctttgtgaatcttggcttggaagtgtatctataaccctcttaaggctttacaaatgtcaaactccatggatttcaaatttgaatgtgatttgagctctcaactcaaatttactcaccctaaaggcctacaatgctcattttgtcatatcttttgatagaaaaatgatttttaagaaattattttttggaaaagttcctcacaagtataaagatcatatctgcaaggtttcaactcatttcgatttgatttgcaaagattttgaccttttctcattttgcgcagcttgctgatttttcagaaaaagactgattttgggctgatttgtgatttttgtatctccaaatggattgcaaatttgaagtagcttacataacgacttttgatcctcaatagttgaagtttacttccaaatttacttacatttttcagtggtcatttggatgccttttgaacctcatattgggtctccaaaatatgaaaaagcctgaaactttcagttggctaaaagcttgtgagatttgtttcttcaattcggttgagatcttttattttctcccaaaatgaaatttttgcatttggacatgaactatctctaggatttatggcatatttttccgagccttgttccataggtttctattgctaaatgacgccaccattgctatgtgctttttcagctaaacatggattgaaaagtgcatatcacttcttattgattatttgagcatgggggtgaaatataagatgtttcaagtactgagctctatgttattttgaaaacttcatgaatccttgagctcttttggatgtgttccttgcttgaactcttttggtttttgaaatgcccattgatatggaaaaaacccccccaaaaaaggggaaaatctaaatgtattttgactttgaaaccaacctcatggatagactcgaaattccaatcttacccaccaaaatacaaattgatccttgcttccaaagctaactacgatatcttgancctaccatcccaaattcaatcttctatatacaactggtctctcaacaaatggtcgtatctcatgatcatcttgaacccaacatttgctcatcattttcattcctcaccgatattacacacttgagcaacatacttccaatattcttaaccaagctcctcttagtgcttgacattcttgagaaaacctttggtgaggatattttaagagaaagtttaagtgctcaaactcaccccttctacatatggaatctattccaaattccctatccaaatataagcctctattagtaagggggagttttcctaaatggttcttttctaaatttgttgctttgtgcctcaaaaaaaattatttggccttgtgagtctttatttctttttgggcttttgtaattgcctattttctagctctttttcatttttgggtgattaatgtcaaaagggggagaatatttgaggatcccacatttgatcttaaagggagagaatatttgtgatatccttatgatcatagctataaaagggggaaatattctaggatcccacatcatagcattacatatgcatcatatgcataagcatgtcattggcatatatatcactcctatttactcaatgacatgcatggatataaatcaattgccaagcttcaatacaatgataatttatatgcttcatatccaaatgtggttattattaatggatttgtcatcaatcaccaaaaagggggagattgtaaagtcaagtgccttaatttgggtttggtgattaatgacaaatctaataatatgagactaacgtttttatgagcttttctttgactagtctcgtttggatattaaaataaaaattattagaggtatgtattaaacttcacatattctaacttggtctctcttgtggatccaaaatatagtgtgagctccgtcactgatcttgattgattatgtatatatgtgttcctttatatccatatgtatgcacatcttgagggggagcttattctatattttatttagtataatatctctaccttgatttgaaattatctttcatctcatctctctatattgtttatatcgggttattatctatcacaaaaagagaaaagattgaaagatcttggattaaacaatttgtgtaattgttgctttgatgatagatgataaaccgatgtttatgggattaaactctctttttcataagttgtcaactaggttatttcccgatgatgagatgtggtagatatgcattctttggtgatggaccttaatcatgataaggatgaaatgcatggagataaaacgatatgtaccacttcttatctcctactttttgataggttcatatatatgatttccatgttattgttatataagtgtgagactaatgtttactcgagtcgtatcttatttagtctcatttacattaagaacatggagatcatgaatgtatgtgttttatgttggtttacatcattactacatatgccttctctatgtgtataggataaacccccattggtcattctctaattatgcatatacttcttccatctcttgtatatttatttgtatgcatatatttagggggagcaaatcctatacatttattgtgcatgttctagatccctgttgttcacctattatttatatcggatctttgcacttgagcttgcatacgagtatatgacacttgtgatgttaatgaatactcaacaaacatatccatatctttcatatgcaaccggttggtcatcaagtgaaggatgacaaccgatttgttgagactaatgttctccatttgagatgtgaaaaggaataggtcccactacgatgaggctaatgaatgacaccatgagttaatggtcaccaagccaaggacatcatcatgttggcaagaatgaagtcaagcttgtgatgagaataaagtcttgacaaaggatggtaaagacctcggcataaatatggttcaaccgaatggtaacaagtgttgatgttggctcaagcattgaccccaagttggatggcgcaaggcaaaggtataatggagctaagaatgttttcttagtctttttcccggtttcggtgtttggtgtagaccggatttgctagatagacgccgcactatcaagaggggtctatgaagcgagcatgtgtatgatcttgtgccatattagttcatatgcatgtaggttcatttggtgggctcgtcaagccaagtgtgatgagttttctcatgtcccaaacaaagagagaagtgagcacgtccaataggagtgagtgacatcttgtgggtatgtccggtgtatatcctttggagagtgagccctttctccctgtattaagttgtgtttcttggatgaattgttcatgggttggatagccctttggataagctttccatagagtccaagaacgtcaaattccgagacccgagtcaagagatatcgccgttttactaacggccggttgagctgaaaagtgacctgcggtctaaccgctgccattacggcggtctgatcgaagtatgttgtccggtctaaccaccactcccatggcggtttgactgctcatcctgattttgaaggaggtctcgtcttggcgatccagagccgctagagccgcagccggtcagaccgagcccctggcggtctgactgagccgtggacggtctgactgtccgctacactgcggtcagaccggccaggtagagtaggctcaattattgccctattttctagccgttacaaagtagtctggtctgaccggccacactatggcggtctgaccggcatagcatagagttgggtttttcgaccccaacggctagttttgttgattgggggtatatatacccactccccagcaacaagggcaaggttttggcactccattgcattatcttgaacccttccaagagctctcacacccatgtgcact

SEQ ID NO: 73002 - DNA, 2617 bp, Oryza sativa
aggtgctgcccggcgacccgaaacatcgccttcgcctcaactgctgtcgaccaccgttcgccacccatcgccatcaaccgccatggtgccgtcgtcttcctccatggtgtgtcaccaatctatgggctgggatggtggatccattcagattcagaaaaaaaaggaaaaaaatgaagtgggggtaagagtggttggctgggtacaagaaaaatagaatatatattggaagtagggaaattgtttttatcgaaggaaatcgtttacttcgataatggtgggagtggatgacggggcatggggtgggatcggaatcatggaagttcttttatcgaagtaaatcgtttactctgataacagcgagagcgggatgatgggacgtgaggtgaggtgggcctaagctgacagatgtttggcgttcaaaatacttggagtgagtgcgctcctagtagtatctataccctcaaaagagtatgtgatgtcaattcaccgaacagttaatgggggtgttattggaaaaaaaatgcattgcattagagcaaatttcaaggaaaagagtgattacactaacatgtcgccattacgagatcaaaggcacaaacatgatataaaacaccctgtgcatgcatggacaagaataaatcaacggacaaggaagactatgattagcattcacatccagttccacacttttagaaagtaacataagcaagtaacactcagctagtttgaggaaatccacacaaaagctagtaatgccaacattctgctccttgttgacacattgtcaatagttagaagaatttactcctattacaaaaatcaatggttttctagtgcttcattcacgttttagaggcgttgctttcagaggtcctttaattatcacaatcaaagtattgttaagctggagtatgatatagatcgtttgtagttgtaacttgctagggcaatgacagtttttttttccatgttattctcctttatttttacttttttaaatataattctagattgtgtgcatcataactatgtactaattgcttgactaataacgctagctttataaaaagggcgatactccgctctccactagtagtattatatgtattataagtagaaaacatttgtttcgttattaattaagtataaattagtaatttattaatatactcatggatgagcaggtcgatgacatcaggcccatgcatcgtgacttggctagttggatgtgggcctgtggcgctcggcgcatcgtccagagcgattccatcgagaaatcaaattggatcgcaagttatggcggctacgagtggcaagtcctccgcctggcggcatgtgttgatcccgccggcgaacgacacactccggtgtgtccctttcttctcctccaaccatccccggcagcccatgtgtgccgattttgcacgcatgagcatcgatagcgacctccgatccgttccaggcggcggcggcaacgcgtgggctactagcgattgtggatgtaaatgacaactatacccttccacacatattttttcctgaacaataataccctctacgattatactaccgttaagtgcggtatattttttcctaaacaataataccctccacgattatactaccgttaagtggggtggtagtagaccgttaggtatatagttcgctcttgggttggcgatgtggtttttcctttccctagacaaagttgcctgataactggagtattttataagtgacatgtatgtctttcctaattgatctctccagaatggaagtctgcggactcttcttctaatctctatcaattcaatcaatccaaccgttcctcctgaatccatagtctcatgctaaaggtgtatacgtggctcactgcggaaaggagtaaacattcttcgttcattacatgagataaggttgcacattcagtatgctctgttttttggtctcctctgtttttgccgcccgttgtcccctgttttgggctttagttctgttttcgtcaggcacacggctacaatttctggtcgtgtggcattttgttcacacgggagcgcgacgtgcggccaattatctggagcctaggatggcattcgcagctaaggatccatgactaaacatgcagccatcattcccaggtttatttgttttgcgacaataaaaggaagaatgaagaacaaaacgctgccggcgttacacggcaccaaaatttgtgatcgtgttcaatatttttcctctctcgcgttcatcaatcaagctttcgttcctgacagagaatgggttggattggcaaatatgcaaaggcaacagcagtctttcacatatgctgtgacgtgattcaacgaccagcatggaccctatgttgtgaacctgctgtcgagctagttcccataatcgaatatagcagtggtacacaagactaaaatattatctttatgccaggataaaactgcactcgactaatactatctctgttttgagatagaacgatttttcggttgtttaaccaagattaaggttgagaacaaaaactttactgccactcaataaatgaggagtgaatcagtgtgagagggtaggtggcgataagatgagaaaacttttgaatacaaactgt

SEQ ID NO: 73003 - DNA, 3478 bp, Oryza sativa
agacggcttgtagaggtgttacccggtgacctctacgaggagattgtggaggaggcccggcgccggttgtgagtggtttggagttcaccaccttcggagtgaaggaagaactatcctagtgatcgaggcttgggtagtcctctccgtgggtcggctcccgccttgcccaccccttgacgaagggggcgtgcggtggcttcatggttgagtggtggagttgggctcgcctcaacggggattaggaaaccggcgagtttccgaacctcggtgaaaaattccttgtctcttgtctcctttattttgtgcaaatttactttgagcaactttacatactagagcttatttgtgctattatcaccctaggcttgcaaacctcaacataggctagcttctttgtgcacttacttaagactagttgatttaggttttgaactgtacaaaaccgttttgatttacgcttccgcatacaaaactcggttttagccaaaagttttaaaaccgtgttaacagtgaaatttagtaagcccggagtaatcatcgctttagagtcagcattgtcttcgaagtcctgagattagccgatgagagttatcaagtcatcagttgtcggattcttgctatattcggttaaggaaattgatctactaaaggaagcttatccagaagagaccaagttcaaagagaatgcggcatggcaagttatctattaattaggaatagtttgttagtttctactggattatattgctatattatattatcatcagccgattgccttcatatcattatatacattggacatatagccgatagctcaaaaccctatcgctatcagctggcattggctatcggctggcatcggctatcggctggaactactacatcggcttgtcagccgatcatctatttgatctactgtttacatatcttgtcagttgcaggatcaaactgactggcacgcccgcatctcatcaacctttggacctgcacaggagctaagcagatctcccaggccagtgtgtgtttttcgcatcaacacatttttgtcacgcccagtgggaccacgaattttatatccacatgtctgaagaagaagtcaatggcaagatcatggtcacagtggagaatttaacagaggaacagaggcaacagacggagcagtttgtagctgattttcaaatgcgttgtcttcaatgtttcatcatgacaccagaagggccaactcagaagactcgattccccaagccgatagttgacaaatacttcaagatacagttgatgaagcagttcatcgcgcattgtttgagttttggcgaatacattacaaaatttgatcaaggtaatagttgatgagttaattatttagaaaagccagctcggggggcagattgaagaacaacaacaacatcggctcggggggcaagcacatcagcggccagaagaatctcaaagacatcagaataaagaagattgggctgatagaattgcaaaattagtagaggagcagtttggacttagacctaaggaacggatccatatgtatcggcaaccatatcctcaatggtttgaaagagttccattaccacaccgatacaaggttccagacttctcccaatttttagggcaagatgatatatctacaatggaacacatcagccgattcttagcgcaatgtggggaagcatcggctaaggaagctctaaaagttagattttttccgttgtctttgactggatcggctttcacatggttttcatcattaccattaaattctatcagaggatggaccgatcttgagaagcaatttcatgattacttctttgctagagtcagtgagttgaaactttcagatttaatatcggttgagtagcaagaaggagaatcggctatggaatatattcagagatttcataatgtccgcagccgatgttatggtttgagcctaagtgatgagcaactagccgatctcgcattccaaggattgtcagcacctatcagagagagattcttttgccacgagtttgacagcctggttcatctaatggaaacagtatcggctcatgaaagccgattgcaagaagcaaaggaagattagttttggagttatcaagacaagaaattttgaagcatgaattctcatactccaaaactaggggggcatgtgttaacagtgaaatttggtaagcctggagtaatcatcggtttagagtcagcatcggcttcgaagtcctgagattagccgatgagagttatcaagtcgtcggttatcggattcttgctatattcggttaaggaaattgatctactaaaggaagcttatctagaagagaccgagttcaaagagaatgcggcatggcaagttatctattaattaggaatagtttgttagtttccttttttcggaaagttttttctttagtttctttcttgtccgacaaggactagtgtctccctatgggtataaatatgtatacccggggtcattgtaatctatcaatctatcgatcaatataactactctcggcacatcgccaccctctttaccgaggtttttacttatcatccgatggaacttggtacctcacgcggggctgcatcggttcagtttgatctccggcgaacgggtaagtcctacgttccgccggccctggtgaatctattggctacattggtgttgttcaagggttttgttgatatatttgcctacctgatatctcaattctatctctagttgcattgtgtttagagacgcatcggtttagttggaactgtctcggttaggtccgatctcctgtcttagccaatatatctctacaatcacattgctgttataaatagatttgttatatctatcacattagacatatctatcggctcatcgagtactatattatcatatacaatctcgtgcaacatcggttaggttcgacctactagattgttgttgataatataagtcttgttaagccgataggttcatgctagtgttttatcggggtgctagccgataagttatctggatgttgcatcggcttataaggattgcatatacatataagttggatttagcaaatccgcagcaaaggcttcattgatcaatctaatcttgtggattttactacatcggacctccagccgatgtatgctttaaccttcggatcaatgcttgttctactatatcatattgttagccgattggtttctactggattatattgctatattatattatcatcagccgattgccttcatatcattatatacattggacatatagccaatagctcaaaaccctatcgctatcagctggcatttgctatcggctggcatcggctatcggctgtaattactacatcggcttgtcagccgatcggctatttgatctactgtttacatatcttgtcagttgcaggatcaaactgactggcatgcccgcatctcattaacctttagacctacactggagctaagcagatct

SEQ ID NO: 73004 - DNA, 17297 bp, Oryza sativa
atagcacatagaggttattgttcgctcaaagaaaaaatgccataggaatgagaggtcccgggaaaagaagatgatatccaagagaaggaattagtcaccgagagcattagtgctggagcattcagttcatctccattgaggacttgacatcttacttctcttgctttagtagaaattctgagtgtcatgcttgcgggtggcaatctggcaagctttgtctgacagtcgtagtgcatcagagttccaactgctgtaagcctgtaagctgcttaggtcacatcgttatttgaggttatgcacttgttgagttctctcgggtataggcgcgtagttagttgttgaggccaggaataaagggaaaaggatgtgtttcgttacagttttcttttgtatcagtgactcgtgaatgttttgccaacctgtgcatttcacctaggtcccaataaacaacatgattatataatgagcgactaaagccttttatgaatttcatatgttttggattagatggatgagcattagtgttattttggaagtatcaagcgacagcacaatacttgtcggttcgcaccaattaaaagactaaaaacctagtaaaaccagtaagatagtgattttttaataagttggtgatacatctctattaaattgtttgcctctataaccaccattttaatagccaaataaacgataaacatgctcatgtcatatgttaacatcttgctttcttccatcggatatggttcctgatcaaatactaatcagagagcagttatagtcgactaaaccattacaagctttttggcgtgctctagggtggacagagatgcaaacctgctatgcgtgttgctatcttgccatatggtgatgtgctgttgatatcagactagtgataattttcttcaatggccacgtcactactgtagttttttcacgtactcccctacgacgccgttgacttttcgaccaacgtttgactattcgttttatttaaaattattgtgcaaatataaaaatatttatgtcatacttaaagaacatttgataacgaatcaagtcataataaaataaataataattacataaattttgtgaataagacgaatagtcaaacgttgaataaaaaatcaatggcgtcatatattagaatatggaggtagtatttccttgagctgtaagcctgtaggctagcttgactctcatccctctttcaggctgtgcactttgttgagtttctgcagttgtagacgcgtaactagttgtcaggcccaagaaaacgaaaaaaaatgtgattgatttatttacatttttgttttgtttgttagatataccagtgactagtcaatgtttttcgccaacccatgcaatctagctatgtaccaataaccgtaacgctattatataataagcgactaaatgattgctatgaaaattcaattagtaagttttggattagatccatttgaatttatgaagaactacagcacgctatttttcggtggctccaaattaaatgattctaaaacaagttaaacacaggaatcctctgagcaagttgtccatacatctctactaagccgtttgcctgcatatccaccaattaatacgcaccgaaaaccctacatatgctcatatgttactccctccgtttcacagtacaagtcattttagcattttccacattcatactgatgttaatgaatctaaatagatatatatgtctagatttattaacatcaatatgaatgtgaaaaatgctagaatgacttacattgtaaaacggaggaagtatatattatagtaacatcttgctttcttccctcggttagtctaaatcaaatactataactaatgagaggctttcttgtaacaccctgaaaattcgaccgacaaaatcaaaactctaaaaatacggattttcaaaaactttttaaattattgcatcataccgatcttattcgtctattttatctggatttgatctcgaagattattaatcgtgagtaaagaatagttaattaggaataaaccgtaaaaacaaaattggtaaaatacatacaaattaaaataaagattaggtggggatagaaataaataaaatattatcgcgaccatatttggatcaattaaatttaaatacgatggaataagaattaaccctaattaaaactcaaataaattatataaaaataaaatatgagtaatattaatctagagtgaattcattagttaagataacacaaatattgagtaaaatgcatatatgcaaaattaggaattgtggaatcaaatttatatggaaaatacactaaaatcgggttaattagaaaacggcattgatcattgcacctaaggtgttcgacgcggtcccctaacccagctcctcctctttccccctctctccgtcgccggccgccgcacgccgtcgccttcgtcgcctgccgccgcgccaccgtcgccatcgccatctcatcgccgcggccacgccgtcgccgtcgcgtcccgccccgcgccgcgcgtgcatcccatcgccgcctcgcgccgcgcgccaccactgccgcgccgtcgccgtcgccatcccgtcgccgcgtgcgcgttccatcgctgcctcgagccgtgccgctgccgctgccactccgcgagcccgcgccgcgccgtcccatcgttgcggtcacgccgtgccatcgtgtcgccgcccatcgcatcccgccccgagccgcgcgccaccgctgtcgccgtcgccatcgacgtcccgtcgccgcgcgcgtcccatcgccgctaccgcgccgcgcgccgcctcgtcgcctcgcgccccgtgccgcgctgctccccgagccccgtgccgccgctgctaccgcgccgcgccgcccgttccatcacctcgccgcctgtcgccgtcgccatgcgccgcgcgccgccgctgccgctcgcccgtcgcgtcgctcgcgccacgcagccgtcgcgtcgcctcgctccgcgcgcccccacctcgcgccccgcgccgccgtcgcctctcccctcttcccctctcctatataaacccctattcccactctttccctccatcctcacctcctctcctctacccactccaccacgccgccgcctccacgccgccgcgtcgtcgcatagagccgccgcgccgccgttgtcgtgccgccgcgccgccaccttcgaagccgccgcgccgtcgccccggagccgccgcgccgtgcgtcgccgccttgcgctgccgtcgccgtcgtcgccgccaccgccgccgccggtgagccgtctcccccccttcacctcgcgcccaccgccgtcgccgcccggggaggcaaagagccgggagagaaaagagagaaaaagaaaaagaggagaggaaaagagggaaaatagaaacaaaggaaaggagaaaatagaagggaaattgggggagaaattaggaggatttaggaaataaaaatggtcggggttaatcatagattatttttggaaattcctcgaacgtaatagtatttcggtcgaaattccgagttaactataaaaatatgtttcttgatcagattagattaaaattggtagtaatttagatataattaataactaaacaattagatgaattcttatagattattatagattatttttggtaatctctatgagccatcggttcacggtagaaattcggatttaattactaggaattttagccgtgtattatatttaatcatttagtcatagactaaattaaattgtataataattctaggatttcgtccgatatttagctcgtaatagaaatttctaacctattatatggatataatgctcgggaagagtaaattaaaaacttatgacaacaaaataattatacccgcaaaatagtttaaatcgaaattgggtttgccgtagtttgcagatggtaaagttaataaaaagtaatcgactttcgcattcgactttcatttggatttatttggatttttatttgaattctaaccgaattcaaatcaatttttgcacgtaactatagagcccgagggagttgcggatccaagcgaaggccaagacccgcaagactttgagcaaggcaagtcatcactattccttggccatgttgatcctaattgcgaaattgttttgtttacgaataaagttgcatgcaatgatgaacatcatacttgtgattatgccatgccttgattattatttacccttaaatctttgtaaccatgtttagtatgagtccctagtcaactatgacaattgcttagaaatgctattctagaatcatgcacactcatatttatcaaatgctatatgcttgggcaattacctttgggaaggtaattgagatgcggcatgtggagacatgagcgccacattgccatgttgttgatgacatgatttgtgaaaggagaaataaaattaaacaactgttttcgactggggcggacggaggatttgggtggtatctggaaaaggctagtaccgtccccagtcaattaaggaccgagccatgaagttaagcatgaaacgacccccgtacaaccgtacttctcgaatgggtatagacttagcggattagatagccgagcggaggcagtatccctgcatagatggttcacccctgagtgaggcaggtgcgctacgatgggacagccgttgaggtagggccgagaagcgtgccctacatcggtgtcgccattagtaggactgccatgaatgtgtgagagagagaacttaacttgaaccataacttaatatgcgtgtaagacttctctttccccgggagcgccagaactcctctcactgctagaaacatggacgcctagagtgcatgaggatttaagttcatggagcgggtactgccaatgcaaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcacggttattgagcaccgggacatgtattacacttggctagactctaaattctttaacttgtgtgggatgggatattgcatgatgatttttatgctgatggagccacttcctgagaggcaggaatgtggacgtcctcagaaaaccataacgactcaatgacgggaaactatccttgggatcacaatggatggtggacagaaccgtcattgtttaatatgaacactggtattaaaaacttgatcagtctatactaggtcttaggcttgtgaaaagaattacaaaacttgctttgtgcaaaagaaccatagccatcctttgaattcctctgtcatgtgcatcattgctatgatggcttgctgagtacggttggtactcacccttgcaaatataaaattaatcagaagcgggagatgaagcctcggaggatccctatgcctactaccaggagggagatgaagacgatggcgctcagtaggtcttagtacggtcgttgcctgtggcaatggcatgccgctgcctgaattccgctgccttatctatttctgcttttgggatgtattccggaccgctcggtccgatgatttaagactatgcctgcgggcttatgatgtaataattcgtattagacactcgtgtatgtgcacttgttatttcagctatgaattcgtgtgtaccagactacttgatccagggaaatggtactgtttacacgattgattcctgttataaaaacgggggtccacatttctattgtgccccttagggtggacagagttgcaaacttgcaattcatgttactgtctcatttgagtaggaaaatactcagaaacgtcatgagatgaatatgagcaaatgctccatccatttaacctgttacctcttcaccctggatattattgcagggcaaatctattctttattttcgttccccatcacttttgcaaaaaaaacaaacaatggaagaactgaaatatactatagagcatcatggtcatagttatgtagcccaactgaacacaaaagaatgaaggaatctatctatctatctactatgtatactaaaagttcactaaactttaaacgctttcaatccgtcacgtgagactcctaaaaacactcctaaatcgctatgtgacatctaactatcaattttcgttaaataaggtggacccactaaatttataaaaaagaaaagtttccctcttgtacgtgatactggtgcacgtcgtacgtacgtttgtcctcagcctcacgctcaacctcccctcctatttatctctctcacatatttatgtcgtattagaaagaaatcaaaaacatattttatgataataaacaaaacaactaaaagatctaaatcatatgactaatttgttttccacatacattattagattctttacaacagatttacgatttacgatcaaaattaactatatttaccaagtaaaagaaatgcattactttcgacaatctatttgacactcacaacacatttttatggaaaaatcatatacattttgaaaccacctgattaaaaacacatatcataaataaaaataataggaaacccataaaattaattaataaaattaatataataagtaccttaattagaaaatatttagcaagtaaaagaaatacattattttagatttctaatattatatcaaaatatagataactcaagctggtaaacatatttgaaagtcagtacatgcgcacatctccctgggaaacttctctcaccaccccactaactcaattttcctcctctcctaagtccattaaacttccaataaacatgctctcaagttgctaagtggaaccataataaataagagaaatccaaccatctatttttatttaaatcgatggacccattgtttaggatagttagatcaattttgaaaaaaaaaacatccggaaccaacatccggatccaatgtatacaaacaaacaaaattaatagttcgcatcataggaacgtacttactgtatgtccttctcctctattccttcctatgttattttctatttcatgagaaattaaaatcaaaattattttttagaggcaaaaaaaaatcacagatagaccaactactaggtctagcggctctccctccaacactttaaacatcctataaacgcttataagtcactacgtggtgctattaaattagagaaaatactagaaaatcttttaaaaaatacaaagcaaccgaccattgatacattgttttggattgttagatcttttttaataaaaaaaattccaaaacctctctccctccctccccacccccatgcggtgttaaaattcattaaatatattataaacatgtcacagcctgaatttcgtttcaggatttataaattatttaataaattattaatagaatttatattaaatgttgattaatttacaagtgaagttaaatgtgggaaataaaattttctaaatataaagcatggatggatttaatttttattaaattctccatgattaattatactctctggaattttctcggatttttcagagctcaattcctaattttaataatacaaagaatatttcagtaattatttaattaataaattaatcattaaatggtctggttttaatattcttaaatactttgagtgtccaagtatgttcaagatttttcttcgaattatttgagcgttgaaagtatttttaacaattgaaagatcatctcattggttaatttatgtggaaaagtaataaaaatcctcctcctcagcttgggccgaattcagcccattctctcccttcctctcagcccagccaaagtctgatttacctcccttccgctacagtactccatcttcttcctccagacagagccgagccagccgtgctcgtgcacagtgccgtcgcctcctcccaccaatccgacctccccgttgctcctctttccgaattagttgtgggaatggaatcctctcaatctcctcttccttttccccaataaatccccaaaatcttatatggaaattctttccaatttcgcggatcaaatccttcctttttccggcgagaaccctagactttcccgatttttttctcgtcgatttgggcctggacctgagcttccgtgccgatataaaggaccccctaatcgtcctctacccatcccctcaagtcccgtccgccgccgtcgccggaaacgctctccccgcgctcaccttctctctccaccgccgccaccaattccagccgccgtttgtcgtcgcctcggccgtcgctctcctgcgccgccacctctctcggctccgcaaggtcaagctccaccctggccgccgttccccttgcgccgaaacctcgccggaagccgtcctcgctatgaaccagtgggttgccgtcatgttccgatctacagccgcgccgttcgtcgtcgtctatggtcgccttcggtcgtcgctgccaccgttgtgttcgcgaggaggagaagaagatcgtcctccacttccccgaagctgaaatccaccggagctccatcgtcgccgtcaacccgaagttcgccgtcgcgttttgatctccggcgaggccctgctgctcctcccgtcatcgccaagcttcgccgcagcctccctcggcatcgcagctgcgaggagaaccccatccacccctcggttgtcgtctcccgtcactgaaaagccgtcaccaccgtggacagtacctcgtcgccgtcccgatctcgtcgccggccatcttccgtcgccatctgtcatcgcgtaagtgttggtaaggaccggcgcctcgcgctctttctcccggtgccctccgtttgcatatttgtgccgtggttcgccggcaaccgccgctcccatgccgtttaccggcgaaggtttttccctggggccttaatccaatctaacctaacccgttgtctatctagcgtcgttgtcgtctcatgtcacgccccgaactagtcccgaccggaactagtttggggcgtgacaagaaatggtatcagagccgactctcgcggtttcacaggcgcgtgtgtcgcagttgcgcaggcatggtgcgcatggctggtgtagaccgggagtggttacatagcatggcacatgcgttggcactggacacatggacgtggccaagagaggacgttcctggcctggggttgatcgacgggggcgtcgatctctcttaagggggtgagggtgtaacatcccggcctagggcttaataagattaatagaatactcatatcaacaagttgcaacttcttttccggaagccaatctccaaagaactccagggttaagcgtgcttggcctggagcaatttgggatgggtgaccgaccggaaaattcttcccgggtgcacacgagtgaggacaaagtgttgcagaaaagacatgtgttagtttgtgagggcagtctatgacctatgaaagctgccagatgtaagtgggcccggtctgggagaggcgggtcgttacaaaatggtatcagagccttgtccactgcgacacacgcgcccgtgaactccttgtcagcgggatccgcttcatcttcttcagcaactgggtggggaaatatttatatagagcaagggtgagtaaaggagtactcagcaagccatgggaaataagtgtttaatgccggcttcaaggaaaggctgttgtttttgcaattgattttatttgaactcttttgtgaaacaactaagtgagtgcttctcaaacgacacggatgagacagtgcgtctcgtccggttggagtatgtgcaatgtatcagtcttttaaattgatcaagattggcacccggccaacagctttcaaacggccacccgggcctggctgatcccatcagccgcagattttccaaacatcaaacccattccacaacagcaatttcacaaggcagaaaacaaaactacgctaggaatcaccgtgggcacggctgttcgaatagttttaataacctctacagagggggtacactttacccacacgacattactaacccggatcatccagcccttgcagaatggccacgactagagaccttagggctttcatgacaaggcatttcgagagccgacacaggttcaccatatgccaacgagaggggtcccagaccaacaccagactaggtcctagaccatactgtgccaggatgccaaggggtcctccccgacaccaccctggcgaatccacatgtctcttagcatcatggctcccccgataagctagttactcagccaggggtgtcccattccacccatgtggtcgtacttgtcttatgatcggatgaaattccaaggaaacggtccttaagtgcaagagcgggaaaccgtacacccggtacgttccccggtccgcagttttggaaattcatttagttcgcaagcaccgactcaagtgtcgggttttccaagtcttttgtaaaacccaagtttcacccaagatgtttctcagattttaagtttgaaggcgaccgtcgatacccgtgcagagtgcacgattaccgaggcgcaactaggtgggtacaagggaacatggtatagcaattaacaaaggaaggatcaaatgcaacaaattaggtatgctcaccgatctgcctcgtagatggggcaaacatattaagtgcaatcctagcaatccataatattttgcaagaaatataacttagttaaaatataggctcaagatgttcaaaggtggcttgccttgctcgagatcttgagctttatcctcgaaatcctcgcactgcgggtcttcgggctccgaaactacacgcggctaaaataaagccttattattgacctctaagcgagccattaaatagatctcgagatttgaggaattttggaagttgaacggagtcaaacggacttacggttgggaagatattgaatttctaagattattggaattttttggtctaaaggaaaatgatttatttaaatcctttttgaaaaagaaaagaaaagaaaagaaggagggagggaaattagacttccctcgggcggctagggcgcggcccgagagaaaggggcggctcggccgagcttaatgggccggccggcccaagaaggcggcccagggcgcgcgcgcgggccgggaggagggagagagtcggtgggccgggtccatcccgcgtggtcccgggtgggacccgcttgtcggtgactcggctcaccgtgagcgaggtgcacgcgggttgtcatgcccagaaattcacgaaccagaatttctaagctgaatgtgtattaaacccctgtccaggaccagccagggtacaaaaacgacaattgttgacatacggatccacgtcttacaaaaatataaaagattacgaatgcagcgaaaaaggtaaaagcgagctaagcctgaagacttgactcctgcagcgggcgattccattccacaggcaacccttgacggcagcgacgaaaccaacctcttcaagacatctccaactgagaagaacttcaactctggtgtgggggaaaagagcaagactgagtactacccactgtactcagcaagtcataccggaagaggaggtatgatgcaggatataaccaaaggaggctacggggttcatttgcataaagcaggcatttaaaaccagtagttgaaaacagtaaaaatagttatagtaattaagcaatattaaccagtcactgtccaacgctacgccacgttgcaacaggcctaaccaaccacctgaactacaccagttcattaagctaaactaggggtgagactaatcacggtgaatctggtcgaccgcccataaccgcgggcacggctattcgaatagttttactctgatcagaggagtacaactgtacccacaagacacagccccacgacacgttcccgtgcgccgacatgccaccacgacataccggaaagaggccgtgacaggacccttcgcataaccctctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaatcaccatgggcacgactagcaaaaccatgcacccacagcccaccatgtagtgtactttaattaaccaacaccattgcggtggcactaatccaaagctattaccaataatcaaagtctatgctttagtgtgatccccttttgtgcattagttgaactaagcatggctaagcatctcctaaaccaacatctagtcattttaatacccaagttatcaatggcgtaagggaaacaacatatagctgagtaataggacccatcccacatgatattgtaaaacaatgcaatatttaatagaaatgcgggacatttgtaaattgggtacaatatgatcaattgcaatgtatgacttgccttgctctcgcactgatggaaccacagcaacgtcttcgaaaaaccacgaatcgacgaaacgggcgaaatctacgcgacaaacaaagcacacaagcaaaacatgctataagactactgaaacaggaaacaaaaccatttttagtggattctatacatttttatgaatttactgagacttgaatggacttaatcggagctcggatgaattagttatgatttttagaagattatctatgtttttactaataaagaaaaagccttaatcaatttattgcgcaataattcatcccagggctgacgtcagcacaaggaggggtggcgccgacacgcgggacccgcgggttagtgactcaaggagagagaggggcggctggcaagcgggctccaccgagcggcggctcatggggaggaggagacgcccggtcggctcggctcggcctcaaaccggccgaccggttatggcgagggcggtggcgcgcatgcacggtcgccggcgacggcaaccggaggcgcgggaagcggcggcggatgacggcggcgcaaaggcggcggcacacagccgaagcggcggctcggcccggcacggcgctaggagggagaggaaggggaaaagagggggaggggcgcctcaccgcgagttggccggcgtggggggaagacgacggcgaacggcgacggcgagcgaccggggaacagcgacgataggcggacgagctccgagacctcctagggaacaagatgggagggattagagggagaggggtagttaacggcgagcggattcgccggtcgaaggcggcagccatgggggtactcatcggcgcgcgaggagaagcaagctccggcgacgggattgaccggggaaacggccggacgggtgggcacacaggcttaggagctcggcggtgtcgacggtctggtacggccacggctctagcggtggcggagtgcggccggagcttggcggcaagcggcggatggcgggatgagaggcgcgggagcgatggagagctcgggagggctcggccgagaaaggaaaaagagagaggaaggtgtgggcgtgcttaaataggaggggggggcggcgagtcgtggccgggaacgacgcaatttcgccggagtagtggaggaggtggaggaggagagagagagagaggcgggattcaaatttgaatcccggccatctcgcaggcgcgggggtgagcgggagtggggcgtgggcgcggggagggcggggcatgcgggagagtgggcgacgtggcccggggcggcagggagtgcggggcggttgggaggagggaggccgcccctccggctagaggttggggaaggtgctgacaggtgggccccacctgtcagcgcccgagggagaatgggggaggcgacctggacttcgggagggggcgggagagatgggccggcggcccaaaggaggaaaagaggggaaaaaggaaagataaaaaggaaaaaggattttcccagggatttaatattgcactttgcttattttaattggttaaaattatttccaaggctctgaaaattccactaaaaatcctgttagcatattttgacatgtagaatccaagaaaaattccacatgccgattccgattattatttgcattgatttaaaagggtttactcttgctttgcaccggtattttcttagggtcatttataaattaaatttaggcttgggaggagaacttcggggtgtgacacgggtcgtgctatggtttggggagggaggcgcggcgcatgcgcgcagttcgcggaggacgcggtgcggcgagcccacgcgcagcctcacggctcaccgcggaccatgcgcacggggggggggggggaacggagggagcggctggccgggtcagccgatccggtcgcggccgaggtggcgctgacgtggcgcttacgtggctgccacgtgggccggcgggaggtagacgacgacgtcggccggaacggacggcggacgacggcggcgagcggcggagcgaaccatggcgatacaggcgaaggcgagcacaccgggatgttgcacaggacgaggggagacgagccaacggctcggattcgccggagggagctcgacggcgccggattgcggcggcggcaaccggcgacgaggtcacgaggggccgattcccggcggcgagagcatctacgcagctacgggaacccattgctagcgtcggattgggcggagctacgccgagcgaggccggcgacgagcgggcgctacggagcatgggcggcgacagcggcgagcacacggtgagcgacggcagcagtcggggcggcgccggctagctacggggaggctacacatgctactacccgagtctaaggggaggagatggaacgaggagggagaacggagggatgcactaccgtgtgggacggggcgcagtgacaagaggccgacagcacgggagtgatctctccggccttgggccggggaagaggaagaaggcgagcgcccggagtccccttccgcgtccacgaacgcatcggctctcccggtgtttggcgatgaacgtcggaggcaagacagaggggcggcaatggcgcggtggcggcgagcgaaacgggaggaggaatcgatgggagggcgccttggtttataggacgacgatgtcggtttggaaaccgaccttgggcggtcaaggcgcgagctggcgctcggcgctcgcggccaaaacggcgacagaggcggatgacgccggcgggaaggggaaaaggaaaaaggaagggagaaagggagcttgctccttgccactttgggaaaaagaggagggagcgggggcgacgcggcagagggaggaggagctctgcctccgtcccttggaggctagcgcgtggagtggcgggggccgggtcgtgacgacgtctatgacggcgggggtggtgtggagcggagtggcgacacgggcggcaggcgcgggcagacgcggtagataatgacggcggcagcgaccaggcggttggccaccaaggcgcgcgcgcgcgggaagcaacgggaggcgcggcgattttggcggcgtcggcgggaagcggcagcgagggcggagggcgcttggctcagcgcggctcacttgcacgcgtgagcagcgcacgggcagagcgggggagagggagagagagagagagagatgggagggagggggagatgggccgagagggattcggcccatcgagggaggccaaatagacttttgcggagggatttgatttgggaagaatttggattcgggattgaactcgacaatagatcggggatttgagatctgagatggcacggacactagacaacaagcaaagaaacggatttcgcaaatagggttttcaagagatagttttcccgctaggcgccacgacggaacgggcgctacatctcagtgtgttgccgctggatcatcgtcgtcgtctctccctctccgatcgttttggtccagtgagacgtctatccgtgtctctttggtttagatttcaacccatcggccacgcttgccaagccgctttgtcgcagccgcagccgtgcctgttgcgttgttcctcgccgcgctgctgctctagcccgtgcaccgtcgctaccggttgtgtcgtcgtttctgtgccgtcgccctaaccctagccgcgtgtctctgtcgagccgccgccgccgcctagccgagccaagtcaccctagtgccgccgtgtcgcagcagtgtgccgctttaacctagccgccgctttagccgttgctcggtagccaagttgtctagccgtaggtgcatccctaggtttctaccggcctatcgtttgcagtaccggggctttaccgtgaatcgtttgagcatgttgatcctatatttaaattctctatttatttcaactatgcatttatttttggaatgtcaccgggtggtgtgaaccaattccttttgttatgaccactttgcattgcttactctattctttgataccttaggtaacaatttgactagtgggacttatatattggttcagctagatattagatataattgcttagccatgcttacaaacattagcacatgattgggataactaatgtttcactatcacttaatgatggatatttaatgatagctcacgatggtttatcgtgattggttaattaattaatgtgccaactaaaacttgataatggtgggttgtgagcacatggttttgatggtagtgctcatgacaattaaggaccggttcacgattttcggttgtgaaacattaaccgtgccaaccacaagccagcatgggcaacagctttaccttttgcatagcatgattcattgcggggcaccagactgagaagtggcggagataagcccacaggggtcgttggggagtccatgccttgttttataagggggtgattatgatccaggaatggtgcgctatggtggattgtgttgtgcgaggggtactgtcacagctcctttccgaggtaccatggtggtatcgaggcgcatggtgacatgttgtggcactgtgtcttgtgggtacagtggtacacctctggccagagtaaaactattcgaatagccgtgcccacggttatgggcgggtctaacaatgtctttcgtgattagtctcacacttctcaccataataaatgatgctataactggtaataacctgcttagctcctggtttggaatgctaaattcctggtttggagatagatctgtacagccgggtatggttgttcaggatggttgggcctgtgcagcatg

SEQ ID NO: 73005 - DNA, 1480 bp, Oryza sativa
gtgtgtttttcgcatcaacaaaccacctattcagcccccctctagtcggcctccttgatcctatagctccgccctctttcctttgcacgccttcctctgcacatcgccacagctgcgcccccgcccagtccgccgccaaatttgcccctcaagccacagcgtccttgcccagatcggcgccggcaccgacctaacgctcgcctttgcgcatttatcaacaccaccatctgcccaccgcaccaactcgccctagcgccatcgccgattcaactttagcgccgtcaccgtttcaccaccgccacgtcgcgtaaatcgtctacccgattcaccggcggtctccggtcccatcaacgacaatgacaaactaatttactgcaacgggtgaaaaacttatatacgtttttcatacataacaatgccaatgacaatatttgtatggatcatttgtagctaagacaataaaaaaatggaacatcttcaatgaaatagcccaacctcgatgatgacaacatcaccgatgcttgctttacctaaaaataattggattattcatgtgataacatgaatataatctaaaaactctttgaatctcattcttgcaaccaataataggatcaatcaaatcctatattgtctcgcatggtcaagtctacacaaaatagagtcattgtgcactcttctctaaataacaattaaaaatatgtttatttttaatattatatccatatcatatgttatcaagaatagtagctatacttaacaaatatagtctgataattgcatatagatacatgcagggtctccaatacaggagaatagatgatgaaacaaaagtcgtgtaggagatggaaaaaaaatcgatggatgctatctaacccaagcatccatcaatttagcatttttttctgacagttttttcatagcagcttgtttttttacgatgttttttcttgcgaggttttttcaaaccagtttttagaaaaatttttcctcgcatgtatttttttaaaatttttacaaatgatggaaatattttttttctcgcccatttttttattttttacggatgatggaaacctttttttagcacttttctctggcctttttttctcacgcgttttttaaccgttttaatttctcacgcctttttttctttttagttgtacgatgaaaacatctaattttaaatagttagattatattagagatagagaagagatatatatgggctactaaaatgaatagaaatcgaacttttttgccgcgcttttttccacccttattattatttttttctccttcgttttttatttttacgaaccgtttttttgccacttccttagggaatcgaacagacctttttagatgtgaattttttaagtagggatgaaagtagagataaagatgtatacaaagtttatatatgaatgcataaaaaaatataaatgtatacaaagtttgtatacgtgtatataaagtt

SEQ ID NO: 73006 - DNA, 5228 bp, Oryza sativa
atcggactttctttttagttttttttcgctgttttttttatttgtgacggacaaaggaaacatctcttaaaaaacttattttttaagtagtactagaaaataggcccgtacgttacaacgggtgaagactattttaatcatattattgttagattttttctgaaaagtatatgggatttttatttgatagtattgatatctaatttagcacccttatttgggatgatggtcatatcatgtacgatgctttcttatgctctaacaagaattctgaagcaattaggagtataactcccgtcccaagttagatgcgagtttttaaaaggaattgttgtacgactccttatgtatttttaaaaacagataaacttaaaaaccgacttaaatacgaatgacgttgcaaggtatcaacagaaacatgtacattttttataaaaatagagatttccgtttgatttgagttttgtgctgtatattttcttattggtgaaaaaaaaagttcgttggagcaatttatgtggtatacttacatacatgcaacattccttgctgttgctggcccgttggatacgtgggcaactataaagagtgaaattcacggcgcccatgaagaatggatatagatataatagtcggatgataaaattaaaaaccaattcaaatacggatgatgtatcaaaattctgacgaaaacatctttagttttataatagaagagatagaaatatagtcatatagagataaaggtgtagaatattcaatttcggtgcagataatatcttaattcaatccatatgcagattccatgatttctctcgataatctataggaaagggaaacaattttatccaaagagaattacaatcattaatcgatagggagcagaaaatctccttgtattagtagcaccaactaatagcagtgcagcatgtatcaacaccgatccgtgccattacgtgactgattaattaaatgcaaccgtaatcaatcaagtctctggttacgaagtaaatccatgcggacgcgcgacgccaaccaacacaggagacgacgcatcgtcgcacgcagaggcgatacgtacgaaaatcaggcaaaaacatcttaaaattttataatagataaagataagtagacagatttattttagttagtaaccaggattaatttgcatatatcacgtttgccatttcatctaacgccatctgaattgatttccctgctatgctgtgttccatacggtgcaggatacaataccacgagctgattatccctcctgacttattcctgggctagctacgaacaaagattctataaagatgtatttgctattaatgtaagcgaacgcccagcttttctatattggtgagaggtgaatcagcaatgtgtgccttagtgcaccatttacctctacataagggtggaaacgagcctggctcggctcggcttgtaatggcttgcaacaaggtaggtttggctaggctcggctccggtaggaaaacgagctaaaacatgagctcggctgtttcttggctcgagctggcttgcgagccttccgttgaagctatataatttggtaatcattaagaaaaacaataacaaatcatcaacatgtagaaataaaataactttatatattaaattcatcaaaatatagatgataaattacatattgacaaataatatgttggaaatatagtcatatatcggcatattttaatccaaaatattaagacaataatcatagcatgaacaatgtggggtgatttagtgataaaatcaaacataaacaggagcatgcttaagatagaataagcatcatcatcatacatagaacgcaatagcattgcgactaacagaaatatcaaaaaccgaaataacagtagagggttataccctgtgaattgaaagtccctccgctggattgtgaggcagaactgcctccgttggtgttgtcgatcggtgcaccagctccagctcccgctcccggcgcgccatctccaggcgcggcagacatgggtgatgcagacgaacggtcgaagacgaacagaggacgaggagcagtcgtgcagaagcactccccaaaaacctgatcacccacctacccggtgcagatctcaggcgaaggtgtggttccagaggccctgctcgttccgatctctcgtgcacgcaagcgattagaaccggggaagcagtagtagcagcacaggcagcggcagcgcgaggaggaggaggaaccagtgtttggaaagtaaccgaagagatctgatcgggttgcctctttccctatagcgcaggagagaaatccgcccgttgtcgcagtaacgacgcgatcaataggtattgaattgcctacccgttacagaggcaatcacacggggttggattccgatccgttgcaaaaggataaagagagagagagagagttgcaacgcacgccacgcctctccctcgcccttgcccacgcccatggcctaggcccggccccgcgcgcgcgcgcgtgtggctttctgatccccacctcaaccggtcaacagggagcctctaataactccctatttaagttgagatactcctcttttaattcctagggtggtattattatccttaacatttattatgggcccttgagatttaatagaaaaatcgggcctagcccatttattctaacaatccccaccaaatttcatggcacataagaaatgttctcaaagttgtgcctatttgatataccagtgttttggtggagactgttaagttgaacttccacctaggaaatgagctacatcagaccacaactgaacaatggactatgccttgaattgtcagtcttgtgtgatcaggtttcactcaaacccttgactggtactgggatgccgtttgcatcccctctgtttggagcatataagtcaaactccagccctttcatgagtatctagagatcgcccaaatctcatagactgtgactagcaatcgaactcatataggtgtgttccttctgagatgttctgcaggtcaacacctctgcttagaaaagccactcggatcacattaaggcataagccatcctaccatgcagagtagaagagaagtacatcatgaaaatgagcccttttcaagggtctcttatctcagccacacaatagtttgtttcgccatccaaattcacgggatctccgatcacaatggacaggtttccactattgtgcaaccttaggtgggtatcaagccaatttccctcgatgcactgtctatcacattacgtagtagccccttggtaaactaatctaccagatttttatccgtttagacatagtccaatgctatcactccggagtttttctgctttctgacagatttcagtcttattttgatatgtctagatgacttcacgttgtcctttgaactgttcactttaataatcactgtttgattatcacagttcgttaggatagctggcactggtttttcaaccaccggcaaatccatcaggagttcacgaagccactcggcctcaactgtcgcagtatctagtcctgtaagttctgcttccattgttgacctcgttaagatggtctgcttacaagacttccaggaaacagtgccacctccaagtgtgaacacatatccacttgtggcttttatctcatcagcatcagatatccagtttgagtcactatacccttccagtacttttaggtacccggtatagtgaattccatagctcatagtgccctttagatagcgcattactctttccaaagcctgccaatgatcatccaccagatttgagacaaaccggctcagcttgcttacagcaaatgagatgtcaggcctcgttgcactagccaagtacatcaatgaacctatgatttgtgagtatctcagttgatcccttgctattcttcggtttttccttaatagcacactgggatcataaggagtaggagctggcttgcagtcgttgtgtccaaagcgactcagaaccttgtccacatagtgggattgcacaagtgtaatcccaccctcatctcctcttagtagcttaatgttaagaataacatcagcctctcccaaatccttcatttcaaaactcttggacagaaagtccttgacctcctcgatcacattgaggctggtcctaaagatcaatatgtcatcgacatataaacacaagatcactccttctcccccaccatagcgatagtacacgcatttgtcagtttcgttcacaacaaagccagcagatgtaagtgtggtgtcaaacttctcatgccattgcttaggtgcttgcttaaggccatacaaggatttcaacagtttacacaccattccctcccgaccttctagtgcatacccgtttggttgatccatatagatctcctcctccagctctccatttaggaaagctgtcttaacgtccatctgatggacgagaagagcatgagaggctgccagagcaagtagtactcgaatcgtggtcaaatgggcaactgatgagtaggtgtcgaaaaaatcctcgccttccttttgggtataacccttggccacaagccttgccttgtacttttcaattgtaacctctggcctaagctttttcttgaaaacccatttgcatcctacaggcttggacccatatagacgctcaacgacttcccaagtaccattagacataattgagtctatctcactacgtactgcttccttccagtagtcagcgtcaggagatgaatattgtcacgtcctggtaaattcatcccgaaataaaaaaaacattctctaaaaggaataatagaattaattaaaattcgaaaagaaattggcaaacattaaaatgcgcacaagaaaaattcgaatgtggccggagaatttttgttaaattctccttggtctaaaatgagctctcaaattttacttgaattttcagagcaccgaaaataattattaagcaacaaaaacaattatcacagtttattttaaattgtactttaattatttacttagtcaatttactttttagggtttattcctaactaattattcattattcatgatttataacctccgaaatcaaaattcaataaaataatcgaacaaaattggcatgatgcaactttatttaaaaagtttttgaagatccgtatttttagagtttagattttgtcgtcgaatttttagggtgttacaaacctacccccttaaataaatatcgtcccgagatttcttaccaa

SEQ ID NO: 73007 - DNA, 21835 bp, Oryza sativa
  unsure (1)..(21835): unsure at all n locations
gtggtgattcgctaaaaatactatgaccattagttcaatatttcatgagagaaaatttagaatgtgtgcctttaccccaaaccacgttacatgcacttatattttcatcccaaattgcaaagatgaaatcatttcaaggatgattcatagaatgaaaatatcaaaaaaagaataaataaaatggacatgaaacaaattgaatattaatagatgttgctggatttaaaacccattcaaaatagaaaaattcaaacattttacgaagactgttagaatgaaaaaaatataaaaaaataaatacaataaaaatgatattattggatttctttgttggttgtaagatactccctccatttcgaaatataggacacaatacttttcaaagttgtttcataatataagacgtgcatgcatgcatgcaattaattagcatctcatctcccctaaattattactttttaaaaacttacacttacaagatctttaattatgccggttgcatgtattttattagttggggtgattaacaagaaagatgataataattaattgtttcttggtcattgggttaaggatgattatgcgttatattttgcaatggtgggagtatccttctggggagttaaaattcctaaattttctcataggaaccacctccattgttttgatccattttttctcgtcaattcaaaaccgcatgatctcaactaaattttattttagaacttatatgttcaatgttcaaagcacacaaataagtttaattttttattagaatataacaaaagttattttactaaaaagtcacccgcacataaatattcataataaaattttactcacatttatataagaaggtgcccgcatatctgcgcgggctacattactagttggcaaaaatgatagttcagaggtactccaaaacataggagtattgtgcttcacttaagtaagaagaagagaaactgttcatcaaccaaagtgatccaaattaaaggacccctccgaaaacaaaaaaaaacaaaaagaatcatgaaacgtgacacgcgaccgaaacaccccttaggattaacaggctgtccaaggggagcagcccagaccgaaattcacgaagtgtcttagctacagcaatacaccaaagagaactctttctagccaccgtatgcaaaacagcctgcttaggcaggcacaattgaagaaatgatcattgtggtactttcatatttcccgagccactaaaataattgtttcaatccagataggggtgatgtcctgaacttcacgacatacgatcacaaatcgataactagcctcaatgagatcaagataagcttcaagcaatcaaaggtaacaatgcaacctgacaaccgtagttgccacttcttcaatctcatggggaaatcagaaaagcaaggcggtagagatctctctttgaatttgttagcacacagctaaacataagagttcatattctcattgtcaaaattcttctaatttttatagcatgaggggtattgtaacacccaggtaaccacgtacctagagtgccacaccaaaaaacactcaaaccactaacttccaaaattattagaaatttcggcaaagtctcccctataaatacggacatccacgacagacaattataagttaaactaataacaatattattcccagaattcgatccattcttataattcatggggaagaaactattataaatctaaaagattattacaagaccaaactaggatataatttaagtgtcattatagacctaagctatatagtttgatagtgtgcaagtagatgtgtatataagggtgctacttcccgcccatgcatgtcggtctcaatgcatacgtaaaactaaataaaatacaagagtgagtataaaaatactcagcaagtacaatgtggaactagaaaacacatatacacatcattgacaataaagtatgaacagaaggctttctttgtttgataggaaacacatttccaaacaccaagtcaaagaagatagtagttcccatctcgggcaggcatgaattgaaatagtaatttccatcccagacaatagtgaatacatcctagcatttaccggcatagccgagtaagcgtgatcagcgcttacccataggaacttgaataaagaaccaaattgcactcccatgactacgcatggtacttgaataattgaaaccggaatcaaagaaccaaattgaaacacatccatggcaagcaaggaacttaaattatttaagcagaaccagaatccagaatattaaaacaagaataacatcgtacacataagatcaacttgaaatctaaatggcgtgaacaataatatgaacataagcagttacttatcacgttgaaatatatcagaaataaatagatagagtaaacaatccatgaatcacacaattagttcgtcatgcacttgcctccaacgaaggattggtatcatgcatgatctgatggaccaccacctaatcacaaacaaaaccttagcaaacacattcaaacatgcatataaaacaatgaaaaaggtgaacctactgccccatcccatcaaaactcaataacaaggaacgccgcttggactatacacaagactgttgcttcaaacctttatatcttggaatgtgaaaaggctatgactgaaaatgtgtacattttgaaaatctacagaacaatacctacaacttttatgtagaaagcatatttttattctgccatttaaatagtctaatttgtgcttgaaagcaggctttagaatctgtccagaatttcagactgtccacactaaaacaatcataactggagttctactcgcccaatcagggtgtactttacaatatggaaagctaagaaaacctctacaactttgtctataggcggcctagctgattccactgtgtaacccctccaaaaacagttcaatctactactatccagattatgacacaaaaacaatagtcatactaaaaaaattatatctcctaaaccacttgagataaaatcgcgccctttggtcagaagatatatccaaacattatctacaacttcctagttatatacttagaaaataacatttagagccccgaaacatcaaaacactgaagcactgcaaatctgcccgcatgcataactgcaacgaaccgaaccgcaactactcaaactccttctctagccttccctaaccacgaattaatgcactaaagtcatgctagaacaactgatacaacaaggggataagcctcacctagggtttctttagagaacttctgaggagacaataggggagactccggtctaactcctccttgtactcctctcctcctcctcgttccatttttctacttcgcttcttaatccaagctatgaagatggagatctagagagagcaatttgctgtagatgggagagatgcgaacacaggaggaggggaggaaggaggcaccagccagggagagggatggcggcactatgaggggaggtgggattcggttcccctctctttaggtttttggggagaactagtgggctgggtttatggaccttctcatgttggcccacttctaaagatatttttcttttatttatttctgttaacatctttattttaacaagtcaacccaaactaaaaaaacctaaatatcttttaatatacggggtattacaggtatttatactaggaacatccgtccaaattagatgtgaaatggctgttgagctttggagtaaattggcaagatgaaaggtctccaaaaatcattcgtgagctagtccgctatgccttttcagcttccgtgcaatctccgctgcaataaacattactctgtctttcgaagttgaaacgacgagatgtttaataagtttgaaactagacttgataagatttccaaccatgtttatcatgcatggtaaaacgagactggcttgatcgcacatctcttggaagttgaaccaattgtgtgtaattggtctattcgttagtgtgaaccatctcgacttgagcaatgaccgcttcattttctatgcaattcatgccatactttatatagtcattcgttgttgtagcagtgaaatgatcgtcggacataaaccttaaaagtagaaatgtacactaaagttaatttcagcaagaaacgagttaaccttttgtcttattttattgaatgatgttcggcactcaatccttggctggcacaatctcatggagatgaagtcacaacatggcttagcgtagttggtgcttgatatgctggcactagtccaattgatggtttcacgtttagatgatagcaagtgtaatgcattgttactttgccttggtgtagtggtggtattggtagagtaaacaatgtcatgacccaaggtcatggacaagattggggatagacggggaaaacacccttttcccgcctatcctgagaaatgagcctgaatacaaaatgaacacacactttgactgacaagatttttgtattccaatatgtcatgtctgctacaggctttttgtctgctttatatagttcatagctatacatataagattacaattgtgcccctcattgggcccatgtaagattacaattatgcccctgccatacgagcaatcctgagggcattttagtacatttcaggggtcattatagtcttttggtgccagttagaaggagtggttgagtggccccccgggaatattctcttggcatctttattgctcaaattgccttcttcatgaccaagagctttttccaccaccaagggtcttttccacgaccaagagtcttttccacggaaagtagtcttttccatctcgaccatcctttccggcttacctggtggctgacctgtcattaactcaagaaatactcaaaaatggatgatttagcttaatggaaggaacttgctcaaatagtattttccgactcgaatggtgttttccaactcgaacgacattttaccgtttccctgtttgaataaccctttaccactcggatacttagaataaaatctcaatcttacccagtcttttcctctacaatgttttgggccgaatatggaggggcggtggtgaccccctgctacaacaagcccctcacgggtaagggcaatgtgtgttttcggccgaaaccgtgttcgaatcaaaagctgggggagaaccgccgtcctcctattcggtcgaaaaacactaggatagaaaattttgaagttcgaaggtggttactcttgtcagtcattatgcatttatttgtttattattatatatttttatttattatatgtatatatcttttgtatataagtatgcacatttattatgatgcttgtatgtgtgccacatgtcaactttgtactggatgattggaaagagaagtgccgcttcggggttcgcgcccactcatggccacgaccccccaccccctagacctatataaggtctgtgagggtcgctttctaccggctactgttctgtcctccaccaactcgaatccttgtctttgctcgaaaacacccttttcgctcgaagacacccttttctctcgactactttcttttctccgtgatggggaaagataagcagaaaacaaccaagaagggaaagtcaaaaaaggtcgaaaaatccgagaaaagtggtattgtcttgggtggccatcaaagacaagcatttaaatcaacttgttcaaaatggagttatttcgaactggaaatctctggttcgacctgtcggcgaatcggatccttctcctaaacctttagatttccatgcagctcctttttgatcgatgttttgaagattttcaaacacgagttcccacaactcacccctaacgcgcttgtgcacgtgggtatattcgaatggatgattcgcagctgtggcgggaaccctcatgccgaggattttgcatatttccacagcatccgctgttataacaagcaaaactccaagtttggttgcctcaacttctcctctcattcgaagcatggatgtccttggccaaccatgcccggtattcgaactaaatgggggaacaaatggtagtctacgtggttttatcatcagatccctgccgacctgcttactgacaaagagtgtccccttcactttctcttgcaaaaccactaaggttgtagccgaaccatcagcaggcctaacggcagattttcttgctattcattctcgaggtgaagaacttgtttcgaaatttagtgctcgaggcttggttgaagaatttgtttgtcttggtatccaaccgctcacggccggatggaatatttctctagggcagatgctgagcgaagctacttcgactttgcctccctttgaggttgatttgaacagtaagttttcttcttctttctttttttttgttaacacatttatgtcatttattaagttcgaacaattttgttcgagtactttgtacttatgtatgccttttgttttctatagttgttatccctgcaaacattgtccgcccctgccaaacatatcttggtccttataccaaagatgagcacgcgaagtaccaaaccttgcaaaatggttcaaggatgaacagagtgatgtctgcccttggactcgagatccctgctcgagttcatcctgagattgttcttgactcgggcaagaaaaagaagaaaaagaagaaggctacgaggaaatcgtcctctgatgaagacgatgttgaagttgaagaaaacaaagaaaatacagataatgaaggtaatgatgggaacgaagagctcgggagaatgaagaaaatgaggggaatgaatctggcgaagacagctcgagcagtgatggtgactcaagtgacagctcgagcagtttttgatccatgttttgaagattttcaaactcgagtgacagtctgtcggatgttccaattggtgttggtcaacatggtttaggcattggagctggtgtcccccaagatggtgtcgctcaagattttgcttcattgaatgaatggatcacgctatctgccttaagcaccaagggactaccgtaaaaatttttttcactttttcactgaccctctcttttatctacaattttgccctttttttttctttttatttgtatctaacttgaaatctaacttgttcctctctttgtttcattntgtctcagtttccaacaagcttaaaatatattattgagaagcacagtaccatgtggcaggatgagtttgtttcagcatatgacaacttcaagagggacatgattgatttgcatgcaaaaagaacatgtgatatgatttctgacataagcaaggtgctagctgatagcaacactgcagtgtgcatttccgaggctgtttcaaacccaccaagcactgaggggggcagctgaggccgtttcaaaaccatcaaacactgagggggcagctgaggctacagatgttgatggaccaagcaaggaagcttcaggtggttatgtgccaagcagcccagctgttgatgattatattttggcttaccgctctgatatctcaaatctagattatgcatgtgatgcaccgtcattcagcctcttcaatgaatctgatcctgaattcattagaactcaggacttggctgctgagatgctctccttgcgtgttttaaatgttcctcagtcggcaatggatgcaaggacaccttctccatcacctcagtcacctgtttctgcaaggatacccactgcaaagacaccttctccagcccccccttcacccactgcaacaaaaacatgaacttcagtagtactctctctagcagcagtaagggaaacatccccagctacatcttcaccgccacgtgctaagggctcgccacctctaggtaaaatcaccacttttttgttccttctctccctctcacatttttttcggtgtggttaaagtaactatgaacaacactcctccccctccctaatgttttttcctctatagtaggtactggtagtagtggtccaagcatgcatgagaagaaaaataggaagaaaatggcgcggaaaggtgattgtgatgtagagacgaagaagttgaagatttgtcattgattatgtgccaaacaggtcaaggaaggtagatgccaaagagttgtaagtgttttcacacttttctttttgcgcaaaatatgtttcaacctttttattattaatatgtttcagtgtagtttcccctgttgtttcatcagtcactatgacatatctcactaaacgcaacacatttgtttcagaacagctttatctgaattttttcccaaccttttttttttggaaaaacaggccaactccattcttaaggattggaggattccatgtctcacttgagtatttccgtgaagcaatgaaacctagaggagagttgaacaacgaagttacgtcgtgttggattgagatgttcaatgcaaactgcagggaagattctaagatgaaatcaagcataaaaaattttgttttcccccctggcttgacggtaacatgttttaaccaccccctcccttttattacatctgttttgtttttgttttttttgcttttaattcacttgttccctttttttcctaggataaattgatttgcaattccgagaagtttgtgtctgaaagctgtgtaaaatgggtgaaatcaatcaacaaggagcaaaaacttcctaaactagatctggtactagttctcccatccctctgatttttttcatgttttggttagtctgctgatatatttcacaacataccaatacagtgtttcagctatttttaactctatgttccaatgatcatttatttgtttcaatagttagtttcaccatattctaacatattgtttcatccataactgttccttgttccagttctcatttaacataagttactttttttttgcctcccaccccatcaagttgttcttcccaattgtacgtgacaagcattgggtgctgacttgcatcaaccttttgtgggaacaaataaattactttgattcaatcaagaggggtgatatttctcagtggttcatactgtctcagaacctggtaagatgttcacgggaacaccatgtgttccattataatttttttattgtttcattgagttttaagttcttttttttcccaatgccgatgtgccgtgcaggtcacaaatttcaccaaggttgcagtggatgctaaaattccaatcaaagatatatcaaagtttcaaacttgctctcctccacagtatccagtacaaagcaatttgtatgttttatttacaaatttttgtttcttttttctttttttttgtgcacaagtgtgtcattttaatttatcacttgcttttccatgcactaggtttgattgcggtttcttcagcttgagatacattgagaattgggatgggaaaaacctgcaatcattcaatgaaggggacatgcctaactaccaaaaattcatgacacacatgatggtttcttcgcatctggctaaagttgaccatgatcaacttcaagcaaattagtgttgggggcagttgtgtcactgaagttgtgctttttctgttcttttgttaggattgaatttgtgcactgaagtatgctgtgtttttctgttttttgtttgtgcactgatgttacgctatcaagttgaactactactctttatataatgttgcatctactgtgagatatttgtttcagcctgttctgaatgattgttcatattcaaatgttctttttcagagtaaaacaatgtttcaccttctagtacttatatgttcagcttgttatcaatgattgtttcatagttctagatgttctgtttcataagaagcaatgtttcacttactgttacataattgttatagcctgttcttaatgttgtttgacagctccacatgttttgttccataaaagcaaatgtttcacctactgttatacagttgtctcaccctacacttcatgaatgtttcacaagctctacatattctttttccactgtaatcagtagtgcagagatgtaattttcttttttggcattcccttcgttccactaaacaatcattcacataaatcataagaaagactcatttcacataatcatccaacattctacccatatgtgaattaaaagaaaatatgtctattgcatctcacaacataatgtgtttcacctaacacaagatagtttcatattgtaatatggcaattaccactatattttctaaaagtatagtgcatcgcatctaaatctacagctcctggaactcttttctcagattgtcaactccgtctcttgcaccattttttggtttagtagagcgtctcgcatgttcgctatcttgagatactggcatattgaaacattgtgtgtctcatcaaagcaatatgagcatgagctcttcttttttgtcctcctcttcttgctgctttcagttatttgttcccctattggcttcatcctgtgagttttttctgctggcctccctgttcttttctttgttggtggattcttagctgaacttgatggggcttgttgactaggcaaaataccttgctgatgttgtgtctcaacagtgtgtggtgttgcaaccattgtttgtaggttctgaatcccagccgaaacaatcaagtatttttcctcattaatacatgcatctgaagcaaggcttgtcgtcgccctgcataacgcgttgaaccttagcttgcttgttgccaggactccaattgatggtgctggaccattgtactcatcacatttttgcaatgtcgcttgctctgaccaccgtttcagcaagtacttactcggtatctcatggatgttaaggacagccatcaccctcaagatgtgtgagcaaagaagtccatctctttcaaatttgtggcacgagcaggagtatgttgagtgtgttgcatcaaatgtgaccatatattttttacctgttctttctctgtcacttggcataacattatacatgatgttgggtacttcttgtgttttttctgcatccagccctgttgcttcatatatttcatactggaatttgtctgcaaacatacttgtagtgtaaaactgcgatgcttgtttctcaatcagtgacctgcataattcaatgtttcaacccattaatgtcaattgttccacacttgcacagtttatgttgcacagtatagatattatttgtttcatcaatttttcgaattacaaacagaaagcacatctttttcaaattgtttcaagacagcagatcacattaccttgaatacattctaggttctgttgtctctgctctgtagccctccctgtcctctctgtcaagccttgtctcaattatgtgctcatattttttgacaaagatccacaccgaatcttgcgggtgtacaaataatttgaatagctgtaacagccctaaaatttgacaactttttaaaaccgatttagtttgctttgattctctaaaaatataaccgtcgagttagacatttatttaaaattttattttccaagtttgtttccggtgtttcttttctcgtttaattttttgtcacaaagtgcatatcatccctcaaacaattcctttgaatccgatttaattctatcccgaatgtcggactgtctaaattccacaccaattcaaatcctatctattttaatcttccccacatttttcttttctctatttccaccctaattttccttttctatatttttttcctttctctgtttttcttccccctccttccctttctctgttttttctctttcttcttcctctctctgtttttccttttctttctttctctacttggctagaccaacccaggccgagccagcgcccgtgttgccttgcgccgatccctcaccatgctcgcgccaagctcgtgccgacccgcgcacgccacacgcccgcacgtgcgcacacgaggacgaacgacgaacgaatgcctggacgacacctccagcttcccgcttccgtaactccttcgttcctcaactagaaggctgaagaatggaggcgaaagaaccgcaatttcgacctctttcaccttctcaagtctgcccctactccaactaactcaatcgtcgtcagcggaggaaaattcccagaaaccctaataccggcaccattgattgaacttcaaaattcgtcgcatacatcgtcaatcctctgaaatcgaaggtaaaatcggattctccatgccgagtactcccattcccctctctttacccatccaatccatcgctggaacgttgccggcaccgcctcccggcgtcgctgctctgttcggccgccgccagccgcatggcgcgccgccgctccagggcgccctagctttggccgtcgccaccctgggactcctctcgcctcagtgaacctcatcaagccaccgccctccccggagttcgccggagtcgccgccgccatggccgcctccacctcctattactgcctgccgccgccagcctcgccaccggtgcttctctcgctgccgaccacaaaaacggaatcgcctcgacctctagatcacaaaaccggtgcccccttaccgaaaaccggcctcctcggctgccagcaatgtgggattccggccagttcctgtgcagagaacgagaagaacagaaaatctgattttcctgttgaaaaataaatcagaaaataccctttttcttttcctatcaagttgaccatccgtttgacctcaaaatcgaaattcaagacctattccaaactcctagaattattccgaatccatccgtgtcagttttgttgcaatccgagcacccgttgtagcaaccctaattttagccatagggttcgccgttcaccgaaattccaaaaatccctaaaattatttccttaaatcctttccacccattgttgcactttgtgatactatttgttttggttatctttgtttttctattatttattgtagtgatgattgttgcgtaaatagaaaacgctgacgttggttcggtagtcgaagcgagtgaaatctccgcgccaggaggagacggtttgtacgactacatcgaacccgaggttgcaagacatgcaccctcctttgaacaatttaatcctagtagatagggagctattttagtagtgtacttgtcctttggagtacgatagattgagcgaattcttttaaattaattatattgctattattgcattatattttatgttgttatggacgccttaatgagccttagagtctaaccaacttaggataaaatttgagaaacatttaaacaaactgttaattatttaacatgctatctatttaatatggatattattactgcatatgaaaacatgcttatggaactatttatggctatatgctaagaactgttgacaccgcttgtgagcgggtggtacacatgatagagttcatgtgtttggtttcatggacctgtttatggtcgtgatggatatgtggatatatttatggttatttcttatttaaaattgatataataatcaacccccttgtgtcaataagaatgacatagtttcgcccatccacacgatcgatttgtcaaacctagccgtatattgctccaattgattgaacttctacaggcctttcggtgtactggccattagctttcaagtgtgtgaagcaaagtgacatggttcatgtttatatgatttatatatgtgggctcgatgggccccgagagttcaaaactaccctatgggtccacgaagttctgggctgcccatcgagtaacgaacaatggtaagtggatgcggaggtaggttggcacacacctcggaccggatcactccgagcaacatcccgagcatcctttaacttactaggcagaagggagagatatatgtagcaatattacaccttgttacttttcagcccggccagctgtgggtatcatgtgggtcaagctgcgcagacgctacagagtcgttgagtattcaaatatgccgtgctcccggttaatggagatgtgtctatgggtgattccagattatgggcacaagttaaactaaatggctattaattaatatagttaacttatttatattactttatgttctattcaagttatttataagtaacatttatacttttatgctcattattattgtttaaattaaatgttcaatagtgttgtttatatcaaatgtttattaagttaggctctatgaaataactgttaaggttagggtttaaaccttccagctctcgatactgcaagttttatattgcaattattgtatttattatcataagcatgtcttgctgagtaccttttgtactcataaatgggatcagatcatgaggaggaagatgcttgtggagaacctgttgatctgttagagtgggacagctatggtttctaggtcatcatatgcttaggcagttcctgtggtgaagtctagcagtttatttgtttgtagaaataaagctttataggccatatatgtaatggtttgtatttatgtgtgttgtgaactaagtgacttaagtattgtataatcgaaggttatgcttttatatcatttcatgcgtaactgaacatcctgggcagttacttattcgtggggcaccatgactttatcgggtgtccccacaatagcccttttagaccttccgatctccctgtcatccaagtaaaagggaaaaaacttgtgttaaagtataccggagcccacatttcttttgcttcccacaagttattcaaagtttggtttccatggaggtcatattcatctagcatttttttcaaatatgatagaagctgatctattgtttcaatcatatatgcatctacacagagcttcaaggaagcctttctttgaagtatacacgggtaggagttgctgatctgcttttgttgtcacgtgccaaaagcaacatctatgaattgtaccggggaacacctttttaatcattgctctcattgctttatctcggtctatcatcactgaacctgacatctgtccattcattgctcgcatccatgtttcaaagacccatatgaatgtttcagttgtttcatcacaaatcaaagcatatccaagcaatattgtttgcaggtggttattaattccaacaatgggtgcaaatggcatgttgtaacggttagtcataaaggttgtgtcaaagaagacacagtctttatagctttgatacagttttcgtgttctgccatccacctgttaacaaccaaatttggtaacatctgtgtcaggaaagaaggttggatcaaagcaaagttagaggcagagatcaagttcggaaatagagcaggaatcggctggagtccagatcggctatgattagaatcggctaggtctgagtcgggctgagtaagccgatacagctgattccgacaatacgacttgtacgcgacatcgggttcaagttaatgtacttcaagatgattgccacgcacggatagagtcctgggaaggcaattgtatctattaattaggatatttttatgtaaattccttatagataaatgtgggcaaaagtctgtcgcaaagacttatggtatcttagagtttgttagagataatagtcgtgtccggtgtgggcatatcttgtaattctcgggtataaatagaccccgagccctatgtaattaacaacacacacgttcaatacaacttcagcgcatcgccactcttttgctttagttttgtttcgacaagttcttgctttcgggttgagctgcatcggtttcgatattcaacaagaggtaaaacttgttatgacggattgtgttctcaagattagtgtttccatctttatgatactctaatctcgtttatgtaattcgtcgagttatcatatatcttacataatcttgggcaatattgatatctaacctactatcggctaacatctgttagcagagggcaaccgattaggttagattttgacgttgatctagattatataagatatctaccaccctatgaaatttctagcggcttgattgtctagatatcgtttttcttttcatacttaatgttgtatcatttaagtttgatctatcaagtcgtgcttagaatatcgatctctagcctgccttctagttgccgattagaatagcatcggagtttcagccgatcttatctgatttaactacatttgttctatatgcttcattgacatgttaaactgtcctttatatcaagatattgctatatctaagcatgttaggcctttgtttgacatattatacttaccttaatatcctgatatagagtagtatcggagtattagccgatacacgctagatctatctgatcggctatgctataaacatatatagtcctgttattgatatatatttcaatctaagtgatttatactgtctcggcatggtgaccgatctatcccaatcacttggtttaagtatatatccatataaggagtatatatcgttaatgtccacagccgatcgagtagatttagttcttctttacttattcatgaccgccgatcgatacacaggtaacatcggctcaaagataaatgatatgtcatcggcatctagccaatcggctatcatttatagatttaaccacggtttctttgcttgtatttcttaatgattacaggatcaaatcaactggcacgctaacatacctgaaggcaagctttggacctgcactggagttaagcagatctcccaggccacgtgttttctgtcaacacgcttttggcacgcccggtgggacctgtaagaagtcagacgtcagttcttcctcatggccgagaaacaaccaccaccatctagcccaggttccgttaatggcaaggtgttgggattgactgacatcattgaagaaaacgtcatgccgattgatccagagaagttcacgcctgagcagaaggaagagtttgaagcaacgttgcagcatgcatgggatcagttcctgaactcattcatgcagacccgcaaggggacacttgtttagaagtataaaataaaagtggttcctgatagtcctgggaccggttcttctaaagatggagaagtgaaacaagctcctggcggctcagctcagccgagttctaaaggtgttaccgacggctctccgagcgatcaaggcgacaattctcaaggagttcatggcgttcaaggtgatggtgctcaggagccacaaggaggaaatcttaatcagaatagtgaagtagcacaagattttttcaataacttccaagatcgggttgattatgctgtgcatcatgctttgatcatcaggcaatagccgggttgatcatcagtccagggtattagtcaataccttgtcaaacatgatgaagacaatagccgatggttcgatagctgagcatcaggctgctggcccagttggtgtcttcccaaattatcgatctttgatcaccgatgtttagccatctgttcaagcagttccctctattgcacccacaactcagccgacggcgccagcgtcgagtcctttacctgctacactagctatgacgccgggacagccggtgaaccctcggttgttaacaagggaatagccacagcatggcgggcaggctgcgaatcggctaactcaagatcaagttgctgccatgtttctgccacctccacctgttgtcgatccagtacagcaacagccgattcagcaggcacccccaatccagccggttgtacaaccaatccaacaacaggtcgtacaaccagctcagcaaacaccaccaaggcagcagcctctgcaaccgattcagcatacaccaccaaggcagcagcccctgcagccgatccaacagactccgttgaggcagcagatcgttcagccgatttagcacccggggtcagtaaatgcatcggccgggttagcagtacctggtggtcagcctgtacagcagtttgtaaatcaggtcatcccagagcatttggttcaccatgcacagccggatggcacagtgatgcctcagatgattcctgagcacttggtgcgcaatatccagccaaatcttcataattaccaagggggtaacttgagttatcaatatcagcctccttccccgcaagcccaatatcagccagggggatcggctcagccccagttcgcatctcagtatggtcagtttgagcccatgcaacaacagccacaaggagcagctcagcaacgaccgtgggccgatgtgattgccgatgtaatgagagaacagtttgggcttaatccaaaagagactggaagcttgtatcgacagccttatcctgagtggtttgaaagagtccctcttcccaatcggtttaaagttccagatttctccaagttttcgggacaagacggcgtgtcgacttatgagcacatcagccgattccttgctcagtgtggtgaagcatcggctatagacgctctaaaagttaggttattccggttatctctgtctggatcagcttttacttggttttcctccttgccatatgggtcgatcaatagttgggccgatttggagaagcaattccacagctatttctacagtgaggtttatgagatgaagttgtccgacttgacggcgattaagtagtggcatgatgaacccgtgcacgagtatattcagaggttcagggagatgaggaacaaatgctttagcttgagtttgactgatgctcagttagccgatttggccttccagggtatgattcctcctatcagggagaaattctcgtccgaagactttgatagcttatcgcatctgatacagaaggtaaccttgcatgagcataggtcggggaagtcaggaaaagctttaagaaagttaatcatgtttgtccatacatgtatgggtcggatgacgaagaagatgattctgaaatagctgcagccgaatgggtgaggagcaagaaggtcataccatgccaatgggtaaaaagtcctggaaaagaggaaaagtatgactttgacattaccaaagctgacaagatctttgatttactactccaagaaaagcaaattcagcttcctgctggtcatacaatcccatcgcctgaggaattaggcaagaagggatattgcaaatggcattattctggatctcattctactaacgattgcaaggtttttagacagcaaattcaggttgccattgaggggggcaagattaggtttgatgattccaaaaagctgacgaaggtcgatagtaagctggtcaagcagccgatggggtccgtgcaaagggttttcaagtaaattcggctaagattatcaacaaatatcagagaaagtatgacaagcagcaggagaagcattacaaaaaatacgatgatggtttcgatcctcattggggttgcgagttctttagattctgctggaatgaagggatgaggttgctatctatcgaaaattgccctaggtgcagtgaaatcatcgagagctcgagccggccatatagtaggggcaatcggccgaggcaggcgagactttctgttcatcaaagactgggttcggtgaatcaggatcgtggccaagaagatgaggcaatcaggaagaatcaatggtgtccttctggtattttcacaaaaaatcagaagagaagggtccaaagattgaggaacagggagcgcctttaggaggttgaacaagaaatcaatcatcggctgcggaaacaaaaacaagacaggagtggcatgttaagaatctggttcctgtagctgatgatgctgcagccgatgaggcgaagaggttggcaaaaggaaagagtgttgtagcggcaccaattaacatggtctttacattgccagctgaattcgggatagatcaggccgatgtcgatgaagtggaagaggaatcggctaagttgnnnnnnnnnnnnnnnnnnnnnnnnnnngataaacacgaggggacagagaatcggcatcttaaaccattgtatataaacggctatgtcaatgggaagccgatgtctaagatgatggtcgatggtggggtcgcggtaaatttgatgccttatgctacgttcaggaagttgggtaggaacgccgaggatctcatcaagacaaatatggtgctcaaagactttggtggtaatccatcggaaaccaaaggtgttctgaatgtggagctaacagtcggcagtaagactattcctaccacgttttttgtcatcgatgggaagggttcgtacagcttgttgcttggaagggattgaattcacgccaattgttgcattccttcgactatgaatcaatgcttgattcaatggcaaggcgacaagatagagattgtgccagccgatagatcagttaatgttgccagtgccgatttagccctttgggagatggatggccttgattgtttatctggaaaagtctgggatggagattttttaaaagtgtccgattctgatatacagccaattgaagatggagaacccaagctattactttaagggcgtcgtggagggttcaaatgtctacgccaaagatacggtagatgatctcgatgacaagcaaggtcaaggtttcatgtcggccgatgagttggaagaaatagacataggtccaggtgatcggccaaggccgacatttattagcaagaatttgtctccagagtttagaaccaagctgatagagttcttaaaagagtttagagattgcttcgcttgggagtattatgagatgcctggactcagccgatcgattgtcgaacatcggctacctatcaagccaggggttagaccacgccagcaacctccgagaagatgtaaagccaatatgctcgaacctgttaaagctgagatcaaacgattgtatgatgctggttttattcgtccctgccgatatgctgaatgggtttctaggatagttccagttattaaaaagaatggcaaggtcagggtgtgcattgattttcgagatctgaataaagctacaccaaaggacgaatatccaatgccagtagccgatcaattggtcgatgctgcgtcggggaacaaaattttgagttttatggatgggaacgcaggatataatcagatctttatggctggggaggatatccataagacagcttttggatgccctggtgcaaccggcatgtttgaatgggtcgtcatgactttcggcttgaagagtgctggagcaacgtatcaaatggccatgaattatatatatcatgatttaatcggctggttggttgaagtttatattgacgatgtggttgtcaaatctaaagaagtggaggaccacatagccgatttaaggaaagttttcgagagaaccagaaaatatggcttgaatatgaatccgacaaaatctacttttggtgtgtcggctggccagtttttggaatatcttgttcatgaaagggggatctaggtaattcaaaggagcgttaatgcgaacaagaagattcagcccccggaaaataagacagagctaaaagagatgatcggcaagataaattttgttaaaaggtttatttctcatttgtttggaaggttggaaccttttacacctttattgaagttgaaagccgatcagcaatttacttggggggcagagcagcaaaaggctttggataatattaaggagtatctcagctctcctcctgttttgattcctccacagaaaggaataccgtttaggttatatttatcggctggtgagaagtcaatcggctcggttttgattcaagagttggaagggaaggaacaagttgtattttatcttagtcgacggctcttggatgctgagactcggtattcccctgtggaaaagttatgcttgtgcctgtatttttcgtgtataaggttgaggcattatctattatctaatgagtgcactcttatatgcaaagccgacgtagtcaggtatatgctatcggctccaat

SEQ ID NO: 73008 - DNA, 9607 bp, Oryza sativa
  unsure (1)..(9607): unsure at all n locations
cttgttcttccggcactcgtaagcatttctttaattgagacacatggaagactgggtgcacatcagcgatattctctggtagctgtaactgatatgcgacttctcctcttctagccgtgatttgaaagggtcccacgtatcttggtgctagttttcccttaaccctaaacctttttgttcccctcatcggagaaacctttaaataaacgtaatctccttccttaaattctaggtttcttcttcgggtgtcggcataactcttttgtcgtgattgtgctacctttaaacggtcacggatcaagcgaaccttttcttcggcctcattgataatgtcaggtccaaataccgcccgttcacctgtctcagaccacatcagcggcgtccggcatcgtcgaccaaacaatgcttcattgggggacatcttcaggcttgcttgaaagctgttgttgtaggagaactcggcgtagggcaaacacctctcccagtctttgctaaaatccaacgcacaagctctcagcatgtcctccagtacctggttggttctctccgtctggccatctgtctgtggatgataagctgtgctaaaagcaagataacttcctagggcttcatgtactttttcccagaaatgcgaggtaaactgtgtgcctcgatcggatataatcctcttaggtataccatgaagacacactatcctggtcatatacaactcggcaagtttagcactgctatagtttgtcttgacggggatgaatcttgccgtcnnnnnnnnnnnnnnnnnnnnnnnnnaaatggaatcatatcctgttgcggtcttgggcaatccaacaataaaatccatacctatctcatcccatttccattcaggaatcctaaggggttgcagcaagcctgccggtcgctgatgctcagccttcactttttggcatacgtcacagagtgctacgtattctgccacatctctcttcatgttgggccaccagtatccttccttcagatcttggtacatcttcgtacttccggggtgcaatgagtatgccgattcgtgagcttcctttaaaattaatcccctcagtccaccctgttcgggtacgtaaattctctttttataccatagaacatctttttcgtcgattgaaaattcctttgcacgtcctgcagctaagcgttccttcaactctcggatttcctcgttgtccttctgggcttcttctatttgggttctcaaaagaggttgaatgtccagggtgtttatctgtccatgaggtactatatgtaggttcagctaagctatttcctccctaagctcaaggaccatcccttccattctcagatgattgcaatggctcttacgactcagagcgtcggccacaacgtttgctttgcctgggtgatagtgaacctctagatcatagtccttgattaattctaaccatcgcctttgcctgaagttgagatctgactgggtgaagatatacttcagactcttgtggtcagtgtagatatcgcaatggtttccaattagataatgtctctaaatctttagcgcatgaaccacagctgcgagttctaggtcatgggtagggtagttttcctcatgtggtcgcagttgtcgcgacgcataggccacaacttttccgtcctgcatcagtactcctcctagtccttgccttgacgcatcacaatatataacaaagtctttcctgatgtcgggaagaactaaaataggcgccgaggtcagcttttctttgagctgctcaaagctttcctgacactgttctgaccacataaaatttttttccttcctgaggagttgtgtcattggtcgggctatcttagaaaatccttcaataaaccttcgatagtatccggccaaacctaggaaactccgaatttcggtcaccgacttgggtgctttccattctgtaacggcctctacttttgcagggtccactgctactccaccggccgagattacgtgacctagaaaagcgacttccttcaaccaaaattcgcacttgctgaattttgcatataacttgtgctttcggagtttctggagcaccaatcgtaagtgttccgcatgttcttcctcatctttggagtagattagaatgtcatcgatgaatactaccacaaacttatctaattaatccatgaatactttgttcataagattcatgaagtaggctggggcattggttagaccaaatgacatcactgtgaactcatacaatccatagtgtgttgaaaacgcggtcttgggaatatccttggtcctaatcttcagttggtggtatcctgatcgaatgtcgatctttgaaaacaccttagctcctttgagttgatcgaagagatcatcaatccttggtagtaggtacttgttcttaatagttacttcgttcagtgatcggtagtccacacacattctcatgctaccatctttcttcttgacgaatagcactggggctccccaaggtgacgaactggggcgtacaaatcccttttcttgcaactccctaatttgctttttaagttcttctaactcattaaccggcatccgatatggtctcttggatatgggggcggttccaggtatcaggtcaataatgaactttatgtcacgatctggtggcattccaggtaaatcttctgggaacacatcaggaaatcgctgcactacaggcattccctttaggggtagcatggtaaatatacctccggcacgttcggttagcctaggatcttgatccatggttgctctcatatccgatccccagggtgtggttaaggtcacctctctacgcccacagtcaattacacctctattctttgttaaccaatccatgcccagtatgacatctagggtctgaggtattaagatcataagattggagggaaacaccacgtccctaagacgaattggtacgtctatgcaagcatgactcacagttatctcgcccccaggtgagtgtactatcataggctttctaagtcccactagggttaagttgtgcttttgactagccttcagagatataaatgaatgcgatgcaccagaatcgaagagaactttaaccggggtagaattgatagagaacatacccatgagtatgccctgatcttcctgggcctcttcagctcggacatggttcacttgtccgcgcccaagtccagtggcggtcctgttagattgcggagtcttgaatagacctcgcccggtaacaggggtagtagtgccacgaacagtcattgcattcgtgccggtccggacaggagtcttgcgtggatgagggcagttgttggcgtagtgcccataccccccgcaattgaagcagttcacattcatcttggctccaggggcagccaaagttggtgtaggggtgcggttctgaattgcaactggcctgttgaagttgctaggtgcagcgggacggttggttgccacgatagggggcttccatccggatgaagtggctcccttgagtcgctgaggcactatctgaggtaggcgactcatagcaagcctcctcttgcggttgtgttccaccgtcctttgatcgttctctagcctgacgactttgttgatcaggctctggaaactctcgtgatcctgcccgatcataggtccacgcaattcatcattcagcccttctatgaacttgtcgatcttttcttcttcatccgctaggtctccaattgcatagcgggccaactgagtaaacttgttcagatattcttgcaccgttgtattcccttgccgcagccatctaaactcgttcttcttcatgcgcatcactgcagcaggtacgaagttctcgcgaaatgctgcagtgaactcctcccaagtgggttctccagcatcgttttcccgagcttccttgtaggtgtcccaccaatcactagcgggtccttccagttggtttactgcgaagattactttgtcggtttcgcgtaccctgacaagagtcagtttcttctctatgatgcgtagccagtcttctgcctccataggctcatctgccgtagcgaacgtgggtggcttggtcctcataaactctccaaagctcgatccgccgcggttgccttggttattcgcaatggcttgtaggagttgggtttgagtggccataattccggccagggtggttaggtccggtgtctgagtttcttcattgctggtcgacgcccgacgtcggcttgccatcagtgatgtctggcttgatctctgactcggtgttggtcccctctgtctcggagtcgacctggatcggagtgtccaaactggaacccagctgcggagaaggtgtagggatcagtcgggtgtgcacaatctccggggcaggtggctgtgtcgctgccgggtccactaggtaaggtgctgactcggtagctagcatactagcctctcccaaaagagcgtggaacgccggtgggtacggcggggtgaggaagaagtagcggtcacggcctactgctgtggaagtagaagcccctgtggtgctgatcttggctgctcgaagctgctcctctagctggctgacgtgctcctgactctctctcagctgctcctcaagagtatccatcatcctgcggcgatcgttatactggttagataactgctggaactggtcgccgtggacctggagctgtgccttcagtgagtctatctcactgccccaagcctggtgctcctcctccaactgaagctgctgcactgagaggtcagtcaactcagtctccagctctcccatacgtctctggtggtcgtcaatctccaacagagcctcctcgtagtagtcatctactgcctcagcccatcgtgacaaccgagtcaccatcgggttgtagcagcagggcgtgtcctgaactgtgcaaactgagttgctctcctcccggaacgggtggtgagcaaactcggtactcgctaactcagctcggtggatagagctgagtcggaggaaggcctcccgggctgcatcctgcatcgcggtctctggcaggtctcggtggtgacgtgtctgaaagctgtagtccaactcggaagggactcgggggtgaacctcgaccagagcctcccaaactgagccacactgtctcactcggtatgacgggaacccagagtatcgcagacgcctcaacatccgatgcagctcaatgacatacccctctgattgaggtaagctcaactcccaggtagcgggtgaatccggatctgccatctaattttaagaaaaacccaaagtcagttgagagtaaaacttgttttgtaaagaaaatagttaagagtaagatgaaaatagcgtttttatatagcgtttttatttttgaaagtattactaaatgggaatttctcccttagccaacttagaaaaggggtggggcgccttttggtcttttcctacagtcgtatggctctgataccagctctgtggacccccgtttttataacaggaatcaatcgtgtaaacagtaccatttccctggatcaaatagtctggtacacacgaattcatagctgaaataccaaatacacatacacgaatgtctagtacgaattattacatcataagcctgcaggcatagtcttaaatcatcggaccgagcggtccggaatacatccaaaagaagaaataggtaaggcaacagaatttaagcaacggcatgccattgccacaggcaacgaccgtactaagacctactgggcgccttcgtcttcatctccctcctggtagtaggcatagggatcctccgaagcttcatctcccgcttctgataaattttatatttgcaagggtgatgagtaccaaccgtactcagcaagccaccacagcaatgatgcacatgacagaggatttcaaaggatggctatggttcatttgcgcaaagcaagttttgtaattcttttcacaagcctaagacctagcaaagactaatcaagttttaataccattgttcatattaaacaatgacggttctgtccaccatccattgtgatcccaaggatagcttcccgccattgagtcgttatgattttctgaggacgtccacgtttccgcctctcaagaagtggctccatcagcataaaaattatcatgcaatattccatcccactcaagttaaagaatttagagtctagccaagtgtaatacatgtcccggtgctcattaactgcaagcacggctattcgaatagatttagtttactcacactgcagtggatgtacactttacccgcactccgcgactgcccaacacatgagcctcatcccaacacaagagacgcgtcacggcaaagcttttcgataacctcgcattggcagtacccgcttcgtgaactttacatcctcatgcactctaggcgtcatacgtttctagcagtgagaggagttctggcgctcccgggaagggaaaaacacacactcctacgttgcttcttgtcgttgaacccagtccatcatgattgttctcttatgggtatcctcatgtagtattgccaagccagcctctgaccatccggaacgggcatccgccattcacctggccatccgaaccgggcatccgccaacagactgcttgccacatcacacacctaaaagaagaccactacgcatggatactgcctccgctcagctatctactccgctaggtctatacccatacgagaagtgcggttgtacggggggtcgtttcatgcttaacttcatggttcggtccttaattgaccagggacggcactagccttttccggacaccacccaaatcctccagccgccccagtcgaaaacagttgtttaactttattttcctttcacaaatcatgtcatcaatatcatggcaatgtggcgctcatgtctctacatgccgcatctcaattaccttcccaaaggtaattgcccaagcatatagcatttgataaatatgagtatgcatgattctagaatagcatttctaagcaattgtcataattgactagagactcatacgtaaacatggttacgaaggaataaggggtaaacaataatcaaggcatggcataattacaagtaggatgttcataattgcatgcaattttatttgtaaacaaaacaatttcgcaattgggatcaacatgttcaaggaatagtgatgacttgccttactcaaggtcttgcgggtcttggccttcacctggatccgcggctccctcggtctctataattatgtgcgaaagaacaatttgaattcgattagaattcaaacaaaatccaaataaatccaaatgaaagtcgaatgcgaaagtcgattcctttattttaactttattattcgcgaactaaggcaaacccaatttcgattcaaactattttgcgggtataaatgttttgttgtcataagtttttaatttaatctacccgagcattatatccatataataggttagagatttctatcgcgagctaaatatcggacgaaatcctagaaatattacatgatttaatttagtctatgactagatgattaaatataatacacggctaaaatccctaggaattaaatccgaatttctaccgtgaattgattacttatagggattacccaaaaaaataatatataataatccataagaattcatctatttgtttagttattaactacatctaaattattaccgcgaattgatttcttatagaaattgccaagaataatccataatttatattaaattttgcaattctatgactataattaacctataaaattccaattattttaaattttctaaacttccctaatctccctctaattttctatttatttcctttttctttttctccctttctttttctttttttttctttttcttttcctctctttctttttctctctctgccggcctctcttttcctctccctctctctctcggctctctctcccacccgagcggtggcggcggtggacgcgaggggaacgaagggcggctcaccggcggcggcagcggcgacgacggcggcagcgacggtggcgcacgccggcgcgggagtggcggcacggcggcacgagaacggcggtgcgggggcacgggaaaaatggcgcggcaacaccttaaatgcgnncncggtagcggggagatgaagctccgncggcantnnggngnnggcccggtanaaaggnacgtcgcctaggggaatgggtgtggggganaaaanaagggctgggggttttatagggtgtgagagagagaaaaagaggggcggtaaagagggtagcaacgcggcgccgggggggcacaaagggtccggccaaggggccgcgaggcggcgatggtacgcgcgcggcgacgggacgcacgtggcgatgggacggcgcggcgcgacggcgatcgcgacggcggtgtagggctcgaggcggcgacggcaacggcacgtggcgacggcgacggcgcgcggcgcagcggcgggcgatgggacgcgcgcgcgacgagacgggtggtgacagggcggcaacggtggcgcgcggcgcgaggcgggtcgcgacggcgacggcgacaacgcggcagcggcggcacggggcgcaaggcaacgtgacgggcgagcggcgacggcgacggccaaaggcgacggcggtagcggcggtgcgcggtgcgaggcgtggggcgcgggcgcggcgtcggcgcggcagcggggcagggttaggctaggggacctcgtcgaacacctggcggccgacgaatagcgtcgttttctatttacccgatttaagcctatttatttatttaaaattgattctataaaccttaatttttgtacaaatgaagttcactcaatatttgtgttattccaaccaatgggtccacccttgattaattttacccatattttatttttatataatttccttgaatttaattagagttaattcttattccgacacttttcaatttaattgatataaatatagtcgtaataatattttactcatttctatactcactaaatattattttaaattgtactttaattatttacttagtcaatttactttttagggtttattcctaactaattatccattattcgcgatttataaactccgaaataaaaattcaataaaataatcgaacaaaattggcatgatgcaactttatttaaaaagtttttgaagatccgtatttttagagtttagattttgtcgtcgaatttttagggtgttacagatacggaggaactcggcgagtttagagtgttgtgggggtggtggtggagcattatgttgtggcggattttggatgtggtggaggaaagcagccatcatgttggcctgctgggcgaggatttgggtgaggatggagttggtgtctggtggtggtggtggaggcgggggaggaggtggaggtgggctgccatggttgttgtggttgctaccttcgggttggttgccatcaccggtagtagcacttctcctggttgtcaccttctaaaaatcccacacagacccagcaaacagagagagctgactattaaaactaatcacccacgactaccataattcttgaatttattattgctattaaatgggttcattaaggttcaactggcttaagcaaataaaataaagacaggctccga

SEQ ID NO: 73009 - DNA, 9734 bp, Oryza sativa
taaaactagggggacacatatatatcaaaatgcaatgaaaaattgttgatcaaaatgcaatgcaaaatttttgagcaaatttcaaagtcatattaatcggcacaaaggattgttaagacagtacagtattagaatgtcttagctgattacaaaagtttctaagtcctattacataaagattattgagataagtatcgctggatagccgatatggccttctgcctaatctgttctacttcctctatggcttgggcatcttgagcgtcggttctagggataactttcagagacttggtcagatcagcaacatgcttgatagccgatttgagtcttgctttctgttcttcaatagactttgggagatcagctaactttgtgtgctccatatccagctcagcattgcattcttcgagttgtgctaacaggtcaatcttgcgagcctcgagccgatcaatgttagacttgattgggccttcagatagttgatcaagcttggacttctcttcatgtacgagttgtcagttagcttggatagtggcctcaatgtccttgcgttctcgccgttcggccaatcttaacctggctttctccagtttgaattgatgttgctcaagataaacggctagagtaaggatgtcggctaactcatctgggattagagcctgaatctcatgtagccgagctctgattgagccacaatcaaccaccaagctatctagtgatgatgcttctagccaatccaagatacttcctagagttttcttcacatcatcagataaaggggctaaggctttgcttgtggtgtcttcttctccttcatcaaggtagtctccgatgtcgaaagagaaaagatcagctaagacctgcaacaatgatttagaagcagttagaggttaaacgggcatagccgatctgcgtgtctgttgtcaagggagaacttactgggatagcaggaacagctggttgaatttcttcctctatatggtgactccctacagctgatggagtctggtcactagatgattgatgttcagagggaggaggaggctaaaaagaaacaagtgttagaccgaatcgactggaaattaactaatgaaggttaaaactatcttactggtggagctggtttagatattgtcgcagtcgatttcttcttcaccgcagtcttctttttatgcaattataaaacttgggagtgatcggctataagacaaaataattatgaaagggattaaagaaagttgcctactcttgaaaagtggtccggagcagaaggtgttggaggggtttgcttgggcgaagtagatggtgttctttcagtatctcttacttcggctgcagcctgatcaacttcgtcttatattatctcttcatccagagcttgttcaatggaaggatctagggtaggcaggtcatcggctggcttggttttctttgtcttcttcttcttggttggggctgcgatgtttatagccgatgatctggtttttctctttttgccggcatcggctggttctctgatgagcccttgaagaagagctgaggtcttgggggcatcatagccaataaccggaggagatagcccacctctgttaggaattaaacctggggcatattggatatccctgccactgttgctttgatgaggaggagaagattctgttgtctgcaaattaaaaggaggattagttgaggttaatcggctaaacagctatttaaacgaaatcaagtagagttaaagacttacttgagggacaacatctggaaaaaggtctgtcatatacattgaagctggttggtgaaataaatgcagcttccattcgccccaccacctgtcaaagtttttgcttctgaacgttgccagttctatgttgtcaatactacccatagggggtccttggaggttgagcagccgatccatcatcaaggttgatgaaatttctcctcggcattggatcttgttggcaaagaataagtcgattgggagttggcccattccaagttgtctagctgagcttattggatgatagaattcataagaagattggatgtttcttccttgatgaatgccaacaggaaggatgcatgggctgattgcagctgagaaaatctccctagacaattggtatatttcgtggttgatgtcttcaaatctgaagtccaatgggtgctcaagttctgcagaatcttcataaagaaaccaaactcgagtatctttttgaaagctttcatagaagctatagaaccaatctttgagcagttcagccgatagttttaccccagcatcggttggtgtagaggcgtactctccatatgatgtgcatctccgatgagtgagttcctctccgtcgtcattaacgattggctctagtcttgggaactcagcctctgatacggatggccgattgacaaccttcataactattaggtttaaccaagtttgtagcagccaccagggtctacctgctccaactactgagccgacagctatcttggccgatgcattgttcaacatctggtatagatagccgaggaggattttacccaaggggaattgtatctttgtttctagggcttcagctagaaattgccagttggttgtgggaccgcaacttgatccatagaaaagaaattgttctagccacattaacaagaaagccacatgttcccgaggggtgaccgagccctggcccatatatgctgctacgtagcttgaccagcctcctatgcttttggtcttgaaatcatattggttttttgtgttcaaactcataggattggccgatgaggtgacatccaggcccatgatcatactgatatctatgagagttggagtcatcggccttgattaaacaaaaaggcattaatggtgtttgaccagaagtaagaagcagctaccatcaggggttcatctttggccgaatttgctatagtaaggtcaagtgcttggccgattccaatttcatcccaatgaaccctcttgctggctgatacacgtttgaaccatgtagtgcaactcttttttggtggaactttctctagagacggccaggacttgaaagtattcttccagtgacctagatctgggttggttaatctgaaggggatcctattgatttcaccaatgatgaactcggtggggtcaggattgccgactgggccgagaaagtagtggttttcatgcgactggctgggaatcgcaactaggttggagaggtgctacaaatccaaagcgatccagaggaagagagcaatatgagatatgagaaaaacgatccgctgctaaagaaggggagttagccgatgagaacttacatcggcatattctgctgatggcgcaccagatgggctggcggaagacgacattgctgcgggcggaaatctcatcgaaggagaggtcgcctggaaatcgcctttgtgccggaggagtcgccagaggagagagagaagaggtttcgcttgagcggtgaaaacggaagtcacggcgtgagatttctcgggggtaacggttagtatttaaagcgctggaataacggtcaaaagcgtcggagtgcgaaacttgctcggagtcggtatacggcaaatccggaacattatcaaatatcccggacttggggggcatgtattaacaaccaaatttggtaacatctgtgtcaggaaagaaggttggatcaaagtaaagttggaggcggagatcgagttcggaaacagagcagtaatcagctggagtccagatcggctacgattaggatcggctgggtctgagtcgggctgagtaagccgatacagccgattccgacaatacgacttgtacgcgacatcgggttcaagttaatgtacttcaagatgattgccacgcacggatagagtcctgggaaggcaattgtatctattaatttggatattttatgtaaattccttatagataaatgtgggcaaaagtctgccgcaaagacttatggtatcttagagtttgttagagataatagtcgtgtctggtgtgggcatgtcttgtaattccagggtataaatagaccccgagccctatgtaattaacaacacacacgttcaatgcaactttggtgcatcgctactcttttgctttagttttgtttcgacaagttcttgctttcgggttgagctgcatcggtttcgatcttcaacaagaggtaaaacttgttatgacggattgtgttctcaggattagtgcttccatctttatgatactctaatctcatttatgtaattcgtcgagttatcatatatcttacataatcttgggcaatattgatatctaacctactattggctaacatctgttagcagagggcaaccgattaggttagattttgacgttgatctagattaataagatatctaccactctatgaaacttctagcgggttgattgtctagatatcgttcttcttttcatacttaatgccgtatcagttgagtttgatctattaagtcgtgcttagaatatcgatctctagcctgccttctagttgccgattagaatagtatcggagtttcagccgatgttatctgatttaactatatttgttctatatgcttcattgacatgttaaatctgccctttatatcaagatattgctatatctaagcatgttaggcctttgtttgacatattatacttaccttaatatcctgatatagagtagtatcgaagtattagccgatacacactagatctatctgatcggctatgctataaacatatatagtcctgttattgatatatatttcgatctaagtgatttatactgtctcggcatggtgaccgatctatcccaatcacttggtttaagtatatatcaatataaggagtatatatcattaatgtccccagccgatcgagtagatttagttcttctttacttattcatgaccgttgatcgacacacaggtaacatcggctcaaagataaatgatatgtcatcggcatctagccgatcggctatcatttatagatttaaccacggtttctttgcttgtatttcttgttgattacatgatcaaatcaactggcacgctaacatacccgaaggcgagctttggacctgcactagagttaagcagatctcccaggccacgtgttttctgtcaacaccacccaaaacagtgccttcaacacgttgtcctcatcatatcttgcagcatagaagagggaggggttatctgcttgagttttttgaaaataatcaatagtcattgcaacatctttgagtgaaacttgttgtctcagttttgtcctcaaatttgagacatctttaacagtgaaagttagattcctcacaccaccgtgcaaatctcctaacaacgccaaaatctgcgatgttgcaatgtttcgatcatgcaaagtctttagaaattcatagtattcatttgagatgtgcctgtgagatctataatatctccttcttctaaggcgcttcaccatcggatgcgtgtgttctggttggaaagcaataactctccactttttgtccctaagccctacagccatatgagctttgcaatcatactttgcaacctttggttgtttcctcttcccttccaccaacaagggagccttctttttgtgaccttcaagcaggggttgattttccttattcccttcagaaatgaagctactgccaccagcactatcttttgtggtatttttttggcttacatgcataaacacactcaaattctctccttatcaacttcggttcatcattatgattgtctccattttcatatactttacatttcttcgatgccttttttcccctgatgatgccaggctgtttctagatgatgcaattcttgttccaaatcctaactttcatgcccaatgaattcggataatagcacatcaaggaagccaccagatgagcttggtgcttggacatcaatctgtaacattttgttttgtttcattaacttgtacagttatgtttcagcaagttaatgattattggtcaagtcaaattccagtccaaatttatacaaaagttaaaattaaaaataagacatgaatataaatgttgcatgagagaagacattgtttcacagatctgtgcttcaattttttattgaaactttctcaaaaaaaaagtgaaacaagctaaaccctagaaattcgttgcattatgaattggggttgttcccccatttgcactagatgaactcggcggaaaatccctctcaacttggtgtatcaaatgtgccatggcggcggtggcggcgtgtggtgtggaggcacgtcggcgtttttgccggcttcgccggcgtcgcgaggaggataggggcgtgggggatagggtcgccggcgccggagagaatcgccggtggcagcgcagcgccatgccgcgcagcgccagtcgcgccaccgaaatctcccctcgagctatcggtcaacgggcggacacattgaatgaaacagttaacgtgtacgggtgttgcaacggcgggagcgtcgggcgcgagttgtttctccaatcggacggctggcgcgcgcgtgctgtatcggacggtcgcgcgaggcgtccgatttttttgtctcgcgccgtacgtccaacgcgtagagctctcgagtgaactgcatgtcccacgaggctaccgtatgtccattatcgatcttgccagtttgctcgtttattaattgcctgccgacagctcaacagctatacatatgagaaaaatggagatgataataaattttatgtccgctcaagaaaacaaacggaacgtatctagctaattcaaggcccataatctcatgacaaatataaaaatgcagataatgatttccagaacaggagttaattaagcactatatatcggtatattttaccgacgagccagatctccttccgttcagtttcattagcatttgtgattgtgtggaaaaaaaaagtatacagtgattatattttctacatgtgactgtatttccctaaggatgttaggatattaagtgttatatgtaggtctcaagtagatgggatattatagtagggcaaaatgacaaattaggctttgggtttttgtagcaaagtaattaaaaaaatttaggtcatatacttattaattaactaggaacagaaggagaaataattagaccagatgagctagtttccctttgtgtgttatcatttgtgtttgtgtgtgtggttcgggttgtctcgttttaacaaatatcttttttattcgtgttctaacatgttcgattattatttgtatttcaaataagattttcttttgctacagatgtgaaaacaaacatgacatgcacattattcgtctgtatatatccgcgctgtttggtttcaccccggcccgtgctacagccactaaacaagaactctaattgtttagtttttcgagcatttgtcttgggttattttttacaggccagtacgttgttccctgtcagtttacacaccctttgtctttctctgatatatctaatactccatcaggtaaaaactattggtttctatctcgtgttcaaattttaatgttttatttgtaacataatgtattggccaaatctaaagaattatattattatcaaaatgttctattagtaatagaaatattctacgctattattttttgctgaaatatttgatgctcaaagcttcaaatgtttggtggttgggtaaaataatgatgcgttttaataatttcacatgactatatatatatcaggtcacattcatgggccaacttctcgctatgcttgtctttctatgcatatcgtcacgctagttgttgtaaacgaatgatgatatgtctgcaactgtccatgaatgttttcgattggtttgagcagattgtgtccacacatccaccaatcagtcatacacgcatatcttagcttgtatattactcactccgtttcacaatataatgtaagtcattctaacatttcccacatttatattgatgttaatgaatctagatatacattcatattgatgttaatgaatctagatatttagattcattaacatcaatatgaatgtggaaaatgctagaatgacttacattgcgaaacggaggaagtatatcatatttttgtaacctattagctttatattatatcatatttaagtaatacctataagcgattatttataattttcctcatcatttgaaaagaaggtaggtagacttattttctttagaaaacatgtcagctaaagtaaaagtaaggtgttttttttttgtctagttgcatttgtatggtcatagtttattaaagggtgaaatgggtgggacatgcagctccactaaatatatgggtttataaagcttaatatgattgatgtagtttgagaggtgatccatctacaaacaattcatgttgagtgggtgagaggctccatgcatgtagtctaacatgaatacgataacgattagatataattgtgcggtgattaatataattgtactatgttcctaaaaaaattcagtaaagaatttaacattattgattgtttctctgttagtttaatagctaaaaattggtgtcgtgtgcatgtgagtgtgataaggaggtggaggagattttatttttctatttctaaaaataatttaagtgaaagccaatcatgagatgttttattttccttagaatttctaagattcctcctttttttacatgtgatgcatggcgatttatggtttttcaaaacataaagatctgatagttaaaaataatggatacatcaatttaatttgattttttttaaaattctacgacatgatacgcggtgacttatgagcgctctggtggggtttaattgatttttttagtacaatgatttagtataaaataatacatattttcaattaatctttcgttgttatttagttaccatgcaaatgattgggtctacctttaaatgttatattttgaaaaatatagctaatgtgatcttgatttacttatttaattataaatagaagaatagctatgactgtttttatattatgttagttgaaaaaaaatataagatgagataattgaattggtgaaagaggatgggagagttgagcgggagggtcggaggtatacgtaaggcagcaggatgggaggatgattcttatctattttcataaatacaattaatcttagttccactaggaaataatttgggtattgtattttctaattagactacttaaattgtttcaaaattttctaatttaattgcacgttattaatcagaagatttaaaaaatctattggatcagtgaaaatttatatagtgatatagttaatttggatatttcaatttctaattttatcttaagtaatctaatgttgtgcaccagtaaaaatatagcaatatgatttagataatatagttgtttaaaatttgttatcataatttatttttccatataactaaaagaggaaagtcggagagaaagaaaataggtggggaggtacctactggatggaggggttgagacttgcaatcttttctttatcctttttctatctggataagtaaatctaatggtagaaaacaatgagtcaatcgtatattattgaaaatcaatggttgtatgttttgtttattctagatggcacgtgatggcgtactagcatttgtaggacgaaaattattatattgctctattagctctctatgaatcggaaaatgtttgaaattaaaggactgttggatctcttttgtttttggaat

SEQ ID NO: 73010 - DNA, 1395 bp, Oryza sativa
agaaactctacatactgagagatatgacaattgtcgtaataatatatggtaccccatgatatatcttaatgctaagaacagaatgatggcaccgaattttacactgaaaagatctcttgctacttgaggaccataaaagatctcttaataaatggtcagtgaattaaaggaagtttatctacaatactactccccgttgcactatttccagtgacattgttatacttagtgcctataagtacagtgcggagaaaaggagagagaaaacccaactagtggttgaaaacgttattgaggaaagtgcccaaaccatcattggtatgcatgactgttagtccatgattttcctctcagaccacagcaattgttccgctcttatcgtcacagctaagtgatgcctgcgcttcgctgttctcagaatatatttttcaacaatccagctagcagtaaacaagaaaaaaataatgaaacataagggttttattagtatttatcatgaaacaaataaatgatacccgtgctttaatgtgaaatatattcataggtatatgttaattatcataaaaatgatagatgtatttgttaaaataatgtgcaaattatgtgagaagtgatgattggatatgcttacatgatgatttgtagaattaaataaattgtagatgatgttgtatgcttacatgggtgatgatgtggcatgattgcatgttgagctttacaattagtgggctataaatttataaaaagtatagataccatcgatcaacataaggagtgaagacctttaattattggataaaatccttaattttttttgtaattgttcaggaaaagtatgtttgtttgtatttcgtattttctatttccgttgttcatagggaacgaaataccttgaaaatatgtgcttctgtaatattggatctagatatgtcctcctgtgatttgtgtaatacaaatcgaaatatgtccatattcctactagctagaggagggctaacttaataatcaactcttatagctagttaatatcaatgatggatgagttgttttgtagactgcgacctttgagtaatgcatcaatcatgcggctgatgttatttctgttttgattgggagattacaaaagacgataccactgtataacgaagcaattcaaacaactgatctagaccagtctgaatcagtactaacaacgttaattagtttagacgtgcaccgaacacatttcgtgtgtgcaatctaaatccgttcacagtatttttatatatttacatgggaaatttgccaaaaggaaaaaaacaccttataagttacttgcaatttaacattctatcccataaaattgtgttttgttgcaaacgtccacacagtactcacttttattaacaaacaact

SEQ ID NO: 73011 - DNA, 18143 bp, Oryza sativa
catgttggtgtggagaaattttatgttgtctgtacttatttatggcctaatgtcacgctacacttacatgtttgttaaagggagttaagaacgaaagtttgccagaggtggtgcacaatgtgaagactttagctgtcagtgtgcttttgcttgatgtggataaggttgttgacatattgagatgctttccttgcttggagaacttgtacttcaaggtattctttactgaaggtttattgtataacttggagtagtatttattaccgctcttctaaaatagttaatttttgttcttcatgtcctttttcagtcatgtgaattgacctcaaaagttgtgtggcgtaaaaaataccggaatcttaccaagagccttgacattcgtctcaagacagtagtgttggaagattatcggggcatctgggcagaagttcattttgcccaattttttgtactgaatgcaaggacgctggaagctatgaaatttttcgtaacatgcaagattactataaggggtttgctgcagaacagcgaaaggtgcttcagctggacaaaagggcttcgagtggtgctcgtttcatatttaccacaaagggatgtttccacgatgctgcatgtattgagcatgtccaagatttgtcatttactgatccctttgaatgtagatgttgaaatcggtttggtcctcgggggacttatccttgattatccccatcttgtgtttcttccaacatgaatcatgtattggttctcagaagtacatcaatttgacattatgttgtctctgcttgggactaggtgcaaaagatggtattagaatttggtgtttcaaaattggggaaattgtctttggaagttctgacatttttagtgcctgtcaattgttactaagcaaacctggttgatggacagaacagcattgagaatttcaagctaacccggtacctaatatcaggtgagttattatataaaatatggctgcttatattttagtgcatgcttggcttagctgtggattataatctgatgctgatactaaattttagaatatattctacggttttgtttattttcccttctgttgcatggcactctttgtgattgttatagaactatacctgaattcattgtttgtaagtaaagcatgtaagtaactactagtatatgcaattcgccaattcccatgtcatagtttgtagaaactagaaacggccacctgtttatctgcgctggaggctctatttgcttcgcatgcgttggccgtaccgtagacatttggaatgaaatctttggtatgattgttcaatcagtcgtgctgaagctgataatgatgtttattttttatttttcactccaatacttctgatgttattattttcacctcagtacttctgatttgtactctgtcaacatttctatgtgtcggcctagggggaaaatcatccgaaatgtggctcgcaatagttttactaaatcccccccccccagtcaaaatattccacgatcttttactggaatttacatgacacgtgaactaattttaatcaaacgtaaccctgttaagagtttttcataaataaaactatttgcctcctacatccggtacacctcctattcgtcatgttcatggcgtctaagctttcatggcctcacggccacttgctattttattttcaaaaatgcaaaaatttgtgagatatgtatgtactccctccgtcccaaaaaaaagtagattaatctaggaggggatatgatattttctagtaaaatgaatctagacaaaagatgtactaggagatgtcacatccttacctaggttgagtttttttttacggagagaatatattagaagcacaaaacaatttcttatacaagataggcgatgtaccgtgccatccgcaaagcaaaggggccattttggcatgagataccagatttttttcgatgtttggtgtcactggcggtctacttcctccgtcctaaaaaaaggcaacctagaagaggatgtgacccctcctagtataacgaatttgtacatatctacagaaaaaattatggagggtgcattacaaattacttctttttaaatagtaataaaatgttaaagtttaaaaaattaaagaagttaatccgagggagagggggagagggaacggtgcaccccgtggggaaaggagaggatgaaggggaaaggcggcaccctatggggggaggcggcccgtggtgtggggggatgaatctagggttagggttttttttttggtactagggttttgattgattcggaaccgatctgagccgtccatcaaaacgaacgactcagatcgattaagtgtcaggtcgacctccattgccgtacagcaacactgctggctgcgtgcaaaacgtggttagattttcggttacagctcacatggcaagtgaaaggaggagtagtgggaggttaattagactttggttgcttcctgggccggacgcttggttgcgacctgaggaaatcgggccgactcggttgcgtgttgaagaagaaaataggctgaaaatggcccatagagaaaggaggatttttatttaaataaatgctgaaatgatgtttgtactaagatttaaaaattccaagaaaatttcagagtgaagctaatatggacagtttaataaaaattaaatccaaccatattattttatttgttacacttactttagttgtaaattaatttaactatatacctaactacttaagaaatacccaaataattccaaaaatttgtatttgaattaaatagataatgtaaatatttctcatccctttgtcaattttctcgtcttttcatctcattgcgacacacggacactttttctaatataatactccagtataagtctaaataattgtgtttgatctttttttctaaatcggaggcaacctaggaacgctcacatatctctattaccgatttctggatccaaaccctggattttcattgggtcacgtgactctaccagaatcagccagaatcagcggtacctcttctaaaattcgtgccacgtgggcttctctcccttcggcgggttttgccgcatcctcgtaaaaacaagcgagcgtaaaatcctttgcctctcctttaggccttgtttggttgggccgttcccggccaggattggggtccaatccccgtcgatcaccccggcgaggaaacaatccaggcccatccgaaattgtgtgttcggttaagcccagtctgggttttaccccggcctatcccggcctttccccctcacccaggcccgggaaaaaaatcaacttctcgtgtggcgtggaaaaattcctcacgacgggagccgggaggcgacgcgcaacacgcgtagcggcagcacgacgtagaggcgattcgaggtggtgcaacggcgggggcggcgcgacgcggaggcgatggtgacggcacggcgctctcctccggccgccatcttctctccagtgagcacgcagccttttcccctctcccctcctctttcaaagctagggttagggttttcttcttttctccctttcccgtcgtcgccgcgattcgtcgtcgtcctcctcgtattctgctcgatctggtgagtcttgatctgggtgagaattagtgagttcttgatcagatggggaatgagctttttttcttggttgggtgaggatgagttcttgattcaccaccaccgccgccgcacgtcctaaaccatatcattagttcttgatttgggcgtggtgagttcttgattgctgcatttcccggagagtaagatcggagctgcgaaggctgtacatggcaatgcagaatgtaataactctctggaggttagaagagggtaacttgggctttaaactgtatgatttctctgacataaaagatgcaactaataatttctcaagtgaaagtttgcttgaaaaaggtggttttggatctgtctacaaagtaagttcagatttcagagtcacactctattaccagtagctagcaagcaagtgtttagtgttttcaaggctgaattgtacttccacacgttctaatttctagagagagaaactagaagaaggttgaggtggtcatccttttctacatttacgatatatcagttatacacttgagtctgaaactttgtgcattataatgttcactggttttattttatgtatgtacagcaagaaatggattgttgcattagttcagttcaacatgttttcataagattatacttcttgtcatgtgcaacatgtttaagaacgctgaaagttgacaagatattaatttttgtgatgtgaatataataattcctctgtcaatttgtttctgtctaaagtgttattatgaatattaatcatgcgtgatgaagatgatcatttacaactagcttatatgctatttttagaagaaaaaaaaatcattttttgtttgtgtggcatggcaaaaggcaatgcttgcataagttcctcgaagtactgtagattaaagttaatggtatttgtgtataccaatgtcaccatatggatgcatgggggaataggagcatgttgcttaatttttggatcattattctgaacatggttaaacttcagaaaattgcaattagtttgtatggtcttccatacaactatattagataatgcttaatttttagttgttataatctacctctctttggggttacccacaagtagttgtcaattgctggaattttaaattaccatatacatatcctcaatcagctctattatggtcttaaataatttttcgtaattctcctgtgatgatagttggagaagatgctgatgatggtgtaaattatggaactggaaggctgtaaggatctttttgttgcaggggcactgaaggatcaattatgcatctgcactgcacttctttcactatgtctaaaatatttattaagcatagactgtagaagctaggactgatcgatattctaacatattctaacttatattagataatgctatgtttcgactgaaaagcaaaagtgacatttgatgttcattggagattacagtaagagtaaattgcacccatggtacaataactcggcaggtgggtgcgatataatgcaagatcttgcgaattgaacatttgagtacaataacttgacaagtgggtgcattctagtacaagaactacaatttatagtattttggtgcgtcaacttggctaagcatatgctaggtgagttttttcacgatgtcaatatgccattacacaatattcctacggatattaccttataatattgaatttaatcttcaagaattatactgcatatacaatttaatcttcaagtttttttttttttgctttcttcaccatctcaaatatcaaccgaaatataataattctacatccaattttattaactttcagttatcggttattagaataaatatataaatatgattatacaaatccatgctagaatatggtcaaaataaaaactcaaaaaattaaaatgctccaaataattaagttgtcatgtaacttcttaatttattgtatcaaaatcgtacctacttgcaagttgttgtatctatacgatcacttataaagttcttatactaaattacacctttctaccaagttgttgcactagaacgctcatttctcaagttattacaccaaattacaccacctatcaagttgttgcatgtaattactctacggagtatattttgtttgtacgataagatattatcaaattccgttgctatgtttgataagatattatggagcgacaggcctgtcgctccataatccccatacctaaacagagaaaagttcgcacttctccccctctcgcacgcgcctcgccgccgccgcatcgcatcccctcgtcgtcgcagccgctacctcctccgcttagtcgccttccccccaccccggcacccccaccttttctctccgcctcgctgttgcctcttccatgatgtccctagtgagagcacggcgagggcatctcctcagacctcacacatgccggcgagccgccatctgctcctcgtcgttgctggatggggaggaagaactcggtgacctcctcggcgcccacgccgtcgccgaacgccgatgaggtccagcaggagatggccgtgggccgctcggcgtcggccaggatccgcgaccgggcgtctcgttcgctgctggggcaggagccatacatgacaatgtaacttattcttctcatgattttgctgggtgaatagcaaatgattttgcttttttgctccagtaaatgggaaaattgctctggttactgagcaattagggagttgatctggttgattttgttttggtggaacatagaagaagctgtcggtggaagagaagtgcttttcactgcatagtagctgatttatgctagatttatgagcgcgcagctgttcttgagttttggccctcttgttcagctattcattcagaagctgtcaccgaagaaagttgttgagcttagactcactgatttataagcacattgctctgggaaaatttataagcacatagcgcctcctctgctcctcacattgctctggtaaaatttataaacataaaatttataagcttcctgtttagcaagcagactcatcggtgtgtcacattcagaagataccagcacattccaactggaacctagatctgttggcctattgcatcatgtacaggcaagtctgaaaactaaataagggtaaaaccgtcttttctcctctagttaacaccatcaagtgtaaaaactaatggaagtgctacatagggaagggaaattttgagggtgcatagatagagaacttttgaagtttgggtggtagagatagaagaacaactttttttttatactacatagggaattttctctacaatatatcagtttgcgaggggtacggcgacggagatagtggcaggcctgctcattggaggacagcacctcaccgtcgtcagagctcatcgttgctgcccagctcctcctactctctaggtcagcccaaacggatgattatcggctctgggttctctattcggaggcaaatgctggccaacattcaaagattcatctgctcggtaggcatttattttccatgtaaataaatcttcaaactctcttcatcgttgattgttaattgctttactgctttgaatgacacaaccagatttggagtacgaaaccacctcgccatcacaggcatactgcctgccatgtggacttcgattataaatctacctcgccatcgcgcccatactgttcggtgtggtgtcgatgctcctgttgagaagtagcgcaattggttggttgcttacttaggcttaatattgggttaatgtagatatgaccctatggccttttattgtctttattttaaaatatatatatatattctgaaatacaggaagtatattttgtcccaaactaaatacatcacagtaacagcatggttgccttttttcttagattattttttcttcaactcaacattagggaactacctgttggtattaaaattttacactaataattaaataagtcaacttataaagcgattcatataaggatgtaatctaactcaatttatttaaagattgttttgtgttgctcaaacctacaattatgatgcattaataattttgtacaagatcatcggcttcatgatatacacttatgtaagacttgtacatatcaatgtagtttttaagacatttatgaactgtgttttgaaacaatcatgttttcaaattatcaccttgcaataaataactattgctacctagcaaggtgagaatgtatagccacctcctcaaggatggttaaaaaaaagatcctttttacggttcttgtagagctacacatctggtttaaatttgtggtatctgctatcatccaggaggtatgatactatgtacatcttcgaggcctgtaaaaaggctttttgtttgtaaataatcaccttttctctatagaaatgtgatacatgccttaatttgtgtttacttgtactgatgatatctggtctttgtctaccaggattttatagtaataatggttaattatttgatgatttcatgtaatgatggacttagtcaattgcgagctataataagatgccaaaaaatccctatttttgaaaattcatgaggaaagcactttctaatttctgactcttaacacggtatttgtgaaatttcagctttgatctgtttgagaccaattaaactctactagcaaatttcatgcctgatgtcgacatcaagcttccatctgcttttggtatgccaacatttccttggatatttattatcataacatcatctcttcaagctcttaacaatttgatcaataggttataacttctatatagaatttacatttatcttttatttttgaattatattatattactctaagttgtatatgccaactaatataatattgatatccaattgcaggttatattattaattagaactatccgatttacctcatttctttattttgatttaggagtaactggtggtcttttctgagcacgactgaacccaccatttgataattttgaaatcttccctatacatccgtttgtggaagcaaatgctgaggactccagtgttggtgctggatcaaaggaatatgtgcacacgctcattcagtgtggcacaacggaagaaaaagactgattattgttcaaggcttgaagagagaatacagccagaacaaaatattctaggatctagaaaaggaatttggctgtaatgttactgtggtccatgattcagagctaggaggtacaaaatagcacgtatattgtgttgtatccaagttgtttggtgtgaatgtgtataataatgaatggtctgctatatatgtttgtaggtcattcagattcaaggtgatcaacgtaaaaatgttttgatatttcagtactttgaaatacatttccttgcagtacaatttgacaagtgtaattctctgcctttctgcatccatgttgagtcctatataaacggcaactttatgagttgactttgaaatttatagaactgactcatttgaatggtataattccataggtaacctgcttaatgatgagaaacatagatatcaacagttgatttcaatggtgtcacgtcctgataaattcatcccgaaataaaaatcattctctaaatggaataatagaattaattaaaattcgaaaagaaattagcaaacattaaaatgcgtacaagaaaatttcgaatgtggcccggagaattttcgttaaattctccttggtctaaaatgagccctcaaattttacttaaattttccgagcaccgaaaatatttattaagcaacaacaactattatcaaagtttattaaaaagaaaaacctaaaaataatcctccttcctcctttgggccaaatctggcccaaaatccactctctctctctcggcccacgcccaaagtccttccctcctccctctctttttccttctctctctcttgggccgccctccctccttcccctcggcccagctccctcctcctccctctccctcccgggctgcctctccctcctctcctcctgggccggctccgggcccaagccgagcggcgccctcccgcccgtgccgcgcacgtgcgtgcgctgaccgcgcgcctggccacgtgggtcccacgcgccgggtcgtcgtcctcctcccgcccggcctcctctctctctcccgaaaacctagcgccattcctccccaaaatccacgcgattcaaaccgggaattccaaaattgattagggggaattaatcccctttccttcctcttcaattccaccccaatttcccccttgattcgtgcccccaatcatcgagaatgcccgcgccaaccccggccaccttccatggccgctggccgccttttccaccgtcgtttcgccctctcccgtggccggctccctccccgcgcctataaaatgaaatcccctcgctccgttctatcgttttagccccctcccgcgctcccccgtcgcctcaccacccctccccgcctcctccctctctctctccgagcgccgaccacctccagccgcctctgctgtcgagcccgtgcgccggccggccgcgccatctcctccctcagcgtcgcacctgcttcccctccaccggcgtcgcctccgtttcgcgcggagaccaccggaggcgtgttcccgctggcgtccaatggcatcgccaccactgcaccacctcccgtcggccgttcgccgcgcctaaagcgttggccgacgctgctatcccctccctcggcacggtgacatcgccatcaaccccgaccgctgcccgtcttcgtccggagaccgccgccgccacgccggcctctccttcctcctcgtcaacatcggcttcggcagccacttccgccgtgcccatgcgccggccgatgtcaccatctccacctctggcattacagcggcaaggtcgccctcagcctcgcctccccttcgaccgaaccccaccggtgttcgtcgtcgtcgtctccgtccgacatcgccatcccctcctccggtcggccgttcctcctcgccggctcatcatctcgcggcgccaccctccgtcgtcggatttgcagtggcgtgttccgcgccgtcttcgcctccgtgcagctgctgccggaagcctcgtcgcctcctcgccggccccggtcgtcgttgcgtcgtcctctcgtcgttcccggtcgtcgtggtgttcgtccctccgtcaagctgttcgcgttcgtcgtccgcgttccgtcaagtgagccgctgcagccccgtcgttgtcttcgtcatcgcctccgcgtcgccaagcgttgcgccggccgcgtctcgccttcatgcaaggatcgccgccgaagtcgttccctcgccgttcgcctccgtcgtccccgagccgtctccgccacgctcgttcatcgttgtcgttcccacgcctcgtcgcgtggtggtaaggatccgtcctctcgctgccccgtcctagtcctttcggtgtcgcccgtgcccgttgtgcggttgttgaccccggtacccgtgtactggtgtcggtagtcgttcgcttgtgcgtgtggtgaccgtgttagtgtgcctgctcggtagccgcgtggtttccacgtgtgcaggccgtgtggtgtctcgtggagtccgtttgtcggccactcgcctcagttgacacacgggatccgcttccgtcgacccgtggaccgtctctgtgtacttggtctactgtggtcccttaggttgacttgtggggtccacatgtcaacggcgcagccttcttgtcttttccaggctagcgcttatatatgttttataattgcaaaacctaatcacaataatccgtaaatctccatgtaacaacattaaacttcggatgatcatatcttggtcatacgaacgccgaatcaacccgttcaagtctcctaatatttgttataacctaaagaaccgtgtgctttctttttatgtattgttattgcttctttataggcttgtagcttgtcttgtgtgcttcgcgtagcttctgtcgtttcgaaggttctcgaagcatggtttgcagtcgtcgccgaaggttcggaaggccgttctctctgagcaaggcaaatcgcatcatccttgagcacattgaatcccagtttataaaattattttgatttaaattaatgcattatcgctttatttaaattcccgcgttatcattgttttatttagccatgcctatttatctttggtacgaccttattattactactatcattatttttaccttgttcaccctaggaaaataaaaccccaactagtgggtactctatttatggttccactagtatgaatttaggtagatgcttcgctgtttaattaggcaacactaggtggttttataactttagactttgggaattctcatatcacttggatactatggaatggttggcttatggtggaattggacatacccctcttttcctctttcaaaacccctaaaacctgttttccggtggggtttgggtgcattccagttgtgggaagtagcaccccggccaatataaggattaagctcgggcctctattgcaaagcactaccgtactaaccacatgtctaatgggtaaggcttaactcggtactcagtctactcctgaacaaaaggacacgtatagagatggatgaagtcgttgcgacgatggatatctctgaggcaaatgaaggctacacgagctgtggctcggtaatcgagatgtctaggcaaatgaagactacacgggtcggtgcccgttagtcgagatgccatggcactggactagtacgcgggtggtctcacccctatgcgtgtggcgcacccggtctagatcctgttgctaggggctcaatcctggcctgcctgtcccgggataccggccgtaggcagggttgggtcggtacttttgttcacggctaggatgggtgaagggttatgtcacatgtttacgacgggttccaaggccatggaatgcggagtaaagatgtgtcttgtgggtaaagatgtacacctctgatcagagtaaatctattcgaatagccgtgccctcggatatgggcaatcctagcaatgtacccaagttagtggtttaattcttaaaatttgcttaacaactaaaatatggaatggttggcctgggttggcttgggacgagctgggacccagggcgggttgccagttcggtctgaatcatcgtaggccttgggttaaggcaggttcgtgtgggtccacggccttgattaataatactgtgtaactctaggatcgtctttataaaatagctttgggcaattaattgacttttaaatgctgtttactgccaaacttaacccctatattattaccccttgtacccccttgcattaatcatgcatctcccggtgtgacttgctgagtatggtggttgtactcattcttgctctatctttccccccttcagtaagagaagctttggagaagaagtcttaggtggagtcctggcttataccccagttgagcgcctgtgaagatggagccgtaggcccgctagtccgctgctgtttatttttgattgtcaggcctgaagtgcctttgtaataatgtaaatattatcgatataataaagatgtgccttttgtatcatatttgtttggtgtaccccggcttttcctgggacggggattaatacactagcgttcgggaaaaggcaattttctcggtcgcgacaagctggtatcagagccatctcgactgtaggataagccaagtggataaaacctaaggacatattttataaatgaaactatttgcgaaagttcctttttttttctccttccctaatgctatttgcaaaatgtttactcctttctttcttcttcggatttcaactagtactagttggtcagctttgtgaagaagaagatgtcgtcagttgtctgctgaagctctagaaggctgttggatccgttagcaaagcaaaggaagcagtgaagccagatgtgaagcaagagtgaagatcttggagaaccagtcacagaacctaagccgccctctagggtagtgtggttagtcgtgtgttcttttgcttgtgtgtgtagtgcgtggtttgcatcggtgggttgtgatgtaaccatgctaggttgtttgcttaatcaacttgcagaataagtgaaacaaacaacacatcaacaagaagagttagttcctttaaggtcttgtccctagttctggtctattctttccttgtatgcttcccctctcaacctctaccttgtgacagatggataacactggtaacaaaggctatgggaatgatggatccgatgactcaagaacccaagccaatgggaatgagaaaagcatcaacgaaacctcgccagagctaatccaaattgtggttaaccaaaccaacatcttggcaacagcatttcaactattacagaattggtacaacccagcaggggcaaccaacgttcaagtacctacagtccagcaacagtacaagttatcagaatttctcaaaactgagcctccaacctttgccattaccgtcgatcctatggaagccagtgattggttgcgcacagtcgagaagaagctggggttgattcagtgcacagaccaggagcgggttgtcttcgcaactcatcagttggttggaccggcttcagaatggtgggatagctacaaagcatcacgaccagaaggacataccatcacctggggcgagttttcagctgtattcaagagatcacatgttcccgcaggaatgatcacactgagaaaacgagagttccgctacctgaagcaagaagatttgaccgtcacagagtacctgcacgagttccatcgtttggcttactatgcaccagaagatgtggaaacggatgaagacaaacaagagaagtttctccaggggttaaaagatgagcttgtagtgcaactactcctagaggattatgaagattttgagaaacttgtggacaaagccatgcaactcgaaagtgagcataatcggatgacgaactgcaagagaaggattgtcaacatcccagtatttccactgagccacttcagatcaccggatcttctgttgcgcatcaagagttcctaccccaagaagatggacacaatgcagacaacaacattagcaatactaatgctgatgataccaccaacaaccatggttcttgccccattcatgaccacttggatcaagagtgcaatgtcaacagcattcaccaagatatcgatgatagtatcaatgaaggcacccagaatgacaaccctagcaattttgactctgagaaagactccaatggtgatagcaactatggtaccactgatgccaatgttagcaaggatttccaaccaccaattccaactccaagtcagaatgatcgttcccagacggacaactcagtaaagaagacattaatttgttacaactgcaaagaaccaggtcatttctccagagattgtccacaaccgaagcataacctgcgtcatcactctggccattatgcaagaagaagacaagtcactcgccttgtggtcactagagcaaacgccatacctgtgaggcctcgtgttaatcataacccatagcagaaacaatgtaccgatgctaagcacctttcctttttttaggcagtgcttagtattcatgtaataagggagaaatgtgtaatacagacaagatctatggggattcttttggaagatgcggatatgtgattatgtgcgtaattgtttactgacaaaggagacctagggtctcatatccgtaagctcataatctatgataaatcaagtaacctagttgttgatagaaaagaaaatgaagcgatctgtgttagattaaaaagccaaagagacttttgtttggactaagagtttcagatgtgtcttctttggatcaaaggcaacaaccgccagtctagcttttgacgaaccacttgaaggtttctctgaaaggcagcaggctcaagtaccacatcgtcaccagaatcatccacaactctcggagtgaagagtacttaattgacaaaggtcaaaagatgattgatagaagatatcgaaaaagatgtttattaccgggcaaagaagtaggtcgaaaggtgattgataagagaaatcgagaaagaacacatcaaggtaaaaggtgtaaaggaatacgttaaatgctaactgaggacaacatgaagagaatagtgggaagtgaacccaatgtaaagaaagtgaatccgagttgcttgttcgtgagagctattcccagttatgaaccaagtgatatgttcaaagataatctacagagtcaagattaaaaatcacatccaacaaagaagtttcagatttggcaggtcaataatcagaaaaatacaagtccagcagtaaagacatttgggaagacatcaaagcatgtcgagtgggataagttggttctcttgagaaacataattcaaagttagaatggtcgaccctcgcggcgattagcagaagtttctagcacccggagaccaggaaagctaaaatgaggcagttagtggcaagttgtcaatcttggtacccttggtaagtgggatatcatagtcgaaagcatttggtggtaagctggaaggaaacgccaagcatggtattctcatgatgacaagcatggtatcctagtaatgacaagcaggtatcgacgtataacgtgaagtgggtaacttgtatgaggttgacaccaaggatatgaactatgagaagttctggaacggaagcatcattaaactaccgcaacctagtctgagtcagctaaaaggtgcgccctggttcaagtcaggtgaagagaagattccatctgcaacaaaagatcgagccaagcagtccagagtggagaagttttgctgggtaagtttgttatagaagacgcaacggaagaagtcagaaaagaagagaaaaccgcccaacctatcttcttgctagcctcctcgaatctcggggacgagattcctataaggggggtggatttgtcacgtcctgataaattcatcccgaaataaaaatcattctctaaatggaataatagaattaattaaaattcgaaaagaaattggcaaacattaaaatgcgtacaagaaaatttcgaatgtggcccggagaattttcgttaaattctccttggtctaaaatgagccctcaaattttacttaaattttcagagcaccggaaatatttattaagcaacaacaactattatcaaagtttattaaaaagaaaaacctaaaaataatcctccttcctcctttgggccaagtctggcccaaagtcctctctctctctctctcggcccgcgcccaaagtccttccctcctccctctctttttccttccctctctctctcttgggccgccctccctccttcccctcggcccagctccctcctcctccctctccctcccgggctggctctccctcctttcctcctgggccgcctccgggcccaagccgagcggcggcctcccgcccgtgccgcgcacgtgcgtgcgctgaccgcgcgcctggccgcgtggatcccacgcgccgggtcgtcgtcctcctcccggccgggcttctctctcttctcccggaaacctagcgccattcctctccaaaatccacgcgatccgggaattccaaaattgattagggggaattaatcccctttccttcctcttcaattcccccccccaatttcccccttgattcgtgcccccaatcgtcgggaacgcccgcaccaaccccggccaccttccatggccgccggccgccttttccgccgccgttccgccctctcccgtggccggctccctccccgcgcctataaaatgaaatcccctcgctccgttctatcgttttagccccctcccgcgctcccccgtggcctcaccacccctccccgcctcctccctctctctctccgagcgccggccacctccagccgcctttgctgtcgtgcccgtgcgccggccggccgcgccgtctccttcctcggcgtcgcagctgcttcccctccaccggcatcgcctccgtttcgcgcggagaccaccggaggcgtgttcccaccggcgtccagtggcatcgccgccactgcaccgcctcctgtcggccgttcgccgcgcctaaagcgttggccgacgctgctgtcccctccctcggcacggtgacgtcgccatcaaccccgaccgctgcccgtcttcgtccggagaccgccgccgccgcgccggcctctccttcctcctcgtcgacgtcgccttcggcagcccctaccgccgtgcctgtgcgccggccgacgtcgccatctccacctccggcatcgcagcggcaaggtcgccctcggcctcgcctccccttcgaccgaaccccgccggtgtttgtcgtcgtcgtctccgtccgacgtcgccatcccctcctccggtcggccattcctcctcgccggctcatcatctcgcggcgccaccctccgtcgtcggatttgcagtggcgtgttccgtgccgtcttcgcctccgtgcagctgctgccggaagcctcgtcgcctcctcgccggccccggtcgtcgttgcgtcgtcctctcgtcgttcccagtcgtcgtg

SEQ ID NO: 73012 - DNA, 1102 bp, Oryza sativa
  unsure (1)..(1102): unsure at all n locations
aatcaaaagcatagagatgagataaatttattttctgctcttaataattgcaaaagtacctaagtagtaaattctgatccgtgaaactttgttccattaatgacgaactcatgtcactcatatgcatgtttgggaaatgcctaggccgactcccgatgcttgggggctatgactagtcggacagagtgtttaaacgtacagagtcatctgctcggggaaatcaaaattgacaagaggagaaatacatatttatcaatattttaaaatacttgattttttctcgagtattatatttatatcagatactactcatcctatatgtttgttctgcaggatccagatccagacatgcataaaagggattcatggctttaagcttatctcttacgctccaggaatggatcagtcagaacatcaccaaccggccgcctcgtctgccgccgactggtgcttccgcctgcacggctgacttattatgccgccgttgttgggcgtctacgtcttcaccgaccggcttgccttcgccgccgccgactggtgcttccgcctgcacggctgacttattatgccgccgttgttgggcgtctacgtcttcaccgaccggcttgccttcgccgccgccgactggtgtttccgcctgcacggctggcctttatgccgccgttgttgggcgtctacgtctttaccgaccggcttggcttcgccgctgccgactggtgcttccgcctgcacggctgacttattatgcccgcgttgttgggcgtctacgtcttcaccgaccggcttgccttcgccgccgccgactggtgtttccgcctgcacggctggcctttatgccgccgtattgggcgtctacgtctttaccgaccggcttgccttcgccgctgccgactggtgtttccgtctgcacggctggcctttatgccggcgttgttgggcgtctacgtcttcaccgaccggcccgctcgtnccgcgccgactggtgcttccgcctgcacggctggcctattatgctgccagtgtgggcgtctacgtctttaccgaccggctttgcttacgcgcccgcgactggtgtttnacgctgcacggctggcctttatgc

SEQ ID NO: 73013 - DNA, 1417 bp, Oryza sativa
  unsure (1)..(1417): unsure at all n locations
aggagtttagctgctttctanatacctggacannggatactttggggtatcattacgaaattgttactgacgcagcaacgttgtagggctagccgggcagcggcatttttttcccgattgcagtaaatgcaagtgacgagatcgaggcaaacatgagccggaactcttatcttttcgctatgcttatactccctccgtacttagagaggcgtttagaacaatgtttaagtcaaatcttaagaatataaatcatgaataactcttaagttgttgagtttgaaaatataaaaattatatgtatagatttgtcttgaaaaatactctcataaaagtatacatatatcacttttcaataaatacttttatagaaataagaaatcaaagttgtgttttggagactgtgtcgctgtcctaaacgacttcctttacgagtatggagggagtacttatcaaccaaaatttaaattttcaaccttaaatttaaagatgtttttaaagtttttttattgaagtttattttttcagcctttgcttttagatcgctaagaatacatatataaaagttctatttacaaattactactttcttcatttcacagcatcaatatggatgtgagaaatgttagaatgacttacatcattttacaaatatagcgtttgggggggccgctggattctggaagtaaccgaagaatgatcaagggaaaactcgtcaagttcttggcactggtcagagtgaaattgcgaaatactatccccctgataatgcgattactagatttcctgataattacccggacggggcaagccgtgtcagggaattcggtttgtgcttccaaggcacgaaacggggtgaagtgaacagagcggcacgtcggggcgacaagggcccccccgttcagtttcagtggcacaaaccgacgcgacgcgtgttcgcataacccaccgcattccgcggccgtgcaaaaagtgtgaacggtgaacctctcccctggccccggggccccaccccccaatcatcttctcctggccttcagcctccagctgatgccaactgccatgtcagcaactaacgcgctcgcttccttcccgcctcgcctcaacgcaaagcgagatccccccctatacctattaatacctcatcttgtcgtctcgtatcatctcatctcatcacatcagcacacatcacacgcgccgattccgaagaaatcaatcaaccaactactagggaaagcaagagcggatcgggtgctgcatttcgcggtcgttttcttcctctgaattctggtgtttgcggttacgaaaatggcgttggtggcggcagcggcggcgaatccgaagcagaaacagaagcagcagaaggcgtggggatcctctagagtcggcctgcaggcgagcnagatatgcatcttcagcg

SEQ ID NO: 73014 - DNA, 1524 bp, Oryza sativa
  unsure (1)..(1524): unsure at all n locations
cacacgcgtatgtggtgattaggcgtgtaagggataantcattataacgttaantgtttttatggtatataagggtaaccctaaaaaacaaacaccaaaaagggatgaattcgattcnccttcnnaccacggaaactaaaaagtgcagtctttacttccagacaatataagaatatgaattttcttaaggacacttaaaaaatgtggtaatttaccacagaacacaggtacattataatacaacatccacccaattgaagacagaaaaaccacgaaatatatcgatgttttctttatcttcttcgctctaatcttcctaaaatggataccatcatggtggagctatcgtgggcctctgcgtcatgaatcatgactaagtgcccttagtcggtgatgacgaagcacccaagacatagcagccaggagtcaccactacactgttgtggcccttgggattgcgacaaagtacttcgagcgcaacagttggcggtcatcaccataccatcataggcgatttggcctatccctcggccagatcagccatcatcggatccactgttacccattcttctcctaccaggatctagcatagttcatcctcctcatcgtcctccaatacacgtcatcgtcagcagtcgattgagtgagcttccctaaacccaggcagcttggtaacgactaacaacatatcatcttagctagttggttgtaattattctatttactatgcccttcatcccaaaataagtttatttttcacccataccatacatgccaatataaaaccaagaggactggaataccccaactttatcaaatctcaatgtacttattcctctctttatctattctcaatatatttattcctttactttcacaaactctgatgaagtgattgctaagggccattcgagacgcaggattgagaaaagataggaaaagaaaaacatatgaataggatgtcatactcattggattccaacaggattttgaaacacatgaaacttttaaaatattatttgaagagcacataggaaaacacatagtaattttagacatacgaagaggaaaacatgaggtgagacctcatgcttattttccttcaaacttgttctagaatgatccattccatagtaatttcaaaggaatgggtatgaaacaatcacttgtttcaaaagatttcataggattatttcccataggataaaatcctctagaatttatatgcttttctttgttttaaagagatcctaaaataatttattttcagacaaacaaagatgaaaaaattatcaatcgtttgttccagcttgctatgcttgttgagaaagagtcgcaggaataccaacaaaagaactagatcaatattggcaactccctcatgtcaagaacatcgaccacgactagacaagctaaggtgtcaacaagctttcataccgtgcatccaccagcgagcacacgacctttttgcaccgctggagcaatgctatcacccgcacctactacacgagttntttattctag

SEQ ID NO: 73015 - DNA, 32005 bp, Oryza sativa
  unsure (1)..(32005): unsure at all n locations
tttctccaaggtttatttacctaaacctttgatagcatgcattccctattcaaatatgtgtttcactcttcctttatcattccctgtgggcaatttgattgcttcgtaatctgttcagttgagaagatgttagctgtgcaatcctatattgcgattcactcttttatcatcccttatagcagttgtataactttacgtctttctaatccatgaatcttttatttctctcacaaacaaagaggtattgacacttcagtgttgacgactcatttaggtaagacttcaatccatacaaattcagctcctcagttgtccagtaactttgttccatccaagtttccacctgtacgaggtactacattttcatctatgctgcataggtgccacctgcaataatcccctgtattatttgattgattaactgttgtaggcatctgttagcttacttgccgctctttcatatgtacaactgcttccaaatgtggtgtgctgctcctgtcaatcttcaatccgcaaaaataaggctggtgtgtaatcactttcccttatatatttattttggacatggccaagccagtaacggggtttgaggctatctttttcatactccgatagttgaaatccctgcctcgacaaccatcgatttattttagagttttatcgtccaaatacatgaatctgcaacagctggacagcagtgccgttcgacccaaagcattatagaggaagccgtcacagttaaagctctactaaaatgaatatcgaaagaaaaaactacaaaacttaaagccaggagcttaagactactctctctaaagggtttaatgtatgtaaaagcaaaagaagatattattcatgagagatctccaagattgcacagaaagagctatattatcttcatattattttttatattttactcattctttctttcttttttatcacttgctggcctgctagctgggtttaatcttcctgtgttttcccctcaacagatagccaaaggtttgtttggaagattcagtattctccgtaagcagaagttctcaaagctaccttctacctagatggccactagaaggttggactccctttttatgctactagatcatacatccttacattttttctttggattttcatggcacatattttcgctaatggcgaacaagtttatgatcccctatctttccatcttcctatttcatttgtttgtcactaatgaaaattaggatggtgatttcagaactttttgagggattcaccctattttccagttctttcagctcaatatcgttccttttgatcgtaatgatataatgtcatcaagtgatttgatcaagcagaaagagtgcaaccaataaccatttgcatcagtacacaggtatatatatttgatttttggtatgtttagaactgataaccaatttctatgttctgagaatttttcttaccatcattcagaatcgagtcactgaatttcacttccctttactaaaatgttaatttgaatacaacaatttgttaaaccattaaagttttccttgccctaatattacaatcgcgtgtatttctttactattttcaggccatcttgcaatgccatctcctatataggtcagcttgcgcaaatacgctgttgctccattgatcacgttgtttgctggttgtagatgaagatgcttgatgcttaatcaaataatgtacggactgctgcttaaagcagttaaattagtatgtttaaaaagaatgaacctaataatcagttccattcttgatgaacttgccgtaagttaaaaacatatttggcatgcttttctaattgtttgagtttatattgtagacaatcccatatcaattgactttacgggctataaaagaggtgcacatgtcaatatgtaatattgctctgctccacaagtacatatcctaaaatatatgttatttagttgagagtcccaactacaactccgaactttcttctatccttgagtttatcactctctcactattaattcttaagctttcttattgtccatatattttttttaacaaaaatccccgcagcaacacgtggggaattatctagtgctctataaaaggttgctgtggggacttcagctcctaaagcaagtcagaagtgaaatctccaagattcagtaaggttggagaacgactctatgaaggcttgtcgaaacaagatttcggcaatactaaaaggggtggctatcaagttagaaaagtggatgggtttagagacaaggaattttatacaggttcaggccttcttaatcaagaagtaataacctactcctgtccggggattgattcgccgagtgtattattgatcgtatgatctgggagaaaatcgtgcccctagaagcacccagacctctccttatataggggaaggggtccgtattacaaaatacagtccatatccttaatggaatatatagttacagataaaatacaatcgtaaccgactaggatctcggatatttccttgacatacaagtttaaaacttaacccgagtcttctcgaagatattctatctatgcatggcaccccatacccagtcggactatacatgccgtgtagatatgtggtatccataatctccacagtagcccctgagaccttttcagtcgacgaaatagccttctcttgaaacataaagtaataatccgagtgcttcaatttcttctgtattgatctccctagtaccaaaatcaaagactgtgaaggtctaaaaatagaaaaaactgggtgcatcgactagatgcacctaattagatgtagcccccgactgtatgattagttaaaaactaaacatatagtcaagatgtaaactacatccaaccgagtgatcagacaaccatatagcaaagcatatgcggcgttcaacaaaacagccagccgactgctttcagctttaatataccaaaaatgaagatatggaaaggcctgagtgaaaaacactctaaaggtccataaattcacacatttgataagaatccgagtaaaaactctcaaaaagatccatcaaatgtgatataaatgtgataatcataacaagtgataaccttgatgcacgggaaaaaggggggctcccatggtggactgctaggcgactggctccgctcttgcgtcggcggcctctccggccacggcgttctcttcccaaccagctttagcgatgtcgcctttctctggagcatcgctggctaggtctctaagcccagacactcacccccgtcaccataggcttcgcccttctccaaatccaccgcttcttcccctacccccagatccaccagcttccctagcctctccaaccctcgagttcttccctcctgttggtccttcccgtcagccccctactcttcctagcctgggcgtccctgcttcagatccagctttcgtcagcagaagatatcgggttccggggacgggctgccctttccggtctgcggtatcctcgccagatctgcagaatccgatgctggattcgagttctgctccaaatcctcgcctgtcttctcgatgtcaaggttcgccgaaaggtgaactgccgggattcaagcgtctttactccgatgtagttactgctcctcctcaacctccagctgccaagtcttcagatttcattgcagtgcagcctccctcaagattttcaggggcagtagcaaaggacataaggatcctgcagagtggacgtctgctcgatttgtctacccaaaatctctctgcatcagcgcaaggtacaggagacattcaagttggagagaatccttggaaagaggtcaaaggaaaacgcaggtggagaaaccactccgcattcactacaccaaacaacctggagcaaatgcattcaagaaaagcaagatttcttcaacacatggaaggcaagtgtttccgttgtttgagtacaaagcataagatcgtcgactgcagggagccgtttcgatgttggcgctgcttaaaatttggtcatctggcttccagctgtagcaagaagtttgcctataagtccaccttgcctcctctgaagactcacactgaagcttttcctgctcttgctcctctttgttttcccccacgatcgtttccatcccctcccaagtccccgatcatggacgacctcacagctcgtcccctcctcgactcggtggtgatctcggccacaggggagatcgagaggaaccgggaacgcttctcggcccattccttggtggcatggcaagtgggtgcccaagaaggaagggtcgagctcaacacgtttgcagatgacgtcccctcagccttcaacatcagaagagctgacatccaattcaccaagttccacccagaagacttcttcatcacttgctccaaccagggtgatcgagacgcaatacttcgccagccaagacttgccacggcttccgggagggtgtatgtttttcgtccttgggacgaaagcctgcacggcgtcgaggcaaggttccggtaccgagcacgagtatgcattgaggggatcccaatgcatgtgtgaactgatgaagcagcggctaaggtgataggccggaagtgctccattcactatgttgaagagtactctcgccgccgcaactacaaccggaccttcgatttgtggatttggacggatgagccgagagctatcccgcgtggaggtaccttcgctattacctctgctgatgaagaaggactggccacagacattcctctgccagaccttgaaccactccgcaacccgccgccgtctgagccgaagaaagggtggacatacaatgtcttggttcatgttgacaccttggaagatctcctctctcgcaaagctcgagcttacaagtgggattatgatgttcaagacgatggcactctctacaaagaatatccactgccctgcagggcagaacctgacccaacaagaggaccggcagatgatgatgaagacaaggacagagacaatcattccaggagtcgccacaggagccgctcgctgtgggaccggttgaggaggcgatcttcaagccgcagtagggagccggacagaagagacggccactgccaagacaatgaaaacagggggcgtccgcgcaaccgggaacgctccgagcatagaagcagaagctgtcgttctcgtgatcctagcgaggtgagaccgcctttctcttcgcgctccatctctcaagatgactctgttcaggctactcttccactttcctctactccgtctgcttcaccttgcaagctacagaattccctacgtagtccgagccctgatgggggcgctgccgcaagcccttctctcaactagcacatccctgatcagtccatccttcaagctgattcttgcttctcctcgcaggggagcgaggaggttcttaccctcctggagagccatctcgaccctatgcttcatgaggcaaccgtacagcactccatctattcgccagacacatcctctccgcgtgctgtttcccctgtttttgtgccttcttttgcagtacagggaacctcgcaagaggagttggcggcaacccaggcaagccctgtccaggagttcattgctgctctgtcaacaccagtgcagccgcctctcctgcctgctccggaaacacaagctcgccgtccgggaagagcaaaggtgacaatcccggcgctttcttcagctcagcgtcacagcgaacgcctgcttcgcaagcgacgagcaggggcaaagcttgaatcttttgctcaggaaatcctatctaaaaattttggtataatggacgaaagatcttcctttgatcataacatcaaaaagatttatttgcagcgctacaagaagcctctgtctccagcgtccctgaagacaattgcagaattggtggagaagggaggctgcaaaagcattcgcctgaaggcttccaagaaggcgacggtggcgcccctgtaagcggttgactgccaagcttgaagcgctcagcattggccatggaaaggaacaacctgagaagatttagctcatctctcctctctctgtcttttcttagtccgtgtcaaagatgtaaggttcccctttgcctgtgtttcttccaactgtgttggtcgtgtttcggcaaaggagcaatgaacttctcctccaagctagttagtgccagttgctgcttgtgttcccatcaaagatgtaaagttcccctttgcctttgtttcttccaactgtgttggtcgtgtttcggcaaaggagcaatgaacttctccaagctagttagtgccagctgtttgcttttgttcccatgtcacaagaaaatgtctatctgtttaattggaatgtgagaggtttaaattccaaagcaaagcaggattctgtgagatgtattttacaacagcatggtgcaaccatcgtatgtctacaggaaactaagttgtcttctatcagtgatcgcattattctcaatactctgggccagagatttcttcggcactgtgtttctctaccggccaccggcacaaggggtggcgttctgcttgcttgtgatgagaattacttctccatttcagatgtactccttggcacctactctgtatctgcagtgttaacaatgaggggagaggggcttcaatggtctatcacggtggtttataggccacagttagagccagataaaatcaattttctttctgaacttgaagctctgcagacctctatgaaatctgcttggctcattattggagatttcaacctaatatataaagcttcagacaagaacaacgaccgacataatagaaggatgatgcaacgttttcgtggcctcattgacaaattgcaggtgaaagaactgtacctcccagggcgtaggtttagctgggcgggagagggcataaacccaactcaaacaaaaattgatcgcgcctttgttacaactgattgggacatgatgtttgactgctcgaatctttaccctctgtcatccgcatgctctgatcatgctccccttcttctggttggaaatgagaaaatgaatagatttccaagtttcagatttgaagctttttggctgaaaattcctggctttcttgacattgtgacagattcctggacaaatccaatcttgtcaaccaacagattagccatcatccgtttaaagctccggcgtctagctcaagatctcaaaagatggagtcgcaatcacgtgggtgacatcaagctgcaactcgctgttgcaacagaagtgatctttcaattagaggattggctgatggagagcgggctttattgtcaaaccttaaaaatagaattcttgctctgtcagtgttaaacaaaatccaaatcaggcagcggtcaaggcttacctggattaaagaaggagatgtaaactcaaaatttttccatatcaaagctaattctaggagaaggaagaatttcattcaatctttacaaacgccatcgggcatcgcaatttcagcacaagacaaagagaacgagctctatcgtttttttaaagagaggctggcaagtgcctcggcacccaacgacgccggactgcgactacgtagctcgtagccgcactccagtcctcaccgcgaggttttgcccctctgctggtggcttgtgcctagtggagagagagattaggaatgacaatctattagctgcctttccaacgagactgattacatgattatatggccactggcctaaccaaatatagaaggctatccttaattctagggacaccaaaagtagcagcagatttcttctttcctttcttcagcctctggacatcgtcgtcgtgtgctcggccgctcggcgcatgtcacgcctgcgcctgtatgtgcggccgtacatgacatctccccctccgtcgaagtccagctcatcctcgagctgaaacgctgggtacctggcgcggaagtcgtcgaggtcttcccaagtggccgactcgcaggctcgtcacgccactggacgagcacctgccgaacgccgcgagtcagacggccgcgtgtgacgcgtgcaggttctggaaccaccgccccatggagagtaggaggcagggccggggtggaagtgggcggcgtgcccacaaacttcttgagcactcctacatggaagacatcatgaagacgggcacccggcggaagttgcagccgcacggccacatcgttgatgacttcggtgacgcggtagggcccgacgtatcgaggcttcagtttccctgtagtggtgcacggcagggacgaggctgctctctggcggagacgaaggagcgcccagtcatccacctgataggacaccggccggtgaagccggtcgtagtgcttcttttgcacttcttgcgcttgctcgagtcggtagcggacgtcggcgaggaaggcctcgcgagcttctatctccagggcgacagcggcgacgcgggtctcgccaggctcgtaagagcggatggagggcgggtcgcggccatagaccactcggaacggcgtctcgtggagcgaagattggtatgcggtgttgtagatgtactccgcccacggtagccagcgcagccactgtcgggggcgatcgccggtgaagcagcgtaggtacatgacgatgacacgattagccgcctccgtttggccgtccgtctgggggtggaatgccgacgacatgagtagcttggtgcccatgaggcgcatgagctcgcgccagaaccccgaggtgaacactgggtcgcgatcggacacgatcgactggtgtattccatggaggcgcacgatgtcgatgaagaaggcctgcgccacggactcggcggtgtacgggtgcgccaaggggatgaagtggcaatacttgctgaagcggtccacgacggagaggatgatcgtcttcgcgtgcacccggggaagcgcctccacaaagtcaaggccgatgttggcccacacaatggacggaactggaaggggctgtagcaggccagccgggtagagatgttccgacttgtagcgctggcaggtcacacacgccttcacaaagtcctgcaccaaacgacgcatgtggggaaaatggaagtcgcggtggaggcggtggagtgtgcggtggacgccctcgtggccatcgtcatggaccgcggccacgatctcctgtagtagcggcgaggccgacggaatgtaaagccgcccgtcgtaggtgaccatgtccgtgaccacggcccacggcgccgcgcgcgtgcctgcacggacctcatcgtggatggcgaccaggctcggatccgtggcctgggcatggcgcagccgctcgatgaaatcgaaacgaggcgcggagatggccaggagctcgccctcctcgatgtcgcggcgggagagggcgtcggcgacggtgttcgtggcacctgatctgtactccaccgagaaatcgaagcccaagagcttcccgacccagtggtgttgcggaatcatcgctaggcgctagtcgaggaggtacttgaggctgtagtggtccgtcttgacggcgaaacgacgtccccataagtacggccgccagtgccgcatagcctagacgaggccgatgagctcacactcgtatgcggcgagggcgcggtgatgaggggcgacggggcggctgaagaaggcgaccggatggccctcctgagtgagcactgcaccgaaaccatgggacgacgcgtcgcactcgacgatgaagagcttggcgaagtccggtattgcgagtactggggctgtagtgaccgcggtcttgagggccgcaagtgccaccgccgccgcttcaacccaagagaagccatctttctttaggagggcagtgagcggcgcggcgaccgtgccgtagttgtggacgaacttgcggtagtagcccgccaagccgaggaagccgcgcactgcccgaggcgaacggcgagcaggccagtcgcggatggcctgcaccttggacggatccatggcaacgcccgccgccgatatcacgtggccgaggtaggcgaccgagggggcgctgaaggagcacttagtgcgcttgacaaagaggtggtgtcggcggaggtcggtgaggacggcacgaaggtgacggagatggtctgcctacgtcttgctgtagatcaaaatgtcgtcaaaaaagacaaggacgaaccggcgcaggaaggggcggatgacgtcgttcatgagggcctggaacatggccggggcgttgcagagtccgaacgccatcaccaagaactcatataggccgtcgtgagtgtggaacgcggtcttgtgcacatcctctgggcgcatacgcacctagtggtacccggaccgaaggtcgagcttgcagaagaaccgcgccccgtggagctcgtctaggagctcgtcgaccacggggatggaaacgcatccttgacggtgagcgcgttcagggcgcggtagtcgacgcagaagcgccaagtcccgtcgggcttcctgacgaggaggaccggcgacgagaacggggagtcgctgcggcggatgatgccttgctcgatcatggcggcacattgccgctccagctcgtccttgtgggccgccgggtatctgtacgggcggacagccaccggctgcgcgtccggcttgaggatgatgcagtgatcgtgcgcacgctggggaggcagacccgtgggctcggcgaagaggtccccaaatgtcgccaagagcccatccaggaggggctcgccgtcggtggtggcggcgagggccggggcgccgggggtgggcacaccggaccagcagacggtccgcccttggcgctggaacgacatccggtggctggccaagtcccagacgatgggccccagggtgcccagccaacaggtgcccagtacgacgtcgaagcccaccagcggcatcacgaagaggtcggccgggaacagggcgccgtcgatggtgagcggcgcggccttgaggacgcccgcgcaggtgacgcgctcgccgttggcgaccatggccgtgagccgggggcgtgtgtgcaggggcatgccggagcgccgtgccgccgcctccgagatgaagttgtgcgtgctgccggagtccaagaaggcgacgagcgacgccggcccaagcgcgaccgcgacctacatggtgtcggcggcgggtaccccggccagggcctgcagggagaagacaggcgcctcggcgtcctggtccgcggcagcctgggcgtcgtcggcgtcggcgagttccaccccatcgatgaagaagacgcggcggcagacgcggttgtggccgcgcgtatacctctcatcgaagttgtagcagaggccaaggcgacgccgttccgcctggtccgcctgggaaagacgtttcaccgggttcccagccaccggcgcggccggcgcggcggctcgttcaggggccggcagggcgaggcgtggcggaggcgccagaagaagagcgcgcggagcaggccgggcggttggcagcgccggcgtggactgcttgatcaactccagttgccgcgccaagctcatcgcggcggccagcgactgagggttgtgcacgcggacggcgtggctgagcgggggcagcagaccgcccgtgaagagctggacccgctgtgcttcctccaagggtccggtgcgagggagcagcgcctggaagcggtcttgatactccgtgaccgtccccgtgcgtcggcagtcggcgagctcgaagagcggcgtggatcggagcgggggcccataccggaggttgaggaggtcgacgaagcggcgccagggcgggatgccctcgtccctttggacttgaatccactacatctgggcaccatcttccaagttgtaccccgccatccaaacttgctcctccgccatgattttctgctgatggaagtatgattcacagcgattaatgaatacgagcggatcggacttgccatcatacttgggaaaatcaagtttctggaagcgcggaggtggccggtcggtgttggtctcccccgtgcctgccttgggacccgaggacaacgacttgtcggcggagagtgcgaggattgccttggtgttggccgccgcggtcgcctggagggccttgacggtttcggcgagctgcgcgatggtggtcttgaggtcgtcggtgtcgctcatggcagcagcgcagcaagcggatgaagacgaggtaggggacgtcggcacggcgggcggtgtaggggaggtggtgcgggaaggagaggatcgccgggatcgttataccaggttggcaagtgcctcggcacccaacgacgccggaccgcgactacgtagctcgtagccgcgctccagtcctcaccgcgaggttttgcccctctgctagtggcttgtgattagtggagagagagattaggaatgacaatctattagctgcctttccaaagagactgattacatgattatatggccactggcctaaccaaatatagaaggctatccttaattctagggacaccaaaagtagcagcagatttcttctttcctttcttcagcctctggacgttgccgtcgcgcgctcggccgctcggcgcatgtcacgcctgcgcctgtatgtgcggccgtacatgacagaggctaggatcaggttttcaaagagaggctgcattaaattgggattccctgcatttgccaagcctagacttgtcagacttaagaagaggatgtaacagaggaagaacttaaagcgactattttctccatgccagctgaaaaggcgtcggggccggacgggttcataggagttttcttcagagcagcatgggatgtgatcaaggctgaccttctagcggcagtaaagtctttcttcgacctaaacacttctcaattacatgatctaaactcggcttatatctgcctcctgcccaagaaagaagatgctacttatagcagagcactaccgccctataagcttgatccatagcttctccaagataatttccaaacttatggcaaacagattagcgcccaggctaaatgagcttgtctcccaaaatcaaagtgcttttatccgtaaaagggctatacacgacaatttcctttacgttcagaatatggtacagctcctgcacagaacgaaaaaacaaagtttgttcatcaaagttgacatagccaaagcttttgacacggtgtgttggccatatctcctcaatgttcttcacaactttgggtttggaattcgctggttagattggctatcaaatatcctggcaacctcttcttcccaagttctgcttaatggatccccgggccagccaattcatcatgttaggggccttcggcagggggacccgctttccccgatgctatttattctagcaatggaaccttttcatcgtatccttaaagcggctgaaaatgcagccatcttatcaccgattggcgggagatgtgaaaggttcaggtgttcgttatatgctgatgatgttgcggtcttcgcaaggcctcagaatagtgatatatctactttggcccagcttctatccttctttgctcaagtgtcgggtctgcatacgaatattaacaaaacagaattcttcccgataagatgtgaagagattgatgtaagctctcttttggcaaacttcccaggcacagttaagcaattcccttgtcgctatctcgggctgcctcttcacttcagaaaacttagaaagattgactatctgcctctcatcgaaaaaataggggccaagataccaggatggaaaggaagatttttcacttcatcggggcgtcaaacgctggtacaatcagtactgccctccaaacgctgcccattcatcatcttactgccctccaaacgcctaaatgggtgataaaaagaattgatcgattccgaagatccctcctctggaaaggtgaggatcctgatcacaccaatccgggacgtagcctagtcagctggcaaatggtgtgctaaccgaaatctttgggaggcgccggtcttccagacctagaaagattttcgagagcgctccgtctacgttggttatggctaaactagaaagaggaaggcaaaccgtgggctggtatgaatgttccctgtgacgattccgacaaaagattatttcaatcagcgacgactattactcttggaaatggagcaaaatcaagtttttggcacgacaactggcttcaaggcagatgcccaaaagacatcgctcccttgtgtttcagactggcaaagagaaaacagaggaatgtccaatacgagcttcacaacaatgcatggatcatctcctttcgacagataactacagtggaggaattgaacgaactagtgcatctggggggaatgatacagaatgttcaactccatcaaaatccagacgacatcacttggaattggtctgaatcaggtgtttactcatgcaagagtgcctacttgtaccaatttgaaggctcatttacctcaattaattttaaatcaatttggaaaacaccagctgaaccaaaaatgaaatttttggggtggttgattcttcatcaaaaaactcttatagcacaaaaccttctcataagacactggccgtgtgattggatttgttgcctctgctcgagtgcgttcgaagacacaaatcagtgaatgtgactttgttcgggaggtgtggaacctggttcatgcttggctaaacttatcaatttctacctccaatccgcaagctggaactgcaaactggtagtccaaggtaaatctgactgtttcaaaggttgataagatcgcgacaagaggagccttgctcacaatgtggtggaatatttggttagaaagaaatagaaggatttttaatcataaaagcctttcggaaagagaagtggctcacttagtgaaacaggactgagacttacgttgctgggtgtttaagcctccttgagctatgttttttatcttttgtaatcaaggatctgtttgtattctgttttccttcttaatcaaattccgacagagctcctgccgtcgtcttcctcaaaaaaataacaagtgacaagtctaaatagcctaggctatgactcacaccagaagaataaacatataatatgccgagtgaataactgttcaaaaaccagttatctcaacaaaacccgaacagcttttgcagcctaaaaagacttacaaaattagtataacacttttctgttgggcacctttttatttgcatcatagtaattccaaagaatcatccaactgcatcaaaaaggattttaacagcattgggccatactgttgtgagcaaaaattaccaaagcaaaaatgcctaagtccctaaggatcacaactagccacgctggtaatagaattgggctaaagtactgtataggcccaggcccatcaacacccctgaaaccctagcgaaataaacgccgaagtcaaggcgtcgtttcgtcttcccagccgaaactctcgcccctttccccattctctggtacagtgcaaaaccacaccggcaaaagctagggttaacaaatccacttcgatccagcctcatgagctccacaaaaacctttcgcgcaaccactgcatcgattccccatccatttccagccacatcccgaaccaaatcacatcatccagtttatattcatggcggaagagagagaaagcttcgagagtcaatgggcgccctctgacgttacggaggagagcttgaaggaaatggtagcgcacggtgttcttccggcgaaggaaatcatcgggtggcgtccgacgtgcggcaaagcgtttccaacccctgatacacatgaagtcgtggtattttctcatttcttctatggcggattttctcttccaacctcaagattcttccggggaattttggatttctacgggattagtttacatcatctaaacccaaactccatagttcatattgccaacttcatacacgcctgcgaagctgttttgggcatcgtaccacattttgccctattccgtcgcatcttcttccttaagccccaaccaaacaaaagcaagccatgcgtagttgggggagctggattccaactgaggggaactctgagccaaaagtatttctccatgcccttcaaaacctcaaacaaaggctggcatgcaaattggttctatgtacaaaaccccgagcctgctctccccgagtactcctgtcttcctccagttttcgatggaaaacttgaatcatcatgcccaggaattcgccttgatgaagtcagaccctccaattgctcaacgccgatcacctcgccggcagactggtcaggcgagtggaggaccaaaaattcggtctaatactcaaccaaacacctcaaaatcagccagccagtcaaactcccgcaagaggaaattggttctgagtgatgatgagggcgatgatgctggaaaaatctggcgataaagaggtgactggaaaacaaccaaggcataccaatccgaagaagaaaacgtctagtcatcccatgccaaaaatcaggaaatcttctaggtatgaatcatttggccatcttcctcgtattgctgctcacccactgttgaaataacactgatggcataactcaaattcataggaagccatctgatatagatccttccggaaaagactcggagccgactgacatggagacaggcccttcaaaagaaaccgggccaacaacagaggattgttcgagtgacaaacaaccgacaaccaacaatgtagaagctagcaacgagcccccgactgggaactagtcagccgaagctggagctgatgctaatcaggagcccccgactggaaaccagtcgtgtacagaaccaaatagagatattcccgaagtagaagctcaaacgaacagccctcctagaaagaatgccagtgctgatccagtgcccagctctcctgtcaaagtacaagagcctgcttgtcctcgaccggaaattattacaggtaaacacatcctccgaacccgttttgatctgacagactttcttcaattgtttcacctttattcatgaatgcccaaggcccaatgatcggcgacgaagaagagatcctccggatatagtcagctgaggattctcgcccacccattttagtcaagtggtgggatgacgacatgcaacctcagggaattgtaataaacaagcaaaaggaagacgaggaagtatgcctgctgaataaggcactcagccaagccactcgcatcgtaaatataagtctcctcatgcacagcttcaaccatcctgtttactactttgctcaaataccaacaaattctcgtattacagagaatccatctcaggaacgaagcgaagactgcgactcttgagaggttagttctccatcttggaacccttgaggccaccagaaatcagctgcacgaagctaaggagcttgccagaaaaactgagcatgatctacgggaccgaatcgccgagcttcaagattctaactttgagctgagcggttcgtcaaaaggtaaatacaatctctatcaactaacttatgctgccactcttgtaatattaattaacaagaagcaatacagtgcaagctgctgagatatctgaattggaaaaacgaatccaagctctggagaatgacaaggccgaattggcgagacaaagggactcggctctaaaagacgtcgaaggtactagtgactaatactccagaaactattcctttccttatgcccactcgttgatataaatatatttttgcagatcgcaaaatcaagtctcaggctcaattcgatgtcttggtcaacaaaattaagaggcttgaaggggttagggatgaagtcgccatccctactacaccactcgtgcaagccatgttcttcaataacaatggtccaagtacatttgatgcttccgaaatcttcgacaagctgagaattgctccggatacatactttaagaatatcaaagaggctggaagtatgggagcaagcctgacgttagcaatgaccaagtctttatacccgaagatcgacattgatgccattgatggctttgcagacggaacgagcgaagaggccgcccttgacctcatcaacgatgcgcagaaagccgccgataagattgccgttgatgtagttgagagattccaggacaacgatcttcggccgactggatctaataactccgatgatgaaaaaactgatactgattgatgtcatatcataacaatgattctgatgatgatgatgatggaggcacaatttgtacaatactgatgaatttatgctgtgattgatatttcaaacttagctcctgatttcttaaaagcttttgtcaaaccttattgagcctaaaacccacaaaagttattaaaaaactttcagtccttattgactaagccaaaaaatcaagtagggcaatgataaatcaagtaagcaaattgaattgataaaaatcatactccataattattatagtagccccctactgataactcaaggagaaacttgatgttagcagtcaaagagggaaatacaaagtaatgcctaagtataaaaacgacgaagatgttcaatattccaagagttgttaataggggtaccgtcttcacgcttgagttggtaagaacctggttgagtgacttcggaaattatgaatgatccttcccacaagggagataacttgtgccgatcccgtgtagtttgaatttttctcagaaccaggtcaccgaataaaaaagctcgtgatcgaacgttgtgattatgataacggcgcaacccttgcaagtaccgagccgactgaattaaggctgcttcgcgggcttcttccagtcggttcagattatctactcggtcttctccgtagcgctcctcgctgaagttgcgaaaacgtaaagattcaaattccacctcactgggcaacattgcttccgctccatagactaggaaaaacgtcgactggcccgtggcccgactggtagtggtgcgcaaggaccaaagtacagacggcagctgttctacccacttgccggcatagggattcagtcggtcaaaaactcgtgcctttattccttggagcaccatgccattggcgcgctcgacttgtccattgctcatagggtgcgctacgcgcgccacggaggcataacaaattttaatgccaaagtcttcacaaaagtctttaaatactctgccagtgaattgagtgccattatcagtgatgatccgattaggtaccccaaatcggtgcacaatgttgatgaaaaaatttctagctttgtctgccgtgattgtgatgaccggtttagcttcaatccacttggaaaatttgtcaacagccacaaagaggtgagtataaccaccgactgcctttttaaacgggccgaccatgtcaagcccccaaaccgcaaacggccaagacaacgggatggtctgcaactcttgagctagtagatgagtttgtctggcaaaaaattgacaacctttacatgtccgcacaatcttgtcagcgtcggacacagctgtgggccagaaaaaaccttgccggtaagccttgccaacaatggttcgtgcggcagcgtgattgccacagatgcctgaatgtatatcctttaacaattgtctcccctcctccaaagatacacagcgttgcaggattcctgatggacttttcttgtacagctcagtctcatgaatgatatagagcctgctgcgcctggagatccactcggcttcatctttatcttagatgagttcttgtttggtcaaaaatcttatgaggggctctctccagtcagcttcaatcatacttacgtcttgagtgtccgtggcttcagttgtttctttccttggtaaagttggctcgtaaagatgttcaacaaatacgtcagaaggagctgcttctcattttgaaccaaaattggctagtctgtcggctgcctcattattatgtcggagaacatgggtgagctcaagtccgtcgaatttgtcttccaacttgcgtacctcctgcttgtaagcggtcatgttatcatcaaggcaggaccactctttcatgacttgattaacaacgaactgagaatctccacgaactatcagacgctggattcccaaggagatcgcgatccttaatccgtgaagtagcgcctcgtattccgccacgttatgggatgcagaaaaatgtatccacaatacgtagctcaatctttccccagtcgggaaaattagaacaacacccgctccagtgcctgagagcctcttcgacccgtcaaaatgcatggtccagtactccatcttctcctcgggcatgtcttcttggcactcagtccactcggcgacgaagtcagctaaagcttgggacatgatcgaagttcgcggcttgaaagatatgtccaaggacatcaattctagggcccactttgtgatccgcacatttgcttcgcgattatgaagtatgttcccgagtggaaacgatgtgaccaccgtgaccgagtggccttggaagtagtgagatagtttcctgacggtaatcaaaacaccatataatagcttttggacctgaggatatcttgtcttggagtcggccagaacctcgctaacgaagtagattggtcgttggactttttgaatatggccttcttcttcacgctcaacaaccaggactgtgcttacgacctggaaagtcgccgatacatataacaacagcggctcttgagggtgtggtgaagctaagaccggtggagtggtgagaagttttttgaagtcttcaaaggctttttgttcttcgggtccccactagaaattgtctgttttcttcaacagcttgaaaaagggcatcccccgctcgccgagtcgcgaaacaaaccggctaagcgccgccatgcaaccagtcagcttttgaacatctttctgggaacttagcggcttcatgttgaggatggcattgattttctccgggttggcttgtatgcctcgatgagacaccataaatccaagcagcttccctgacggtactccgaagatgcacttttcaaggtttagtttcatcctgaaagcgcggatgctcgcaaaaggatcttctagatctgtgatctaatcatccttctgcttggtcttgacgactacatcatctacataagcttcaatgttgtggccgatctgagttgaaaagcatctctggatcatgcgttgataagttgctcctgcgttctttaatccgaagggcatgatgaatgaagtctttaagcaatcggattcctttagtcggatctgatgatatcctgaatagcaatccaaaaagctcagtagctcgcagccggcggtagagtcaactacctggtcattgcaaggcaacttgaagggatctttgggacaagacttgttgaggtcggtgtaatcaacacacacacgccattgtcccgttttcttctgaaccaggactgggttagccagccagtcgggatgaaggacttccttaatgaagcctgctgctaacagcttggtcaattcctccttgatcgcatccttcctatcctgtgtgaagcggcggagtcattgcttgattggtttagcgtcttccgtaacatctaaagagtgctcaatcacctctctaggaatagtaggcatatcagatggtttccatgcaaagatatctttattattttgaagaaaggtgatgagcacgctttcctatttacaatctaactcagcgcctattacagcagtcttagtaggatcagaaggatctagaggaattttcttggtcttggcgtcgctttctccgctctttggcatcttggttacaggcacttctccttcgtttgctgtggacgcagctagtcggatttcttctcgagcgagcgtgatctcgcgggtctgggccatctcgcatctttccttgtcgcatgtgacggcttgcttgatgttgctccacagggatatgactcctcgaggaccaggcatcttcatcatcatgtaggtatagtgcgggacagccataaacttggctaacgccgggcatccgagtatggcatgatacgctgtctcgaaatcagcaacttcgaagcaaacgttttctgtgcggaagttctcccgagtgccgaaggtaaccggaagagtgatctggccgagtagtgtagcggatagacctcgaatgactccgtgaaagggcgcattactcggctttaattccgtgcgagggatctgcatatcatccatggttttagcgaaaaggatattgagtgcattgccaccatccatgagagatctgcgaagcttgatgttgcgaaccactgggtctagtaccagggggtaccgccccgggtggaccactcggtcaggatgatccgagcggtcaaacttgattgttgtctccgaccaccgaagatattggggcgtgtcgagctgaacagtgttaatctcccattcggtcagcttttgctttctcttagattcataagtcaggggtccgccaaagatgtgattgagttccttgcgatggtcttgaaaacctgtcggggcatcatcgtcatcgtccttctttgacgtgctttgatctccgtcggaggcctttcgtgcgttcttggcgtattgttctgcaaattgtttgtagacgaagcaatctttggccgcgtgattggaattgggatgatgcggacattgggagttcatgatcttgtcaaaagtgttgacgcgcgaacgttgtcgggaggaaggtatagtagttgcaacaagttcctcgggcttacgcttacggtccttgtgattggtacttccactccctcctgtagtcggcgtatatttcttctgcttctaagtggtgcccgactgcttggacacgataatggcatcttcggctttggcatactcgttggctttttcgaacatctgtttgaccgtcttggggggtttgcgcccgaacttgccgactagatcttcgtgacgaattcccttggtgaaagcagcaatgatgacgtcatcggtaatgtcggagatctcaaagggattctccagacttctgaatgacgttgtagagatcaaactgtgtaccagggcgttcaaaggtgacctggaagttggcgatgaagtggtcgcgaagttccgcccataatctgattgtgccacggggtaacccatgaagccagaaccaggcaaaatccgctaaagccacaggcaagtagtttgccatggctttgctgtctcctcctgctgcgcgaattgcgagaccgtagacggtgagccaagactccgggttagtggtgccgtcatacttctcgattctagttggcttgaagtcagctggccaatccactcgacgcaggtcgcttgtaattgcagcgactccatccacatcgtcatcgtagcgatccggtgaatggtggggggcgtaacctcgtgccgcgcagcgctggttgattgtatcacgaaaatcgacggggcgcctgcgaggtggggagcgtggccgttcaacttggcgctccctgtgtcattcgggaggcgagtgaacaaatcgctcgtcgtgaggcgatgctgaggctcggctagtgatagtcttgagattgaagatggggaactcggctgctagtcggcgtgcggacgcttgcggagttaaccgggactgaggcggcgatcatggtctttgtctggttcaagatgttgacgacgtgattagcttagtttagtatgtcttccttgaggagggtgtcgaggagggtgatcgctgcaaccgcgttctgttgaggggtgcgaaagaccgcagttcccttgacgtctagctgcccgataagttctcgtgctcgtcgcccggcgtccaaggcccgttgtcatcggtcctcagcctcctttgcagcccgctcgcgttcctggtgctcatgctgcagccgttctcgctcttgtgcttggcgctcctcttccaattggcgtcgtttggcttcctgttgtacgcgtagctcttctgcttctcgggctttgtgttgttcctccgtctcgttgtcagccatgaagacgccgaagtagagaggggtgtagttatctttaaagccctcgtcgaagtcgtcgaggttgcggttgttgtagcgatagccgaagtcatcgtactccacgatctctgttggtcgtgagtcaacgccgggggagctgaggtagccgtccagttggtccgtcgaaaccgtgccaagtggctggagtatgacgccgacttccctagagctaggccggaccggggctgaagccggatcctgcctaggcctacggggagaagacgcccttgtagtgaagacagcagccaaatcatcggggagtttcatcaggattggcggataggccccatcatcttgatcgggtcatgttggagtagattggatctcgtccgagtggtttgaagccaattcggcggagatgaccttagggtagacctcggccgagttcgggatcccgaacagagcggagatctagcctctttccgactggttcgaatccgagtcgaggagagaaatcttgccaaagtcgttggtgatgaagtcgaggctgccgaaccggaacgcctgcccgggagggaagacgaagtcgtcgatgccggagacggaacccatcgcactagtcggcgaagaacttgatgctgtgatatgcactagggttcccgatcttccgaaaggttctgataaacaacgatttggatagagtcgcaacacaaatcgatccggcttcttgaacgcgcacgctcttgagccccgcaatcgtagcaccacgtctcctctagttatcacccgtgtcgaaacgcggatgacctcgccgagaaggctaattcctgtttgccaatcgaagaacacaaacaagaacgggatagaaaaataaccaaaattgcagatgaatgattaagctcacgagttggggtcttagaaaccgatctagcggcgaaactgttctcaacagattaatctaagcaaaatccaactctaaacgttgacggctactgaataaatgtgattagggacgtcctagggtttcccaagggcgcacacccccttaggctaagcccacgacacaattacaaagcccaaaacccaaatcggattcggattggatgagatacgtggcttgttttgcagattcccggtagctcagttggaattttaacgtgggaccaaaaccatctgaaagtagactccataagctttccaacaagtattcatgggccccgaaatttgtcacgcccggaaattcacaagtaatttctaaactaatttgtgcattaaatcctcgtccaggaatcagccgaagtacacagattgacaatttaatatacagattcatcaaattaactaaaacgataaattgaggcacttagtcctcaccatgaagaaaactgcagcggaaaataaaatctagcgaagctccggctccactcccacaggcagctcaactgaggtataagccaaacgtcttctccatcgcaacttttcttcaactgaggtttgattgattattgcaaggtgagcatatgacatactcagcaagccacacaccaaatatgcaagtgcacaaggataccaaagaatggcataatataggctcatttgcaaaagcagcatttagcaaacatttgagaattgtaaaacaatagagtaattaatcatcaatattaatcaacactgaacagcatacccatactgcacaggcccaaccatcctgaacaaccatacccggttgtacagatctatctccaaaccaggaatgtaccattccaaaccaggagctaatgaaattattatcagttatagcatcatttattatggtgagaagtgtgagactaatcacgaaagacattgttagacccgcccataaccgcgggcacggctattcgaatagttttactctggccagaggtgtaccactgtacccataagacacaaccccacgacatgtcaccatgcgcctcaataccaccacggtacctcggaaaagagctgtgacagtaccccttgcacaacacaatccaccacagcgcaccgttcctggatcataatcaccccattataaacaaggcatggactccccagcgaccccagtaggcttatctccaccacttctcagtctggtgccgcgcaatgaaccatgctatacaaaaggtaaagccgttgcccacgctggcttgtggttggcacggttaatgtttcacaaccgaaactcatgaaccggtccttaattgtcataagcacgatcatcaaaaccatgtgctcacaacccaccattatcaggttttagttggcacattaattaattaaccaatcacgattagccatcgtgagctatgattaaatatccatcattagataatagtgaaacattagttatcccaatcatttgctaatgtttctaagcatggctaagcaattatatctaatatatctagctgaaccaatatataaatccaactagtcaaattataacctaaggtaatcaagacatagggtaatcaatgcaaattagccataacaaaggaataagttcacaccacccggtgacattcgaaaataaatgcacagttgaaataaatagagaatttaaatataggatcaacatgctcaaaggaattgtgtttgggatctgtgtgacttgcctcgcaatattcggtcttccattaatcttcttggatacttccaacgcactcacgaactttcgaaacgacaagctaacacgcaaaacgagaaaaaagactaataaaaaccaaataaacaatacatataaagtaaacaatcatgtagatcataattttagatgaattatgagacttgaacggcctcattccgatttcatttgaattagttatgaatttttacaagatttaattccaattaaacctattaaagaaaagactattccaaattaattaaaccatttacaaatgatttataacggagagaaaagattaaaacaacctccggaaaaagattagatcatatgtggtagatgacatatattaaaaaggaataatatgccattgaaaagaaaacggatttatatcgattttggacggctaagattaatcttgatcgtgtcgaccaagatcggatgacttggattgatctggcaagcaagcctcacgagataccgactcaacgagtcaattctacgtgacacggaatcacccaaatgatcaaccgaaaccggtgaacggaaccggtggctctgaacggctctaaactaaaggacgactccacacagacgaacgaacgaagcacggggacacctcgtttgaacgaacgagcgaacgactcaacaacggctgcgactaaaccgatgagctagatacgattcacggtaaagccctggtacggcaaacgataggccagtagaaatttagggatatacctacggctagacaacttggctaccgagcaacggctaaagtggcggctaggttaaagcggcacacagctgcaacacggcggcactagggcgacttggctcggctaggcagcggcgactgggcggaggcacgtggctagggttagggcgacggcacagcgacgacgacacacagcaacggcagatggtggctacggtagcgggatggcagcgacttggcacgcacgagcagcagcagcacggctgtagcagggagcggcacagcgacggctaggcggctagtgcagcggcgacgctagggcagcacctaagcatggcacggcagcggctactcgacgacaaaaacgagagattaaaaactaaaccgagggaacacggatagaagtctcaccgaaccaaagcgatcggagagagatagatgacgacggtgaaccggcggcaacacatggagacgatgacgacgctagggccaaacaagattagattagattagataggattaagaccctagggaaaacctcacagatgaacggcataggagcggtggttgccggcgaaccacgacacaataatgcaaacggagggcaccgggaggtagagaaggcgacggcgattcttaccaacacttacgcgacgacggacagcgatggaagatggccggtgacgagcttcgaagggcggcgaggtactgtccacggtggcgacgactttccggctacgaacggcggcaacagaggggtggacgtccttcggcttggcgctgcgatgccgaaggagggagcagctctgaccagggacagctgggacgacggcgaacggcggctgtagaacaaaagacggcggcaacccactggttcacggcgaggatggcttctggcgagatttcggcgcaagggaaccggctgccgggcttctcctcctccttgcgaatccaacggcggcggcggcgaccgaaggagacgatggacgacgacgaacggcgcggctggagcggtgcctgcgcttggagagagaaggagagcgcggggagagaaggtttccggcgacggcggaagacgggacttgaggagataggtagaggacgactagggggtcctttatataggcacgggagctcgggtccgggcccaaatcgacgggaaaaactcgggaaattctagggttctcgccggaggaaggaaagattgaaccgcgaaattggaaaggatttccatagaaacttttggggatttcttggggaaaaagaagaggagattgagaggattccattcctgcaactaatttggaaataggagcaacgggtaggtcggattggtgggaggaggcggcggcactgtgcacggcacgggagacagtcggctctgtctagagctggaagatgaacagtggcgcagggacacaaaacagactttcggccgggctaagaggaagggagagaatgggctcaattcggcccaagctgagaggaaaattcttattacttttccaaatagagatgatctttcaattgttaaaaatacttccaaagctcaaataattccaagaaaaatcttgaacatacttggacactctaattatttaaaaaaattgaaaccagctcatttaatgattaatttaatatgtgaacaattacagaaatattctttgtattattaaaattaagaattgagctccgaaaaatccgagaaaattccagagagtataattaatcatggagaatttaataaaaattaaatccaaccatgctttatatttaggaaattttatttcccacatttaacttcacttgtaaattaatgaacatttaatataaattctattaataatttattaaataatttataaatcctgaaatgaaaatcaggctgtgacaaaattccttctagatcagcggctaggtccgtttgaagttgatgctgtcaggaggcccgaatccgaattcaaaacgtgcacaacttaatctctagtcttctatgggccaaaagtgatgtggagagatgaaagaagacttggagatggtcttggtttggtccccaatcaacttcttcaatcatccatgcattccttatgttcggtttcttttctttcgcccaagcaagtaactctgcaaacaaaaacatacaaaactcatcgtgtagcaatgtttgttcaaatatataccaagtaaatctaatatacaacatatgcacctttggttgattaatacataaagtagccatggttatatccgagctagttgtgttctcatcatcctccccttcttgattggaaaccgtcctcggtttcaccttgtcatggagcgtattgaacttatctttatctatcacatccggtgaggaacatttcttgatggtcatatgattggatccagaaatctttgtagtcgaaaaaccactacactccccttcttgcaaaccaacctgtaactcatttaaacaactagaggaactagatagagaataacttatacgcatgttgtgctctacacaatacatttcatcatgaaaaggaggtatggtcaaatttgaacaaatatatactcgatgcacattatattctcctttactatcataattgccaataacatgaaaaatcacatcagaagggcatggcaattcaaatctagcaaataatttcttccctaaacagttgagtggacaaagatcatcaaattgaatatatccccaagtatttaaagaagatagcaatttaagctcttcattctcgctagcaatgtgaataacatgtttaaactcaacacatagtggctctactaaagaactaagatgtcaattcattagatgtgacatggatataagtgaagcatcgcacaactcttctttatcacaagaaatatcaaccaaattattttgtgacaaaggtatctcagcaattgtttccactatgggttgctctaatgtagcataagtagtggacatagttggcacatcataactatgcataccttgagcagttgtagcaccattatctttaccttttttctcatcttcagaaattgtaggcgcttggtcaattaaacattcctcaagcatgcatggagctatggatagatcttttggctcttgtttttcttctcttcctcctcattaccttggttgttctcagatgcctgcaagatattagtatgcaaagcaatagtcacaacaatacattcgttttgtaattcagacttggttgaatacatcacaatnacatctttcctggtatctctgaaaatctcatcgattccattgttcatcctttgaaaattatcttcgaaaatttcagtaaaactcatgggtaccaatttcattttccgaccattatgtctaaatgtgtatgtgttagcaacaaaattatgtgatccattattatcatatacccatggttgaccaaacaacaaagaacatgcttgcatagggacaagatcaaaattggcagtatcatggtaatttccaatcgaaaagtttattctcacaattctatttaccttgaacttactacaagagttgaaccatttgatgtaatatggatgaggatgcggttgtgtaggcaactcaagtttcttaaccaaatctgatctcacaaagttattgcaactctcactatcgattatactatgacatgttctatccttaaccacaaactttgtttcaaataattcgtggtactgccattgctccgctttctccatttgagaacttagcacttgttgcaccaaagtacggtcatcacgtgcaccttgttggtatcgctgattttgagcgccactcatacttgtcattgcaaacataaaaataacagcaaacaatgaaggttatccctaataatctgctacgcggtgtagtagtgcccctcaacaactcagccaaatggagcaccttaccaagctcttacaaatgtcttaccatcaatactaaggacggtacaaccggtggctggtccgtgacaccttgaagaacgtgatgtggcgattgcaaggatcaaagcggtgctgactagaagtatatatgtggagcttgggaggcacagtatatagtagcaaagggacgcaattgtgctaatcaaaaaatgcaaagttgaataatagttcaaagtactagtcaatgtgctggcctagcctagactcaactctagctcaagcaagcaaccgacaacactaaggactagatatgaatcaatgcacaactctgcactctgaaaacatactcaaaggatgaatgattttttttatttcttggtgcggcttttttttaagcacctttctacctttttttttctttttttgtgcggctttttctttgcacctttctgccttttctttttttttatttttttactttttttttcaacaagaactgaccactgacctcgaacagggactcaaatgtaaatatgaatattacagggactcaaatgcatagtgcaaaattaaaattagatcacctaaaaaatggaatgcttacatcacgtaggttacgtttttataaaaatatctcaaatccgctacttaacaattttagtgctacggacgggagagacgggagtattcacggcatagatccgatctcctctccctcacacgcgcattatgacggcaatacaggaactttagaaatcgagcaaatcccaaaccgcctgatgaaaacttctccaaactacaaaaacagaaacccgacgacgagacgattcaattattcaaggtcccggcaacaaccgacgagatgaaaaactagacccaaaactgacgtacaactcacacacttgagtgatg

SEQ ID NO: 73016 - DNA, 2732 bp, Oryza sativa
  unsure (1)..(2732): unsure at all n locations
ctcctttttaagagggtaacctcctgttaaatttaggttttccaaggaaacctgaataaatttttctgttaaggtcaaaatttttttcaccacaaaagaaattacatgttttccacttttagtgtaaaaagtccagtatcacaaagattgtcattggctctctgtgtaagacatggccggttaccagttagtgcaacaagttcatccggcatcacaaggagcaaggctttttcccggttgagatgctttcacgcacttacacagagtttggatctaggaccacatttgaagattctgtgatgccaagttatatgnaaaagaaaaggcgcgcaaaagtaggctactcgtgctccatgcatgctcaaaaaagttaagttgagcaagcgtctacagtttctgaacatgaaaacaaagggtaataataatggtgctacattactcaaaggtatgcatagatatgatgcgccaaatatgtccactacttatactagattagagaaacccatatggaaataattactcaagacatgatgcagatatgaaaatagttaaatttttatgtgctaatgacattccatttaatgtattgagaagcccacaatttgctggaatggtcacagccattaacaaagcttctagtggatacaaaggtccatcctctgagaaggcaaggacaacttagctagatgcatgcaaaagaagcgtagaacatgatttggcaatagtcaaaagtacatggtaattttcagttgctaacctttttcatccttgtacaggtgcaaatttgttaaccttttaactgaatattgagttattgactatcacttctcttatttttgcatcaagcaggtgcacacaaggtgtttctgttgtgtctgatggatagactgatataaagaacaagccactgatcaatgtgattgcatctaatacccgaggttcatgctttctatatgcagaagatttctctagagttgaaaaaaacaggggaagctattgcagagttcttattgaaggctattgatgaaattggaccaagaaatgtccttcaagtaataacagacaatgtatctaacaaatataggaacacgatcctctagcatggtatactgtttgttggtatttcttaatgacattactagaaatataattctcagcaatagcgcaaaaatacttctgatatattatggttacagagttcatccgcaagcacacagatataccattgtagcatttcactcgagagtattccaagggtaccgtatttgcttaatcccgtgggaagattatgataaagagaatcgtactaataatttatatattacttgtaataaccaaagtctaggtagtggttaatataattcaaagggtagagtgacactaagcagaagcatttatactcattcataattatctaagctaagtggaaagaaaatagaaaaattatattcctatacttctagtacacataggtggtgtttgaatctcctgaagatgaagattaagtgtttcacgcaaaacgaagtggtaatagcgtgtgattaattgagttttaattattataaacttgaaaaatggattaatctgatattttagaacaattttcatatagaaaatttcgcacgaaacgaaccaattagcagtttgaaaagtgtgccactttaatccaaaatttaatcacactttccaagacattcgaatggggccaaatacaaacatcctagttatatgattacttagctaataccctctttccgatatcctcctggtgcttcgagaagccactcttgattgccgagttccttatgacaatccgtcatgaccattcaactggggctaaatacggaggagtaccctccccaggaaattaactttggactacatatacgcgcggaggaatacccgtactgagctatcaccatcagcggcccacctcgcttacgtagcatataaccccaaataatgatatccagtaatctaaacaccacgcttaaactaccgaatactactttaatatcatcatgatgacatagagtcatcgtaaatacgatcattatacccacaccattgcatctcccagataagctaacattataataaatataacctggatatataataaaggtggtatttgtatacttggaaagtatacatacccaagtngtttaaaggagaatttccaaataaagtcaagtcttacaaaagaaggaaagcttctagagccatacacgatttctccggggacttcgaggactgaagattctattctattttatttcactatactatagagactatactcaacctgggagatgaatgaagtttcttgctgagggtgtcttgaaaggagaatgacctcttttttagactctcataccgtttgaccgttggagggtcggaaaaccctccactggattggggggaatttaccccgccaggcaaagccttattaacgctgtgggggggatcgcccacaccagtttggggggggcgccctttgtgtccaatatccctgtgtgaaaattgccctaagggccggtaatttggaggttggggcttataaggaaaaatatcttccacttcgcccgaggaaggcccctttttgggggcctctctttaattgccctctccccggaggggtctctcgcgggggggtgttttattacaacacccttttctccgccctggtttttttttttttgttggggagggaaaaaccccaaaacacacca

SEQ ID NO: 73017 - DNA, 6467 bp, Oryza sativa
  unsure (1)..(6467): unsure at all n locations
tcagcaagtcacgtgcatagtaagaatgaacaaatctagtccgcatgacccgtttcaacgcatcccaagtttgtggcatgttattaggatttttcttgccatgttctatccaccaaaccgaagcaaaatcagtgaactcactagtagcagctctaactctagtgttctcaggaaactcatggcatgcaaatttttggtcacagcaatctcccaagaaaggtacgcatcaggatcatattttccatcaaaaggaggaatattaaatttaattttagaaaaagcatcatcattgttgcgtacctcacgtcggcagcgaccacccatacctctacgattgttgtgtagccgtcaacgatcacgagcatctcgatcatcttgttcagtgtcagcaatatattcatcctcccaattatccccgatgtactctccatcgatgtcctcttcactacgcccaccattgcctccagcattgagagcatcaaaatgcctcacaagagcagcaaggctagtgtcaatgcgggcgaccgatgtctccagccctgtaagcttggtgttggtggcgatctgcgttgactccaattgtccaatcttctcgtttgtcacctgcaaatctgtatcatgtccttctgtgtgttgcttcacttgccttgtaaaatattggatgatgcgtttggtgcgtggggaatgagatgcaccctcctcgtctttatcctcgggacctgccatggtttagaaaagaaggacaccaaaacaatagaggatgtaatataagccctacaactattgggatgtagcttttgcaaaatgctcactcgcagcctatctcacaagctcttaacagttcttatcttgcacacaggaggggacggtaacacacaagttagcaaccgtggaacgaggtgtattagtgctgtagcaacaagacctgtcaagctgtagtcgggtttgtggtggagctgtcggtgggctgaaagcaatgctcaagagaaaactagaaaccacgttagtcaaagcaagttgaataatcgctcaagggtatagtgtacagtgctggtcctaggctagtcgaagtagagacgtgagcctaaccacaaaggatgccacaaaacacaaaccaaacagcaacgataaagggggaatggtggttactcgaacggtggaaggtggtgaccaagggggaatggtggggtgtgctcacaagtcggcttcctctcttctgcctttttttttttgctttctctctctagtgctgaggagagagacacgactttttttattttttttatttttttgatattttttgcacaactaggagcacactggaaccaaccacagaaaatcttatctcaaacggacaaagtatgaagcttgtagaatttttcaaagttctatccgaataggtcccaaagcttctcgccacgaaaacagaattttgcaagcggaatttggcgattttaaatttgccgaacccggcgaagatgggaagaattggatgtaactttttctgtagatgtccatggatatattataagcctaatttcgagtccgtatgaaaaagatatgactgttttaaggaaggtcactcgaatcagggttctatttcctttctagtggtggcaggatacaaggcaactcacaaacgctatcggcaacagatcaaacacaaatagaaagtgatttggtgggtgactgcgatggcggtgacggtggtgatgacgacaaaattgatgagggtggcgatgtgcggtggcaagaactcgaaactctaatcgcctaacactaagaccagcaaattaacacaaccgatgcaatcgaaaactcaacaagccttaactaagcagtactagcaaaaaggtacaatggtctctaggatcacgggaaactaatctactatttttttttgttggccttttctggactataggaaaaaaatttaataacaaagggaagggtaaaatctctcactgatgaaccacgctctgataccacctgatgcgaacccgctagggtttgtggcccgatctttcgatgagaggtggggataactcgattggatgaagacgacgttcacggcccgattacaaccgtccaaagatgctgcgccttagcaaccgatacactgtctccaatggtcaccgcgaacttgtggtgcgcgtcaaccctgccacgagggcactcatcttgcaaacaatcaaagaacaagcaagaacaagtagaacaagcactgaattgctagatgacgatgaaagttttcacaatcaaaaacacaatatggtggggttctgattacatgcagacaggcggtttagccaacatgcacgctgcgagccggtagcaagtagctaactctatcatcaaaacccaagtgttcttggcggcgattagaggtataagaagaggggaagaacaaccacagggtcgtgctccaaccctaggacgcacccctaatgggcccaacttgatacacaacccattgggccaaaggaggtgacgcagcaccatggacagaaagcagttgggactaaaacgacgattgcggccgctccagaacagatatgaacatgtggctggatccatttgaaagtagacttgataagctttccatgaagtacttgcacgccgaaatcgcatgaaattgtgaagaccgtccgatgttggtgctgtcctgtaatctgaatccaaccggcggaaatcctctcccctttggatcctctccatcgttcctgagtaaaacaagagtgcacgcgtctccggggtataaagaagaggaaaatgaactcaagaaagaactcacctaattgttcagttgacgtgcacgagcgcgggtaataggaccatgaagttgtacttgtggggacgtggatgtatcgatggtgttgatatcctcatcacatgttagcgaaaccgggcatccatactacctcgggaccttttttggatggttttatatagttgaggggtacacatttctggtattgcggttaggggaccttagacagactcggcgtacaattgagggatgtcacgtgaacttattccttttaagaatatcttttaatggaagtgtagcgtctcatgtattatcgtagattatagggttaatttgattcatgccattatatttgcttgttttgaaatataccattataattcatgaaattggaaccataccattacaatttaccataaagatgtgccattgcttaccatttcaatacaatttttacttcttcctgaccaaattacccttgtcttcttgttcatcctcttcattccctttctctcttctctcagctccaagctcgatagaacaagatccgttggttgccctcgttttgaggctgtcctacaacgtcgccaccgccggaccttgccaccacaaggcaagactgagtagaggtcagcaacttcgcaggatggctaggtgatgacctatgtctcagagactccgccaccgtaatgtgcagcaacgacctagatgatgctgctcccggagacgatgatgtcggcgacgcctacaagatcgtcttcctgttgttgttctggcggaattctccaaaagtgagttgctggggcccggccccatcctcacatagttctcttcttcccccaattagactgctttagttatgtcagtatgtgtatatctgtgttttgtagtttgtacagctcccaggaaggacacctatggagttttctagagcccattgacctggaggagatggttgttgggatatgcgtaggctacgataacataaatcaaaacttttctaccgcgtaaactaggaaccatgcaagtattagatcatagatcgttatcactcgacgcgctgcgcagcggaagaaggcgctaagaagtcgaaggaattctcgcgaagtagtgcgcgtcgatgtagaggaagtagtcgatggcaccggctcgaccttctcctcctcgtgtactcttctcgcggtactcccatccgatcagcaccgcaaatcagcggcacctctactggtatccacacgtacaaggacggaacgccacgcgcagatgtgctagcacccgcgtgcggctagggttttgctccggaagggaagtgacggctagggtttctcacgtgatgcgatccctccgctggtcacacctctcacgaatatatagaatccatcactcgggcctccaaggcccgtaggactcctattcggatccctatctgaattaagctcatattggatctccatccaatccccttattccggcccattaagcatgcgaccctgtaggttcatgtacactcggctgtaacccgaaaactccttttcgctccacgtgtcaacagcggcccctagcagaacgtattgacccaccgagcatacataaagatcatatcagctgaacctctagcgtatacttgtatgaacccctttgcctcacgatatcgattaagctcaagaaaagatatgtgccatcctctaatagctcaatcattcactcgaatctgtgatagatagattatataacttgtgattgactcctcaatcacttttggcatggccatgcacttccataatctataacatcgaggggcccagagatatctctccataggaggggccaatcccatcttgattattcatattccactacatgtttcacagcatacccaaaaactacttttataatttcccaattacggagtagcgtttagcagtccctaagtaagctacgacacatgttgggaaccatgataatctcaggtctaaggattcaacaccaacactaaatgagatcactgatgacacaacacagatggctcttgcactgtatcatgttgggtctatccaacaacatgttccccaacatgtgttcacattattaatttggtatctctgtactatgatccatgagacatgatcatcaattaatacttgtgctgatcatttaaacatatttgttccacatatgatatttgatcatggatccttaagaaatagtacaaacaacataaagagtctaatgaaagaaccacatattcattaaccaataatgagttatctatttcaaagaacaaagttggataaatatataaacatagtatgtgatacaatcatctgtatgattgcctctagggcatatcactacagtggtgggagtgatgatgcatgctgcacgttgtacaatgaagccaacgacggccattcctgcctcttgttccatcggaactcgaagctgagaggagggaaagaacggggaaggaacaggaggaggatggaggaagaagacgacggtaatttgttcagaaattgtattgaaaggggtaagtattggcacatcttcgatacttactaaattgtggttccaattttataaattataatggtatattttataacgagcaaatttataatggtatgaatctaattagggcccctttgaatcgtaggaataaaaaaacggagaaataggaaaaatataggattctgacaggaatgctagtgtaaaacaaatgattgcaaaacacagaaaaaacacaggaatgatcgtttgattagaccacagaaaaaacataggaatcggatgagagagataaactcaaaggatttttaccaagagattggacctctccaaaacctatatgcaacaagccattccataggaattttgtaggatttcaatccttttcatcaaagagctacataagaaaatttccggtaggatttcaatcttatgaaatttcctccataatttgtttgattcaaagggcccttaatcctagattatattggcttacatgagtctactactagtctactacacgtggcttccatcagggatgtcctaacggactcaaccggtgtttcttctacgcctagtaccttccaggccgagatctcccatttggatcctctgttctgcagtctgcacggctttcttctagctgtcggaagggtgaagtcttgcaacagatgccatacctaccaggaaagcaaagtgtcgaaacatgaattcggcaataataaaagggggttgcgtacgagacctaaagtggatggatgcagagacaaaggatttagacaggttcaggccctctcgatgagaggtaataccctactcctgtttggggatttgaatccgccgagtgtgtattgatctgacgatcaggttgtctcatgcccctagagggggctccctgccctccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatatttcatatatataagttatcccctataactagtcggataatcatgccgtgtgggtatggggtacccataaatctcacagtagcccctgagacctcacagtcngaaagataatctctctcgaactagattac

SEQ ID NO: 73018 - DNA, 2540 bp, Oryza sativa
  unsure (1)..(2540): unsure at all n locations
atagagactatactaaacttgagagatgaatgaagcttcttgcttgaggtgtgtcttgaaatggagaatgaagctccttttatagcctcctaatgacggttgtgacggttggaatggtcggaaataccctccaactgtcattgggagctaatctacaccgcccaggcaaagccctagatcaaacggctgcgagggggattcggccgaaccaggttttggctggtggcctcctctcttgctcccatatgccgacttgtgaattttggcctaattggtcgtgtcatttctgagttcttggcctattcattgataaatctgattctcgacattgtccgattgattgatcgtctattttgatgttgattctccttcattttatgttcattctctgcaagaggttagtaatcctaatgctagtggaatatttattaattaaacacaaatatgcattacaaccatggctagttctcttttatttggatagtattgaccggcaaaactgatcactaacgaccgtcaacaccattttgaacaaccatggaacatattccatctatggttccgtagagttccagattgtcgttccaaaaaattaagctaggaacacgttccacctatagttccgaaattttggaagaggtatactcctctagttccatgcttttggaaaatggcatccaacgttccacgttccagttcctcgttccatcgatccatgaacttttgagacttaggtttagccaaaatttggatgaaacaaacttgtaatgttgattattcaacctagtagtcatgctgcctattgggaccataccttgaccaaatatgctctaccgaatctttcttcaaagcgtagtgcgtacctcgatcttgtacacgttgatcatgttggaggactgatgtcggatggggtcccgatcttctgataggtaatttatcttcccataaccagaaaaaaaaaatcattcatcctttgagtatgttttcagagtgcagagttgtgcattgattcatatctagtccttactgttgtcaggtgcttacttgagctagagttgagtctaggctaggccagcacattgactagtactttgaactattattcaattttgcattttttgattagcacaattgtgttcctctgctactatatattgtgcctcccaagctccacatatatacttctggtgagcaccactttgatccttgcaatcgccacatcacgtccttcaaggtgtcacaaaccagccaccggatgtaccgtccttagcactgctggtaaggcacttgtaagagcttgataaggtgctccatttggctgagttgttgagaggcaccactacaccacatagcagattattagggataaccttcactgtttgttgttgtttttgtgtttgcaatcacatgtatgggtggcgctcaaaatcagcgataccaacaaggtgacaataatcgcgtgcccgatgatccttattctaaggttaagtttaaaataccatccttttcgggttattatgatgctgagaaatactttgattgggatatgacagtagagcaaaagtttagtgcccaccttgtgcctgagcaacatagagttcgacaagccagtagtgagttcaaagagtttgcttatatttggtggtctgggttagctgtagagagagctttacctactacttggaaagaacttaaggtagctatacgtgatagatttgttccaccatcttatcttagagaattaagcaagaaactgatgcgtttagaagaagggaataaatctgtacaggattactatggtgagctacaaaagggattgatgcgatgtagcatagtggatggaactaaggattccatttgtcgcttttacatgggattgaggcgcgagattcaggacatagtagataataaggaatttaacactgtcaaccagttgtttcagtttgctatgcttgcagagaaggaattgcaggggcgtaatcaacaagtcaagaacaaggcgagcatgtacacgctgcgggcgaagccatcttcggggctgcccaagcccatctctttctggacgaccccactagcgagcaagcgaccaattgcacccggagtttctgcagcgccaaaaccacctcacccacgacctgcagattcaggtaaaggttcttcgcaggtatccaataagagtgcctcatctgtcacttcgacgggacgcacgcccaggattcagtgccaccgctgccatggatttggccatgtgtagaaggtttgcctaagtcaacgggcatacgttgctacggaagatggctacaccagcacctccgacgttgaagatgatgaggaggaagagaagaaagacgaagagaaaaaaacctatctatagctccatgcatgcttgaagaatgttcaattggacaagcacctataatttgtgaagatgagaataaatgtaatgataatggtgctacaactaatcaaggtatgcatatttatgatgtaccaactatatccagtncttgtgcggcggtcaagagtaggatgtcagcccc

SEQ ID NO: 73019 - DNA, 3435 bp, Oryza sativa
  unsure (1)..(3435): unsure at all n locations
ccccccgctttattgagactacttttttattcttgtataactcctttacttactatgtttatattgttctttaaacgctcaatcgttcaaaaaccacaaacccccccgcggtttgaattgactggcaccttggcannncncccgcagaatagagttcagcctttttttttttggcaaatatagtagtacgtattttttttccctacttctatgtaaacgtacgggagtgtttttttttttgtaatgtacgggagttaggaggaagggatttgccttcttagatctaatttaatggtctaaaataatgggtcgccgatttaagtaaaaattgacggttagatattttctttgtatttaaaattgtagaactttttagagatatgacatgtggcgatctaggagtgtttgtaggagtgccacatggtgatttaaaaacgtttatagaaagttatagatggtgctgccgccggggagagcaaggccaagaaattcctgaagagggcgttgtcgttcacgggtagctcgtcattggggagtgcgatggtggggatcctgtggcctcggacggagtcgtgcacggcggagcagggatcccgacgtccgacggcggcgcagcgagggcgcttaaattataatgagatggagactgggctcctaccccgcgcgtgcgcgggtgattaaatcgcgcgcgggatccgcagcgcggagtcgcttttcattttttctgttttcctttcgcttttctctaagaaaaaaaaataacctttagcacgaagaaaaaaaaaacctttagcacgttttatttcttttttttttttaaggataggacgcggaaaattaggataggtacggagggttaactgcaacaaacttttaaatttaagatttaaaactcttaactcaagatttgaaacttttaacttaaattttaaaaaaattctaagtcaagatttgaaaacttttaatagaactactattaggagtgcagcgcgctcctaatattccaagcgccaaatattcatcagcccaggctcaccccaccccacgtcccgtcatccaactcctaccgttgtcggagtaaacgatttactcctatcgtgcgcctcaaacatccacctttattcgagtaaacgatttacttcgataataaaaacaactcccctgcttccgatcccaccccacgtcccacatcgtgcacccaccattatcggagtaaatgatttactatgataaaaacaacttccggtatatattctatttttcccgtacccaaccaaccactctcgtccccactctattttttacttttttttcggatctgaatcgatccactatcctagcccacagatcggcgacacaccatggagaaggacgacgacaccgtggcggttgatgacggtggccggcgagcggtggccggcggcggttgaggcaaaggcactacttcgagcctcgctgccagacgctaggcagcaccataaccagcaaggaggtgttcacctgagccaatagcaacaaccagcggctgctccatgtcggcgacattgatagaacaagcaagtaaggaaatggcactctgatttgcatctgcatactctccttcaacttcacgcatgaagccctaattttttttgcaaatcaaattaacatgcaatctccaatatcacctgatctcaattgatgggttgcacaagtcctacatttgcacatcgtgctccatgtggctggccgtagaggatagggtggagtccaccggtgatggagattgtttgctatttttcttttgctcgtcatctgtattgacatgaacgagaatgtttttgcatttttttgtgcttgttagatgatggatggctgctattgcgcaacgtcaagctcatctctatactacaccgctacatccttccatgatggatttttggctgaatcattttttttcttttctagtttgattcacctgtgagtaattttatcgcttgtgtgtgattgagcctataattttttcattcatacgactattttgtgatacagatcaacaatactcttagtatcagtttttacactaatactatatattgaatacatcagtaaacatattactacacagtggctatgagatcatggctatatcgagaggaagatggtaattgttttactcgcagaccacgaaatctaaataatattggtaaaagaagtactagagttgtaagctggtagtaattcttttacgaccatttacgtatggcatcatacgatgtagagacattcatgcgaataaatttgttactttagaataagcagatgtgggaggctgggagtaaatgaaaaactccatgagtaaattcgttacttttgaaacgtgcggagatattagaaaaacggaaaacttggaaagaaaaattagacagtaaatattttactaaaacgcgaaaacagaaaaactttagagaaggaatgaataacagaaaaatctggatagttaatattttaccgggcccattgatgaagcacagataagacggtaaagagaaaaaagaaacccggaaggtggggtggtaaaaaccgaaaaaaacaacccgagaaaaagtgggatgcgaaggacaggtggggtggtaaaaaaggggaaacccgaaagaagaagccggtgtgcggcgctcgaattattattccgcgctgtagcgcgtggaatagcgctaccaaacttttaactcaaatttaaaaactctcacatcaaaattcaaaacattcgatttaaatttgaaaactttcataccaaatttaaaacatgcaacttaaatttaaaaactttcaactcaaattcaaatctctcaactgatattgaaggtgaaagattcaatttacaaaatatcgcaaagaaaattgcatgtgtgtgtggagaaaaaagggagtgatttccaagaaaaaaaagagaaactagtgcctatttcccaaaaaaaaaaggggggaggactagcgccgtgactgttgacagtgtccgtgctgccaatgcgtacgcgctaattagcaaattcactaggattgagggctgagaggtgggatttaggtgtcttcctattttgagggtttagtgctggttttgttggatcttgattttttcctcttcacccaaaaattatttggggtttaatttatgtgccctgcaggacatgcaaaagttagattttgtttgcgtagctttttcttttttttagataatagaagctttattgatcttagtcatccaaggatactcccggcctctgcaccacgacagtgcacacagccaacaaactccaacacactcaaaataaaagagaataaaaacagcgtgcaagatcaaggccctacaacccgaagactaggtcgccacccataggggatcctctagagtcgncctgcnggaatgcggactacagtntgttcatccaaggccat

SEQ ID NO: 73020 - DNA, 9411 bp, Oryza sativa
gcaatactcaaaactaaaaattaaatctaaaactaaaccagcactcgacacgatgatgcaatctagaattcaataaagcaaaatctaatagaacaatgcaacggctcaaattgtctaggtaaacaataaatatttttgtgtggtaattttctggttatggaagataaattacctaacgggcaaccgcactctgataccaactgatgagggatgtaggtcttgatcttccgaaaggttctgataaacaacgatttggacggagtcgcgacacaaatcgatccggcttcttaaacgcgcacgctcttgagccccgcaatcgcagcaccacgtctactctggttatcacccgtgtcgaaacgcggatgaccttgccgagaaggctaatccctattttccaatcgaagaacacaaaaaagaacgagatagaaaaacaaccaaaattgtagatgaatgattaagctcacgagttggggtcttacaaaccgatctagcggtgaaactgttctcgacagattaatctaagcaaaacccaactctaaacgttgacggctactgaataaatgtgattagggacgtcctagggttgcccaagggtgcacacccccttgggctaagcccacgatacaattacaaggcccaaaacccaaatcaaattcggactggatgagatacgtggcttgttttgcagattcccggcagctcagtaggaattttaacgtggaaccaaaaccatcagaaagtagactccataagctttccaacaagtattcatgggccccgaaattccttctagatcagtggctaggtccgtttgaagttgatgctgtcagcaggcccgaatccgaatccaaaacgtgcacaacttaatctcttgtcttctatgggccaaaagtgatgtggagagatgaaagaagacttggagatggccttggtttggtccccaatcaacttcttcaatcatccatgcattccttatgttcggtctctttttttcgcccaagcaagtacctctgcaaacaaaaacacacaaaactcatcgtgtagcaatgtttgttcaaatatataacaagtatatctaatatagaatatatgcacctttggttgattaatacataaagtagccatgattatatctgagctagttgtgttctcatcatgctgcccctacctggcacgccaactgtcgaaacaagatttcggcaatactaaaagggggtggctatcaagttggaaaagtggatgggtttagagacaaggaattttatacaggttcaggccttcttaatcaagaagtaataccctactcctgtccggggattgatccgtcgagtgtattattgatcgtatgatctgagagaaaatcgtgcccctagaggcacccggacccctccttatataggggaaggggtccgtattacaaaatacagtccatatccttaacggaatatgtagttacagataaaatacaatcgtaactgactaagacatacaagtttaaaacttaacccgagtcttctcgaagatattctatctatgcatggcaccccatacccagtcagactatacatgccgtgtaggtatggggtatccataatctccacaaggctggatagtgcatgataaatgtaagatcaacgtgtgttttgattcttattctgtgatgaacaattggcatttgtgactgttggttttgatatttggagattactgttgaagtggttttggagataattgattttcaggtgatgaacagggtttgctgttttgtcgggaccggtcagaccgggcggtggttgctggtcagaccggcttgtgttgagcggtcagaccggctagcccgcggtctgaccggccgccgccgtgtcggtttcggtttcgggttgtttctttggatatccatgattgtttcatggttatggcttctagatggatactatacatatgtaatactgttgtttgctaacaatgagtcaagttggtgatagcttgatcttggaatatggtttttttgtttgtttcttgtgtaggtgactcgatgcctcgggagagtatttgcggtgatggaccgggagtcggcttggtggtaagacgatgtatgtggtggtcagatattatgcgggataattaggctagagttgatgcacgtggttggtgaagatttcatatggcatacgatggaggtattgtgtgagtatgggatgcggagtcgaatttggaaggagtccaaatttggtatgattggttatgtgaagtttgtttcttgtactagagggtttcctaaggtgtttaggacttctagtatgagtttggtttgtggctttaggctgcctacctcacgtataaatagagggggagcgtgatgcttccctgtatcgcttttgagagcaattgagttgctagtttagctagggtttcgagtttagtcgacatttttgtaaggagtgctgttggtgcactttgtaaacatagagagaagcaataaagttgtcatctactttgagagttcttcgatttgtgtttcaccgggtttcggcggactaaccggcatctctccggcggtcagaccggcggcatcacggcggtcagaccggcggcgtaagggcggttagaccggcggcggcttcaggccacggcaactgatcaggtggtcagaccggagttccaatctcggtcagaccggtggcttccaggcggtcagaccggcacgactacttcggtcagaccgcaatccgtcgaattcatgggtaacttttatttccgctaaaagttttcggtttttaggtatatcaaccattcacccccctctggttggcttagttcttgtgtttcgatcctataagtggtatcagagccttgttttcttttttggatttttatcgatctagagtttttgccacggctgctcctgttaggtttttaactaagcctcatgttttcaatggaacggatttttctcattgatgtagtaggatgcaatcttacattatggctgaagattatgatatttggagaaaagtttctcatctttatgtgattcctaaagtaattaatactgctgctgcaaaaactgactttgaacaaaattaaaaagctcgcaatattcttttgagtgggatttctcgttcggattatgatcgtgttgctcatcttcaaactgctcatgagatttggattgctttgagtaattttcatcgaggaacaaataacattaaagaacttcatcgagatcttttcaaaaaggagtatattaaattggagatgaaacctggataagctttggatgattatctttctaggttcaacaaaattttgagtgatcttaggtctgttgattcttcttatgatgttaattactcacaatctgaggtttctcattgctttttgaatggtcttgacatgtctgtttgggagatgaaagttacatcaattcaggagtctgttgatatgtctactttgactttggattcgctttacacaaaactgaaaacacatgagatgaatattctttctcgtaaagttgattctaagtctagtgctttggtttcgtcttcaacttctttggatgttggtgcttcttcatcgaagtcttctgtccttgctttatttaatgccatgtccgatgatcaactcgaatagttcgaggaggaggactgggttttgctatctaacaatttttctcgggctatgaataatgttaggaacaggaaaagaggaggaccgaatcattgttttgagtgtggtgcacttgatcatcttcgttcacattgtcctaagcttgggagaggcaagaaggaagatgatggtagagtcaaggaagatgacgtgaacaagaagaagatcacaaaggagaagaagaagaattgcgtgcaatggctaatccaagaattaataaaagcttgtgatgaatcagaggatgaagatgagagcaaaggtaagcagaaagcttgtgatgaatcagaggatgaagatgagagcaaaggtaagcaaattgttgatttagcttttattgctcgtaatacaagttctgatattgatgaatctaatagtgatagtgaagaaaaagcttagttatgatcaattagaacatgctgcttacaaatttgctaagaaatttcaaacatgttctattgtgcttgatgagaaggatcacactattgagattctaaatgctgaaattgatagattaaaatctttgattcttaatgatgatgaatgtgaatcttgtgaagttttattttctgaaaattaatgctttgcgagatgtcaattcaattaattgcaagaagttggaatttgagattgaaaaatctaaaaagttggagtcttcttttgctcttggatttgctttacatgctcgtgttgttgatgaattgattttgacaaagaatgttttgaaaaaatacaaagttgctttttgtgcaagttctttggtcaatgcttcatgtgcaaataaggcaaaacaaaacaaagatgttttgatttctcaagattgttcaaagtgtattttgaatgagttgaagttgaaagatgctttagggcgtgttaaacacatggaagaaattgttaaacaagatgaggtattttcttgctcaacttgtagaaaaagtgtgctattcttactccggaggtttcttatttgaaaagttctttgcaaaggttttctgatggtaaaaagaacctcaacatgattcttgatcaatccaaggttagcacaaataatcgtggtttaggttttgattcttatgcttatcatgctagacatcctcctactgtttttggtgctgctaggagaggtgaaattttgattgaaactgagcctaagaacactgtgtttaaatctgctggcatcatgtcttctttaaatgcatcttcttcaaaatctaatgttgtgcctgcaaaactttctgttgatgcaaaaccatcaatttcaaatccatctacttcacaaacttatcgtgagaagtacacttattcttttttggaaaagatggacatttggttggtttttgttttagacttgcccataaacagaaaaaggaaaaagaaattgcttttgcaaaatgacgttggcaaaaatcgggttttaattcgaggagcactgttagaccgacgttgtcgagtcagtcagaccggccagcggttagaccgcaggtgaaccgacggtcagaccggttgccaggcctgctcagaccgcaggcacaacgttcaagattcaatcgaagatacaaattccggaagtgttcaaaaggctcatccttagttgccataaagaacacccaagaatattgagaaattcgtcaacaataaccaacacaaaccactttcctccaatggattgcacactagctggaccaacagtgtccatgtgtagtagttttcctggtgcatccgtcgtcatagaaataataagagcatgtgaagaagcaaccatcttagcatgatgacatggtgtacaaaccaaatcaagacctttcctaagtataggcgaaccacaaacaagatccaaaccacttaacttcgtcagatgatcaaaaccaacatatacaagtctacgatgccaaaacatcaaatcttaaatgaatttagcaactaaacatgtgaccacgggtgaaacaggattttcaaaaccagctttaaaaactcctccatagcaagaaatattaaacacataatcaacaatttgtgaaactaaaagtaaattatacattaagtcctataccaaagctacgtctttgaattcaaacttgtcacttaccaagacagataccgtagcaagaaagatagttgaagcatctccaaagataatcgattctgtcttggatgcttgtttgagggaggagaaccaatttttatcactggtcatgtaccgcgaacaactggaatccacgatccacatgttctccttcctcgccaccaaatcctacacacaagaagacataggattggagaggtacaactcctcctttttatattagtatagataaactagcgtatgaggcatatttagggtttatgtctaatttatgcatcaatccatagccgatctagtccaactacatcggatgggatcactaacgatacgtcatcagcctcggccgatcggcaatctaactttccttgttgtttccttgctggtcgtagaatcgaaccagctggcacgctcttagcacactcgaggcaagccttggacctgcgctggagttaagcagatctcccaggccgccgtgtttctcgtcaacacgcttttggcatgcccggtgggacaaagttttcattgtttaattatgttgttggaaagagattggattcacaccagttatcatattccctcatgaggtgacgactgttggtatttcttagtgacactactggaaatataattcccagcaatagcactagaaataatcctagtatattatggttacagatatgatccacaagcgcacggatatacaattgtagcatttcaccagggagtattctaagttatcgtatttattttatcccaagggaagatatgataagagagtactaagatatatctaatttcgttgttttgatgtttgtccagaaattgtttgcctgcttacacctaaaaaaggtcagttacatatatatatcatggtttcttctgcaatccttataggaattctgtttaacacattcgtgatctacgattttgattaaaacaatgaatcgcgtttttcccctattaaatgagttgttttattgataagtttgacagcaaaaacccatataatttatttaaagaatactgagcattaatcataattttggggcactggcagagaacaaatattatcaaaaaaatttcttaatacaaactagcagctaatgattaattattcatgccctgtctctgtaaatccgtatatactgtatgtactctacagcatatacatattattgatcaatgccattcgattttgatcattatgttaattttctaatcacaagtaatgccaaataaacatcccccatactttgtccaaatacatttcttggaatgactacatgattctgttcacatatgtatatataatttatcagcctaatccatagttcttcttaattatcaacgtagaattttaacacaatggcatgtcttatggttaaattttttcacattgagaaggaaatatggaaagtcaatgtgcaagcaattagactttaggacaacataatccaaacagcaacgtatatgcacacataaaagtgattctaggtcccttttagagattaaggataagcgtataaaccaagatgtccgtcactaaataaggagtagttggagagggcaagggtgattggatttaaggctgagagaaaattaaataaatggtccaattgggaaagtagcactccaaatcccttataattgtggataaattacgagccttaaaatccattatactccctccaaattttaatagatgacttaattgacttttgaagacatgtttgataattcatcttattcaaaaaaaatactaatgtataatatataaatcatgcttaaagtactttgagtgataaaacaactcagaataaaataaattatagttatgtaaatttttttaataagataaatggtcaaatgtgtgataaaaagtcaatggtgtgatctattaataaacggatgtagatttgtgcatagagggagtacttattacctcaatgtcatactttattagcgtaaatattttttcatgtatggatagtgtttatgtttaatgtcttcttgcttatattacttgtctcatatcccatgttaaaaaaattttaggcccattaatagcaaatggtgaaaatgtacatgataacagatctcaaggtttcatttgcagcattatattgtccaactgtcaaccataattcagtcaacttcttaaacattaccaaacttagcaaaattagaacaaacatttatattttcaagcattgagagtgtttccaaagaaagcatacttttatggtaagatgtcaatatgaaaaaatataagtcatatttataatatgttaataacaaaacaaaccataataaaataaataatacttacgcaaatttttaataagacaaatgtcaaatgcatgtcaacaagtcagcaacatcaaacattataaaaagcggaagaactatattgtaagatgaactcaaacacaagtttcgatctgatatattaaattaactaagaatggacagaccctatctgagaaagaagagctaaaataatcgagctatatagatagaaactataaattgacttggtacaagcctccaaagctttcctcttgatacaaaatgtttcaaactataaaaccttcattttattttgctacaagccattgctacaaaaacataacagtctgaagtttcgtattaagcatctctaaccttagcaagaggtgatatatccatgacactatgctccaaactgtgtaagtttaattaatatcatttaatccatataagtattggcaacagtttatttgaaattttagcatatgcacagttgagacaatttgaagcacactatatatggagtgacaagaaggggacattggaaaatattttatttaactcacgagcaaatgtatattttgatataattactgacaaaaataaacttatgtataatgtttaaaagtattattcataccttgatttgtttatatatgtagattttgcaatccatgggatgatatacgatgacataatttatattttcaaccttttccataatcttcatgactatttagaaggcatgcaaataatcaacaataatgtttcatttccatttctcataatttgaaggaaaattacaaagtaaataatgaattcagtcgaggaacatcatggaaattgcatgtaaattaattagggtgtataagaaaaatgtcatattaataaaagaaatggcctggccattattctaacagttatcttagatagattgtagtatcgtgaccactcaacgttaaatcatatcaatagctcatattaaataaaacaagcaaattcaaattttttggacgatggatttaatatttgttaatttaatttcaaattaataattgtaaaattatagcaaacatgtccctgtataataaattcgaaattgtaggtaatttgaaaaataaccaacatttagcctataataaaaaatttactatatataaaagaatatgcccccatataaaagcccgtgcaacacacgggttggcgaccagtaactctaactctctattcagtgaccaggtttactctggtatacgattttccggacaagaatgtgatcccatctgtgcatccgcaattttacatacacggacaaggttgttaacagatgtataatgccaaaatagaatgtttgactgatagtttttgtc

SEQ ID NO: 73021 - DNA, 3965 bp, Oryza sativa
atggagccgtaggcccgctagtccgctgttgtttatttttgattgtcaggcctgaagtgcctttgtaataatgtaaatattatcgatataataaagatgtgccttttgtatcatgtttgtttggtgtaccccggcttttcctgggacggggattaatatactagcgttcgggaaaaggcaattttctcggtcgcgacaaatggtcaaatcaaactcaaataaaaaggtcaagctcccttcgacgatcctcgttgatcagccgtacaaacatcatacatggattaggaaaccgttgcgccgctcagtttatccataaaaattagcatatatggggacaatattgtctaatagaaaatgtctaatagaattcaacttttcttgaggaaaatgtctaatagaatagaacaaatcactatagatatcatcgaaataatctataaatattacgtgcatgcacaagctgtaaaaaatatcaaccctgctatccgtccgacgcaaatcatccgactagcatccgactgaaacggcgacaacgaacaacatgacggcgtgagacgactctattatctatatatgaatcggtccaacgccatgcaagcagcccattcctgcacggctacaccatatgcaagcccatatacaagtctagactccaagcccaaactcaggaagactccacgacacttctgccggagttttggtcgatctgaatcactgcgtgctaacttcaatctcaacgttctcttgtaatgttttcacagctgcagctgctcattttccagacaagtttttttacccttttaatatactcctctgtttcaggttataagtcgttttgacattgatcaaagttaaactgtttgaagtttgacaaagtttgtagaaaaagtagtaacattttcaacccaagatattgtaaatattactatatttatctataaacttagttaaatttaaaatagtttaacttttaatcaaagtcaaaacgacttataatatgaaacaaaaatattttttttgaagcaaatgacagcaggagatctgctggatatattagaagtattagaaataacaggttggtatataccacagtttcaagttctatttttatgcctataacaggttgcatttaacaaaatataaggctgtgtttagatcaaggggtgcaaagttttggcgtgtcacattggatatgtaggcatacatttaaagtataaaacgtagactagtaacaaaaaatttacataatccacttgtaaattatgagacgaatttattaagcctaattaatccgtcattagcaaatatttactgtagcaccacattatcaaatcatggactaattaagcttaaaaaattcatctcgcaatttacacgcagtccgcgtaattagttattttttttgtctaaatttaatattacatacatgtgtcaaacgttcgatgtgatagggtgtaaagttttggcattagatctaaataggccctaaatgcagtgatgtccaaaaccacaagcatagtttctaatttgtcacgaccggaaataacccaacgggcattccttacgtgcgtgcattattccttgtcccaggaggcaaggtacaccaaagttgatacaattcagagtttaacaagcggaagcgtaattaattaatttattacatgggcggcgaagacccagcacacacaaagacaaacgaaaaacagcggaagactagggcgacgaccacaggcgcttgacggcaggcacgagctagacaccaaagccttcatcttccaggaactcctcttctgggtttgggaaaaattgagcaagactgagtacaaccaccgtactcaacaagacacacccacaagtgcagaataaatgcaagggagtacaagggggttataatataagggttagggtttgcagtaaacagcattaaaagacacttagttgctcaaagctattttgtgaacatggtcctagagctatacaatattattaaccaaggccgtgaacccacacgaacctgccttaacccaaggcctacgatgattcagaccgaactggcaacccgaccctgggtcccagctcgtcccaagccaacccaggccaaccattccacattttagttattaagcaggttttaagaattaaaacactaacttgggtacattgctcggcttgcccataactgagggcgcggctattcgaatagattatactctgatcagaggtgtacatctttacccacaagacacatcttcctcacgtgtaaccacgtgccacataccaccacggtatacggacggaagacatgacatagtttccaacccatcctagccataacaagagtaccgacccaacccacctacgggcggaacccccgggacaggtaggccaggactgagcccctaacaacaagacaccggccctgggccatgacatttcgactaccgggccgcagctcgtgtagccttcatttgccctagagatgtccatcgacccccgacttcgtccatctccatccgggtacttttggttataaccagactgagccacaaactaagccttacccactagacatgtggaagtacagtaggtgcttttttggggccaaacagaggcccgaagaccggtccttatatggccgtggtgctactatggccgtggtgctacttgtaacaccatgcaccccgagcccagcctaaaaccattttgagggttttgaatagaggggaaggtgtgaatccaattccacaataatccaaccattccatagtgtctaggtgataagagtattcccaaagtctagagttgtaaaaccacctaatgttgcctaattaaccagcgaagcctctacctaaaatcatactagtggtaccatgagtagagtgtccactagttggggttttgtttattctagggtgaacaaggaaataataacaataacaataataaggtcataccaaaggtaaataggcatggctagataaaacagtgataacgcgggaatttaaataaagcgataatgcaataatttaaatcaaaataattttataaactgggattcaatatgttcaagggtgatgtgacttgccttgctcgctttcccaaacgtcggcttcaacctccacgaagagcggatcttccgaagctgcagcgtctacacgaccaacggaaaagaaaaggcttttactctaataaactccatataacaagcaggaacaaagcacaaaaatgggttcttgacttcataaggaaaaattagagacttgaacggtccaattccgagttcaaatggccaagttatggtcatttgaagtttatatgctctttaaatgaatatttgcgaatttcttcatttaaaatttaatttaaaaagggtttattgcgtcagccgaggggagggggcgcgcggaccgggtccacgggagtggggcccacgcggcagcctcacggtccacggtggaccgggtgcacccgggctcacaccggccggcgccgtgggtcccacgcgtcagccgcacccgagggcgcgggcggctgacggccgggccccacgcggcagccactcggcgcgcccgagggcggccacgccagcgcggtcagcatgaggcggcgcgcccgcgccccgatggtcgccgccggcgaccaccggcatggcggagcggcggccgagagaggggagggaagggggaaaggaggcgacggccccacgactcaccccggggcgacggcggcgatgagggaggcgcccggaacgaaggtaggcggcggcgcggctcgggtcgacggggtcgacggcgttccggatcgggtcgatggggtcgacggcgttccggcggtcggcgaccgacacggagaggtggacgaggtgggcgaggatgcggcgaacccgtaggaggcggccccgaggtgggaggtggttcggggcgacgacggcggcggaccggagctcggcggcgacggcggagaga

SEQ ID NO: 73022 - DNA, 22320 bp, Oryza sativa
aagacaaacggttaaacatgttttaaaacgtcaacgacgtcaaatatttagtgacggatggggtattaaacaagtgaatcaagatcgctacttgttcatacagattctttgacagattatactgatgatatttgcttaattgacacattgttgtactcctgtacatttttgcgataagactttgagaccaaccaaatgctcctatgatcgaagtattctgctaccttgtccatatgttattcgctaataccaagtagaaataaagcgtcatccgtgagagtagagtgatccctatgtcttgctctctgatgcatcccactctcattgtagatagtcaacaagttcatctcttcatcagttttcagtgtgtcagcatatggcttggctgtggatgcatttatgcgaatgcgcggtgagaattggggggggggggggggcaagaatgcgggacgaggcatctagtgggttgtgttgctggacggatggatgggaggtcaccagacagagctttgtgaatcgcgattttatatttacaaccatgatttacaaggactatatactggactctacaatcttgtgcatttgggttgtttgaacggataggcagatgttgaattttaataaacatggatggagaaattatattgttgttttaatgcatttacttctatggtcgcaattcagatgcatctacaattctacatggttgctaaaatatgtcaaacatatcatattacctactactctgtccaaacaataataagttccattcagagcatatatatatatatatatatatatagctaaaaatgcttatatttgcgggtggatgtagtacgtgatgtccacccaagtcttatcacatttttttttcttttactcatcacttcttgtcctttgtcaaaagtaactagtaaacacttgttagctgttatgaaaatagaaacgacgttgtttgcccaagttacgtccagttcccctctctttgcagtctagatgagccccggccatggcttgttgctgcatgatgaccatgagatgacaaggcaaacatgaagatatataaatcaagcgcatagtttttattgaaactggggatgggttaaagttatctccaggatgatgtcattttataatttctgggtatcataatggactattatgatttttggagagggtcgcttgcttttatgacgactgaaattcagtcttattaatagtatttctcccttttttttattacaagagatggatgtgcacacgctgaaggagctggtgaaaaattcacgaagctcataaatttccaaccaactgcacctcgctccattaattggtttcttcttttttttaatcaggttttaatctaaaaattaactgtccttaatgggaaagactcggctgctacatatatttatcctttatttgaattgaacgtatttaaaattattatttcacatcacatggttttcttgacattatattgtattggatgttttaccatattttttccttctaattcaatgtgtttacatttttatacatttacaattgtaccatgaagcaaaaaatagaaacactttactgagtaatggatgttgaatggatttttgtagggaaatcatcaactatgaatgttcgttgataatttaacgaaattatgacccgaatacgcaagagaacggcataatgcattcaaaagaagaagaagaggacgaggtttgaatatttacaagacacccacagtggatgatggaaagggaaaggaaaaaccaccaaaatcttccgaaaccaataaaaaacctgaaatattgtaaatttaagtttcctagctagttcttattgggaacgtggactttgaatatcgaaactgcagagtcatacttaatcacggaaaatataagaatttaattttattgtttgctaagaaatgatttagtttatgaacgatcacagctgcgaaaagcctctttagtcccggtttgtaacccctttagtcctagttggtaagaccaaccgggactaaagatccctggcacactgacaacccctgactagggttaaactttttggtttggcagatttgatcgggcatcaccaaaataccaaaatttccaaaattttgaacaaaacttagttgaatttgaacaaatattaccaaaattcatgaaaaaattataaaaatgaaaaatttcagccgaaataatatcgtatcggagaggttcgaaatgactgaaatttcggaaatttcagtccgaaatttccaaccctgcccctgacagaaagtgaaccgggaccaaaaattataaagtcccattgcgattttaaaccggcagtaaaaatgatctttagtcccgtttcctattcgaaccaggactaatatcatttttgcatggcccacaaaagatgagttctccagtagtaaattcaaattaggtgtagtgtcaactgtatagttttttactgatgtggcaacatatatccatgttgttcttgcagtacagctcttactttcaatccggcaaagaaattgtcaggctgaattacttacaagctttagtacttgtgggattgttttcttgtaagaagatagatccagtgtacattggatatcactaaattaggtcatatcatttgtttagatatagggaattacaggatatccattatgtcaaatattgacccgaagttaattatttaaacaagaatatggattaatttatacaagtaactctatctgtaaatagttgaagacattgcaggaagcagcacgaacttttgtaaaaatatgcatcatgcataaacatctcgcaaaaaggggcatattacacttctgcaatgtgtaaccatgggtaagaagaaaccattcaacatattttcttcacttgtccttttgcaaaacagtattcggatttcatttgttcaacaagaaatcaaaatgtcatggtgcaaccggcaattgaagatatcaagatcaagatacatatgactttttatatggaagaaattattgctatggcttggagcatttggataaaaagaaacaacaaaattttcaggggcataggtcctcacaacacaagagtttgcaatggttatccatagggcaaaacatagttattaccctctcattttttttaagggagccccacatcttacaatggttagaaagtttgtaacataaaacctataaatttcgtagctctgtttataaatatataacaatatatatgttatatgaatctttcatacagtttttaccaaaaaaaaacatggccatattataggtagagttgtagtgtatatatcatatatactaaatcaatagcacgactcctttatcttaatatatatatcctttttcgagcgtataaaaaacatttactaagattgctttatctactgaaattatttagttctgtttcaattatgctcttcttaaaaaaaattccaggcaatgaagacttgtgagtgtgggtgtgctaggaaaaagcgctagaaattatgcaagtcaaagtttttttctagaagtacaatgcagatgtataaacttagtacaagtcacaaaaaacacatgcatacatataacttatgtcctttataaatgtcatatctgcgtcaccagcacaactaatagtttagcttcgatttatattattgaactgattattgtcgcaggctatcaacttcattaagtatgattaaatattttaacgattgaacttaacaaatagctcaaactaaaccatgtaagcaatttagtaaaacaacgattttcttactgaatgtattttctttaaagaaagagccaaatttaagaatctatttcaaaaaatccttgtcctgtgcatgtcatagtgtgatggacgacaaataaatagaacagatcctgaaaaacaacaagatcagtgagtccagtgcttagaaactcaataaaaaataccacctcccattctcgccttggtctgacatgagtcactcactgggtcatccacccagcagcggtgctagtgcaaactgcagcatttgtgtacagcgagaatgggatgcatcaggaagcagagagctgcgccgtccaatgccacatgccgacctgtgtctaggttctttaccagagcagacgattcggaacatggtgacatgtactctatattgctcctccacctagctgcaagcctgcaacaagtgtgagaagcttccatgtacgagtagacagctagaggagcatagggtttagagcattcacctgctagaaggatggctgcaatcaaccactttgcatcctgcacccatgagacagagtttcagaactgtgttcatcctcatcgtgtggatggcacggaaggggcggaattcgtgagtcttctctgtttttcgcctgtgacaggatgccaatcatctacgtctcaagaacttttattctccgagagacgcgagaaattaagttgaagttgaaaactttcttttccacatttaaacctattgtctggggagtaaaatgcacgagtcatcaaaagatcctcaaatcttgagtgttgccaaaaaaaaaagaaaagaaaatttccaattaaatgtacaaataatgtgcatacagtactgggaaaatatttttacatgcggtcaataatccagtaatacaaatatttcatgaactaggaaggtggcccgcacgatgggcaagcatttatattgttgaaagatgagattatatttttttagaaattgtcttataggtaacaaacttatgatcgaacaatatcctttggaaattgatttgggggttctattttcttaacgtatctcaaaaagcattcattgactcttcaatagaagatgtatcaagtaaatattatactaccgctagcttaattatcaagcatatcacttgtatacataccattcaaatatggctataagcgaaaattgcgagattaaggaactcaaaatgaatgatcttatgaaggcatatgacaaataaattaaggataaattaaaagttggattacaagttctcaatagctatgaagaactttaaaaggttttggtgcatacagattacctacaccatcgctttgcttggtattgcaaaatatcaacattgtttgaagctaatttctttagttttggcaagtttggttattttcctgaaataatatttgtctaaaataataccatagttgtataaatttaattagtatggtagtttacttataaatttcgaattgttttgtagtaaagtttttctatcatgtagtctggttatatcaataatatagttttgttcaataaattgaatattatttacaacaccagaattaataaaaatttatgaaaccatccatgactacttaattttttttggttttcttatttgtttattttaaattcaaataatcacatattctccttctaactggtatgtttgtcattattcataataaaaaaaattccttgtacaactgacacattgatgttttcactcaatcacatataaatgtaaaatattttttcattattcttggaccgctcattcctcggtggtatcctccactcatctatcatcttgtcatagtcgcatacaccatattttgtctaattttttagtttacatatggggcgacaccacgttcctccaccctcatgcatggaacacagtgtccaaaatgttttttttcgaaagcaagttcttaattaacccgtgtaatttattagaaaattacatgtgtaatatatgtgtatgtgatacatggtaattccaaagcagtgcttgattcttcttctttctacattgcatcttcgtgatttattttcatgttattaaaaaaaataatcgttgtccattgatgatttgataagtcctcactttagcaaggcagtagcgctacaacatcatgatcaccttagctaccttaggtatacgatgcttcatcatgcgtgtagaaggtaaagatgtcacatgtgttgtatagagagacaaagaggacttccaaggctttgtttattttaacaaaagatagatctcatggtctaaataatatatccaccggtttaactaaaaatcaacaaacaaatatttttattaggaaatagtctaagataatatcatataatggtgtaaactatatttttaaatattgtagatctagtttatttacatctgttaagacttatatgctgatattcaatgtttataaagcagctattatttatagtgtctcaaactaaatacatggaaaaatcgaaagcaaaaaagaggaaggttacataccacctgagtggaaggaagggtggaaccgtagtttaatctaacggctcataatattggaccgatcaatttaagtggaaattaaggatatatgtcttgcttttttctcaaattttataggatttggcaacttgagagtgttttgaggaagtttaatcgacatacgtcgtatgatttgtttgagacacttatataacgataatattaagtgaagaacatctaccacgttttctccctaaattgttttcgtcggctttgcttttataattttgtaacctaatagttacctttatactatatcgtatatcgtagttaagtaatacatagaagcaattatttataatgttattcatcgactgtaaagaatggtaggcttattttcctcaaaaaaatatgtctactaaaataagtgttaaagtaaaattaagacttttttaattggatataggttattgttttctattaactagccgccaaccacgtcgactcgcgtattgcacatgtaggtggccggtgcgggagtttcgcaacattcatttgctcgttcccgacgacatgaggcggctagctgttgtacgatgctgattgcacggtgaatgtggtcatggatataacactcaatcgaccacctctgcctccagggaggacagatcctgcaacctccaggcagaagtctcggttcgttctcagaagtctatggtaacagccattgaaaataatcaactttagaaacaaaatactttcccgtttcagaaatttgaaaactcaagttccaccatatttgaaaaacgtgtaccaatctaatgatatcacaagcataacactaaccacgtatatcgttagttcaaactgaatgttaatactaaactcaaatgttaaatctcctaaaaacaagggagccctatattttttgggcggacaaggtagtatttattgctcaaatcaataatatctgaaggtaccaaattcaagacaaggaaaatcgtcgactcggtattaagattacatacatgtgcagcggcgagcggagggcgcctgacggtgcgtgtagttacacacggatgggtcgggcagatgggtggctaggagctctccaggccagggggagctccgggagaatgagggaataccaagtcgacgacccctcattctcgcgactgagtccgggaggatgaggggtcgtcaacttggtatttatttccctgtacgtaaaaaacttggtattaagattaagatgaagatgaagatcaagttgtttcatagttcgtttctcctgaagatgaaaatcaagttttttttacacaaaacgtggtggtatcaatatatgattgattgagttttaattattacgaacttgaaaaatatattaacataatattatagagcaactttcatatagaaacttttcgcacgaaacacaccgtttagcagtttgaaaagcgtgccacgaaaatctttatcttcgtccaactcttgttggagaaatgaacatgacctgattatgcgcataaaccttcagtgatggaagataaaacgatttggttataaaattagacgagtcgtatcatcaatcattaactcccctacccgttgcgattttctcctttttttgaattttttttcggctcctcggggaggtttagcgtgatttgcaattttgcaacaagctcttcgcatttgcacgaaatattacaaatgttcttaaatgaccgataccccgttgtcacttatccggaaaacaccttgtctttcattgaaatacaatggtaagaagagaaaattgcacttgtagggtagcgctgtaaaaaaaacaaaggcgtatttctgataaatgtcctaatctaacccaaaccctaccccattccctccccatctccatcacctcagcgccgccgccggcctgcccccgcccgggcagccccccctcccgtccgccgtccaccgtccaccgtccccctatcgccgcccaccgttcccccattgctgctgccgccgccttcttccctctgccaccccccgggcgccgccgtcctcgccggcgaattcgaccacctggtggaaggggagggtcgcgagccattccctcaccctcccggagctccccctggagcgctcgtatccacccatccgcatgtacctacacgcgccatcgggcgccctccgctcgccggtgcacatggccccgtccccgcccaccgcgcgtgcgccgccgctagagccatctctgcctctggcccaaggaggtgctgttgctcgacacggtctagagcggggccgacaggaacaggctcgctgcggatgagtctatggaggggagaccatgtcagaggggaagctgcactagtggagaaaccatctttgcccggtcgaccaaaaaccagaataggtcccggttgcagtaaaaaccgggactaaagatggtttttactcccggtttatatgcagaacgggactacgtgaccaaccgggactaaatatcatctttagtctcagttcacatgctgtcaggtgttaggcccctccaggatctttagtcccagttggagatacgaaccgggagtaaagatcggatctttaatctcggttcgtaacaccaaccgggactaaagatcacatctttagtcccggttggtgttactaaccgggattaaagatcaaaacacactatataatccctattacttatcatattttcccatccacacaaactcctctctctctctctccatctctaatccttatctcatcccttcttcccttcctccttatctcttttctttcttatcccttcccgtgtgcacagcaggagtgggtgggcgggccggccggcggagggcggcgcggcggcggcgggggaggaggggaggcggcagccggcttagccggccggcggctttgcttccttttttttctttttttttgaagaatttgtgatccatgtatagattgagatgaagaatttgtgattcattgcatggattgagatgtataatttcttttttagaatctcattgcatggatctgagatgtacatgatttgtgtatttgggatatttctttgatttgggttttgatttgggatgtataatttgtggtgtatatgattgatttgtgtatttgggatgttactttgatttcgggtttgatttgggaatatgcatcccacctaacttgggagaaaataaattagagattaagtagtaagtagcaataaatgaaaaaaaaaaactaaccgtgactgcccgctcccatctttagtcccgggtatttgaaccgggactaaagatagagatctttagtcccagattcgtagtcccagtttaaaaaccgggactataggggttatgaactgggacttaaaacgatttcaccaccagtgctggagaccagccaaggcggtggacggtctggtcgaactccaccccgcctgagagagcggtggacggtctggtcgccaaggtggtggtggagtgcgagatgtgtgggaaggcggtgagcatggtggtgacggccggagggcacaaggctggtggagtgtgacgcgcgttgtggcggagctcgccgctgacccagccaaggcggcggcagggagtcgggagggtcgccggtcgggcagagctggacgcactgtacatgaccacgtcactacgacgacgtcctaggacgttacacgtcggtgtgcagggtgagagcaagcctccacggcttcgacttgatccagggctccacatgccgctgaagctcaccgattgtcgcaccagatgtagtggatggaggaggtggcccagagcagcccatggaagcggcacaagcacagaagagcaggggccgatttgggttcatcgccgaggccttgggggtcatgctcaatgtaagtgttgttttctccgaacctatgacaagccacttaatattcaggattgctaaacttttgattaatggatccattgatctgcaaaagatgtttggcaaatggagtgggtgtggaagaactagattgattaggaagcattatcacctcccgtgggaggccgcatgaatatattgattgagccggcaaaacgcggcgagagttacagggagtttgttacataggataagcaacacaaaagataagaagataaccaatctaatcctgaaacttatctctactctaacagcccccctcaatcatgactttgacaagttaagattgtgctgaaattcatgaagtttctgaaaactgagcgatttggtgaagccatcagctacttggtcattagtagaaacaaatctaacctcaagaagcttctgcacaacccgttctctcacaaaatggaaatcaacttcaatgtgctttgtccttgcatgaaatattgggttagcagacaaataagttgcactcaaattatcacaccacaatcttgccatagacgggcattgtataccaagttcctttaacaaagttttcacctagattacttctgctgttgcattggccaaagccttgtattctgcttctgtactagatctagatgcagtagcttgtttgcgtgcactctaggatataagattacttcctagaaatacagcaaacccactagtagatcttctatcatcaacacatcctgcccaatcggcatctgagaatgcacttacaagcatagactgagatttctgtatcttgagtcccataccaagaatatttctcaaatatctgataattgtttaaacagcagaccaatgtgtcaaagtaggagagtgcaagaattggcataccttattaactgaaaaggcaatatcaggtcgagtcaatgtcaggtactagagagctccaacaatactcctgtaattagttgcatctccaggacctaaaagactcccttcctgtacagataatttttctgatgttgacaaaggggttggcgcaggcttacaggtcgacatacccattctcttcaatatatcatgtgtatatttatcttgagacagaactaaaccatcacttatcttctttacttctatcccaaggaagtaattaagatcacccagatctttcaaggcaaaatccatcttaagatcatgaagcaaagagctaacaacatcttgtgacgaacttgcaacaattatatcatcaacatataccaagacaaagatagtcacactaccttttctatagaaaaataataagatatcagcctttgaaggactgaatcctaattgttgcagcttcatgcttaatctagaataccaggctctaggggcttgtttcaaaccatatagggccttgtcaagtttgcaaacatagtgtggcttagatttctcttcatacctaggtggttgtctcatataaacatcctcctcaagaatgccatgtaaaaacgcattcttcacatctagttggcgcaaactccatcctctagacattgctattgaaaaactgttctaatagtggtttcctttaccacaggactaaaagtgtcttcataatctctgccataacattgtttaaaacccttagcaactagccttgctttatatctatctattgtgccatcttcttttcttttaaccttgtacacccacttgcaatcaatgagattactaccatcctcaggtggaactagatgccaggttttattttgtttaggagcatcaaactcactatccatggctaccttccaatccttatgttttaaagcctcttctagactttcaggttctccagtagatgtaaaacaaccatacctgacacagccattagtataaacattgggcttgcgcacaccactttgtagcctagtgtgtggtcgagggatgtttgccgctgtatcctccgccacagaggatcctgaaaccagctcttcctcatcagtgcgcgtaccagatggcgagctcacaatggtcgacgcggcatgcggtgagggaggtggcgatggaggattgggcgacgctggtgcaaaggacggcgaggcgagagaatttccccctgcgctccacacgtcagttgctggatcatcggtcgcggcagacgatgattctgacgtcgattcagcgcctgtagcggagtcaatagcagccgaatcggtctggtgctccgcggcatctgttgctgctgatatttcatgtgaaatctgcaccgaatcatcagcaaaactcgcagaattttctgcattagacatattttcaggcacagtattttgattagcattattaggcacatggtcacccccagaaaaaggaagaaaaagaccgggagtaagatcaatttctttgcgaagaagtgcaccagcattaggatggagctttgcaaaggggaacacattctcataaaaaataacatcccgagaaatgtagatgcgaccggtggatacatgtaaacatttaaatcctttgtagagacggctatagccaagaaacacgcattgcgtggatcggaagacaagtttctttgaattgtagggtctcaaattaggccaacatgcacacccaaatgtgcgaagggaagcatattctggtttttgatgaaagagacgctctaggggcgtatcaaaattaatcgtcttggccggagtacgattaataagataggtcgcggtgcaaaaggcctcatcccaaaactttagtggcatagacgcatgagcaagcaaggctaaacctacttcaacaatgtgtctatgtttgcgctccgcagcaccattttgttgatgtgcgtgagggcaagagaccctgtgagagattcctattttagtaaaaaaggaatttagtttttcatattcaccaccccaatccgtttgcatagcaattatttttcgatctaaaagcctctcaacaaaactcagaaattcttgaaatttttggagtacctcagacttgtacttaaggaaatatatccaagtaaatttgctaaaatcatcaataaaactcacataatagttctttctgccaactgaatcagtggcaggaccccagacatctgagtacacaagttctaaaggaacagaggaaatactgctagacttaggatagggtaattggtgacttttggcttgttgacaagcatcacacacagtttctttgttggactcactagaacacaaaatattatgcttcttaatgacatgttgaagaacaaaagaggacggatgccctagacgactatgccactttgacgttgagggtttgatggcgccatatgcttgcttccctgtatccacggatctgggaggaaagggataaaggccattcctacactttccttgaagaagaggtctcctcgttgttttgtccttaaccaaaaagaatttatcatgaagttccttttggcttgaggaacataaaggacatcattaagattaagtgcccgaattgaagtaggaatctgggtgtgaccaatgtgactaatatgcatacctgagccacttgttgtatagatttgttcgccaccattgtacctctcacgcacggagagcttgtctagctcgccggtgatgtggtctgtcgccgccatatctgcataccagttggtatcggtgttgttgccatggattgctgcagctgcacttttctccggaacaaagtcctcgttgtaacggtaccagcagttgccccccatgtgaccaactttgccgcaaagctggcaagttggacgatttcctcacccgccaccattgctaggtggtctgccgccacgccacggtttccgccaccgcgaccgcgaccgtcgctgccgcgcccttgttggttgcctcctcgtccccgcgaagccacgttcatggagtgttaggccgcccgacgactcaggcgctcctcaaagctgaggagttgagtgtatgcgtcggcgatcgtcactgcttcagtgcgcccagtgatcaccgagaccaccgggtcgtattcttcatcaaggcctgccaagatgtatgcgacaatctcctcgtcgtccattggctttccagccgctgccatctcatcactaaaagacttcatcctgttaatataatatgtaattttcagattacctttcctggttgtggtcatcgccacacgagtattgaaggattgtgcccgcgtctgggagcacagcatgttctccagagtcctccagagctcggctgcagtttctattgacaccacctgtgtcaggatctccctcgtgagggaggaaaggaggtagctcaagacttgttgatctgcaaccacccacttggtgtactctagattggtggctttcaccaccttctcgccttctttgacgtcgatgagacgggccggcggcgctgtggtgccgtccaggtagcccatcatctgtgcgtcgcgaacggccggaagaacttgtgtcttccaaagcaggaagttgtttcttcctagcttttcttccaccggttggccgaatggagaaggggacgccgttgccatgacggaggagctcgccattatcaatctagatgagtttgaggagtaggctctgataccatgtggaagaactagattgattaggaagcgttatcacctcccgtgggaggccgcacgaatatattgattgagccggcaaaacgcggcgagagttacagggagtttgttaaataggataagcaacacaaaagataagaagataaccaatctaatcctgaaacttatctctactctaacagtggggaatcagaattcgaagtcatgggggttcctggatagtgcagaactgcacgtgcatgcccttaattaagacgccttcattttctgaaatttactgaaacaccaagcagtcggcaacccagctctgaattagagtcacgaaagtttctctgtttttcttccagattttcctaaagcaacttgccaacttctaatattggttgcacatgttgcttgaataaggtttagatgatgaagagatttctttgctcaagttggatggggatctcttttagagatctttgatttctacagttttaatacttcctccgtttcatattataagactttctagcattacccacattcatatagatgttaatgattttgtgtctagattcattaacatctatatgaatatgggtaatactagaaagtcttataatatgaaacagatgaagtagcattttttcatcattacagatgtattgggttctagaattagcagtgatgcattacaggcagagtttaccctctatatttgtttgaaccgatgcgttttctgtaaaacttattatattgggccttaggtgaggatcatcgttttaactactatgcatataaccccaactacatgtttttgacatccttaatgatgggaataatagagcccttgtactgattttataagctgtagtgattgtttcaaactgcagatttaactacggactcactattctttgcatattatgatcggtaatagagtacgctcacttttacccaactaaattgaagtaatatttatgtttcttccatctgctggtggtgttcatattattgttgttccagtcgattgtgtcaatgaataatatggtgacttttaatcatcgcatgattcaaaacctgaatttatctcacgtgttaataaaatggagaagggaactattcttcttcacttcctggttctcgctgtgtgatctactgaatcttcttctcgcattttagtttgcatcaagttcctttcgacaagattctatgccgcgcggcaaataatatatgcacctgttttttgctgagattgttttcttctcttctctagcacttactgtcacctttttcttcagatatttacatgggaacaaacttactgtaggaacatgagtaaatttaaaattatgttattcgcacttgtgggcaaaacgaaccgcaaacgtgttctgtatttctgttaatttattatacaacctttttctgtactgtacacccccatatactttcattgtatgcttcttactaactctatgcacatgttagcgtgcgcggcgttacgccgcccttatatttctagtactactagtgttttactaaggctgattctgaaggaaaccagagagcaagtccacaacagatggctaagggtcatccatatatatcactttccattagtttggtaaggctgtgcccttttcctctgtttggagagaaagttcattagtttggagagaggtttttaacgcacgccaaacgagaaagctcaatagtcccacacgtcattcgcacgtcacttagtttagtgcaaactgcagaggagatgagcttgtatcttcattctgtgaaatgagagtgagatgcatcagggagcaaatcaaaggattgctgatgctatggtgtaggccagtgtgatcctaggtagaaccagggaactacagagggcgaagatgaccaatgggttggacaattttatttttatgcgcataagaattcgagcagaattgtctacgagaagatcactttgtcaatcaagcaaagaccaccagaatattccatgaataatgataatccctcaatcctgaagtagtaggcatgtcggtcttcttttgcttggctcagttatatctgttcgtttccaatgaagggctgtttctttgagccacagttatcactgcatgattcatctaatacatgaaatttcgccacttgacatgaattcagttcctgcatgcccattcattcaaacaacccaattgcattcactatgaatgcaatggatcatcttctaaagcacaagatcctcttcagcgatgcgtctcatcagtaccatttcccactcccgtcgtctaggcctcacattctgtcatttatttggcataatgctagtataaacatgcaaaagagaggaactgataggtggaaccgtggaagtgaaacacaacacactgtaatcaagtgttgcttattcttgactcgcacatcgccacgtaaattgcttcgcacaactagtaaagtagtgcagaataaatagctcaagcaaacaccccatgcctcctccctatatacacacttggcccacaattgaatcagaaggagggcttcctgtgaatcagcgatacaaaatagcacatgcaaaggttattcatcactcaaacaaataccctaaactttccattggaagcggctggaaaaagaacgcgtaccataagaatgagaggcactgggaaaagaagaagcagctccaggaaatcgtaaagttaccgagagcattagtgctgtagtgttcagttcaatttcatcgcgatgccgagtgccgacatatttctccactcggattagtgctcagcttaaaacaatagaaggacgactggatgaaattgtttttggtttcctaaattgaaaataggaagtgaaaaaactcctccctccaacaaatagcctaaattcaatccccaaaacttaaaagtggacccttctgttaaactaccaacagaaaattctgtttttttatttcacgcgcagaaagatcgctatctcccacgtgcgggaatgggaggagagaggcgggagtgcgagattgggagcgaatttcacacctacatataaacggagcgaggaatcgggagaaggtaactccaaaaatcgggtaggagagttggggatctgtcggagctgttttttggactaaaatccctcaaaatcagttttgagaattagataggtagactgttggtgatgctcttaggacgctactgcttatgtggtgtggggtcccaaggccgcttctctgatggattcgagctgtcttgatacctataagctcaaattgtacggtgccatgtttagtagattggtgccgtaagtaggtaataattttcttcaattcatcaagaatcactagattacgttgtatgtgtgtagttcgtatatcgaggatatctctctgttaatgtgatttaaacacgagagtgtttctttgcaaacaaacgtatgaaatcagagtgcaatccgcaaattataaggttcaacaaaaagatccaatgaagacatgtactccctccgtttcacaatataagtcattctagcattttctacattcatattgatgtgaataaatctagacatatatatttatctagattcattcacatcgatatgaatgtgggaaatgctaaaatgacttacattgtgaaacggagggactagttaatttgggttcatcatgtttccaagaattttgtgataaatataaataaaaataattttctgaaaaaaacaatcaataatgatttctgtacatgaaacctatcgatctatgaggataaataagggtgcgttcaaccgaccaacgtccttgagctttttagctgcacagaaaatgaggtaagtatttaagatgtgataaataaagttttaattattagaaatttgaaaaaataattatttgattttatttaaaaaactgttatatcaaaagttcttttaaaaacatatcatttagcggattggtgagcatgctaataaaacaggtaacttgcgattgcaaaaggagaagaagagcagggcagagatttaaatcctcttgatatctccaaatataactctatacatgcacaaaatggcttggttatgcccattaatgatctcttacaacttttaagttataaaaataagattatttttacagcccagagataacaccataaaaatgtgtttttttaagtagcctcaaaaagaatatgagtcatctattcacacgacactacgggacagatagttactattggaaagaaattgtattgcagatagctattattggaaataaattgtattgcataagaatacatttcaaggaaaagagtgaatgccaaaatctcgcgacgagacaaacgaggcttggcggcacaaagataatttggttttcctccatcgacacaaatcacaccacgtgggcaccctatctccacgctcgcacaataacaaatctactgacagggaagacagagattgtcagttgtcactggcctcctgttcctctcttttaggaagaattgcagcgagcacaaatttagggtttcatccaattgaaagtaacataatcaaataatggtcaaatagttccaggaaaaatcacaaaagctagaaatggcaaacactcagttccctgttgaagtctgtagtctcctgtggtgaaaacctatagtataggatttgctgaccggatcatggcagcggcaactacctacacacggcattccctttttagaggcctttattacagtccaaacattactatgtttgagtataatgataaagattgtttgtggttataactcgctacggcttgatatctttttgtcacatcattcttccttgttttataattatagattgtgtacgttctaactatgtagagcctatatttggtcctagattaattatatcatcgatatcttgatgttgttttctgagattaataaaaaaattcatttataaatacaatggattttcttcaaatgcaaaatacatactatagagtgttgcccggcctacttaatatcaagtctccatccaccgacctctacgtcctgtaataataaaccattgaaagtatgatagatatggttttccattactttatagccttcgcattgtcatccatcaagccttatatatagccagtgtaatctatggatagaggggaactggttggcattgtacaacgagactagaatgtaccacaagtttgtgactcattccacttagcttgataaactgcttcaataatatgtcttggattctagagaactctaaccgacttgattattccaccagctcgaggacttttgaaaagccacaataaacagttagcacattgaggtcagttcattgaaattaattagaagtcaaatatcctaggaatgagaagctcctggaaaagaaatggttactcaagagtgacgagaagtcaccacgaatactagtgctagtgtctttagttcaacttcatctatgtcacaacatgttagtcagcttccaattcatgtcactatagcttggcattctccaatacctacctggaggaactttgttgtactagagtgcagtattagatcatattgtcctctgaaacgatttcgtacacagaaccatacttcatatatatgtgaagccgtacacaaccgtgggatggattttgatctgcatatatttttcaagtcaagataatccatatttcccttcaacaagagaaggcaaatgttatgtgtagtatggaattgtactcataggcgtcctaatgattacaacgatatcaatttgttaaccatatcggttattacttacagaacctgtgtcgatatggtgcaaacctgtttcgaagggtacaatttgacatggattacacaatgtcacataaacatgtgcatacatgtcctccacatagggttgaaagttgtcagaggcaaaaaggcttcttttagataagtaacatgagaattacatctccagcctctaatgcacataaccaaaagttctaataatttaaaaacatgacacatagccataaaaaggacatgtgtgtactcctaatattgaagctttcgtacccaagaaaacaaggaatacgcaattaaatctccccaaatcactagacggagaaatataaatggcatgtgacacccataactttccatcttacaatcatatccatgcaaagctgtcctcaatgtcgtcacatatattcatagcggactctcacctttctcttatgtctgcatggtatcctacttgcaaggcccgtttagttatacaaactgacacgaatgattgagagcctaaaaatgcctctacaagacaaaattagcaaatacatctagtagatgtcaagagtgcctaaaaaatttctttaacgcagaactattgtagacgattttaaaattgcctctataacttgttaataggttacggaactctatatttcaatatagagatgattcgaaaattgtctctactaatgtatcgctatcgaatatttttgtcgtagtacaacttctcataaattcttggcgtattcatccatcagttagaatgatccatccgctttcattttagatgcacgatattttctgaaaaatatgcaaaacagagtccagtaggctgctcaagaaattgatgcacaccaaggtatttcaattttcaactcacaaataactccatcaacgataggaagctccctttcagcaacaataaaccatgcctcatgtcattcgcattgggccagaaggcagaggtccgtaggcagcccatattatcaattaagttagagataagattattagttaagttagagataaaattagattgaattcttacttaagggtcaagctataccatctatcaattagtctaatctctccctcccagtaatgttcttctctctagcataaatctacatcccttctccaggagccgatgccgcccggctatcttcccggtggtgtttatcctgtcatggtctcgggtcatgacaacttggtatcaaaggcactcaccatagcttccgatgccgaacaagttctccatgtcactatgagcaatctgctctatccagtgacagaggatctactccatcgaggatttacatgtatgagatggaaacacgtgtgaaagcttcggttcaattccaatctcatgaggatgcggagtatggacaaaaaaccttccacggacgcaacttctacaatggctgctatcggatggatatacatcttgagttttcatcgccggctgcaatcagcagcaactccacactgacaacacctttctccctgataatcgaagagttaaggactgacctgaaagaattggcggccacgttacaggaaaagttggtgaatgaggaggagaggcgcaccagggaggcggggctgcccttccggtgaagacagcaaggacaccgctgcttgtgtcactgttgcctcagttttctccattaaaagccagttcctcgcaggaagaggaggcatcaccaacgataaatgccaccatcaagaggcgtcaactattgacctgatgttgcattgctagagtgaaactgcaagagtggaagactgacgttgtaaaatgagatccggaatacatctcacaagttagcactgattattcttgcctcaaac

SEQ ID NO: 73023 - DNA, 3980 bp, Oryza sativa
aaataccacatcatcttagcaggaattctcttctttgttagctgcccgtcaacttctcctggatcgtctcgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttcccccgagaagaatgttcttgacgagtttcaataaatcgccaaatgccttgtcactaaccccattttttgccttccattgcaagaactccagagtggtatccaatttttgtgcccctgctcgcaacctgggtacaacgaagttctgtggtcctccaacatcttgtccaatttatgggcctccttttcactttcgcagtcctccatagcgtcctgcaacatctgaccaagatcatccgcaacgtcgttaccatcagcagctatttcctcctcacccgtttgattttcttcaaatccaacatactgagcaaagtccggaatattgtcgtcttccacttcatcttcttccatttcaacaccttgctctccgtgggatgtccaacaattatagcttggtatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaagattaactttcactagagttttccttctcaactattttataataccttgtttagcaaatgaactaaatttctatatattctttcttccccacacacattttctctctcatcaacttacaacttataaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatataaataggggtgggactttagtcccggttggtagcgccaaccggagctaaagatcaccaggatctttagccccggttggtaataccagccggggctaaagttacgatctttagtcccggttggtaactaaagatcccgggggggcctgacatgccctgacagcattcgaaccgggactaaagatgatctttaatcccggttggtaccaaccgggactaaagatcaaatatgcccgttacccttttgaaccgggactaaagatcatctttagtcccggtttttattgcatccgggactattgcggaaatcggccgaccgacgaaagatggtttctccaccagtgacagattcatctctagaattggactttttttgtgtgtccagatttatctgtagaattagacttttttttttacggagggagtactccggtaagcacaaggccgaatttttctcatttttaattttaatttttttaatatttatagaaatattataccatccaaaatatttacacaaatggcccctgtcgtccaagtagagggcgtcaaggtgtacgcattttgcacttaggtcccttgccgtcctctacaagggctgcaagggggtaaatgcaatttttgtcctgccaaaaaatgcattttttctttttttttttcaacttgtccgtccctcacgtcacttctgtaaatgtttatatttacgccggtacaatatttctataaatattaaaaaataaaaatttaaaatgaaaaaataccgcacagggcccatccacaaactcagatgggccggcccgtcaaccatccgcgtggcccacttaattgagagagagagagagagagagagagagagagatcgtcttcaatcgcgtggcaccttaacaccggcacgcgcctcctcctcccctcccctccactccgcgagccgccaccttctccgccgccgacgacgacgacgacgccgcatccccaaccctagccgccgctcggcggtgctgcgacgtaggagcgggtctcctctctgcatgatccgttagggctaccgagccgatcgaccggcgggcctaaaaccctaccgagagaggctgcgggttgggtgggggtgggggcgtgctcgactctccggcggcgccatgaagctgacggtgaagaccctcaagggcacccagttcgagatccgggtgcagcccaacgacaccgtgagaaattttcccccctacgcccatttcgattttcttttccccgtctcgtgtgtagctttcgttagtggggagatggagaatttttgctagggtttccaccaatgtagatgcgaggtagccattgagtcctgctccgctagggtttcgtttcagcaagtatggctcacctcgttggagggctcgttgtttgctgttatttagttatttattattatatggtaatgtagtggatatgcctggatgatgatagtccctcggagctgtgttcgtgaggatggatggattaagctgcaggcttggagctatcgtctgctttggactcatagttttacagtgtgttcatgatgattcaggcgcagcaatgttagcaagtggttactgtccgaaaggagctatcgtctcctttgaaatattgaatgcatagcattgtactggctgattactggataaaagtaaaacttgtcaggtttcactgggggatgataattccatccaaaaccagtatttgaaaccctgggtgcaacaggggtttagatatttatttcttgtctgctacgtcttctataattatagcaaaaatggctctgctacatatataaccgttccaggatttttctgtttgtacactatggaacagattatggctgtcaagaagatcattgaagagatacaaggaaaggatagctacccatggggccaacagttgctgattcacaatggcaaggttttgaaagatgaaagtacattggaagagaacaaagtcagtgaagttgggtttttagttgtcatgcttagtaaggtaggccgcgtatgtgctgtatataatttaaatggtgatgttatttattacgcttcatttaattcttttctgactggatgctgggtgtaacggtgcagcaaacttagttgttaaggaaaacacgatgacgttccatatactccctccatcccataaaaaacaaacctagtacaagatgtgacacatccttcatattcatactactaggatgtgtcacatcccatagtaggtttgtttttatgggacggagggagttaatagcataaacagttaaacaataacttgcgagacgtaatcattttgtggatattcataaacgatgaatatgcctggctctggcctcatttaatgcatgttggttttctgataatctgacatgggcgaataaggaacatgattaatagtcctttccacgtagcagctatactatgggtagtttcttctatgccacagtaccaaacttaattgacacctgaatcgttcttatgcttctttctatgattaattttcatgacctgtcaacagtcgcttctctatctactggctttacagtgaccattatctataatcacattatccgacatttcctctcatgcttgtactcttctt

SEQ ID NO: 73024 - DNA, 5268 bp, Oryza sativa
  unsure (1)..(5268): unsure at all n locations
agacagtgcacttcgnnctcgaacagaggcagcaacattaatgaagcaagtggttaatcatgcattttcttacccgcataaacactcgtttaattgttcattttctttatggcagcacaaattaaatcttaaaaaaatatagatttgggaaaggcggaaaaaaaaacccacttccctgtcctatttgcatccttaattaagaggacagctataccttctatcaaagtcaatagatagtgtttggttgtttgctactctctccgttttatagtgtaagtcattcagcattgtccacatttatatagttgttaatgaatctatatatatacatatgtctaaattcattaatatctaaatgaatatggataaggctagaatgccttatattatgaaacggagggagtactatagatgatgacttgcaagtctcttaagtttcgaaagaaataatcacgcaattctgtgtttgactgtttgctactccctccatttcacaatgtaagtcattctagcattttccacatttatattgatgttaatgaatctagacatatatatctatctaaatttattaacattaatataaatatgggaaatgctacaatgacttatattgtgaaacggaggaagtactatagatgacgactagcaagtctcttaagtttcgaaagaaataatagcgcaattccgcgtttcaaaaaataggacacatgcatttgtacagtttttttccttaattcctaaggctatgtctttgtacagtttttcctcttacttaatgcaagtacaccttgccggatttaaaaaaaactccgcgtttcaacaacttgatatattgactcatgcaagcacacgtctttgatcatattgtacgactgcagtttataattaaaaattcaccatgaaactgacaactttaccccttttttagctttttcctggaataaaacagagaaccactttaaaatcattaggtacttatatcctatccataatctatcactggtggagaaaccctttgtagtcccggttcgtaaccccctttagtcccggtttccaaaccgggagtaccaatccgggactaaagatcgctatctttagtcccgggtgaaataaccgggagtaaagatcgatctttagtcccggttggtagatggctcagccacgtggccggttgagccatctttagtcccggttggtgttaccaaccgggactaaagatagagctgaccttttttttttgcatgcccctcttgctgcatggtttatatatatatatatatataacccatgcatatatatgtttcaatacatatatatgcatacatatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccaccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacatgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaaacacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggatgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttctttgttgcccttatgtgggcaagcggtggagctgggggggcccttgactttgaaggtgccggaagaggagcttgcgggggagtaggtgtaggagcacgaggaggagtcggtgcaggatcctgaggagtagatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcatctcaccgtctcctccagggtaatccagctcgaggtcctcgtacgcgccctcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttcaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcccagtgatcccttagctttgggaatgtgtcgaagttcggtgtctgccccttcagtatataccttctggtacagatctcccttgaagctctgaaactgttctgccattttcttcagagtccaccttttcactttgtcctctgtacccccaggaagggtgaatgtctcgagcattgtggtccacagcatctctttctccgaatttgggacaaagctctcatgatctccgcgtgcccttaatatttgccagtacaccgtactgacaggcacattatcccgcacaacccaaccgctgtgacgtacatagttcttggcggcttaggacggggcactagacgtccatatttttacctttccgtattgatgggcgaccctcaagcttggatgcctggcaggtcgactcttagagaatcccggggccccgagctgaaattcgcctctagcgagagcgtatatacaaattttataaacatgtggcccccccgtcagtattttttattatccaaaaaaaccgctctcgtcttatggtaaaaacactttgtgtgggggtggggggtaaaaaataaaaaaaaaatctccccctcccgcccctggggaaccaattaatggctgtgggaaattcctcttttacagctggtgtaataacaaaaaaggcccccaccataccgccctgtgatccctgaccccaaatttccccccctatagggggggttttaaaaaaa

SEQ ID NO: 73025 - DNA, 1456 bp, Oryza sativa
  unsure (1)..(1456): unsure at all n locations
cttgaatgtattataagatttggggtgaatttgtatngtgtgcatgnattagggtggttgatgccatactgcagccgcgcgctaatgatttaaatttttgttaagttgatttttgtgatgctcatgcttgggtgaatggaccgttgacgaagncgaaggcgaaggcgaacgaagcgttcgctccgtccgtcgtttttttttaaacttggttagtattttctctggcggctggtatagtgtaaccgccagcgaaaaaacattttcgctgccggccatcttaaaccagccgccagtgaaaatggatctttgctggcggctggcttaagacaaccaccaacgaaaatgttttttcgctagcggtcgataaccgctagtgaagatcttgattttcactggcctttgctttgtggcggctccaaattccgccagtgaaaacccaaaatggccgccacgaaagatggtttttgtagtagtggaggtgtggttataaggatggtgtcggtggggtcttcttcctcctctttgaagtccatggaggttgcggtgacgatgacatgcaagcagcgatggtggccgtagaggcggagctagcatggatactgtacctcaacagcaaccgctgcggctaggttgggtggaggtgcagtgatggcggcttctattgctccggcggtttcagggacgactagatgtggcattggctagatccaacatgatcctcctgcctagatctgctgtcactctgacgagggattagattggggggtcgcggtggcttgttgaacccttgggcagcggactatggcagtgacaatgtggcaatcatcgttgttggtggcaagtgggctatgccagcctggtgttggatgcacgaccataggcgtgggttgctcgatggcaagcgggtcgacaacgggcttggctggcctggcattcgatgacgctggtaggtgtgatcgcaacagcttgggtcgtagtggaggacacacaatggtgcgtcgccctatgctggagtagacaaagatggggttgacggtggcgccctggtaagggggtcgtggctttggccgacgggctgactcctgagatgacgacgatgatgatggtgtgcaaaggtgggcgttaggtggcatgaagcaaactcttctccagacacatgccctcttgaggcagcggctagccactacaagatggccacgttggcaggcttatactggagagagcggatccactcttctctctcaccctctacttctgcaactcaaagacgtggatgaagtggagcatatcggaatgtcgagctcctacctattggccgaccgataatgagcactggtgtggtggctacgcgttgaaggtgtttagatggtggtagctactagtgacatgcacaccttgataganaagataggagggtaccaagctcgaatatcaanttgtaattcaaggccacaca

SEQ ID NO: 73026 - DNA, 25114 bp, Oryza sativa
atttactgactgcatgatccgttattagacttcaagcacccctttgaccaggcaagaaactcctgcggatgcttcacgagcagctcctcaacccctgtgagtgcactattgactttcttttttgcatcttccccattcatataaggtattactcactaggtggatgtattgtgctcttgcagagttgcacctacaagaacaccccagcccgaaaggccacctgcggagtatgtttccagtctgcaatcaatatttgtgctatgtccttttttgccactaatatccttgtttcgtgacgtggtcactccgaaggaaaattcctttctttaaatttgatagcacactcaaatcattcaacatttcatacattaccacatctgataaggttccattgtgaagactggcatacacgcatacgtgataagatgaactaataaattgtggtctgcgagagaggaggggaaaaaaacacacttgctagctatcagcaggaagttaggctttagtcctgatcaattttgggattctaatagctatggaagatagatctgaattggtcttatgaatatgggttccactgtttactttctaatgaaatatactttatatgcttgctaaaacttatttttattttagagccccttcaaacgcatatggtcaagcagcatcaaatctattgtcgggaagcaatcttgacactacgattaaccagctgatggaaatgggtggtggcagttgggacagagataaagtccaaagagctctacgtgcagcttataacaacccagagcgtgctgttgaatatctatattctgtatgttctgtttcctcctgtaaatgtttgttattcttttttttctaacgttaatagataatgtttgtttctcccaaacattagggcattccaattacagcggaggttgctgttccagcaggtggtcaaggggcaaacacaaccgagccatcttctactagggaagccagtctgtctggaattccaaacgcatccccgttaaatcttttcccacaggtttatatgctatcttggttattcattaccatcgcctactattgcatgtatttaacaattgaaatttagcagggcgatgcaaatgatggaggtggtgctggtggtggaacacttgagttccttagacataaccaacaggttgtcatcctctctgttttgccatataagattatttttgttttttgttcagtataattttcctgagcaaatatttggttttttaatatagtgtttcttgaatatataaattatgttgccattgtttgtctggtaccggataactaccttttagcttttcatagccagcaatggagccactgtatgcatgataagatgcttttgatgctgctagcattgtttctgattaattattgttattttgatagcacaccctgtcatcttttgtgcttgaacagcgcaccaccctgtatggtgtgagcatcaacttagtgaaacttccatatcatgttttccttttttgagacaggccctaatgttcacatcattttggtaccctcatgcgtattcgagaaaaaaaagcatcattttggtatacctccattcagtataacgttgcgttgtttgaattgttgaagtataacacccctatcttcactattttgcagtttcaggcgcttcgggaaatggttcatactaacccacaaatattgcaggtcatttatcttgtttgacatgtttacatgctatggattatcttgtatagcctgctatggcttattttgtatcacctgcctaatctttgtgctggtatcatgttatagcctatgctccaggaactgagcaagaagaatcctcaacttctgaggttgattcaggagaaccatgatgagttccttcagttaataaatgagccctttgatggtgctgatgggtatgaactgttcatctgcttgattcaattctggtttcatttgatttgttatagggttataggattcgttaatgcgaaatgaaaaaaaaatcaattataaacttgaaatgccattggtatgttctctgtgttgcttcagcacactcccataacttctttcaatggattttcctcggtgctacttgtacaatatggttacacctttttatggactttctgtggtagtacgtgtgcattactccggtattcatttgcactcgcctgcttcctgatgatacagggacttcttagaccaacctgaccaggatgagatgccccattctatcaatgtcacacctgaagagcaagaggcgattggacgggtatgtacaacatagttaactcacttattacctcttggtacagaagtatatacagtgtacataacattacataacaacaatgttttgaattattttcatgcttcagcttgaaggcatgggatttgacagagcacgtgtcatcgaagcattcttcgcctgtgacaggaacgagcaactcgcagcaaattaccttcttgaacatgctgctgatgaagattagatggaattatttaaacccggtgagaactcttgccatgtcctggccgactgtttccctgtctttggttcagtaggaaaccatgcactaacgattatgttttatttgtgggggccatgacagcttattctgtacacctgccctgcaatttatcagacttttgaagtttgcgggtgctttggatccaaattgaacaagctgagatggagctaacaccgcgttgcatcgatttatctcttgtacaatacttgctttatttaattgctggcttagcattcaaatacatggcttaacatttattcgagctgtctgagggacggatccttttgtccatccgtttttagccagaaatttcaatggatgtgaattgtgttgaccacattttctgtcctgtttgtgttattcaattcgtgatttctagagcagtaaatatagtgtgcagaaaacattgcgattgtcgagaacagagctccgttgcattattagccccttctcaaggcgagaatgggacaattgctcttacaaaatcgctactcaattcaaaataggccaggactcctttggaatgttggaaatttacaggattattacggacattagtttaaatcctataaaattcttgtgaatttccaccaatccaaatgaggttccctcacatctccgatacatcatctcatagtgtgcagcatagcttggagtcgatggatgccaggcaaatgcacaatgcctggtagccagtcaatgggtacctacaacaaacgatgcttatgctaatgaatctttgctctttgactgataaaaaaattcagaattacaccctgctatgatgaagattattgctttctttttttaacttacctgaagtccataatgtacttggatttgccaatcctaccaagctgcaatattgtctgccttcctttctcctgccaaacaaagcaaaattactcacagtttgttccgttgtgatagccatgagattccaatcagatccaacaattagagttcaggagtgtggcaacagcataaggttgctctgtttacctccaaagtcatctggaagttcttcaccgatggctgcaccttgtatcccatcctccctgccctctctctgaagtccagttcataccgttttgtcatctgtgaacgatgaatgcagcaggacaaacatcttgctatcagcttactctgaatcttggcatagtatcaatcaaataacaagagtcattttaaaatcttaagagagaaattgcatacattgttgtagaaaggagatcttgagcagagctgatcagccttgatcttcttctcttgccaatcctttggaagcccactgatgtgctgaatctgaaaaaaaaattgaacattccaaaaaccacattcttagcctaatgaattattccactgaatttccaacctccacaacaggaaattcacttgcctgagctgaattgctgttcttcagatgaatggattggttcttgggaatccaagccctcatgcttctgaagctccctgtaagcgtagtaacagtaggcgcaaacctgcacaaaaccaaaacctgacaaattcaacaaaaatcactcaaaaaccttcacaattcctgcatgaaatgaccccaaacggatatcgaatctcacgcgacgacgccgaggagccgcttcgactggctcttgatctcatccaccctgttcccctgcatttgcaaccatggacagttgaacacccacatcaatggcggctcatctccaattctccatcaaactatcaccatgaggaaggagagagagagagagagagagagagagagagagagagagagagagagagagagagagaggaggttgtggtttgttgtacctggccccagattcggtatctggatccgacgaggtttgagctcaatgtgccgaggaagttcttgtcggaggtgcagaagatgccgtccagattctgcgccaccacgaactccgacctccctctcctcctccggtgccgcgccaccgccagcttcctgtcctgccgcccctgccccttctgcgccgccgccgccgattagactcgctcaagcaagcaagcaaccagagaggaagatttggatgaaggatggaagaggctcacgttggtgtagagggagtagagcgcgacgccacgggcgcctgcggcggcggcggcgagagtctccttggcgatgatgcaggtgcacctgccgacgtcgagggggagagggcggcagaggagggcgcggttggggagcgtcgcccatgacgaggccggcgccgcctcgttgtcggagaggtcccacgcctcgtacgacgacgacgtcggcagcggcagcggcggcggcggtggcggcggtggaagtagcagctccctccccctcggccccatcctcacctgcaaccccgccaccaacgccaccggcggagacgacccctcctcctcctcctccctctccttctcctcctcggccttcatgcgaacctgcagcgacgacggcttcagcggcggcgccggcggcaccaccaccgccaccaccacaggcggcttcttctcccctccatccttcccccgcccaatctcggtgggcacctcgttctccttctccttctccttcgccgccgcagccgcagccgcgccgccgcgagcccgtctctcgaccgtgccagcgttggagctgatggggcggaggggctcccgcttcgtggccgccatgggaggcgaggcgcgagagctcgcgagttctgtgtgtgtgagagagagaggttgtgtgtttgtcttattcaaattgtgggggttgggtttgtgatttgtggtggtgatttggagggaggatttaaatttgaaacgcgagaggggggtgggtttgggtttgaaacgtggtaacggtcgccgtcttggttgggggttggactttttggggtggattgatttgattcctttttggagcttttcttccttggattttgccatttcggtgacacaagtacaaacctcatgtactgtgtgcccccctcatttgaatggaacacgcggacgtcatcatcagaatccagatcatttaaacattatacaaaaaatgttgaaattcaattttttttcaaatgtgcttggttggatacatcctgatgtactccatactactatctccgtcccaaaatatagcaacttttgactattaatctggacacactagctaaaaaatacttatattttaggacagagggagtagattggattgatttctattttatactatcaaaaagttgtttcaaaatctagaggtatattaattcatctatttcaaatttgctcatttaaaagctgactctgcaaaaaattattactcctacctatttttttcccgcaaaagaaaaccatggcatgcttaaattggacgagcagcagcagcgaacagtacaataaatgaatgaactgataaaaaaaaaggataagatgaacagcggggccgtaacgttgacgcattccatccatccgtaataaagctgcggttccaataaattcccaaacatgtgagccgcttttgtttaatgcgcaagtacgaagcaaactgcaaacgccagctttggaagcagcaatcatcagggtgctcgaattttgcggatgcagtgcaacttgttaaaaaaaacgccacccaaatttaaacgcggggatggattgggtgggtggtttggtttggcctccgcgcgccgccgccggcggcggtgggtgggtgccccttctccggcggcggcgatcgtcggcgtgcggcggcgacggagcggcggaggtgtgcatggtgatcggggtctgctccatccaatctccactctatggagacgagggctggttttcccagctccatccactctttttttcacccgcatgctttctaaatgttcacagttattttagaaaagttgtttagaaaatcacagtaatctattttttttagaaatattagttaatacttagttaatcatgtgctaataaattgttccgttttacgtgtgtagaagagttcctaacttgttgtcttgttgagaagaacacagccacacgggagtacattctccgtccctaagagcaggtacaatagcgggctataagttaactatacacatattttaaggagataaataagaagagagaagggcagcgggctacacatttgtagccagctgtagcacagactccaagacacattgtacgtatgacatatgggaccagctattaatagtgtagtatgtaactattgtatgaatgagctattagattggctatagatgaattggagctagtagttggctatactattaaacttgctctaaatataagggattttgtttggatgtgacacatcctaatacaacgaatcttgacaggcttacacatcctagtacaacgaatctgtatagagaaatatgtcatatccaaccaaaatcccttgacggagggagtactaatttgttggtaggttgggctcatatgttaaaaatgtggacccggcccactaataaattggccatgcgttggcaccagatgggcccacatggcagaaatggacctagccaatatatactttttgggccatcgcggaaaaagcgaaactgtctctcatattattaccggcgtttttccattcatttttggccgctttatcaaatcgttgccatggactatttgctccatgtcttaaacataagctctcttttttttaagataatggaataatcatctcggcctttactcaacaaagctaagtataagctctcttagaaacaacttttgcaccgtattcatttcgttaaacaattaatttatttttataattaagtaggtaatctgcattaataattaatttggtgaatgatatgtttcaaacgggccatgtctagggttttctttgaaaaaaaaaactctcgaactgttctgcgcaaatgaaatcaccgtgccatttgagcatttgacaaaaaaaaacaagattaattagtttgagataacgaagctgacgagatcaatctttcacgaatcctcctcctcttccttccgccaagtaagcatgtatagtagtagcgtctctcaccgtctcttccaagcgtgcaagccacccaccctgacgaaaccagaaaattcacttgttattactccatttacggggacattcacttttaagatgtgtcaattaattatttgccactcgctgtttataacatatgggtcctcatatgtctatgacatgtaggtctagtggcaaatcatttatcaccatccgtaagagtgataaataattaattattctccatttggtaaactacacggttggtggtacgagagaaagtagtgtgataaactacacggttggtggttggcccaacggccctaaccttttgaaacgatgtaccggtcctgttcgtctcagataatttaacagcaaattggcagtctaaacaataacaaaaacagttaaatttttatcataccagttttacgaacaagttgcgaggaaggtatcctttgtaaaaaggaaaaacgtagggcatagttcatacccgggttgaacgtgcgtgactaaaatctgaagtacacaatcacacacttgtattacttggcattcagtgagctatgttgaaaaaaaaaaccaaagatgttatattttgaattatcaggaaacgaagtgacatcgcgcacctccaagcatgtacacatcctccgttaaaaaaaacaacaacaacacttctaagtttaagtttaaggtatgtttgttttagtttaagattattgtaatctagattattgagtcatattaccataaaatgaattataataagttgacatagtgttagccgtttgtttctctggattattagctggttgttaggtgttagccacacaataattaaaaaaacagattactagattatagtaatctggcttttagatcgtaataacatatcataataagctttctgtttgtttcagcttacttctaataattcagattgtaataatgctaagctgaaacaaataggaactaaatctgaacataagtgattttttatgaagtgatcactatgagtaggcatttatcatgagaactattttaagatgtggttttcttaattttcataaaagaacatacacgtggacgtcttgcactgtacaatgtatatggccatcacaatttaagcatgcatcactcgaaaacaaatcatgcgtaatcatgcttatcaataggaacacacgttgtatctcaaagacgcaagcaagtaacccatgtttaatggaattatctctcgcacatatccatccagatgtgttgcttttttttttcttccacttaccaaatgtgcacccgcatgttagcatgtatcaccaaacatcatatctatcccagttcacaattgtatcaaacactttaagccaaacaaacccctcttcaacatcaatttgatttaaccaatctacgccctgtttttgttttctctaacaaaaattggataagcttttagatactcgtgacacgtttttcaaactgttaaacggtgtgtttcatacgaaaactttctatataaaagttgttttaaaatataagattaatccatttttaagtctgtaacgattaaaactcaattaatcacacgttattatcacctcgttttacgtgaaacacttaatttttatcttcatctttatcatcaggagattcaaacatcttagtacgtatcagcgctctttccaagtattgccattccacacaggaaaatataggttgtgtttagatccaaagtttggatccaaactttggtcattttccatcacatcaacctgtcatacacataactttttagtcacatcatctccaatttcaaccaaaatccaaactttgcgctgaactaaacacagccataagctcaaaagcacaaagcaccgctcacaaagaaaaaaaaaatatcgtaacgattatcctagaccatctgatccacaatccgacggctgagctgtcaggtgcttctccgcaagaagaaaatagaaagagaacatttaagaaatgtcattgataaaaacccaaatccgagaaatactattgacgagtacaggtttcataaaaataccatcgtacaagtgatttttgtcccagaaatacaatcgccgttatgattttatccattccgtgtcattaaatgcaccgttcattctaacggaaccctaacggagatagcatttttaagaacaaaaacacttgtataatgcaatttcatagaactctacttacgccgtgtttagttccaaaataattcttcaaacttctaacttctctatcacatcaaaacttttctacacacacaaaattttaacttttccatcatatcgtttcaattttaatcaaacttctaattttggtgtgaactaaacacagccttatcgataatatttcttgtaattggatcgattacatttgttgaattttctcagataaaaaataggctgtgcaagtgcaacggaacaggtgaagagttgcccacccatcccatccctcccatgtgccctgccgcccgctcgtgttcgtccgcgtcctcgtcctcgcctcgtcgcccgtgtcgcccgcgcgcccgccgcgcgcgcgctccccgccaagatttcgccacgccacgccaccacctccggcttcggctataacctcgccgcacgcgtgacgggagcgcatcgcccccttcccttcccttccctccccatccaggcacgcaggcgcgcgcgagagagagcgatgggagcggtggtggccgcggcagcggcggagatgaggcgcactggccgctgcggcggcggcggaggcgggggcggggagaagaagggggcgaaggaggagggggtggtggttgcggcggaggcggccgccgagagggggcggcggctgcggctggtggggtacgacgagctcccggacttcctgcgcgacaacgagttcatccgcggctactaccgcgccgagtggcccctccgcgacgccgccctcagcgccttctcctggcacaacgagaccctcaacgtctggacgtgcgcgcccccaatccccctcccaattccattcaatctctccttctcatcatctcatcggtggatgatttgcttttcaattttcatgccgattgtttgttgtgcatgccatgcagccatctcggtgggttcctgctcttcctggcgctcgcgctcgccggagccgccggcgacgccgccgccgacgtcgcgccggggatcatcaggtaaatacattgcatccacacacatcacatcccacccacgtcacagtcttattcaaaaatgtttttcccaatttctattcctttcttgttccacaatttaaaatgcaatcctcttcgctgttctaattcatttttaatcttacaaatagaaaaaaataaccgcgtgatttccgggtgccagtaggtatctttgaaaaggtctatctagtgtgtatactatttgctttgatgctttcatgtttgggacttttgctgtggtgccctctagattatgtgtatttactactttttaccccaaaatattcaaatatggagtatatttgctttggttacttgattacttctgcgaatgaataagctcctaccactgactgatttgttgccgcttagtttcctatattgttcttgttttcacatgctttcgcaattttgctattgtattatttatatattggtttttttaacgattattctgtaaattagttctatgctattaataaccatgtcgaaatcaaaacgacaaactttcgcatacggacaatcacgcaaagtttgccacacccctttttttgggagcaagttcttggtggtatcactagagctatagaggaccacctagagtagggattaccaaccactcccaaacaatttctgttcgtgttcgtgcacatgtttgctgtcgtaaatgtaatactattaacatttacagaagggtcaaatgcattcttacatgcataccactgcaaaattaccattcacactggagatatggagtagcatacagcagattgaaaatttgtggtgacaagatagattatgaattgttggtgtgcaagtgtatcatagtagtcaggaaaagatagatgctggcatgctgcccatgtgatgctaatctggataagctgaataattcactgtccaagattgtgagaatcgcacaaacaaggtccgagaataaggtcaggacgtgtactcctagctggggtacattatcgtctcattctctatacctttcttgtcggcaatgaaggaaatagtactccactataatacaatatggaattatggagtatctctttggaaatgcaatggctttggttgtgcaaattctaagtttgttggggggttttcagtaagaacatgggatgctcattagttcttcatgtaattaaatccttttcttcgtcatgagctctccagaaaatgaagggttttttttttcctgtttacgcaaaggccctttaattctgtgtcatccttatcttttctttgcaggtttgtggtaggatcaaccaatgcttcttggcagactaacgatcattcggtaagaaacgaatcgaagaatatatgaatatgtcctgttttcgtattactttcggcgatactagttattttcatgactcatcatattacttttcggagatgctgaaacaaacatccactctctagaagaaataacaatcattaattatttaattgtttactcctcagcagattatatcccttgtcacagctcgcaatctttgctactctgcacatatctgaagaaaactgcagttatttatgcaccattattgttggaactttactgcatagaattttgtttgacactaggtaacgaacgacatagtttggcaatatgggacgggtttcattgctcattcagataggtgcactatgccgtaccgccattagtaaagcttgattaagctaacgaattaatctagccgggtcccaccatccattgcaagtgagaaagggacatgaacggccgtgatgagctgcagccaacctagggtcttagctagggaacacacacatatgtcatccttgtccttgcattctgcaagctgcaaggagaggacatgttcatcagctttggtgtcttggagatgcctctgctgctttccatgtatcactggtacaattgtccaggcatctatccacacttccacagggatgatgatgattgctgatgaatcggcatctatccacacttacactttggagtagtagtacagtacttggcaggccagttctgaattcggttttgagttctctttggacctcattggattattggaaacacgagaatatatcccagatttctgtagaagtttaacagaaactcctgcgaaaaatttagtaatgttccaaaggagacctagcaaaagcagccagattctaacaaaaaaactgtacactgcaatcacaagcagcaaggtgtttttggtgccatgtgagacagttcaccttgtgatggagacactcctctcttcttggaaacaaatgtagcgtttggcttttgctttgctggtcccttctttttatcattggcaaattaagatttgctagatagtttgcagcattttcacgaatgctcctgaaatgatacaatgaacgaagtgacacctgccatgagcactagcttttgtcagccatctggcccagatcaatgagcagacaagaccaagtggcaaatctttgtatctatcctgccgttgatttctgtgatgaccaatgactcaatccgtctatgaatcttcaacaatttcttcttcttcttctttattttgagaaattacgatgaaattcaaaagaaacttgaaaattgtgctcactatttttaagtggcactatgcttgcatatgagttggtgtgtttgcacttagcatcatggtagtatgcagttgttacagtgatgtgaatgaaggtggcattggatgcagggcgcggcgagccatgacgccgcggcggcggcagcggcggcggcggtgctgggcggcgggcacggcgtgccgcggtggccgcggatggtgttcctggtgggcgccatgacgtgcctggcgatcagcgcgacggcgcacctgctggcgtgccactccaggcgcgccagcgtggtgttctggcagctcgactacgccggcatctccgccatgatcgtcgcctccttcgtcccgccggtgtactacgccttcctgtgccaccgcccggcgcgcgtcgcctacctctccgccatctcggcgctgggcgcgctcgtcgtcggcgcgctgctctcgccgccctgctcgtcgccgcggttccggcgtctccgcgccgcgctgttcctcgccatggggctctccggcgtcgtcccggcgctgcacgcgctgtggctcaactggggccacgccgcctgctacctggcgctctcgctcgaggtcgccatggggctcgcctacgccgccggcgcctggttctacgtcagccgcgtgccggagaagtggcgcccgggcgtcttcgacgtcgtcggccacagccaccagatcttccacgtgctcgtgctcgtcggggccgtcacgcactacgtcgccgtcgacgtgctgctcaactggcgggagacggtggccgccgcgtgcagcgcgacgtcgtaggcgactctcctctcctaggcattttgctcattgcgttttgatgattcaaacaatattcaaatttagaagaatggagcagtgttagatgagattcaggatcagggtgtgtgaccttgtgtcattcgatcgatcgaacatctatatgtgatgaattgaggacgatgaagaaattgatttacagtacaaaaaaggtcgtgcctccaaatcccggtgaactttggaagttttggtttccttcaatttggaagttctggtttccttttcgtttattaatgcgagatctgaatttaaggggttgtcacgcatgaattttaaatgaattttgtattaactagttcaattttcacaaaattcatatgaaattcgtccgttccaaaggaggccagaacgacggcgatgactgatatgaggacgatttgtggtatgcaccgaattttccgatcctttatttagagaagatttgctagtttttacaaaacttccccaaactttacaaaaagatgaagaacacgagacggaaagggctgcaggggctgccatcttctcaatcgaagacgacgagcttgtcgtactccgggccggagatggccttttccatgacggcgcgcggggagacgacgccgtcgccgtcgaggaacagcttgaggaggttcttggagaagccgctgaccagcgccacccccttctggccggaggtgaccggcacggccttggagtcccgcaggttccagaacaccacctccggcacggcggcgccgtaccccgccgccgtgtacttgcgcacgatcgcctcgtagtccgtctcccacggctgcgccgacgcctggtcgaactccatgtcgctgaacaccaccacgcggcgcaccatcttgtccggcgagagggcggcgcccgcggccacctcgaggatcttgtcgaacaccgcctggaagttggtgttcatgccccagttcatttcgcggatgaaccgcgccttgtcggagagtgcctcgccgacgatgtggtggagctgtgggctctcgctgaaggtgatcacgcggccgcgccacgggtcgtcgctgaggtcggaaacgaggaggccgagcgcgacgcagacgtccatggggaggccggtcatgctgccggacacgtcgcacacggccacgcagttgcggagcttgccgagggcgcgcatgtcgtcgaccatgcgctgccactggaggtcggccacgccgctgccgccgccgtcgtcgtcgagggagctgatgatctggtgcgggagcagcgcgcccgcggagatcttcttcttgccggacttgacgtcggcgaggtaggcgttgaagcggtcggcgtcgtgcttgaggaagaggtccttgtagttcttcatcgccacggaggcgacgcgcgtgtacaccaccgactcccacgcgcgcgccgagatgtacacctccgggagcttgagcgcgcggcggagcggcacgagcgccgccttgcggaggcgctcgcgggcgcggtaggcgtaatgcgcgtcggggaggtccgcggcgagctccggcaacgagcccttggggaagaggcgccgcgcgatcgcctcgcagaggagggtggagcggtcgtacgacttgtccagcgacgggcaccacttggcggcgagcgagaactcgtggacgttgccctcggcgagcttgcgcatgtcgtcgcggaggaggtcggcgaagagatcggccgtgcgatcgtgcagggatcggtaggtagggtcgcggctgtacctctccaccgccctcgccgcggcctccgcccgcctgcaccgccgctccaccgccgccttcgccgctagcctcccgtcgcgctccaggctggccgcgatgcgctcctccgccgaaccgacgccgcgcgactgcttcctgctgctggtgtggtagccgcgggcgaaaccgcgtccacggccacggaagcaaccgcggccgcggccacggccacggccacggcgggcgatgaagccgatgccatcagcggcggcgaggcgcgccttcttcccgggcttcctcgtggacaacccaccattgacgatgcggtggaggagctcggggaggtccttgaggtagccgaaggccgcgacggaggcggcgttgagcgcgagggtggcggggtggtggctgtggagccagagcgcggcggcgtagaacccctcgcggtccgacttgccggtgccgcgtacgcccctcaggttggccaccagccggagcgcggtcgccgggtcggcgccccacgcggcggcgagcagcgacgcgacggcggcggagggcgtcccgggcacgacgtggaagaagaagtcgaggcaggcgtcccccgacgacacgaacgtcggcgagaggttctccgtgagcgccttcctcggcgccggcttgttgaagttggcgtccatcaggtcgaggaacgcgtcgcccgtggtcgtcgccggcgcggcggccaccgcagcggaggggcggcgtgcctccggtgggccgaggagggtggcgatggcggtggcggccatggagagagagagagagagagggctgggtttgggctgggtagtggatgggctttggagttgagcccgctgggttgatgtggatgtgttggtggaggaggacgcgtggcttatatagggaggggtttcgtggcagccaaggcggtctaggtcggtagtgctcggcaagttggcatggatgaaatgaaccgacattagcgtatcaagggaaaaaaaaaaggagaaaataaaaaaaaaatgaaccggcataggacgggtgtgtatggatagtaggactcgtgtaccgtggcgggcaaggatcatttcgttttttttttttggttttgtttttctcgtcgtggagcacatgtagcgtgatcgaaagactatgtgttttctactgtagtttgaaacagctgtcgtctttttgtttttctttctagtgactcaagcgtaggggtggacaaaaagctcgggctcgcgagctcggctcgggcttggcttgagctcgcgaagctcggctcggctcgaagactaaacgagccaagcccgagctccctccacagctcgtttccaaaccgagccgagcccgagctagctcgcaagctgctcggtaggcttgtcaagcctatggaaaactgagttccctaagcgagcccaagcccattaacaattgtctggcccatgaaagagagaaaccctaagtcctgagctgagccgagcgcgagccgtgagcacctgacgccccagatccgatccctcccctaatccccttcctccgttcctcagccactagcgcagtggcgctggcggtgactggcaagaggagttgccggccgccgcatccatcccctccccagcgccagaccgccagcggcaggccggcagcgccgttcgaacttcgaagccccctctgtgccgccgccgccggcccgccacctcccttccctgcgcggctgcgccgcgggcgtgccgcctcgctccttgcgccgcctacctcccctactgtggctgcgtcggctccgtcctccctccccggcgacgccccctgtgccgtcggcccaccgcggcgccgcctcccttccctagttccctgcaccacctccggcctccgtccaccgtccccagtgccgctcgagccgagctcgacgccccctgcatcgccggcgtccctgactcgacgccgtccatcatgacctcgccgagacgccatgtcgccaaccgatcgacgacagttcatgcatcacaccgcaacgacgagcctaggatgaagaggttcgtgatgtattttctcatttttgtgatgcatgtacatgtaggcatgtagctgtagattgttgtggtcagtggagtagcgtgtgtgtgtgtgtgtcagtgtcaaactgtcaatgattcaattacagaaagaatgaggcaaataaatcaaaaatgttgtaccaatactatagtttgaggctttgagccatgtgttttgtgtagtatattatatatgagagtgagactgcgagtctgcgactctttgttagttgttatactgcactgcatatacttcacactcttgtttttccattgtttataattttgactcatctttaaatatgttgatagatccaaatccaaatcaattggtgcttcagatggtaacgtcgtcggtgcttctgcattctctactactggtgcctcctcccaagcagttgtagggtctacgacaagtgatatggcatacaaagattgtgatgtaccattatctccaataatagccttggtacagtacttgccctacatgaccttagttctaaaatgaataaatgaattgcatgtcgatatgcattgattaaattctgttttgtttatgaactgtagattgatgacgataattcaaaggataattcttttgatcacattgatgacatgtcaatgtcaatgccaagtggtgatgaggcagcgactggtggtactagtgatgcttctggaggggattcattgggtggacgccgaagaggaaagaagctaaaggtttcacccaaagttgctactgtaaaggggaggaagcggtcaacttgttggaataacttcaccgaggttaaagttacttccaaggtaactccaggggagacagaaacaaaggctaagtgcaagtattgccattcattgtatgcttacaaggctgggggagctactacacatcttgtgaggcacatgaacaagtgcacgccttacttgaaccagttggccaagaagagggctcaagctgttctcaacttcacggcagagaaaggtgactcagatatccctctcattgtcacccctagtgagtataaccatgaggaaactcgtaaactgatagctaagatgataattgttcatgagtacccatttaggatggtagagcatacttggttcaatgtcgtgatgaggtatttaaacccttcatatcagtttattggtagaaagaccataagaagtgaatgcttgaaggtttttcattctgagaaagaaaacctcatgaagagtattaggagtgtggaagtgattagcttaacatgtgatttgtggacatcaaatcaaaacctttgctacatggcgttggttgcccattacatagataaaaattggacaatgcaatgccgagtgctgaactttgcagagttggatcctccacatactgggaatgtcataggtcaggccatctttgattgtctagctgaatggaaaattgaagacaaggttataacaattactcttgacaatgcttccaacaatgatacagctgtcaagggtttaaaagctaagctagcagctagacgatcaagttgttacaatgctaaatacttccatgttcgttgttgtgctcacattattaatttaattgtgaatgatggcttagcacccttggcatctttgacaaagaacataaggtctactgttaagtacatcaagaaatctccatctcgtatacacaagtttttagaaatctgtagaaatcttgcaatggaattgggagagggcctgaaacttgatgtgaccacaagatggagttcaacttatcatatgttgagaacttgcattgcatatcagcaagcattagattcatatgcagaaacagatttaaattatgagtggaagcccagcccagaagagtgggatttgtatgcatcaattgagccaatacttgggtctttggctgaggttactactgcattttcaggatcaacctatcccactgcaaatattttttacccccatattgtcaatgtgaaagttgctttgagagatgcttgtgcttcacaagatgctaatttgaagaatatgggaaaagcgatgttggataaatttgacaagtattggaatgtgaaaaacaatgcaatggtgcttgctactgttctagacccaaggtacaagttaagattcattgaatggtgttttaagaagatttatccaactgattttgaaaaggagttagctgaagttcgaactgaattgaatacactttatgataagtttgagaaggagcatagggaaaagatggcagctagcaaaggtaggagcttgagagcttcatcatcagtttcaacttctgacataaacaagtctctaccctctgtctcaagcaattttcagtcttatttgcaatcttcttctgaagatgcatcaaagtctgagatgcttttatatcttgatgaacgaaatgaggacttagcgaacaaagcttttgatctacttgtgtggtggaagttgaatggctaagaactttttgactataccagccagttcagtgtcatcagaatctacttttagtgctgggggaagagttctaagtgattatcgtagttctctatgcccaacaatggttgaggcgttgatatgtgcttctagctggattagaggcgctccaatgattacggtactcactattatgccatgcatatttaatgcatattctcttcttaacacatgacatgagtagctgaattaacttttgatttttctgaatttcaggcagcagaagaagaagaggatgttgagagtattacatttcctcaaagtgtagtgcaaagcaactagtaagtaaatggagtacttcactcattttttttcctatttctttactatcatttgctcgcttgtgattacatgatgatttatcatttatgtaggcaaatggatggctcatggctggaacatgttgctgtggagtgtggagaaagtctaggagttggagatttggagagttccttttaatattttgcgaaataataattagatgttctataattattttgtgaatttgagaatggagactttggacttttggaatgtggtctactctaagttatgtactctctataagactataactatattactctatgcttctattatggtgtggtcatgactattaagattatgtgtgtcatgttgggacatgtcctgtgagtgtgaggctgtgaatgaatgatggagattgtggaattgtggtcttgtgaagttgtgatcttgtcagcttgtgaaatgtataatatgttgttgctgtcttgttgatcgtacatgttgatttggcttgctaattgattgctctattgttgaagtatttacttgctgctgtacatcacaagctggctcgagccggctcgagctttgaaacgagccgagccgagctgcactttttgctcgttcaattaatcaagccgagccaagccgagcctgtagttgagcaagctttcacgagccgagccgagcttggctcggcttggctcgtttccacccctactcaagcgttgcagatctggagactggacttcatcattctttccgagaaggcgagaacgggatgactttgagaattcgtgcacttaatttctgagtaacatggtgattttttttaaaaaaaaattacacatataacttttatataatatttcctccgtttcagaatataagatttttctatcattactcatattcatatactccctccgttttacagtttaagtcattctagtattttccacattcatattgatgttaatgaatctagacacatatatctatttagattcattaatatcaatatgaatgtgggaaatgctagaatgacttacattgtgaaatgaaggaagtatattatgtctagattcattaacatatatatgaatataggcaatgctagaaagtcttataacctgatgaaacggaggtagtacgtattaattgattttttttttcaattcgttcgttccctcgaatcattcggctattcaacatagcattttgttccattcaacatttcgaacaatagaacaatgcacaatggattttacttgaaaataccggtattattgtaggtggaggagcagtggatacgtaacatcatccagtaggttcaatcttgatgtctactactctgttctaaaaaaagccaatcttggctatgaacctggacaaacatgtgtctagattcgttggtaggattaggtttttatgggacggagggggtattaatgaagtgtgtgttagaggacgctttcacggctacacgagtgtggtaggtttctatgagtatacggttggcagttgtgccattgacatgtgggttatagtaaagtagagttcacatgttagtgatacatgtgcaaactgcacaaagtcagatggtttgtttacgagcgtgacatactccctccaaaaaaacaataacttttggttatgaatctatagatataattagattttttttttatggaacggagggtgtatatgtgtcctccatctaaggaaaaaagaaaaggtttattttgacttataagagttaatcacatgatattgcctcagctgccattttctatcgtgcccgagaggattagatggccaaagtggtcccggtcaaaattagatggccaaattggcgggtatttacataagttgttcttgcagaaacaattgttcgcacatactagcattgttaaatacacttaccaggggcctagtagtatatatgttaaaatttactaaactagggggctattcactttgatatctaaatcaacattaccaaaatttgtataaggttgaaaagtgtaagcttgtttagtttgttctctttgtcaagtttttgtgagagattctagaattaccaaactttgataatggagacaaattttggtaatctttagattacttaccttgccaaaaaaattttagtaaacccaaaacttggtttgatttattttgggaacgaagtgaacagcccctagatttcacaacgaaaaatgccagggagaaatcaacagatcaatcatatggtccaacagcagcacagcaatggaacatatgctcaacatcaaaccaagcaagtgcactaacaaaagcaagacaatgatatgaaagaatattcagtctgcttgaacgaagatgataacatcagtggtagctgagagtctatttacaaaggaacctgatcatcatcattatgtacaaaggatgaagaagccacaagcaaccaaggaagtctataaatttcagtttcagtatatttacagttgagagtttctcccttcatttcagcagccataggcatgatcaggaaggcgttttcaacgaatattgtcaggtatcatcgcgaccgtcaccaggaagtactcacatcccacaggcagattgtacgggttcagcatggaagcgggcgaccggcggccaccgctatcaaggcgtgaagcttccatctggtcaccgtgcgagggcagctttgctatgcgccgttcgatgtgcacaatctgcccgattatgtaagctgggtgccgtggatgctgctccgtgaatagggccactgattcctctgataggtagtagtttgagcagttccggttgattgcttcgtaatgcccagcagggttccgaacaaagaccgcgagctcatgaacttcgaaacggccgaatgatatcttctccttactagcctgttgaacagtattgacaaccgaggatactgtcttgttatttcaatcaacaaaatttaacagactcaacctaacccatagagtaatatgtgcttattattgattagcgcggaatttaaactaaaacaatttcaaagtaattggcttcttatgaattcatttattttaataaaaacagtggcttaagaagttacgactcgtacctgtttttccagttgaagcttactgtacaaatttttaatcgactctttcttctcctccaacactcttacaatccttgagtagcgttctagcagctcagcactctgtcgtgatagaaaaccaactttgtctgccaggatcttgatgcattgctgaaactgaatggttgtatcaccttcatccttctttgcactgtttcaataaaaaagtattactcagccagtaaatctgctgtttcgataactctacagcagtaggggatccaaaggaagaaaatgctaatacttttataaagtaacagaactctatgcaaaggaaactactctgagcaaaaagaccaaaaacatacaatcatctgaaggaacacaaaattattttgacgaccaatatttcactgtaagcacaaaatacagtttactactccctccgtcccaaaatataagaacatctcccaaaatataagaacagtttactactcactgtagaaagcatgccaaggttaaataacatctaacatcttcctagctctgtttactacaaattatgcaaaaatgtctcgctaaaataacatccagcgcctctctaaatctcaacaatgagccaagatacagaaaatctggacatacttcctggaagctaccatgaattctattctgctgtttattttgtcggtctcactgactgccaactcacaaatcactaataacttggatatgttgaaccaagatacagcaaatcttagaagttccttcgatcctatttttcttgtttattttatcagttccatagacttggcatggatcaagcccaacagcacaacgaacttgggggtgggtggtttgtaaatgaaatgcagaactgactacacatgagtttaagcgaatgagagcagtaagataccttgctaatgagagagctaaagcacgcagtgagtccgcaaaaccagacatgcctggtgcagtgacacagttatttagtctctcaaacagaccatgtatcctcagagcagatgaacgcagggcatcatactcaacagcccttctgtcagctgaacatttgtttgtgcgggcctcttctcttgcctcgtgtaagcagttctccagttgcacacagttcatctatattaaaatttgtaaaagaaagtaagcagcaatttcaattgagcatgaaaaaaaaaactattgctgaatattctacctcccacttgacttacctgagactcatcaagcagaccctgggtgtgttcaagttctttcttcagagagttgacctcatccaccaaggcatt

SEQ ID NO: 73027 - DNA, 1273 bp, Oryza sativa
  unsure (1)..(1273): unsure at all n locations
actgagtgctnatcgccctgtaccctatcagnannaaccaaatataaaagaaccaaaagttaatgggattaatatttaatagatatgtacttccagtacacatttttcatactaattaaatttcagagaattagcaactctgtgactagccttagcagaccacaatcttgaaattcacagcaatcactattatgcatgaggtgaactatatctttaaataacaacataaagataattttccatccatgcactattagtcataacccacaattcacaattagtgtagtcccaagtaatacgctaatatccaagtccatatgactgtttattcaagttcagttcatcatagttaaattatttatatctgctttataccatgagtattgtgggtgctaaaacagtgtaggatgtttttacttcaacaaaaacgggacaagggagttattagccctgttattcttaaaaaataatgtttgttgtaaaaaaaagttgttaatgtaaaaaaaatggttacctggtatctgagctctctcttagcttcgtttgtggtttcttgatctttgaaccattctcgctaattgaactattgatgctttggacattgaactgccatagtgcatctgattctgaggaatcacttgttgcaatgtcaatgtcatcagaatcatcagtatttgtggaataaaatcttggtctttgctgctcaaactcatttccgtccttttttcttgagttatttctcaggtattgcttatctcttgtacctgaatgcgtacctttggtaaaagaagtaggtaangctggacttgtccctttcaattcacctactgagtaatgggtgtcactacaaccttatggggattcttagagtcaactgaggcatgcaacttgggtatttataaggcaccctaaaaggttggcgaataatgcataactgtttctgggggaaatggataccgtacaaatcacacaaattacaaccggagcaaaaagtaagaccgggggcctaaggggggactaatacaataatgggtggctcatggcggtttcaacggaaaacggtggccatgattaagaatcccacgcgcgggaagccgttggtatgccctttccttctctaacaaccctgccggngtgggggggggggttttctctctagagggatggtttccaaattggttaccgaaaaatttttcaagccccagggcccaccaaggggctgtttttttttattctccccccacaaaaaaaactcttgggggggaacccaaaa

SEQ ID NO: 73028 - DNA, 6700 bp, Oryza sativa
  unsure (1)..(6700): unsure at all n locations
cagagtggctttgcaccctgctctgnacccatatatatatatatatatatatatatatatatatatatatatatatatatatatatatatatatatatatagccattgctggctgctagcctattgctgcaccctcctagtctaaaattcgaaatttgaatggggtgctgtcctagagggcatccaaactgaataaagcataaaggaggcataaaggagatgctaactgctgctgtcctactaaccgcagctgtcctagcaactgaaaaatatgctaaagggtagatgctgtcctgaaaaaggtgaaactacccaaaagcaaaaagaagaatcacgaccaaggaccacaaagacttatccaacattctccccctaagtcttgtgcgtcgtcttgtgggcaagttgggccatcccgatcctggagcagagctcgaggaacttgatcctcccaagaggcttggtgagcaagtccgcaagctggtccttggtattgatgtagctcgccttgatgctcccttcctccaagtagcttcggatgaagtggtacctcacccggatgtgcttgctccgttcgtgaaaaacggggttctttgccagggccagagcggacttgctatccaccctgagctccaccgttccagtgtctctgccggggagatcactaagcagtcgagcaagccagagcgcctgggtcgaagcggcggaggccgctatgtactcggccttgtagctggacagggccaccacttgctgcttgtccgactgccagctaacgaggcacttgccgaggaagaagagaatcctgctcgtgctcttgttggtgtcgatgtcgccggcgtggtcgttgtcgctgtacccgacgaagtgtgccttgccaggacaccttgggtagtagagaccgtggtcgagagtccccgcaatgtagcggatgatcctcttcacagcctgctggtgctccatcgtcggtcgctgcatgaaccgactgacgtagccgacggagaaggccaagtccggccgtgtgtgggtgaggtagcgaaggctccccacaagacaccggtactgtgtagcatccacctcctccgctgtgctgtcgcggctcagcttcagtctctcctccatcggagtgagagctgggttgcaatcggtgagcccagccagctcaacgacgcgcttggcgtaggcggtctgtcgaagcgtgatctcggagtcgtcctggtgcacttcgatccccaggtagaaggagagaggccccagatcactcatctggaaggtggccttcatctcctccttgaacgccgcgacctctgcatccttggtgccggcgatcaccaagtcgtcgacgtagacacccaccagcaaggcatttcctccattgccccgctagtagatggccgcctcgtgcgggctttgctcgaagcccatccctttgagcgtggaatccaacttggcattccacgccctcggtgcctgccgcaagccgtagagggccttgtgcaggcgtagcaccttgccctccttgccggggatcacaaatcccggcggctggtgcacgtagacctcctccttcaagttgtcgttcagaaacgccgacttgacgtccatgtgatggacgccccagccttcctgatcagccagcgcaagaaggagtcacacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgttgcacgcaaggtgcaactgcgcctctaggtcgcgaggcaccggcaccggctggtcgccgagaagatcctccatcgtacggtaccgtagctgctcgccgtcgtggtacgcgtcgatgcgctccccgtcgtgggagagcggagtagcgaactccaccgggctgcgctcaacacgagctggcgtcggagtagacgtgcttggaggagtggctgttggtgctggagcatgtggagtcactggctggggtggtgtcaacgaagagctcgtcgtagtcgaagtcgtggcccgagggtgtgttggtgtcggagtcggtggggattcgggggctggggtagacacgctcggtgaagaagagctacctactcccccagctccctcgaagtagacgtactcgacggtgaagtcgtcgtacgtcggagtcgaaccatcgtccaccgccttgtcccatacccaccctcgcccttcgtcgaacacaacatcgcgcgcagtgcgcacacgctgtgtctccgggtcgaggatgcggaaggccttcgagcccttcgcgtagccgatgaacacccttggggtgctcctgtcgtcgagcttgccgatgtggccaagctccttggcgaacgcgaggcagctgaagacccgtaggtgggagaccgccggcttgcgcccatgccaaacctcgtacggtgtcctaccatcgagggccttggtaggcgagcggttgaggatgtaggcagccgtcaccaccgtctccccccagaagatggccggcatccccctctgcttgaggagggcccgagccatccccacaaccgtctggttgcgccgctcgacgacgccgttctgctgcgggctatacggcatggtgtagtggcgctgaatgccctcatcagcgcagtacgacgtgaattcagccgctgtgaattcgccgccgttgtcggtgcgcagcacgcgcagcttgcggccgcactccacctctgcagcagcctgcgcatgcctgatggcgtccgcagcctctcccttgctgccgaggaccatcacccacatgtagcgggagaggtcgtcaacgagcagcaggaagtaacatcgtcctcctggtgtggccggtgtcactgggccacacaagtccccgtgcatgagctcgagccgttccttggctcggaagctcgtctgctggggaaaggggagccgccgctgcttcgtcaccacgcagacgtcgcagagctgctccacatggtcaaggcacggcatgcctcgcaccatctccttggcactgagctgcttcagggcctcgaagtggaggtgcccgaagcgctcgtgccactgccacgcctcgtcgtcccgacgagcggcgaggcaaactggttgtgcgacctgcgcgctgaggatgtagagtcgattagtgcctccggttaccttggcaagaaggcgacgacggcgatcccaaatcctcatgagtccgtcctcaaccaacacgcgtgagccgttctcattcagctgtcccacgctgatgatagaattcctcaacgtggggatgtagtagactccggtgagcagcctatgctcaccggacttggcggtgaaggtgacggagccaacacccttgatctccacgccggaggcgttcccgaacttgacggagcctcggacgctggagtcgaactcggtgaagaactcccgtcggccggtcatgtgatgggtggcgccggtgtcgaggtaccacccatcagccttgtcgttgctggagccgttgcagagggagacgagtaccttcggctcatcaaggtggaggaaagccgctgcggccggtgccgctggaggtagttcgatgcttgcgtgagccaagagcagagccggctttttctcctccacccgtgcgacgtgggcctggccgcgtcgtggctgtcgacagtctttggcccaatggccaagcttgccacagttgcggcaggcgtcgtcttgtgccggcttgtggttgccggtggcaacgccctgggcgcctctgcgggcgccaccctcggcacgttttcgcgcccaccgtagctggacaccttcccgcaccttgcgcggcttacggccgcctgtcgaggaagatgactcccccttcctcccgtcaccctgagaggcctcccactgctcccgagtgagatggagcttcccgccaatggtgatgggccccgagagaggctgtggctcattaccatcgacgaccttgaggcgacctaacgcctcctcgagcgacatcgtggagaggtccagcagagattcgatcgagcgagcgatctgcctgtacttctcagggacgcagcggaagagcttctcgacagctctctcctcgtagtaggtgtcgtcgccgtactgcaccattttctgcaagagagtcttgagacggagagcaaagtcatcaatatcctcacctggcttgaaggccaggttctcccactccttgcggagtgcctgcagtgtggacttgcgggcgcggtcgttgctgatgcgtgccgcagcgatggcgtcctaggcctccttggcagtccgcttctgggaaagcgagaactgcatctcgggcgggactgcagcgatgagggcatccagtgcccgccgatcctcgtcgtagtcgacgtcgccgtaccggactgcctcccacatgtgccgcacctggagcctcaccctcatcaccgcggcccactcgatgtagttggttttggtgagggtaggccacccaccgccgggaccaaagtccctgaccaccgtctggacgccgtggtgaccatggcgcaggtcaagggagagagagccgcgctgcctgcgaggggcgcgtgcgggctccgggctgccgctggcacgcccgcgcccgtctgggttcccgtcggcgggcgcgcggtcccttgggccgccgccgccgccgtggaggtgggctgctgcccaccgctctgcccgctcccgtgcccttcctcttgccagctcctcaagctccctgtcggcggtgatgtcaccggcgatggagccgttgatgctgctacgcaaggtctcaacctctacctccgccgcacgtgccgcatcttccgccgcctccgcctccgccctggctgctgccaactccgctgccgccagtctggccgccctcgctactgctacagcggtctgagccgttgctcgcctgcgctcttctgctgcagcgagctcggcgtcctgctgacgccgagtgctcgaggcgaccgaactccgagaccgagcgtcggacatggcgcacctccggggggctgctgcgtggaggggggaaagggaaaggggaaggaggagcaaccggtgctgctgctgctgctggctgagagctcaaccgagcttgggaaggggtggaacaagagatgtttagcctacaggaaagtgtggctctgataccagatgttagaatttcaatggttactctcattgaaaagaggatggcactcgagatggggcaattttctggttttcttcattcacaaaacacaaaagccatacctacccgagagaggttggatacatatatatatagccatagctggctgctagcctattgctgcaccctcctagtctaaaattcgaaatttgaatggggtgctgtcctagagggcatccaaactgaataaagcataaaggaggcataaagaagatgctaactgctgctgtcctactaaccgcagctgtcctagcaactgaaaaatatgctaaagggtagatgctgtcctgaaaaaggtgaaactacccaaaagcaaaaagaaaaatcacgaccaaggaccacaaagacttatccaacacaccagcagtgctgtcaggaggccgacggctaggtgagctagcacaacctggtgcggccggccacatggctttccgggtgtgaatcaagatctggatctggaaaaaggagacacttgccttgcggcgaaaggtggttttcacaacctgaaaggagagcagagatgatgggcgatgggaaggggttggggcagtggaagtatggggtggtaggatggatgtggaggcctnntttctctccccttccttgccgttatcgccgccccctgggtttggtctttgttgtcaggctttggtgtccgtgccatcctctcgaagctaaattccctccttgacataataaaagtccctatctgatgggggttaatgcttattattatagagcgcgcttgatcccattttcatataaagaatgctgtctgcatacctccaaattctctattcgccacttctcacctacttcaaactacttggtaatctttcgcatgccaagaaaaacaatacatcgacccttgtcatcttttcttaaacaaattataactacctttcgcgtcaaaaacagataaacgctaccactgtttcacttatccaatctcaatgcccacgtctcaatcctcccttattaaaaatatcactaaccctccgtgctttcctctttcaataatatggacttcgctagctccctctatcacttctatcaatatctcaaaatatgccgctgctagttagctctctcaccatagcctccaataccgtctcgtctgcttcttttcatcaacaattattactaanccgcggctgtttcttctgctatatatcttacataaatcgctcaattttcgcggacgcctctgttaacctaccgaaaatagactacctactatcgttcgcgctgactataatgttcaatacatgacatcaacacactatgtaccatcgtttaactacatagcttttatatcttgcgtcgactccacggccc

SEQ ID NO: 73029 - DNA, 1139 bp, Oryza sativa
tgctttaccatggaacatcttcaaaaaattaatcatgatttgacatgcttattgtaacatgaatgacgtcccagtgtcatttaacatgaatgagttgacagcattgctttactagcatttttttatttggcggaataagatatatttcaatattgaaatgcaaatgctaacacattaaatattccaatgaaaaaaaaaaaactataaccatagaaatcgtctcacctgagccaacctctcgtcacgcctggcaatcttcctctcacgactggccttgctcttggcacgcttaccctcaaactggtcagagagtgtcttctctcttgccttctcagccttagacttgcggatactttccatgagaacacgcttgctcttgaacatgttacccttgaccttcatgtacatgtcatgatacatgtgcttgtcaatcttcttggcctcacgatacttgcgcaacaaacgctgagcacacgcatcctactgatccacaggatcttggtggggagcctagcctccctggtacccctacgcttacctgcaaaatggcagaataaggaatacgcagagacattttcacactaaaataacaatgaacttaattgtacacaacgcaccatagccagagtgacgtcccttctgcttggcctcatgggctctccgtgcacgggacctggagtgaatcttctggggcttcttgataatgaacccatccttgaccaacttacggatgttctgacctgcaagcacaaaggaaaaaaaatcagatagccttccaagaatttcaggcatgtgatatgagtcacagatatatacagggcaacaaacttcagtatctagaacagtaaataattaataggatattttattggttcttgcaggaaatgagttgtgacctattccaataggacattacacaaactcgcttgcagataagctacaccataattcatacgctcagacaggatcataccacagttgtacaaatggtgatgcagaatcaaaatgaaccaatgagctttagaagttggaattgcaattgcaaaactgacaaaaaactgatcctttaatggtaatcatcatttgggcatgaattgccagcatcctaactgatttaggtaacgaataactcaacgaag

SEQ ID NO: 73030 - DNA, 11996 bp, Oryza sativa
atcaaccccggatttgtccatctcaatccgtgtacttttgtttataaccagactgagccacaaaataagccatacccactagacatgtgaaagtacggtagtgctttgcaccaaaggcccgaagaccggtccttatatggccgaggagctactgtcaaaaccatacaccctgagcccagcctaaaaccattttgagggttttgaatagagggggaggtgtgaatccaattccacaataatccaaccgttccatagtgtccaggtgataagagtattcccaaagtctagagttgtaaaaccacctaatgttgcctgattaaccagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaatgtcacatcctgatttttgtttcaggatttataaatcatttaataaattattattagaatttatattaaatgttctttaatttacaagtgaagttaaatgtgggaaataaaattttctaaatttaaagcatggatggatttaatttttattaaattctccatgattaagtcaactctctgaaatattctcggatttttcagagctcaattcctaaatgatacaaagaacagttcagtaattatttgatcattaatgatctaattagaattgttaagagcttttcttgtttaaaaaaaatccttaatttataaatttttgtttaattggaattattagaatttattttaaaagcttagaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaaatagaaaaaaggttttaaaatcctccttttggctttgggccgaaagtcagcccaagtctctctttccttctccctctctcctccccggcccagtcggcccagtccgccgcgccccttcctcctctctctcggccgctgacaggtgggtcccacctgtcaggttcgtcttcctcgctccgccgccgccgcccgaaccctagtcgagccgcgctgccgtctccttccaaatttggccgcgcctttccttctccggtgaaatctttagaggggaaatgatctccgggatctcctctaccttttctcttttggaatcgtcggctaatttcctttggaaataggcggattcgagtttgattcggattcgtgtttccccaatctttccttccgatgccggtcgccgtgggctttcgccgccgcgccctagcccctttaaaaggacccccgagctcccctctatccgccgtcaccctcgccgtcggaagagccctagcgccgtggacctcgctccgccgtcgtcgccgtcgctccagccgtgcttcgccgccgttccggtcgtcgtcgtcgctcggggaggtcgccatcgtggtcgccaagttgtcgccgtcctcgtccgcctcttcgccgtcgctgtagaccgccggagcaccgccgtcgtcgtcaagccgaaggtcgccgccgcttcttcctcgtcgccgtcgtcgtccgttgctcctccgccgttgctttggtcaccggtgagttcaccgcgatgcccgcatcgtcctggtgccctccgttcgtgccgaagcgccgtcattcgccggcgagcttgcgcgcccgagccgccgagccgccgccggtggtgacgtcaccgctgacgtcatcgtggccgtctgccgtgagccgccgtagacccgatcgatctcggccgtccgttttggatggatcgatctcggccgtccgtttccgtgaaccgctgccgtgcgcccggtccaccgcaaaccctagccgctgacgcaataaaccccttttccttttcaaaaataattcattattgcgtcataattcaattaaaatccatataagtgttttaatccgatttaatctttaaaaattcataactaattcattgtaactcagtttaatgtggttcaagttgcaaaagttgtataaaataaagatctacatattaaaattatccataaattgaattaaatttatttaattctttttaaatgcgctttaattagatttaatcttgtaaaattcataataaattcatttgaagtcagaatgaggccgttcaagtctcataattcatctaaaattatgatctacatgtttgtttactttttatgtattgtttatttggtttttattagtctttttcttcgttttgtgtgttagcttgtcgtttccgtcggtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggatattataacttgactagttgagctatatatattggttcagctagatattagatatgattgcttagccatgcttagaaacattagcacactattgggattacttatgactcattattatttaatgatggcttaatgatagttcacgatggtcaatcgtgattggttaaataattacttgccaactaaaatatgataaaggtgggttgtgagcacatggttttgagagtcgtgctcatggcaattaaggaccggttcgcgagctactgttgtgaaacattaaccgtgccaaccacaagccagcgtgggcaacggctttaccttttgtatagcatggttcattgcagagcaccagactgagaagtggcggagataagcccacgggggtcgctagggagtccatgccttgtttataagggggtgactatgatccgggaacggtgcactgtggtgggttgtgttatgcaaggggtaatgtcacagctcctttccgaggtaccgtggtggtactgaggcacatgctgacatgttgtgggactgtgtcttgtgggtacagtggtacacctctggccagagtaaaactattcgaatagccgtgcccacggttatgggcgggttgagcaatgtttttcgtgattagtcccacacctctcacaataattatggatgttatatctggtaataatttgcttagctcctggtttggagttagatctgtacagccgggtatggttgttcaggatggttgggcctgtgcagcatgggtgtgttgttcagtgttgattaaaatttctgattaattactccactgttttacttctcttaaatgttttgataaaagctgcttttgcaaatgagcctatattatgccatcctttggtatccttgtgcacttgcatatttgctgtgtggcttgttgagtatgtcatatgctcactcttgcaataatcaatcaacctcagttgaagaaaaaggatccagaaggagaagacgtttggcttataccccagttgagttgcctgtgggagtggagccggagcttcgctagattttattttccgctgcagttttcttcatggtgaggactaagtgcctctgaagtaagtgtttattgttttagttaatttgatgaatctgtatattaaattgtcagtttgtgtacctcggctgattcctggacgaggattttttgcacaaataagttcggaaattactagtgaatttccgggcgtgacaagttggtatcagagccatcttgactgtaggataagccaaatggtcaaaccttaaggactaattttccgaaaaaatgatttgtgaaaatttctcctttcttccttatctagaattctttgcaaattgtttcattgtctactcccctctctctttcaacttgagttgttctaagacattgaaacttgaagacgccaatgaggtctacttatggaggttaagaaaagtggatcgaggaaggaccgaagtgccaagtggacaagatggaatgaagtttggatcctaccttagaacctatgccgccaaactatcctcgaagaatagttagtagggtagaacgtttgttgtttgctttgtgtgtaggtatggttgcattcccatcattggagtagttcattgatgagtgtgtaactatactaggttgcttgcttaatcaacttaaacaatataatggtctatacacatcagatcagtgttaacctggttaaggacttgtctttagtgtaacccctctcctcctatcttctctaatctgcaacagatggtaaacactcacgccagtggaagtggaaacaataacaatgaagggaacccaactcttgctcaagttcttgctcaacaaactcagttaatgaacatgatgatacagcagatgcagaaccagctcaaccaagggaacaacaatgctccaccgccgcagaacaagtcaactgattttcttcgtgtgaggccacctaccttttctagcactaccaacccagtagaagcaggtgattggctacacgctgttgagaagaagttggaactgctccagtgcacggatcaggagaaagttgttttcgcttcacatcagttgcaaggatctacttcagaatggtgggatcatttccggatgaacagagcagaaggacaaccaatcacttgggcggagttcacggaggcattcaagaagacacacatacctgcaggagttgtttctttgaagaagcgtgagtttagggcattgaagcaaaaggatcataccgtggcagagtatcttcatgagttcaatcgtctggcacgttatgctccagaagatgtgcgtactgacgaggaaaggcaggagaagttcttggaaggtctgaaggatgaactgtcagttacgttgatctcccatgactatgttgattttcagcagctagttgacaaagcaattcgacttgaagacaagaagaacaggatggataaccgtaaaaggaaaatgactgtattccaggaggcacaaggtagtagccagaggcagcgtatcaagccactccaaattggtgaatcttcttccgctggtccaggatagtcgcagcagttgaacatcggtggtgagatcaaatcagagactaatgaaagcaatgaggttaacatcgagcaagctaatcatccggtgccagttcagcaggatcagtctcaagagaataacagtagtggaagggagcagcaggtatgtttaaactgttacaagccaggccactttgcaagagagtgtccgaagccaaagcatcagcagccgcaagtcaacaacattgtcgtcacaggagccaatgcagtgccagttgcgtcttcaagagttgcgtcttcaagtgttacaactcagccaccagtttcaaagcggcagtagttttctttaaagccttagaataattatcggagttatggaataagatagactgcagtttacctattccctttttctttctagccgttccgaatctcgggacgagattctttgtaaggggggtagatctgtcacatcctgatttttgtttcaggatttataaatcatttaataaattattattagaatttatattaaatgttctttaatttacaagtgaagttaaatgtgggaaataaaattttctaaatttaaagcatggatggatttaatttttattaaattctccatgattaagtcaactctctgaaatattctcggatttttcagagctcaattcctaaatgatacaaataacagttcagtaattatttgatcattaatgatctaattataattgttaagagcttttcttgtttaaaaaaaatccttattttataaattgttgtttaattggaattattagaatttattttcaaagcttagaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttcatgaattgctctttaaatgaatatttgtgaatttattcatttaaaatttaatttaaaaagggtttattgcgtcagccgatgggagagggcgcgcggaccgggtccacgggaatggggcccatgcggcagcctcacggtccacggtggaccgggtgcacccgggctcacaccggccggcgccgtgggtcccacgcttcagccgcacccgagggcgcgggcggctgacggccgggccccacgcggtagccactcggcgcgcccgagggcggccacgccggcgcggtcggcggaagccggcgcgcccgcgccccgatggtcgccgccggcaaccactggcgcggcggaaaggtggccgagagaggggagggaagggggaaaggaggcgacggtccacggctcaccccggggcgacggcggcgacggaggaggcggccggagcggagggaggcagcggcgcggctcgggtcgacggggtcgacggcgttccggcggtcggcgaccgacacggagaggtggacgaggttggcgaggatgcggcgaacccgaatgaggcggcgccgaggtgggaggtggtccggggcgacgacagcggcggaccggagctcggcggcgacggcggagagagagagcgacgtcgcgagctcgaatccggcgaggaggaagggcggcgagaggcggaaacggacggaggaggtgcggggagggtttaaatagggttggaagggggagagagcggccggaggggaaggaaaccggcgcgggaggtccggccgccatcaatggcgccggcgagatttgcgggggcaaatccgcccgtttgaacgcgagagagagagggaaaaatggggggaaagggagaggggatcacggggagtaattccccccactttattgcacgcggggacggcgagaggcggcgggattcgcggcagcggcagcgctagggcgcgggggaggcggcgggagcggctggaggaaggggatgacgggtgggccccacctgtcagcgagggtggcgggcgggcccgcccgtcagcggcgtgcgcgcggggagaggccggatgggccgcggggagaggagagagagaggggggggaggagagatgggccgggccggcccaagggagggaagggggacttttagggtttttctttttataaaatcattttaactttgtttatttcttaacaattattatttgtgctctgaaaattccactaaaatttatttacgcattttaggcttttaggaaatatacaaaaatcctctaagccttatttgacttttaaatttgcacattttaattgttggaggctttcacatgaattttaattattctcggcacaatttcgaggatgtattttagggtcgttttgggacgtgacaaacctaccccccttaaacggaatctcgaccccgagattcggaagaactggcgaagagaccgggatgggctgccttcagctcgtcttcacgctcccaggtagcttcttcttcggcatggttgctccactggaccttgcaaaaacggattacccggttcctggtcctgcgctccatggtgtccaggattttcactggcctctccacgtaggtcaaatcttcgcgaacttcaatttgctctgagtcggcctgctcggatggcactcgaagacatttcttgagttgtgacacatgaaacacatcatgcacgttgcccaaggaggcgggcagctccaactggtaagcgacttctccgcgtcgggcaatgatacggaaaggacccacataccgaggtgcgagcttcccttttgtctgaaacctgtgtacacctcgcaatggcgtgacccgaagatatacaaaatcgtccactgcgaattccaggtcacggcgacggttatctgcataacttttctgccgggactgtgccacctttagattatcccgaatggttctgactttaccttcagcttctctcaggatatcagtcccgaacacttggcttttccccaacttgatcccacattagcggtgtccggcatttgcgcccatacaacgcttcgtaaggtgccatttgtatgctggtttgatagctgttgttgtaggagaactcggcataggggagactcttatcccaggtcttcccgaaatctaatacaatgcgcggagcatatcttctaggatctgatttagacgctcggtctgtccatctgtctgcgggtgataggcggtgctgaaattcaatcgagtacccagctcttcttggagcttcttccaaaagtgagaggtgaattggcttcccctatcagatatgattttcttgggaacgccatggagactcacgatcctagcgaagtagagctcggctagcttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactgacccaccagtatttctccttcaagtctaagtacatcttcgtactgccagggtggatggaataaggactttcgtgagcttcctgaagtatcagctgtttaagttctcggttatctggaacgcatacccgatttccgttccatagggttccgtgttcatcctctgtgaaaccagcggctttaccctgtttcatattcttgaggagtccatgcatgtccgggtcgttcttctgagccttgcggatttgatcgagcaaggtgggcttggcttccaacgcagtcaagaatccacgactaactatgcttaggttcagggcttccatctgttgattaagttcgagtggaatgccacggacgttaagagtgttgcagtggcttttccgacttagagcgtcggcaaccacgttggccttaccaggatgatagtgaatccccacatcataatccttgatgagttctaaccatctcctttgccgaagattcaggtccgactgagtgaagatgtatttcaaactcttatgatcagtatatatttcacagcgattcccaatgagatagtgccgccagatttttagagcatgaaccactgcggctaactccaagtcatgggtagggtagctgccttcatgaggccgtagctgacgtgaggcataggccaccacatgaccgtcctgcatgagcacgcaccccaatccttggcgcgaagcgtcacaatacaccatgaagtccttgcgagtatccggcaagattaacactggcgaggaaaccagcttttctttgagagtttgaaacgccttctcgcattgtgggctccacacaaatttctcttctttcttcaataactgggtcatgggtcgagcgattttggagaagttctcgataaacctccggtagtatcctgccaaacctaagaaactgcggacttgagtaactgtcttgggttgcttccaatcggtgacggcggtcactgttttagggtccacagcaactcctttagcagaaatcacgtgccctaagaatttgacttcggacaaccagaactcacacttgctaagtttggcatacaattgatgttcccgcaactttcccaataccagacggagatggtgctgatggtcttcctctgattgtgagtatattagaatgtcatcaatgaaaaccacaacaaacttatccaagtattccatgaacactttgttcattaagttcatgaagaaggcaggtgcattggtcaaaccgaacgacatcaccgtgaattcatacaatccgtatcgcgtggtgaatgcggtcttaggaatatcttcttcacggatacgtaattggtgatatccggaacgaagatcgatcttggagaatacagtggcacctttaagctgatcgaacagatcatcgatccggggaagagggtacttgtttttgatggtgacttcattgagagctctgtagtcaacgcatatcctcttcgtcttgtctttcttctctacaaaaatcacaggagcgccccatggggaagtactcggacgtatgtaccccttttctttcaactcttccaactgtttcttgacttcggccagttcatttgctgccatacggtagggtcgcttgtacagaggagtggttcctggagcaagatctatccggaactcaatctctcgcttaggcggcataccgggtagctcttccggaaacacgtctccgaactctctgactatggggatttcggatagtcctatctgatgaagttctgaacttctgacagaggttgggggtgcaaagaaaacaaccggttgttccggcccttggtacagagtgacagtgcgtctcgcgcaatccactactccttggaattgagccaaccaattcattccaaggatcacatccaagttcttggtgtctagcagaatcagatccgagggaaagggaatcccttgaatttctatagggacggcagggctataatactttgctgtcataacccctccaggggtggtgatgagtagagggtttctaagcctttctactcccaactgatttctccccacgaatagcacagatataaacgagtgggaggctccagagtcgaacaaaatggtagcagggatggaatgaatgaggaacgtaccaacgatgacgtctggagttgtcagcacgtcctcggccatcacgtggttcacacgaccccgaatgacatccttcccaccgttgttggggcggggaggcgcttggccttgctgacgccttggcttcgggcatttatccgcaaagtgcccgggctcgaagcagttgaagcacagacgctgctgaccttgagcgtccctgcggccttgaccaggctgcacagtttgcgtaggaggacggggcgcacgagtcccttgttgattctgctgttgctgcggctgtgggacgcgcaccacgaattgaggtcgaggcgcggagcgaggttgctgctgctgctgttgctgctgcgaggaggatccccctggatagggattggtgtagcggaccctttggttagcaccctgttggttgcggaaattcgccaagcggcgcttgtgcgactccagttccttgtgcttggcttccaagcggatgctcttgtccaccagacgttggaaatccggataatccccagagactagacggacggacagctcggggtccattcctgccaggaacttctcttgcttctcctcatcttcccgcacatcctccggagcgtaacgggccaggttgttgaactcatgcaaatactccatcacggagcggttgccttgcttcaactctcggaattcccttttcttaagggccacgactccagcgggcacatgggtcctccgaaaagcggcggtgaagcgagcccaagtaataggctgtccctctggctgcgtagcctggaaatggtcccaccatagagatgcgggtccctgcagctgatgggcggcgaagatgactttctcctcatcgctgcactgcacagtgtctagctttttccccacggcatgcaaccaatccaacgcatccacggggttgttggagctagagaaggtaggtgggcggatgcggaggaactcggcgagtttagagtgttggggaggtggtggtggggcattctgttgtggcggattttggaggtggtggaggaaagcagtcatcatgttggcctgctgggcgaggatttgggtgagaatggcgttggtgtctggtggtggtgg

SEQ ID NO: 73031 - DNA, 2627 bp, Oryza sativa
  unsure (1)..(2627): unsure at all n locations
gacgaagagggatagaaaaacatagtgaaaaggtagggtccgatgtccgtgaggaaaagtaacggtaggatggggcgaggcgagcagggtggatatgggcacgttcccagatagtggaacgcataagagattagatcgcaaaggcaaacacggttaagtagaggtcaccgggcgaaaatttagggtcaggtggggccgacggcagaataaggatggacctggaagcgtcgcatgggaaggtatcgataccaggcgctgtcacccagcagtaccgttgggcacaatgcggcacgggcagggcccttgatcagggaggggcctcctcctccccctccccctccacggcggtggcggcgcccgtctacgcccccacgccgcgggaccgggccctgcggacgccgcacagcgggtaagccgtcgcccggagactgatcatcataccctcgattctgattcagaaatgtaggattcagtttggattcctgctttagctcggattcttcggcaatccttttaacatcatgcatgtttgagattcagtatgcctaattgaaatgatgtgatgggatgatgctgtcaggtatcactatgacggcacggcgaggcccttttttgagggatggaacttcaaggtgtccattcccgagtgcaggcagagcttctgcttcatgtacttttgcttaaaaccctttgtttcgagatgggatgagtgatctggaatcggttcatacatggatcgcgcttcactggcgtcggggcacacattcttggcgcctttgataagtacatatgccagttcaccgagaaattcaataacttttggggaagtaagctacttttttagatccagtctttttcacattcaccctcaaagacatttcatttaggatatttttatttccattcaatggtgaaaggaatacatatttgcgctaacaatcagctttttgttctgcgcaaaatcctaaccggctgactgtaagatatttaataaagcaagaatagaagaaaggttattaccaactagttcaaaacaataccaccaaccgccctgaaatcatagccgctctttcatggttacctgaactcaacgaacttgttgcatttcccttccatccttcttgtctggtgcagattgatgaaaagaagcttgtcacagagctttattctgaaccatcacctgaatttgcaacggaaaaggttgcttagtacgatgcaagtatgcaacatgtcctctttcacgcacctttagaatttctaatcagcctttttgagatgagacctaatcaactattttgtaaaagcaagctttcttcatattagagattgatttgaggaaataaatttgtgaaaaaaatatgtttataacaacagggaattatattgtgaaaaatatgttgataacaacaggggcttatattagaaagaccttgtggtctagttctcgaaaaagatatagatgtgtacctgtgtagctcatcacaaacctgttctgaccaataagttggttccagtcttgataatagtgttgtgctgccgaatctagttaatgtgcttaacaagtggttattagttagggatacctaacaattactactttacagccttctgtcattatcaaagttaactaagatgtcaatttgacaacaattcctattggtttatattcgcaaaacctaataagatcagaactaatttgaaatcatgttgttcttttgacggacatacttgtactttcatactcatcctacatcttcccaaacagttcaagtgcatatattcttaggagtcttatttgttttggatgtagtgtgcattccatgcatctataaaggtaaaaagtagtaaacaaaactgcagatcaaaagtcagaacaatgcaaactaagatgcagtgcagatattgattacttcatgcttctgttatttgtagttggtattgtttttcctgttcatatggaactttagtagtgcatcacagtatgttgatttccaaattaataagctgcatttcgataggtaggcatgaactaatgctcggaaacactttcattcccaataatggttcaacacccccagaaggggaggttccccctaggtagattctttatggattcttatgaattgcaaaaactcatataatgatcttgaactattcttcgacttaacattttttcctattaacatatttttaaatgccattcccttgagctactccacatttatttgttattcagtaatttattaaaaaatcttagttttcttggttaaattgtgggtataacggactaactcttatatctagcaatggtgggtccttatgcattaaaatttttttgattatttcacaactacctaatggggatgaattttctttcaataacagaataatttccccttccatttaattaaaaatataaggtggcctaaaatgttaacttacactttcttttgttaggggtctgtatttgacactccttggctaattgtgaggcttttgtttaagaatcagataaaaaatgtttttatcacgcgggtgctgaagggaattaagatataatttggagtttgttctttacaggngagtttttatacaaaagagggtttatttatgtggcaccctatttt

SEQ ID NO: 73032 - DNA, 681 bp, Oryza sativa
tgaagcgtagggtggagcgaagcacaagcagtgagcagagcgaggtggcatacatgattgacatggctgaaattttagctcaggtttgttaacttgcttgaagcttggctcaagctcaaaatgataaagatatcagagcatctgatcaagacatacatgatctccacaactcataaccgaactactcctagatagattgtgaccattactaggagtcaaaatttagcgcaccatccatcaagtgccgagcgcccccatcgcaatgaggtgaggttagcaagcagtgcatgttatctagttctcaaccacacacattaatcaagtggcgaggagacaccacctcttttaaaattgtaccactatctttgaactagaaaggtaataccgaagttcacatgcatacctcccacaaggtggacctttgagaattttattttaactactctccgtatgggccaaaagcccaaatacaattctagcatagtcaatgtcgctaaagaggatgactggatgatagctaaagaggatgactggatgacagaagaatggtggctcatggtttacaaaggtaagacgaggaatcaaagtactccctctccctttgttttatattataaaatgttctacccttttttattattaaactttttttaagttttgaccatgtttatagagaaaatg

SEQ ID NO: 73033 - DNA, 7168 bp, Oryza sativa
  unsure (1)..(7168): unsure at all n locations
tatatttatgatgtggtgctcaccaccgtatagaggagaagatattgaacgtcatagtaagatcaaaatcccaataaaagccgacaggattttctcctctctcttgtataatatagaagtattgttttcccatataaaagcttatagagtcgccacattattttttatcatatataaacatcttttcaatgagatggatagaaatacgtggagaacttcactttcataaattgtttcactcccgacagagaaggtgtctccacacatggaatattgtaagtgatttctagaatgtcaaaaatcatatttaatatttttgcattatattgacgaataaattttttttcctattaaaattttttaagagccaattcctataagttccccccaatttttataatccaagtatttacttaaaaaatttaaattttcctgtttaaattggggtaaaaaataacaacccttaaaaatcaagcaaggttggttctttatgacataaaattaattatgattttttcccaactactaattgtgcatattttttttttcattaaccaaatttatttttcaccaacaatattaataataaatattaatgtatgtactaaaatgcatatacttaacatcatctagttgtttaggggtgctgcttattgtgaacgttccttgtccatactgtgcagtgcttctgtattaaagaattcaagtaaaaaaatgtttatttagtaactggtgtgcctgtaagggagattcgcagtatacattcttgtaagctttgatcctttctcagcgtgcaagttttttactaaataatgagatgtcttatctattattctgtttaccctgatatttcctctgatttgtaacttatcactctctacattgctttacatgccaatggctttcttcaagtaatcaacggttattatgtttcattaggaattttctagtcgagttttggaaggcttccaagtgacaccgatttggcatcaaggctttatacgtgatgatggaaggcatgtgcatcttgatgtttatctaagatctattcttgtaactattattatgtttctatgttttattgaaaagtcattacagtttacttactgagcttttttttttgccaatttagtgcgaaatgcttctttccatagctgaactataaagaatagttggatctgcatgttgagaatttatttatttttagctcatcaacacaatgctaaatgaaataacctgagaattgtattctggtcaatcaaaatataatattgtagaatcatgtacaaaatttgaaatatctgcttagtacgaaactatttggagaggaaggtttgcttgtttgtacaaaaggataatagatattagtatccttcgaataccatgatggcaggattttctgccaatctgaattttgaaatcaggcagatggatttcctaatctgtaaaatggaattatgcatttatgcaattgaaaatatgacaagacaaaatgatgagtaaattttagaaaactaaaactatttgtcaaaactattaatttgctacaactttagctaggcatttcagagaactgcaactacattttatgattttatcataaaactacaactttatttgcttgacaagtttggaccaacatgctatacacatataccatactcatgctcctgcaagttgggcccacatgtcataaacacatagggggataaagtcgtagctttcttataaattcgtttgcaattgttgcaattttgtgaaatatgttgttaaagttgcagcaaagtgatagttttaaccatataattgctgttttgttaaatttaccgtaaaatgataaaatgaacatagctctttcgctgtcacttttgaagttcatgaaagcaaacacacttgatacgcttattgccttgtcagaaagggatataaaagtttctatcctttaggtgctccaaatttcttgaactatatattgtgcccaaacacatttttaatagcaaattcaactgtagagaggaaaggtgatgcgacaccatctttgctcatacattgcacttaacttaatataaattttttttaggaaaaaacagtagttcgtgtgtaaccacgattgcaggtaattaagaaaattgctctggatggtttgattgtatcgaatgttacatattataagaaaaaaaaagaccttgacaatgcttttagatttatttagtaatgttatgcaatgtgtttattactactatgatgatgcttatattacatgcaaatcctagagaacaactcctagcagtttatgtcaggactggatacaataccgtaattaatgtttcccttcaaaatgtaaatggggattgagtagaaaagagagtttacactttattgctattaaatgaacaattaaaatttaaattacctgttgctcccctgtcaggtcaaagtatgtgccaaatgtccaaacagctaggtgggagtacagcactcgaccagtatatggctggggtgatgtcacgtcaaagcagaaatcaactgctggttggcttgctgcttttcctttctttgaacctcattggcaaatatgcatggctggtggcttatccacaggtttgtatttctttgtatttgataaactgaacagagagatatttaatttttctttttacctactggttttcattctaggtagatggcacatgtgccactgagtaatttactgaatgatacattcatctctcatgtgtaaaactatcatgtacgatggagttgtatttcttagcctaaaatgtgaaaattggttttccattgatgaagctttatttcaaattttttctttaatatttctgtaggaatccaaattgcactaaaaaataccaggaaatgtggctagtcctatctatatgtccaatccttttattccattcagtatgatttctccagttcagtcctgtagtagcgcacgattgattgaggtgatatgatatagtgttaggaaggttataataatattaagttaatagttcaatactaacttctgcaacttaactactcaggatggattgaatgggacggagagcggtttgaatttgaaaatgctccttcttattcagaaaagaactggggtgcaggttttccgaggaagtggtattgggtgcgtttttctatcttctttctgaccattaatcctgatgtaatggatacactggaatactgaataagttttgcttcatttacagatagaaaatatgctgtttcttgctgtaattctgtgttttgtgttgccagtaatgttcacccgtagtagcttttgggctgtttagatcccttgcctcacctggatttaagagtttaggcctccagtaacaacaaaaatgcttgctttgcctggcaatctcacctcattgagcaaggatattgttagttccttgctcacagggcaatgtttggcttgcatctcatcctgcatctctttatcaaaggaagctgggtgaaggttctgaacaaacccaatatgcatgaaggtttcaagaatggcatgcaatatgatggttgtagtggtcatgataaaaaataccttctttaaacatagtgtggtcggttgaaagtagtcaattttactggtacatttagtcatagttatagaggttatgcacttttaaatattcatgatatagctaggttacaaatacttgtcgcttcacggttcgtaatgcacattttccaattttatccatattaattatctagttagttgtggagggtaatatggtcatttaacatgaaaacaaatgattacacaaatttatgtgccatggttaaaagtgacaagtaaacgtgaatggagagagtatgttttagtttgactcaaaacttcacatgaatgaccaaacttactgattgaacacctttgctcatacaggtccagtgcaatgtcttctcaggcgcatttggtgaagttgcattaacggctgctggcggattaagaaaaattggattgggcgaaacctatgaaagtccttcactggtagagtcctgatactttcagcttttaatctgatgcatacttctaatttgttctgcaacttagctcatcatgcaagcttgattgctggatgtctgccagactgccagtaaggcaaaagggaatattattgatcaaccagttggcctaaaaattttgactgacaaaatcttatccatttccgaagtatgggtttattttcatttcaggactggtcattgatacaacattttatggatttagtggataaatgtattgctggtgatggttatgccacaaattagaatcccctttaccgcagtggttttaagtttagatcttttttgtgtatgtatcatgaaagttacactaattgtatgtatctaggcgacttttcatcccacagaacatttacatctagacctttgacagtcgaaacaaccaacgtacagaaaagccaccagggtgagtaaaaagcattggcagcataagcttgtgtgcagcctgagacagggttggaataatctcttgttccaaaaagaagtgcagcatgctttgtttcctttaaatgtcctgtggtgtttctgtgatgttattatggattcttcctcttttatagaaggtccaacgtcattcttatccactttcttgctttgcttttgtactcacatccacatcaacaaaaccatgtatttattgagaccaggtaatagatatattttctttagccagtaatttcaatacgatgcttgtttgctttgtgccctgcatattaactttcataagaggaagcatacaatgatcagacagaagatttacgaatttaactatgcacatacataacagttctgtttgttccctgcagattggaattcattatgagggaaaattctatgaatttgtgccttggaccgggacagtgagctgggacattgccccttggggtcactggaagttgtccggcgagaacaaaaatcatctggtaattatcatccagcgtgctgaaaatgtaatgcagtgcctgtgctagttggctactgttcacattcgagcaagattcccacttagctttcttacttgtattatagattctcttaggttgtaaggttacttatgtggttctatgttccttgattagcattcaatgttctaaaagcagattatctaggtgctaggcagcctgctggcctagtatccaattaagtgccaggagctgatctatcaccggactagtgcctagcacctggtgaatgcgacccttaacatgcattgctacttttctacaggttgaaatagaagcaaccacaaaagaaccaggcactgctttgcgagctccaaccatggaggctggactagtgccagcatgcaaagacacctgctatggtgatctgaggctgcaaatgtgggaaaagagaaatgatggtggcaagggaaaggtatgcatgcatgataataaggccatcagaatttttcagatagctgatgtattattgcactattactcttgttgcaaaatctaaggtgccagttgggttagctgcctcgaaaattgaactttattatgcaattcacaaggagggccagatgtagcatataatatgcaaatcagtatgcggcccaaaagtccactactaccttcgttccaaaaagagtttatacatgaatttggacaagcacttgtctagataggtgtagagaaaacgaactcttttgggacggaagtagtaatactatttttttctagattagcttggggctgtttggatgggactaaaatttttagtctctgtcatatcggatgtttggacactaattagaagtattaaacgtagactaatgacaaaacccatttcataaccctggactaattcgtgagacgaatctattagccctaattaatccatgattagcctatgtgatgctacagtaaacatgtgctaattatggattaattaggcttaaaaaaattgtctcacgaattagctctcatttatgtaattagttttgtaagtagtctatgtttaatactctaaattagtgtccaaacatccgatgtgacagggactcaagtttagtccctggatccaaacaacctaatgccactattttgccttaggaaatattgaaagttaaggacacaatgaactctgatggattgatggcctctatagttatctgcccccggagcaactgaaaatttattaattcatatatgataatatatgcatgatactatctgtcctgtcaggctctccatattcaaatactagaaaatattttaataacactctttagcctttacctaagcacattgtgggatcaatttctgattctgcacatacatggtcactgttcagtatagacacttttattgaacagaatatagtgaccgacttcattgatagtcatcaaggcatgtaaccatgatccaaatcaaaaaaactctgcttatttactctaaaaaactgtaacaagattatatggtgcattaccaacaaggctacaatgtataaaaattcctagttgttttcagatgatactcgacgcaacaagcaacatggcggcactagaagttggtggaggcccttggttcaatggttggaaaggcacgactgtttcaaacgagattgtgaacaacgttgttggtacccaggtcgatgtggagagcctcttccctatcccatttctcaagccccctggtctgtagcattgttcaggtcgagccatcgataggtagagatgaataggccctccaatcttgtcacaccttgagtcttgatctgttcctcacttagcatcatgttttcagccagagaactacagaaacagtaaaccaatcagcatggagtttattctcgttgggttagagaaaggcgcctttcgggtgaaatcatgttgcacaaatttttacagatcaggaatggatgctgtaattcaagaaaataagtataattcatcttaggcagttccatccttttgtgctcatctgaacttctgaagtatcataaagaagtgatagctggatgcccgggcctgcatctgcaattgtggaggtctttctggtcagaattggctggaaacaattgttgttagcacacttcatatggtaaatctttggggatcctctagagtcgncctgcnggctgcgggatgcagttgtacaaacaaagccag

SEQ ID NO: 73034 - DNA, 2071 bp, Oryza sativa
aaccagcgaccccaaaaaattcatgacaaatccatctatcatataatgctatgccttttcttgcaacgccataatcccctaatatacattcctttccaaccattgggccaattctgcccctcccaatgcattcagtcaatacttccaagcattccaggaaatccctcgacctcatgcaagccaattctgccacctccaatgcattcagtcaatacttccaagcattccaggaaatccctcgccttcatgcatctgaaaaagctgccagaaaatccctcggcctcatgcatctgaagaagccgctcagtgttcccccctgtatgtcttcacttccaagcattccaggaaatccctcaccctcatgcatctggagaagccactcagtgttctccactgtatgtcttttcaagtatcagtcaccaaatatttaataacccctcatagaattttttgagatacactagtgaagttgaagctggaattcttacatactcatcttgttggtcagcacaaaaagcatatgctaacatacgcataactgcagtacatttttataagggtgaatgtcctggccggccaagtacattaagacgatgtgtgaagtatgaagtggctcaacaatacgaaagaacaatgggtttcttatgcgaaaatgatgacgaaagtttctcttcattgtacactggattatcctgttggtattttttatgaccacaaataaattcgcaagcacacgaaataccactgttgcactttaccttcgggtgaccccaaaaggattttgaactcagggaacatgtataatctacctaaggctaagacaatccaaggacaacaactattggtaggctagctaggctaaagaggactttctatgtgttttaattatttaagctaagtaaaggtaatttcctatctgctgcttcgggcaccgacccttgctagtctgccagcatggttccggctatagctctatgatgcatccgaacgtggaggattactaggataggattcagggctgtcaccaactgtcgtttacctctgacaaatccatgggatacacaataaacaaaggtaatctctaacctagacaccatgcctaagttattaattactaatctaatacttgtgcagaaacttccttctttatccagagtctagtattggagcactcagtacgaatactaaacaatgaacccgcaaatatgaaaatctatcttagactaaataattaaataacataagaaaagatcccgagcagagtgtaccgacagctccggtactcctccagaattcctcctagaaagctacacccattgaggtagaagtcggagatagcgccaaactttcgggcactccttcagagcttccccttcaccctctacctattttttaatgtacaaaagatacaatagagcctcttataattcagctcaaagttgtgtgtgttgtgaagtgaagtgagcttcttcttttatagcctccatatgatggttacaactatgggaattgtccaaaacaccctccaaccgtcattgggaataaatcaagagcgtaaacgtggaagatggcgatcaacggccttagaacaggtttggccgaacccaaaaacccacattttggccactcctttggctgggaggttgttaatgggcccccaacatcatgtactatgatttggcccaattataagtggttttgattgacatatgggccctccaatccatgtaaatgtgtcctgattgtccggaggtgtattttgtcgtatgacggacgtgttttctccttaatatacctgcattcaaatatttcaccaacactagtggaaatgattaggaataatccctaccactaagttggataccatattttatttcattatatacaagtattgatggtcagatattatgatttaagaatcgtcaacagtatgatatttccttccattgccctcaatgggatcagtggaattgttgagccaagcactaaccaacaattcaatgtagtggggtaaacatactagtttcactcaccttaatatcatcttcatttaaataaaatggaacaaatg

SEQ ID NO: 73035 - DNA, 8080 bp, Oryza sativa
cagagaaagagctaacaattaaaactaaccacccacgactaccataatttttgaatttattactgctattaaattggttcattaatgttcaagttgcttaggcgaataaaataagacaggctccgacacagttatgccacacaccggcataaccatgccccacacgactcaaaaagacaaacgagaaagaacacacgcgcaagcctactaactgctcgtctactgctgcgacgggccaggacggaaggtgagcaacagcgcatcctccgtgctaccgacgccggaggcttccccctcctggggaaccacgggcgcgggctcggcacgaggggtctcgatgaagcaagtccacgccagggactgacgaacaagctcgggcctggaggtgctcttgcgggcggtgatcttctggctgcggcagacgcggcgacgcttggggcgacagacctttccctgggcgatcttgagctgatgcagctgcgcctccaccgcgtctaggtccttcttgagctgcaggttctcctggcgcagttccaggatcttcatgttgttctcgaccatcccgcgacgtaccatctggtggaagtcgatacgagccgcgttgtacgcctccaccatccgcgccaggtgcacgatggtagcgtcatcctctgagctagcatcccggaaggtggcgtagtcgcgggctcctccgcgacgagggtggtagcggtagggcgagtgttgcaactcgtccgggtagcgctggtgaagagtgccgatggcgaggagagcggcgttctggcaagcggtggggaaggaatctccacccgcggtgactgccagcgaagtccgctcgggagagccagagaggatcactgcagtgacctcccaaccagcgtggggctctgcatcgtcaccctcctgctccggaagcggcctggcctggtagtccactccgtgtggataccccagaaccacgcacatgccccgcaactccaagacgaagccagtcatgtccaaaccacgacgggtgacgctgccggccatctacaaacaaaaacaaaaagaaaagcaacattttcaaaggtcagattttggcgataaatgaagcagcaagacagagagagactagaggattttcacaaataacaaaggatttttatttttgaaaatattgctaaggcttgggatctacggctcgtcctagggtcaaaggtggctctgataccaacttgtcacgaccggaaataacccaacgggcattccttacgtgcgtgcattaatccttgtcccaggaggcaaggtacaccaaaagttgatacaattcagagtataacaagcggaagcgtaaatagttaatttattacatgggcagcgagggcccagcacacacaaagacaaacgagaaacagcggaagactagggtgacaaccacaggcgcttgacggcaggcacgagctagacaccaaagccttcatcttcaaggagctcctcttctgggtttggaaaaattgagcaagactgagtacaaccaccgtactcaacaagacacacccacaagtgcaggataaatgtaaaggagtacaagggggttatgatataaagggttagggtttgtagtaaacagccttaaaagacacttagttgctcaaagctattttgtaaacacgtttccagagctatacaatattattaatcaaggctgtgaacccacacgagcctgccttaacccaaggcctacgatgattcataccgaactggcaacccgaccctgggtcccagctcgtcccaagccaacccaggccatccgttccaccttttagttgttaagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccttagacaagagtaccgacccaatcccgcctacggccggaacctccgggacaggcaggcaggactgagcccctagcagcagggcaccaaccctctgccatgacatctcgactaccgggccgcagctcgtgtagccttcatttgccctggagaatgtccatcgacccccgacttcatccatctccaatccgtgtacttttgtttatgactagactaagccacaaactaagccttacccactagacatgtggaagtacggtagtgctttgcaacagaggcccgaagaccggtccttatatggccgaggtgctaccatcaaaaccatgcaccccgagcccagcctaaaaccatttttggggattttgaatagagggggaggtgtgaatccaattccacaatagaccaacaattccaaagtgtccaggtgatgagaatatcccaaagtcttgagttgtaaaaccacctaatgttacctaattaaaagcgaagcatctacctaaaatcatactagtggtaccatgagtagagtgtccactagttggggttttgtttattctagggtgaacaaggtaataataacaataacaataataatatggtcataacaaaggtaaataggcatggctaaataaaacagtgataacgcggggatttaaataaagcgataatgcaataatttaaatcaacataattttataaactgggattcaatatgctcaaagatgatgtgacttgccttgctcgctttcccaaacgtcggcttcaacttccacgaagagtggatcttccgaagctgtagcgtctacacgaccaacggaaaagaaaaggcttttactctaataaactccacataacagcagaaacaaagcacaaaaatgggttcttgacttcttaaggaaaagttagagacttgaacggtccaattccgagttcaaatggccaagttatggccatttgaagtttatatgctctttaaatggatatttgcgaattgcttcatttaaattttaattaaaaactcatttattgcgtcagccgggagagagggcgcgcggaccgggtccacgggagtggggcccacgcgccagcctctcggtccacggtggaccgggtgcacgcggctgtcgccgaccggcgccgtgggtcccacgcgtcaaccgcacccgcgggcgcgggcggctgacggccgggcccacctggcagccgcggggcgcgcccgaaggcggcctcgccggcacggccgacgggaggcggcgcgcccgcgccccgatggtcgccggcggcgacctccggcgcgacggagcggcggccgagagaggggacggaagggggaagtgaaacaacggtcctcggctcaccccgggtcgacgatgacggcggaaacgacaaccggagcggaggaaggcggcggcgcggttcggatcgacgaggacggcggcgctccgacagtcggcgaccgaaacggaggagcggacgaggtcgacgaggacgcggcgaagccgaaggaggtgacgccgagtcgggaggaggtccggagcgacgacggcggcgaaccggagctcggcggcgacggcggagagagaggaagacggcgcgggcacgaatccgacggggagagtgagcggcgagtggcggaaacggaggagcgaagcacgaggaacgattatatagcgtcgggagggagagagggcggccggagaggaaggaatcggccgcggaaatctcggccgccattgattgcgccggcgaggattgcgggagtaaatccgagcgaatccgagggagagagagagggaaaaacggggggaaagggagagggaatcgcggggagtgatttccccctctttatggcgcgcggggacggcgggatgcggcggattcggcggcggcggcggcgctagggcacgggcgggcggcgggagcggcgcgaggtaggggatgacaggtggaccccacctgtcagcgagggtggcgggcgggcccgcctgtcaacggcgcgcgcgcgggggagggccgatgggccgcgggggagaggagagagagggagggagctgggccgagccggcccaagaagggaaggggggggaaaagaagacttttagggtttttctttttataaacctttttaactttgtttatttcttctcaattattatttgtgctctgaaaattccactaaaatttatttacgcattttaggcttttaggaaatatacaaaaatcttccaagccttatttgacttttaaatttgcacattttaattgttggaggctttcacatgaattttaattattctcggcacaatttcgaggatgtattttagggtcgttttgggacgtgacaggttgcttccaatttagcactgactcgacattgcttggatccacagcaactcctccagctgagatgacatgaccaaggaacttcacttcgggcaaccaaaattcacaattactaaacttggcatagagctgatgctcacgtagtttctctaaagcaagacgaagatgctcttcatgcttttcttttgtcttggagtagatatggatgtcatcaataaacaccatgacaaacttatccagatattccataaacactttattcatcaagttcatgaaaaaggacggggcattagtgagtccgaacgacataacggtacactcgaacaaaccatactgtgtggtaaaagcggtcttaggtatatcctcctcacggatttgaagttggtgatatccggaacgaagatctatcttggagaaaactgtagcaccggaatcaaaaagcacagttgcgggtatagagttaacaggaaacgtacccaaaaccacatcaggtgcattctgggcttctgcagctacaacatgattaacacgagccttcggtgctggagcattggagtcattctggacaggagcattcttcacacgtcgaggatttggacacttatcagcataatgtcctggatcaccacaattgatgcacacccctggcttgcttccttgttccttcctgacagactgattctgtgttggagctgctacaggacgagtgaccacattacgattgttgttgctgcgattaccagtgttgttgttgtagaactggcgttgagggcgaacaactgaagaggatcctccctgtgggtatggtgcagcttgaggtcccatagcaatgtgcggcctctggctactaccctgttgagccttgaattgagcagccctacgcttcttctgttccatcctattgtacttgtcttcttggcgactcgccttgtccaccaactgctggaaatcccggtactccatagccatcaatgcataagacaactcatcattcaatccctctaaaaacttctcctgacgctcttcatcagtgcgaacatcttctggggcataacgagctaagcgattaaagtcatgaaggtactctgtgacagaacgggatccccgattgaatgctctgaactctctcttcttaagtgccacaacacctgatggtatgtgtgtcttcttgaaagcagcagtaaactcccgccaagtgataggctctcccgcggctctgtttagacgaaagtgatcccaccactcagcaacaggaccatgcaactgatgcgaagcaaaggaaaccttctcctgctcggtgcactgaatcaaatctaacttcttttccacagcatgcagccaatcacctgcctctactgggttagtggtgcttgagaaggtaggtggtctcacacgtagaaaatctgccaacttgttttgtggaggtggtggttgattgttgttatttgcctgctggttctgcgcttgctgcactaatagattaatcaactaagtttgttgagccaagacttgggcaagtgtgggatctccttcattgtgaccacttccacttccacttccagtgcgggtgttcaccatctgaagaaaagcatgggcaaaaggaaagaacgacagagagataccattagaacggagaactttaattaatttcaattctatattgctcttaactgtgtatgattacatttaaattgaattaacactatctcaccagctaacttactctctgacaagcaaaagaagtaaactcatgtagttacatcccaccaatgatgtaagcaacacgctaaacccacacacacacaagcaaacttaagcaagcaaactaacacagcgaactacggaaacggtctaactaggcaactaatcttgccttgcgtcggaacgaagagatggatcttcctcctctggagtagctggctctctttcttctgggtcttcctcttcttcctcatcacttaagacatggatgacaggttcagcatgatcaggcacagcatctcccaccacatgagtctttgaagctaactggagacgaggtggtggacgggttctcttccttgcggcgaggcgaagcttgggtgctggcggtggtgcttctcccttaagctcagctagttccttctgcagacggtacaccttgctctccaacttgcaaatcctggcacagttccagttttccctatcatgagctgctttctcccgctccacgcctactgcatccatggcgctaagcatatacacagcatgtatcagagtggcactaccttcgccttcaggacagttgtaagttccatagtcttgaccatgaggcttgtgtggatgatactggaaagctaatgactctaactcctcatcaaagcgatgacatagctctccaatggccaccaaggctgcttcctgataagcatggctgtactttcttcccccagcttcaaactttatcgacggaaggtcttcatgatcactagccaacgtcacgcgaacacgacacttctccttgttggggtcatggggaatctggcgatactcgggggcaacctcatagcctacttcaaatgccatcaatctcagctccctgacgaatcctagcacatcgatcaagcttttcggtggatggggcggcatctaaaggaacatagaaaggaggaatttatgcatatatttaagttagctgcacatactagacttaattaatttgacccaaaaagaaaaagaaaagaaaaggaggaaacagaactaattaaatttcgaatttttcttttctgaccgaaacataaattttcagaaaccaatttgtttttctgaattttttttcgaaaatttttatttatacaggagcacagacttcggaagtaaacaaaaagaagcaaatatattttcttcctgtacagtactcgtggaaacggaactaaacaaagtttttgtttggaaaatgaaatcaactttggacagagacaaattgctttagacaaatgaataaaacaaaactaaaatacttaggatctaccataagcacggtatagtgtcaccattaacagggatgagtagtgctggtgctatcttgattgaatcgataccataatagatgtacagtgccgactaaccaatgaaattcagaaaattaaactatttaataccctgaacagtaaagtttttttttaaataaaagaacatgtttctgttttggtaaagtaggatttagtaaatttggtacataaccttgcatgtgctgccaacttaattaatttgtaagagaatagagaagagcagtcctatttttcaaaatattttgaaggctacttaaggtttaccatttggcttatcgtaaggtcaaggtagctctgataccaacttgtcgcgcccggaatttctatccaaaattccaaatgcttacacgtgcgttaaatcctcgtctaggaatcagccgaggcacacaataacaaattgataatagagtactatcaaacatctaattaatactcgcgaaataaataattattacagaggtggatagttcctctcaaaagaataaaattctacgcagcggaaataaaaacaaaagatggaacagctatggcgactccactccacaagcaacttgacccgaacaaagcctaatcctccagatcatcaccttcaccgaagtactcctctgatgaatgaatattgcaagattgagcatatgacatactcaacaagccacacagcaaatatgcaa

SEQ ID NO: 73036 - DNA, 40784 bp, Oryza sativa
  unsure (1)..(40784): unsure at all n locations
gaagtattggaggaaaaagtaaaaagacatatttgcaaatgaaaaataatttatgaataaaacttttatatacaatgttcttaacgatctgaaagcaaaggctaaaaataaggataaaaatttcaaaattaacttcagatttaagcttaaaaatttaaattttgatcaataataagtataaatataggtgaaaaaatgaggatactatgggcctgtttgggggagcttaagattttaagaagcaactggttggtagtcagcttcttagaatctggaaaagccgggtttcccagtttctggcttctagttcattttctaaattctacaactacagcttctcagaatctggactaaaagctagactgtttgtgggagcttctgattataggagaaactgcaacagctagaaactcctccaaacagaccatatagttggctagagatgttgtagcctttctctcatataaaactcttgacacgaatttgatatagtaacaatttatcccctcacaccaccataccaccttgaacacatgcacaccataaccagcctgaattgccattaattttgataatttgactctttgcaaaaactaattttacaaataaaccgccgccaaaacttatttcaaaaatgacccttttgttcagcgccaaatagcgtggcactgaatttagatacctcagcgctaaatagcgtggcgctgaatgtacgttggcacgttgactcagccttccatccacgatggcacgacattcagcactagatgatgtggcactgaagtgtgtaagttcagcgtcacacgatttggcgctaaaaaaaagggtcacttttgaaataagttttgacggcggtttatttgtaaaattagttttttaaaaaggtcaaattgtcaaaattaataccggaattgccatatggacctatccaatcatgcaaccatgatcgatcaatcaatccaatccaatccaatccaatccaatgcatgcatgcggcgtcatgactcgtgccagatttttttcagggctcagaacagatttcaggattcaggcaggcagcagtagtgtgctggcctgttgcattcgtgcatgttgcagcaacagccacgcgtcagccttaattaaatgccgccgttgacgagctgtacggcatactagtagcacgtcgaatggacggccccgatctgtgtctgcttctttttggacggatatgatgatgtgatatgcatgcgtggtacactgtttattttctgcctatcatatagggtgcgtttaggcactgtttagtaataccaaaacttatctgaacttctaactttccatcatatcacatcacatctaaaacttttctattcacataaacttctaacttttttttccaaactatcaactttccccaaacttctcttcaatttcatgaactaaatacagccttagttaacgttaaaattggaagtttggttgaaattgaaacgatgtgacaaaaaagttggaagtttgtgtgtaggaaagttttgatgtgatgaaaaagttagaagtttgaaaataaaatttggaactaaacttggccatagtagtaatttttatcatgatttttgtaccacgttttttaaacaactaagtgtattctgtgcgaaaactttatataaaaaatattttaaattattctaaatttataataattaaaacttaattaattatacgttaataatttcattgtttttcgtgtcctaatttcatcttcaatagaaataacagccaccttagctaaatgttggaggatatggtcaacttatggcagttgctctcaaatcattctccctatgtagtttatgttattgaaaaattctaagaattaatatagtatagaatataaaaatgaactaacttagagattgaaaatcctagctttttttatttttattggtcggctaatctattatattattaaaggaatagaaaaaggagcctccacgttcactcttatggcctagaaattcccacattaatcggagaaaaagaaaaaacagagtccatataggaatacaatttaaaaataggtgaaattcggaattagaaaataaggaatattagaagaggagactagagtccatatagaaatacaattaggaaataactgaaattcggaattaaatataaggaatattagaagtagagtatagagtccatatagaaatacaattaagaaaaaaaaagaaagtcggaattaaaaacaatgaatattagaagtaaagtatagagtacatatcaaaatacaattaagaaaaaaatagaaattcggaattaaaaagtaaggaatattagaagtagagaatagagtccatatagaaatacaatttacagaaaattcggaattaaaataaataaatattaaaagacgagtctagattccatataggaatatatataatttacaaataactaaaatttgatattaaaaataattaataactaacacgtatataaaatacaatatgaatatgacacattagtagttttgtaaagttattgtaaaatttaaaattatgtttaaatataaaattttaatatatttgaataatataatgagaaaacatatatgctattatatgagagaaaatataataatactagtcgcgtaatctgtacgggccatcatgctagataatactaaattgtaagcggcttatcagaatctgcagctcccgaaacagcggctgtagcaacttagctttcgtttggttggtgcctgtttgggcgccggtgggtcgagaattgattgcaaagttaggagtcgtagcactagcaatcaattaataaacggcacgacggcgaggacgacggagagaagtagtgtagtcctagtgctgccattgttgcaggagtacacaggttgcaagtacaggccggcaatgaatgaagtgatagataggtgttgtgcatttgtgcatgagagcagttggctcttcgctggccccctgagtctgcctctgcctccctgcctgccgccggatcattcacggagctctttccatgtgccgtttgttatactgctactaaaagagtaattctacggtgctctttattggtagactagtaaaattaatctgaaccctctaggactatgttcggttgcacttatttcaattgtagtgtagccaattcgaacagtcctatgtgtttgttgctgcagcaataaggggtacattgtggtgtagccgaacagagcactttcatactactactttatcttctcgttttcccatgtcgtttaaaaattcattaaaaagtctagaaaactttaataaggcatgtcgatatatgatatgtcactcaacaaacgattcaaattcaatttggagagtagaaacgccaaaaagagtaaattaactgcatattggattagttttcttaatttgccaaaggtttcgccttgaactctcttgcacatttttttcacttttgaccagccttgtttactcatttttttgggtttggtttggaccaatggcccagctgtcagatcgtctatatatgagaacaaaaaacggcttccaaggaaagccctggttgtggagactggcgagctccctgacgaaatcctccaacgccatctacttggtgcaagttcgtcggcaacgagataacccaaagtgaaagtgtatattcggtgtaaaagtgaaaaaatggttcaagatgcaactgtggtaattactagttcgtcgtgcaaattcaaacaaaaataaataaattttactgcaaatcgttattcgcggtcaaatttgttgttttgtgtttctagtttaacttacatatttatctgttttgttaagagaaattaattttcgtgatagctatttagacgtacgacatgtataaaacggcgggaaaaaaatccacaggccgggcagaagcacatcattgtcaaagcactataaacagtatagtggagtactaactaatataggctgtgtttagttcacactaaaattaaaagtttggttgaaattggaatgatgtgacggaaaagttgaaagtttgtgtgtaggaaagttttgatgtgatggaaaagttagaagtttgaagaattattttgaaactaaacacagcgatagtaagtgatgtataaatattgagttacctcataatcaacgaaaaataatagctgtcgatgtataatatctattggatgattgcgagacgacgcatgcaaatgattcaatggttcttgttttgcgaacgatgtggcacaatacatgtttagttttcttttgtcttaattagcacaacatagtatagtagataaatgaggagaatatctatttgccactagtatacgttttagggcatgtttagatccatttgaaatgttaaatggcaaatggcaaaagttttggtggcaaaagttttggtattgtaaaagtactagttggtgtttagatgcatgttaaagttttgccattttagcactaaagtgagagagagagaaagaaagagggagtggtcccgaaacactttttggcacaatttgctactatggattagcaaatgtcaaatgccaaattaccaacttttgctactagtgtttagatccaaaatagcaaaaggtgctataaaataataaaacttttgttattttagaggatctaaacagtgcttcagtggttgggaagcataataagctgcaggaaggacgtgggtagagagagtaattaacgtgtcgatgttggtcgtctcaactgtcaaccccatgtacccatgcatatatgcgcgtacgtcnagccgtcacaaaggtaggattcacatgcnatgctagctagtcaaacgntgtgtgggtgagcaccggggcgttgcgtaccgctgtctcgccatgaatgatctacgaggtacccatgcatacgatgtcggcgagctaagctagctagcttgctcaccaacggtatatcgtcgaccagctcgccggctgcttgagccatctgacattgtagtcatatttagtgagattttgatagctatagctttttttaagctttcctaaactgtttaactttttatttagatgctaaaaagttgtggttatatattctacagaataaagtgcaaggtagaagtaagatgctgtgtttaattgttagctccttgagattctcataaactgttactcaaaatattaaacacaaataaacatatatatttttttggaactatattacactatatagtgactatgggcttattcacttcgttacaaaatccaatccttttaaatttccgaccttgatcaaatgcgctagctactgcgctgcgataacgaaaacttagagcaagtttaatagtatagtcaactactagctccaaatcatctatagccaatgtaatagccaattcatacaatagagacttactacactattaatatatggtcccacccatcatattcacattacgtcttgaagtccgtgatgcagctggctataaatctgtagcccgctgctcttctctctcttcttttatctctttaaaatatgtttatagctgacttatagtctgctattgtacctgctcttataaaccaacaaactaaacatgcatgcatatataacattatattaccaacaaatactaattaaattttggtaattccgaaactagcttcctactctcaaaatttctatcaaattttgataagatatcaaaccaaatactactcaaccatactttaattatcttattaaaatttgataacactaaaatattttttttctatttggttacactattatttatgggtgcgtcgcatgcttatatccaatacaactgaacacaatcctttttataatgatttaaataaggcaacaaggacataactacaccgataatattagctggatagtattaaagagagatacccttaacgggtaggtacactagcattgatcgaggatgagatggtgaacagctagatttagctagagagatctatcgattctcatgaaaggggacgaataatgctgcccagctgactcgctgaccgtccagtaatggatttggctgcgcgcatgtactgtaatttctgtgattcttcacaggttcagtaacaacattacacgatggatggatttgttttgatctgtccgttttcatatgcatggtgtttgctcgctgacaggctagctagcttagctttgctctgccagatcgatgcatatccacgaggccttgtcgccaaaaaaaacaacatggaccagacgtacacgtgtccttttgatctgcgcgcaatatatgctgagaagcagcggataaaattttgaaaaacagagggtttgttcactttgctattattttcaacattactaagttttggtattatcaaattttgataagcttgtcaaaattttgataaggttaccaaattttgacaagattttatatgtatttgacaataaactaaatgtaaacactttttttaaactttactaaaacttggtaaagttgaaaatggtaataaagtgaacaagtcctgagtttttatcaggttcttgctactaatttattttctaaaattatctgaactgttttagaaaacttctgaatacattactatggaagatgttacagccaccgaaacatcctcaaacagggcctacatgatgcccgaacaagacgaacattaatttacatatacaagtgtagttacctataacgcaaggtttaatttgatccacgagaccatgatttcaactttaccagtttgaaaaaaaaaactattattaatccgcgtatcacagttggatgtcgctgaaacttttacaaaattaaaaccgtgccattgagaagaaaataagagaatgaagaaaatataaaatgtgacaatgataacacgattctagttttgtaaaattttaataatattttgctgatatcgtgaacagtaatatcatcgacaaattaaaacggcatggatcaaaaactaacccatatcgcaatggtagttcgttcctctagctccgtgtggtgcctttgtgtgcatatacgcgcccaattagagcaggtacaatagcaggctataagccagctgtaaacatattttaagaagataaataattagaagggcagcgggctacagatttgtaaccagttgtagcacggactccaagatgcagtgtgtgtatgataggtgggactacgtattaatagcgtgatatataactattgtatgaatgagctattatattgactatagataaattggagctagtagttgactatactattaaacttgctcttatggacgtgcttacaggcgtacagatggagtaattaattaaggtacccacggaggagaacactcacgggagatcggacagtgatcgcaagcacgtacggcgtagtacttgctagcagcttgtggctacggcaattttaaccatttaatcactgcanaaaggcgtactttgctagggcaattaatcacttaatcactggaaaaaaagcaaagctacagtaattgttggttgcgatgatttgcagtggagttaattattggttgcgattgcgatgatttgcagtgctggtttgcgtgaggacatgcagatgcagagggattttgcctctccggcctgttgtttggtgggcccggcctgtgttggaggtagtggcgtgtcttcttgcattgtgagcccaatttggtggttggatcactcccattcccaggcccgtcctgtagaatattctagaacaaggccgtgacagccaatacaaaaaaattgaaaaagtatactagcttattctagcccaaaggccgtgagagccaatggaaaaaactaaaaaaaaaaagtgagacaatggggagaaaaaaaattccgttgccgggactcgaacccgggtctctcgggtgagagccgagtatcctaaccagctagactacaacggattacaagctgatgctgtacaattatccattttgatgtttgtaaagaatcacattaactatccaatgtatcctaaccagctagactacaaccgattacatgttaatggagtacaactatccagtgtcaatgtttcttttttttccatgtcacggattatatgttttacaattgtattgtttagaatcgtatcctacataggccaaagattttgaagggaatgaaacacacacatggaaaggaaatatacgccgtgaaatgccatatattttaaaattgtgtatggtttacaatcgtatacagatgcatgcatacaaaattcatcaagccgatgtgattgggtgaagatcataacacggatggcacgcgcccagtagagctcagcagtacagtcacggagagtatataagtggcgatctttttttccaagtttgcccgtgaataaccccttttccttcgccattggaaagctggaaaagcgtacgtctcctttccgttgacagctcgagctcattcatgccatccatccaccgtccacgcacttttccgcacagtgcagccgcaggtacatcttcttttaaatggagtatttcgttttcatgcaaacatttgctgatttcttaccctccatctgatagatcggccttccatcatgccattgtgaccgtccgatcagaaatcaacggtcatgattggttcgacggtgcgggaaagcaccaacaatgtagtgatggagttgttaatgcatgacctcatccatcagaattcaaattatggatttattacgtaaatgcaagtgaaagctttcaatgcgactttagcaaaatcacagatgtgctggatttctatctctttgagccagtgataaagacagatgtacaaacttgaagggaaacatcaacatatgaaaaagcttaattaaagcttttctaccaaagaggagaaactaggtaaaagttataaaataataaggaaatacttataataaaatatagttgtttggtttggttacattttagaatcaactatagttattataactcgacaaattaaatcatatacacacataatatctaacaaatccaaatgtgtttaagaaatttttgagagtacaaggtgtatccggcctatgctttgagcgcgtcttagggaatgcaaatcaaggatgtatgagtgtggtgtgttgcgtgtgcgtagtgatcatgtgtcatataataaaatggttcaatcgtctgacaaggcagggtgcgattcttttaaaattctatgtaactaaaagttgaattagatttttttaatcactatatactagtcgtaatattagctattatgcggttaagttaccgttaccagagcacaacgtaacgtggctatgcattgcacgctagggttcaagtgacagatcggttatataaactgctaaatggaccgctccattttccgtgcgcactgttcgtgttgaaaagtactacctccgttttttaatagatgacgccgttgactttttatcacacatttgaccattcgtcttattaaaaaaaattgcgtaattataatttattttgttatgagttgttttatcactcaaagtacttgaagcatgatatatatctatacatttacataaatatttttgaataggatgaatggtcaaacatatgttcaaaagtcaacggcgctatctattaaaaaacggagggagtagcaggaacaaacgcggaaatgcttcctatcagacgtctgacgctacaaacaaaaattggacaggcaaactactacttccctatccactccacacatccatacatgttataatgatatttaaaataattttacttctgatctacttatctaatatatgatatgatcataccattatatttattataattaaatctttataacaagatatcacatcattatattccgatgaaagaaaaacttatgtttcaatccgttaagtttaatgtttcagacacggtagcaatatgtttcattgtgagttttcattatgtttcatagaaaagttaaatatttcagtaacttattttttttgtttcaccacgtacaatgcttcacgctgaaaaagtatgagacgcatatgcctcacacacacacactctctctcatacattttattgtctttctccccacaccatgcatgcatgcaactatttagtgattttaaaaaatcttttttcttccaaactacttaacctatgagcgattcgatcacaccgttgaattcgctataattaaatctttacaacaagatatcacatatgattatattctgatgaaagaaaaacatatgtttcaaaccataaaaacttaatgtttcatacatgatataaatatgttccaccatgtgtttttattgtgtttcacaaaatttttatatatttcagaggctgatttttccatttcaccatgtataacttaatgttgcactaacgctcaactgaaacatttgtccgtccgattttttttacaacatcggacgatttggatgtccgatttgtagctctctccgaacaaacgcagccttaatcccgtgcaccagcgcgcgcggatctcaccgtctccgatccgatataaatatctctcgcacttgacgcgcgcgggcgtcggcgacgcctcgtctcgttctcctcctccttccttccttttcccgaccatctatcctccccttcctttcccgatcgcccgcgcgcgcccacgagaaagattgagaaaggaatccatgcgagcaccgagccatgcgaaaaggaaaatccggagagtgctacggctcgaacgtccggcatcacaccaaaaatcggacgtctaaacgagcgcatgtgagaacgaaccatgtcactgtaacgtatgtgcatagaagatgtttcttttcattctttcctcctctctttaaatatttttttctcctaaattacttatccgatctacgatccgatcacaccgttgtattcattgtaattaaatctttacaataagatatcacatgattatattatgtcaaaagaaaaacatgtgtttcaaaccgttagaacaaaatgtttcatacgtgatagtgatatgtttcaatatgtgtcttcggtgtgtttcacaaaattcctgaatctacctgctactactctctctccacctcatgcatgcatacatgcatgtattttagcaagcttcaaaatgatttttcttttaaattacttattcaatctatgatccgatcacaccgttgtattcgttgtaattaaatctttacaacaaaatatcgcatgattatattttgatgcagagtaatccaaaccagagtaatccaagaggtcgaatgtactgatgcagccttgaacgacgccgacgtagacgatacaattgcctggactggtggaacattggacttatcccttcgccggagatcgaagacgatgcagccccacgtcgggtgccaagttccgtcggaacgtaaaaacaaaagtagaagtaaaaagggtggcgatgcgccgaattgtattgatcgtgaagatagattacatagactccgggtgtacatatttatacccatgggttgatacaagtccttgtcggacaagaaagaaactaacctaaagataaaaggaaaacataaagtctttatcggacactaaacacactttcctaaagataaaaggaaactaacaaactattcctaattaatagataaattgccataccacatcctctttaaactcggtcacttattgataagcttcctttagtagattgatttccttaaccgaatatagcaggaatccgactattggcgacttgataactcccatcggctgattccgagatgctgcagccgataatgattctaaaccgatgacgtctttgccgattaccaaatttcactgttaacagttgccaaggtggcatgaggcgccattactttctctctcttaatcaaactttaaacaaaattttattctaaaatatatatccaatctataatttataacaagatctcacatgaatatattttgataaaaatatatatgcgttctagaagaaaacaaacttatgttgaactatttaaaaataattctttcatcacttgtggagatgtttcaacccacttcacaaattgttccaaagaggtacaacatataaaaagtattgacggcaacaataatcattattacatgaaacattaagtcccgactagtgaaacattttttatatttagattgaaacatcgtattataattaatgtttaaacataataaatgtatttgctgaaacatataaaaagggatagcatgaaacattgctaatgaattagtgaaacatcaacaatgcttgttggaacatttcagtaacaatgtgtgcaacatttgaaaagtaaatttaaaagtcgtcggaatatagtcatgtgatatcttgttataaagatttaattgtaacgaatccaatgatataattagtttgaaattcggataaatagtttaagagaaaaaatcatttaaattttaaaacatgtttgaatgcatgctccgttggtttgtcgtacacctaaccaaccgtttcaccatgcacctacactgttgttattttagattgagacgtccaattttttatttctggccggacggccgatggtaagcattttcgggaaaatcccccttcttgcgatcgatccatccatcgatttaaatcgatctccgcagcttggcctctcgagagagagatcgggatcgagagactacgaggtctatcgtccatggccgatcgagacacatagctagggtaatttgttgtgtgtcgtggtggggggctcgatcgatcgatcgatctccatggagaaggggaagaggcggggagggtcgtcgtcgtcgtcggggccacaggcagtggcgaggaagagggaccagttccccagccgggccaaggactacgagctgctcgagccggtcggggatggcgccaccgccgtcgttcgccgggcccggtgcctccccctcggcggcgaggtcgtcgccgtcaagattatgaacatgtcgcagcgctctgaagacgatgtggtacgtacgtatgtccatttcttcttcttcgtcgtctctggatcatgcatacttgcttatgcgagtcgactgtgtcgtgtcattggtgcatgcagcatccaaactcatgcaaacttaagttcatcagtaatttctagtaatctagttgcatgatgatttcataaattttagtggattataatttttttcgtaggaattatcacggccctgaaggttctaagtttatgcatgttttccaaaatgatcagttaagtctttaggtcaaaaacgtaattagtatttccaaaggtagaatagaagacatataaaacaaaattgtatactatatgcatactataagcattactgaatatcaaatgaacttgatacacaaattagacaatgaatctgaaggtaggcttaagtataagtttatttacttaactaatacttaagtcttcgagtcgaaaagaataactatttctaacaatggaatataatatctacgtaacaaaattgtgtatatcatgcatactgcgtgcattactgaatatcaaataaacttggtacataaacaactaagaagacttaagtataagttttacttattaagaggtcttgaagtcttcgggttaaaaagagcaactatttcgaaaagtggactagaacctatacatacataacaaaattgcgtacgacatgcatactgtgagcattagcccctctctccctctgtccctggaaaagcgatggtgctagcattcatgatagcaagctaagcaatgcacatgaggcattttcccaacacaaatatctctacattgtatctaaataagcaacgtaatcaactctttgtttcgcataatgaatttaatatatgtctttgggtgaccgtcaccctggccttaacttacttcttcttactaagttaaatctgctatgtgtttgggatttagacataataactaattaaatttatagtattgcattggagatgacttcacaacgaaacagtagatgcgagtgttgatttgtagataattgtagtcttattaataacatggttgtgcatacctctagatgcatagtgtgcaagaatgaaattatgaacatattactcgtcagttgtattgagagacacctatatttctttactttctgcagaatcatgcctctgaggaagttaaaatgatgagtactattgaccatgacaatctccttggtgcatattgttcatttacagaaggtgaaactttatggattattatgccctatatggctggtgggtcatgctttcacttgatgaaatcttcatatccaaaagggtttgacgaaaaatttatagcatttgtcctacgcgaaacattagaaggcttagcttaccttcatcgctatgcacttgtacatcgggatgtgaaggtatgaatctttctcatgcagagtttaataaatatgaattaattcataatttatatggctaacatgtattacggtaacacaccatatacttcatacgtgatcttaggctggcaacatactccttgatcaacacaaaggagtgaaacttgctgattttggggcctcggctagtctttatgacccaatgattaatagacatggtaaaagaaagactcttgtggggactccttgctggtaatttctaaagaacagaaaagaactatttgtgaattttaaactacccaagtcaatttaatgctaatatactatttattttgtttttccctttaggatggcacctgaagtcatggagcaaaaggaatatgatgccaagtacttatcaattttgattattggcttatcatctttcagttaagaatgagtgtttttatttttatatttttcaataaaacaaaagtcaactgtagggcagacatatggtcttttgggataaccgcacttgaattggctcatggtcatgcacctttttctactcaacctccagcgaaggtatttgtttagtctaaattttttattttttttcatagcatcatgataacttaataccttttatcaaatattgtataggtctttctcttgacattacaacatgctcctccatcacttcacaatacaaaggataagaagttttcaaaggttcataaatatttatatggtggctcaatatgtgtatttttaactatactaccttaattgtacatttgttttgcagtcctttaagcaaatgattgccacttgtctaatgaaagatccatcaaaaaggccaaccgcacaacatttattggaactcccatttttcaaaaaggtaaagtttgaagacaatgttttgaaatccgtgctaaataagttgccatcgttgggtgatcggatgcaaagtatacaggtatgatccctacatcgtcctatcatagtcaaatattcatcccttcataatattaaattctataagttattttctgtaggagaatgaagcaaagctgcaagctgagaaaaaacctcttgataaatgcaaagagaaggcatcacaggtttatagtactaaaaatatactttgcaatttttgttacactaacaacattgttatgacaaatgcattttctctaattttcatttgctagtgcaattattacttgttcacacctataaattgtattattgctattagaactaatgaatgcatctaaattggtgctaacattaactaagattatgtgagatcaggttgttatataattttaatttatggtaaccgtcattatctagaaatcgatactattgtaacaatctttgaacatttttttacgtacaggatgagtatatgagaggagttagtgagtggaactttgatatagaagaactaaaggcacaagctgcactggtacgagtatacttttttttgcaaaggttgtaacaaccttttaactattaactatataaagttttttttgaacaatgtttagtacccagatgagaatgatggcggcgaagatgagtatttgcgttttctttttgaacttgatactatttgtgaaagtgctcccatacatgacgttcaatcacgagattactctaaaaatgaaaatgagaaggtaattttatttttgagattttttatttttattttagtgactatgttaatatatacatatatctaataaaagtcacattttcagaaggaaagcaatgaaatcacaagaaatgagaaaatagatacgacgcccatacttcaaaggttcatcatcgacttcattcctttcacaatgtttcatttttttaatacaataataattttcattaaaataattatgcaaatcatttcacaataataggtgttccaaatatgtattctttaacaataaatgctcaatgttaatgccacaatcttttttttgagccaagtatgttattgatgtaacaactctcataagatgtttacaatgcattgtgtggttatttgaccattattgtgttttattatatcattgccctctacttatattacatacaagctctatcattttggttggacatgatttatttaggaatgattccatgagattctgatgtaatcgcaagcataaaaaagtttaatacatcatatctaacttagttgtttatgtcagtgtgaaacaacttgagaataaaggaagccctaatggcctcgtgcgccacgagtcatttcaacatcgacccaaatcacctactaagcaaatcacaagagcaggcatgtttgtacatttccttatcccaactaaaaaagtggcggttaaatgcattataatagttttaaattaagtattgggtaattagtattgttcatattttcttatgcttattattgtttcacacattttaaaactttgcattttgaatatagtataaattttggagtggtttacacacattagagcaaggtaagaatgatttgttttttgcagtatcaaattgcaaggactttgatgaatatcttaaatcggccattcagaaaggccgttttaaagtgacggtagaaggtgctgaggttgagaaggtaagtcttttattatacgaaaattttctatatgtgatcaagtttttaaagcattacttttgacttgtttattgcatgatattttctctaactataagtaggggtaaaacaagttatatgtgacatggtactcattttgaattagtttatatcataattactagtttatgtgcttatttttgttcaattcatttgtccttctcttgcaatttacatgttttggtagagtatattcgccgagtaaaaaaaaagaactatcagacgaacatcatatttgatatatatcatttcatatatagggtataaagtcattttgcatgcaccctaagttatgtaatgccataatcttcaatttagtttatcttggtcatatgattatctatattatgtatgtttcttaatttgtagcttcaacatatctagttttagttgttaacaaattgcaatccaataggcttatgaactagttaacgtataaatgctattgttaaacattgataggaacatttttaaagtaaccatttgaaatcttctttgtggcagttggaagtggctacaccacgagaaaaggaattattagaacggattgctagtttggagcgaatgtacgcctctatttgaaacaactttcactatcttaacatataattctctagtttaaagtgaaagtaatttatttgtttataacatcatattttgtaaccatatatctttgtaggctccatgatagccaagaggaggttcagaggcttagagaaaagggtaattgtaattttgtcctaaaattatacttcccagagattaagaggtttactttagattcacagtttatattttgttccacatgctctttgcagagataaaaggagcaatgtcatgcccacagctacagtagcaaagtccaagtacaacccaagttagtctggaaaaagtacaagacaatttctatcttattaggtggttcttggcataacattgagcaatgtcaaatgctctagctgtcataagagagtgtatagttttagaaaacattatgacattatgtcttagttataatcttagctcaccttctattttattgtgtctaaattagacatattattatctagaagaaaaggatctaggagtgcaaatttgatgtttatgatcattggtcaagcacatggctaaaatagagcacatgttgacgtggaaggctaacttatttgcttgttatttatgtgcatgtttccctacgatatgtcaccgaagacacatgcatcttacttgtggatagggtttgaattttcttgaacaacatctcataagcttgttccatcttgaatatagttcaattatcaaaaaatatttgtttttttaaaaaaatctcgctcagtattttccacggcaatatcttttttccctaaatatactccttgttctcccacctagttccttacaagctagcactagacaatgcatgcaatgcaagttgcaacatattcccttcgttctaaaatagaccaacttctagtgtttgaattttgtcgcaaaataaaccaaggcctatcttcttatctaccatcgatccataaattgagatattttatttcttcaataccccttacccaccctacaaccaatacaactttcttattataggaattttatagtcattgagaaaataccttaaggtacctaaattttacactaaaattttttggtaccttgagatacttagtacctagaggtaccaaatttttacattataaaatatggtacctctaggtactttataaaggatggtaaaattacccttcttattaatcaaggatattttggtcttttatctctcctttaatttttcttgatgcttagggtttgggttttattggggcgcaattcattacaatttaatactacgtccatcccaaaatgtacgatgttggttagttcatttttaactaatcaatatcatagggagtaatataatacttatattttgaattctaatgttcttttcttctatgaagttgaagttagcgtatacaaaatgggaaaaccattagtgtatgttaaattaagttttaattactaaagactggaagaataattttatttgatattttaaagcaacttatataaagaaaggcttttaaaaaagtactgtttgtagttggaaaaacgtgctaacgaaaatcgaggtaaaatctacatcttaatatgaaaacaatgggccttaaaatgattcataatagcaagtttagtaaaaggctataaaccaattgtaaactcatgtgaaggtgagagaactagaaaaaaaaagaatgttggctctcattcgaaagctaactcttcacatactgcgaaataaatatgctaaatgtataggtgagagaaaaagagaggagaagaaaattagagacaactttataactaatctattatatacgtcagttttatatgggtttatagctgatagctggtttctacttttaacttgctctaagattttcaccaagatagcacccaaccgagcgattcaggtgaccgagccgaggccgcctcaatctccgggcccatcagctgcaccacgtcaccggcccatacctcactatacatgggctccctgccgtgctccggcccaacaaaaagatggcgttaatccatctggacctctcgccgccatcaccaccctgcctggcgagagtcccgtgcacgcgccttctttaccattacgggaagaaggcaaggacaacggttggggaggatgataaggaggaagaagagaggtgtatagaggtagatgtgctaatacatggggcccgcatgattcccacgctatctcagtcgtcacatcagtcaacaccaagagcaatactgccttgagagtccaaagttgggacccaatacgacccggtttcacaaagattaggaatacgctgtatctgatattccagtccagagacgatttcgaaaatcgaggacaagacgagggaccccaagtgaactttttcctatacacacggtactagtaacccaacctagagattcaggcctggtcaatctccaggcccatcatcagcttcgccacgccaccggcccatacctcgccgggacatgggctccccgccgtggtccggcccaacaaaaaataaaagatggcgtgaatccatccggacctctcggcgcgggcacccccaccaccactccgccattcccggacgcctccccacctcacgctcctcctccttctaataaccccagcgatgggtgggagccgagcccttcccctctcctccctcctcgccgccgccaccaaatcccccctcctccaccaccgccccctcccgctccgcctcgccgcctccatgtcgtcgtcgtccccttccccctctcccgctgctccggcctccgcctccgccatcgacttcctcacgctctgctaccgcctcaaggtgacgccgacgccgacgcgcgcgacctctgctctgtatgcttcctctgtttgtgccgccatggggattggcccgtgacgccgttggtgtgtgcagacgacgaaaagggccgggtgggtgaggcgcggggtgcaggggccggagtccgtcgccgaccacatgtaccggatgggcgtcatggcgctcgtcgccgccgacctgcccagcggcgtgaaccgcgacaggtcaagcgtggggattccatttccttcttggctcctagcgtcattcatgtcttggtagcgagtttcattgttttttttgcaggtgtgtcaagatggcgatcgtgcacgacatagccgaaggtatccaacattttcgtttgcttgaattggatctgtacggtgattgtgttggacatgtgcatgccgtgggtgggttgtgttgaagcgggggatttgatttggtggagtaggatgttgtagcattcaagtgcttataattgtcagaattgttataatgtgcgtgttttatatgttacacaaatttggtaaagtgatgatgcgttgcttgcataattagatggtaatcaaagtttatgcaaaatgctatagatttggtgtaaacttttcctagttacatttgtaatgggccatgacttatcccttacaaactttcttgtagctgcatgcacattttccatgttataagcagtttgaatgaaagtacttgcatttattttctttattcttgcaacttttgataatgattggctgtgatgcgaagatgctgggttgtttgtctcacttaaaaccttttttccctgttctccagctattgttggtgatatcaccccttcagatggcgtgccgaaggaagaaaagagccgcagagagcaagaagcattggaccatatgtgcagtttgctcggtggtggtccgagaggtaattatcctacatgcaaaagcaacatattaacattctttgccatgggagttaaatctgcttcgatcctgtcaaaataatatttgtttatcttttactaccatatactccctccgtcccaaaatataataacttttagacctcagaatttgtcccaaaatgtaacaacttacccaccaacattctcttcccaaccaatcacaaccctccaccattcacttttcccacctacctccggctccactactcatccaatcacaacccttcaccatccacttctacctactttcttaataaccgtattcaactctaaaacttcttatattatgggatggagagagtatttatttaaagtaactgtgatgctagcgtaaattgctgaaaacttcctggtgaccgtaaacaatattcttagcatgccagcaagatgatccaactgttcaacttaatgccttattccccactatgcttgaaagtccaacgagaagacctgagagaacaattacgatattgtttagatgctaaaaatattggttccagctgaaatccattgttagccttgaattaatactcatcatccttctagtgatgttcccttgacaaccagatcatatcatcaaggaattacttattgctgacatcaggaaaatagttcaggacctagagatcccctaaacaggttgtgttctcacactttggaacataacgtaaaagtcctttaggaagcactttgaaacaaaaaaaaagactaccatttggagaaattgttcttcttgcaggaagcaagatagataaaatactgttgtgtaaaggacagactgaagaatatacaaacagtgttgttctttgtcctacaatatttgatatacagtaaacatatgcctattctctgtgtcattttattcagctgaagaaatccgtgaactttggatggaatatgagcagaatgccactttggaagcaaaggttgtgaaagattttgacaaggtacagttttttttgtccagctatgtaattatttatcttgctacccacaacgattggaggggattgaggtgtggaattaatcccttcctcaacatgattaaccgaacaacgattggaggggattgaggtgtggaattaatcccttcctcaacatgattaaccgaacaagtcctaagtgttagagattttgtctaataagtaattagtatggatgtgggagtttgtaccctgtccctaacgtgcccccacgggggtcgccaacccctgtataagtgtatatcagtatatcaatgctcctgcacttgcactatcaactgctagtctaatgaggcatgatgtctgcactcatcatttagaagataagaagttatgtaaggaaataaaaatactggcatgattggcatcatttgttccaggctattagatgtcagaagtgccatagttaaaaagtattgttaacattaggtgagcactatagacaattgagtaaccctcaagagacttgagatttggatcactgttttccttaacttataattagttgtttttcttctttctattcaggttgagatgattcttcaagcattggagtatgaaaagggtaagctcttattttgctagtttaatattttgatgtatccagaatcatccttttcctttttgaattagctatgaactatacagatatacatttgtcaattattcttgtcgatatgcaaggatcaaggaaagttagatcaaatgtggaatatcttttgcattattgtttcacaaagcactgacaaactctaaatagtgtacaaattgataggcactcagaacatcttgactatattaatggagtttacagtatcagtaatgcttatgtatctgaaattttgcagagcaagggctggacctagaagagtttttccagtcaacagcaggtaagatattcttgggatttccctccatcaaattatgttctgttgtttgcatgagcattcggtatactcaattgaaatctgcgcaatggccttaactgttcaatacatcacaacatgcttgcaccagagtggttattgttgacataagttttgttttctcatgaatttctatattcttctgggggtttttttctccttgcacttgttcttaattttccaacatatctttatagcaaccatttgactaatgacctaacatttattttggttaattgctttgcagggaaatttcagacagacgttggaaaagcatgggcagcagaggtagcatcaagaagaaagtgaaattaaccaatcacatgacatttgacaggccccctttggtgtttcttttccaaagataacctcaaggtttctgttaaacttcacccttaaagactttgttagctctgggccatttggacccgatgcttagagcttgagaattgagatcagctggtttcagaggctagttgtttttttttgcttaagctgggttcttgtagctcacctgcctgcctccgggatgctgattcactaggaaagccttattggccgtcctcgttgttgtgatgtaaaatcaactaattcagtttttatgccaatcgagtttcctcgtctcaattgttgctatttgaatcgttgttttagataaggacgaactgtggtcgctaactaaatatatccccttatactgttaaacctttcattagccagcatacttttgtcatgtcaattcatgtttttgtcttaggctctgtttggaagtgattttggtagtggtaactttcttatttttcattagcacgcttttcaaactgctaaataatgtattccctatgaaagtttctaccgtatgtatttcccattttacacgtcgctaatatatcaagcctaactgagccagtctctctctccaattatttcggtagtatgcactaagacaagcgcatcgatgaagattgggaccaaataagctggaaatgatttcatctcttttctctatatcaacatatggaaataatttcgccagatttcaagatatatatagccatgtcgtttttttgttgaaatccatagccgtttcatttttgttggcagtagaaaaaatggcataaatttcatcttgtaaagtggggagaaaacgaaactgatggtaccgtacgtacattaacaattgaacctatttttatgaatagattggcctacgtatgtttttctttaatcttatatagggtgtgttttagttcggggaaaagaaaatatttgggtgtcacatcggatgtttgaccggatattagaaggggtttttggacatgaatgaaaaaaactaatttcataattcgcttggaaaccgtgagacgaatttattaagcctaattattttgttattagcaaatgtgggttactgtaacatttatggctaatcatgaactaattatgctcaaaagattcgtctcgcgatttttcatataaactgtataattagtttttttatctatatttaatgtttcatgcatacatatgtccaaagattcgatgtgatctttttgggtaaatttttttaggaactaaacaaaaccatactctatctatcccaactataaaaaatctagggtcggatggaacatttctcatagtacgagaaaatgtctcatctggttctatattttaataatgtggaatggagggagtatgtttttctttaaatctcctcgtgtatcaccctactaattaatgcaaaattaattctgcaatgtctaatcatgatagtcacagtcatacaaagatggatttggatcgacctgttggggtttaatttatcggcataatagtgattcttacggttacgccaccacctcattcgatttatttcattctagagatgtcggtattaccctaattaactcattctcgatcaaagtagtaatagtaagatgttagttaggatcgacctaattaattaacccacacattaattaattacttcatttgaggcttgaaccaaaatcatccaactttaattgaccaactagcaatttttaacaattttatatgagcatgtgtatgggtaaagcatactattattcactctaataaataatgtcatgtcagctctaatactccaaaagagtgggtcgtaatctgtaatgtgacacgtttgatagtgttggccaaaagctataacgaataaagtacagtgtcccctcactgcagtcgctgttgacaattgtatttcgtgtctttgtttgtagaattgataattcaaagctaagaaaaatatctgcttttgtgcatctaatttgatttagacatggggaagcatgtgatttgatggtgctcgacttcaaccagcggggtttaaattttggtgtccacgaatattaagcacgtacaagtgagttttcagcaggattttaataatatcagggaaatgtcattggttagtttatcccataataagtacttctaggatagattccactcctaagtcctaaattagctcagctagttaggtttcctgtggtggaaccaacctacccacattcaagttctaaatttgttcttgtggccacattttcaagtcctaaatttgatagggtgctcgtatttactgctaattagtctttcaatggtagacagagtattcgtcaacagtgagccgtccgtggtaacttcattaatctcaagatgtacctgacaagtcttatagagatgctcatagagataggagttgcgtgcgtatgttcataaggataagtgtgtgcgtgctgtgagcgtctacctttgtattgtgtttctaaaaaaagtttccacttgattaaacccaccatatacagattatcatatgattatcatattgtgtgagatctgaactcctttagcatctcttgctagttggcaagagacaaacatcttacaaatgtatcatcttcctctatatatatatataggggaaggaaaaaaagacaataaaaaatggctgccagttgtctagctagcttgtacgggtatgcatggccacgagcaacggtgcaaacggtagctgcagtagtacacacagcatacggagtaggtgacaattactccctccagttttttttaaatgaagttggctagttcaaatttatactagccaacgtcatataagccttccagcgaaattaattagctgcagctagctacaagccgatcggagtagttgcgacaaaatggccaccagcgatgatatggctgcagctcatcatctccggcgccacctcccgtggaggcatgtcaacggtggtggcggcggtcggtctcttaaggaagcccttgcacaaccccgtccagaatcgacggtctggctcactggcctctaccgtccgccgcgcctcctcgcctatgccactctgcaaccaagaaaatcaaattaatataaagagaaggaaatatctatagtatatatggtactccatccatttcatattataggccggttcactttgatgccattttcaaccttaccaaattttggtaaagttacaaaaaaaagtggctacatttagtttgctaccaaattttgctaattacataagaaatcctgccaaaattttggcaagctaccattttggcaatgccaaaatttggtaaggtttttttttggcatcaaagtgaacagtccctataagtcgtttaacattttcctttatcaagcatctttaagtttatttttggtgaaacacaatacaacacatacgctcacccctcctataaacatacacacttcccctatgagcactcttttaagtttgatcaagtttatagctaaatataataatatttttttcattacaaaacaaaacattatatcaaaatatactcaatgttaaatttaattaaactagtctggtgtcgtagacattactattttttctataaagttggtcaaacttaaagaactttgattaagaaaaaaattaaatgacttataatataaaaagagagggagtacaatgttatgtcaagtaagattctatatatatccctatagggatttggtacatgagttgtacgtgtcggtccaaaagctatatgctcgttaggtgtaatgtatgtgttgttatatgttgcacaccagtgctctataaagaggccttaattaaaagtacgttttggttatatgattcttttttggtttagagcctcatttaatttcgcatatatttttttcatatcaaggtctcaaatgtttagagatggtgattaattttgcactgatgctgcttaccgtgatggtgttgttattgacaagacggtcgatgaggttgaggaggatgtcactggtgtactccgggtggccctggatgcccaacacattgtcgccgacggcgaacatctccaccggcgtcttgtcggagtaggccaacaccctgcccattggaggcacctccaaaacctaattcaattaagtaattaagcacacatcaacttacattttcaggtcaatcgattgattaattatatattaaggtacaaacatatcttttgttaggtattgcatatctaaatatttcttttgaaaatactagacacttgttttgttacttggccaggaagagaaagtgatcacagggagaaataataatagtacgcatatgattagtatgcagtgctatgccatgcattaacccagaagtacacattttcagtgtcaaggttttttttttttgagaatattttcagtgtcaagttgagaggtaggagtggtgctcaaatcagcactccaaaaattaagtcaaacaccgcccaatctagccaagtgtccgcaattaaggttttaaaacatgtgcaaatggctatagaataatgcaaacacgaaatatacgatatgatattatcaaactgtgtaataattattatattattaaaatatagcgtaaaagggccatcacagtcgctcttactggttacaagaattatcatattataatatgggaagaaagtggagattgtctagactacaacaattaatgtagttgatctaaatcaatgtagatgatgagaagtagaattttgtttttatataataaatatctaacagccatgtaggagaaaaaaaactattactttcatatcatttcaagatttattccaatattcgttctatggaaacttttaaaaaatatgataagtgtgctctcacctcatcttggtgaacctcgatgatggaggcactttggggaatttccttgagatccccaaataacttggacccctcaaaatcacgcacaaaggtcatcttcttcaccccaatgttccatccacttcgtgccttgccaattctaccacccaatgctcgacacaatacctaattaaccacacacaagaaaaaaaacttaattctcaatatttattaatattttcatgaagattaaccttcaaatgcccagttcattccaaaatattagcatttctacatctgcataagttgtttgtttgcgctgtctttcatatattctccaagaatatgaaaattggaataattataacacactaatttgtgtacaatttattgatatatatgaaaatgataactacctccgtctcaaaaagttttagagttgaacacgggtattaaaacagctggtgaaatttggttgggaagagaaggcgaatataaattttgaatggtggaaagtttcgattggttaaagaaaacaaatgtaggcggataagttattatattttaaaacaaattttaaaggctaaaagttgtttttttttattttgaatgtgaggagtatatgttggtagattaacctggtggccgaagcagatgccgaggatgcgcttgcccatggcgtggagcgcccggaggagggagcagaggcggaggatccaccgctcgtcgccgtacgcgtcgtgcgggctgccgctcaccacgaacccctcgtaccgccccacctcctccgccgccgggaactcgccgtcgatcacccggaagcagtcccacctctcctcctcccctccgccgccgccgccgccgagcgccgagacgaagacgttgccgtacccgccgtacaccttcctcgcgtactccgagtcgttcagcgccagcagcagcgcgtacctcctcccccctacgccgccgctcgccgccgccgccgccaccgtcatcgcgaggagatcgagtgcgtttgcgccggcgaggtagcaggactaagctgtgtgtagtacgttgccggcggcgagctctagctagctgtagtgtgaaattgccggcgagaatgcatggtgtataaggagctcggcggcgacgcgtcgcggtcgggtgtgtggaacacgtgatggggttgccgcgcattattaaactccgccgaaatggggatccatccgtgttacactgttctgcagcatgcgcgtgataaagttttagttagcagaacaagcgtgtatatatagacgcgtgcatgtatgtgtggaattaactgtggattcggcttatataatttgttattcgttgttgagctggctggcatttcgattgaactgggtcttagttttttttatttatgttgttttctttacggatgactggacatgttataggcaattgctaatgctgatggattgaatattgtaacactaattgtttgtataagaaagtcttttttttccgagaaattgtagtaataataatccataagctcatataggctgaaagaatacaacgttagggttcaaagtctagcacacctgaaggcttaaattgaattgagatttcaagctttgtaaacataggttgacgagaatagcaggagtcagtgattattatatacacagtatatgaagagtacgtacgtcttgggagaggtgtccatatataggatagaaggcaacatgataatgacatatatgtgaataacaatttttgaggagatcatgtgaaatatgagataatacggttgtaggtgttgcacggatgttaaatatgaaaaagaagacacatactcttagtttttgagatatatgatttatatagcttttaaaatgatcttaccctttttcatagcttttggaatatacatactgatctttgctagaaaataagttcatgagttgaaaataatgcatccttagtgtttaatttaagtcagacacacccagaggcttaagttgaattgagatttgaagttttgtagtgagtggtttttcttgaaataggttgatgagaacaacaggagtcgagtaattactatactatggtacatggttaatttaaagtgataggaggttaagggactattatagatctatatgcatacagtacagtgtatgaagaggtccggcatgggatatgcccactggatggaaggcaatatgataatgacatatatatgcagatgataatttaaggagatcaggtgaaatatgagatggatgtacggttgtagttgttgcacgaatgttaaatatgaaaaagaagtcatactcttagtctttggagagatgtgagttatagcttttaaaacgaacttggaatagacgtactgatcttcgctagaaaataagaacatatataagctgaaaaaaacattcttattttgtgttatttctcatgagttcccaattcccgcgcgcgcacgcttttcaaactgctaaacggtacgttaatgtttacgtaggaaagttgctttaaaaaaatcatattaatctatttttaaaatttttatagctaatacataattaatcatacgttaatttatcgctccgttttgtgtgcggagaggagggattaccacaacccagttggtggtgtctttacacataggttggtgataatatcatgagtcaaataaatgatgattagatgtctagtcacatgttttatgccataagaggttaaggaactgctccatccgtccaaaaaaaaagccaacctagaaagggatgtgacccctactagtataacgaatctggataaaaggctgtccagattcattatactaggaggtgttatgttttgaatagcacgctcagtacattaagaggattggtatcggaggtaaatataggacggaatacaacatgataatgacatactccctccgtccaaaaaaaaccaacctagtactggatgtgatatatgttagtactacgaatctagacatatctctgtccagattcattatactagaatatgtcacatccagttctagattcgtttttttcagaactgagagagtatgcgaatgacaattgagactaccaggtgaaatatggtatagatgtacgaatgtagctgttgcacgaatgttaaattactagttgctccgtttcatattataagactttctagcattgcccgcattcatatagatgttaatgaatctagacatatatatgaatctagacacatatatatgtctagattcattaacacctatataaatgtgggcaatattagaaagttttataatataaaacggaggaagtacatagttttgacggctgcattatatgtttactatatatatatgcttggtagaggggctataattttataatgaaaaagcaatgttgtgcccagatcaaaagtaactaaagaagatacatttagaaaaaaaaacacaaaggtaaacacgtttgctttgcttgcttgccttcttatttaatcattgtggctcgattaggaccttgctgagatccataacagtggtgtgtaacagtctacctgttgatggacgtgtccatgcattatcgggtctcaatcgcctgctgaatcacatgacattgtctgaataataaacaattaaacaaataatgagataatcagtaactaatttgaacatagacaatgtcgatcttttcgtttttttttcttttgaaacaacccgtataaaatagtgagatgtttttattgataaagcaataataaaatataagtctatagtcctataagtgtaaaactatagtcaggagaaaagaaaatacaactatgccacgtgtctacatttgattctaatgatagaaacataacatgtattctaaacaacgcctccaagaaaaaaaaaaagacgctaagagggtcgtcgtcgcctgttctatagagccagattagatatgctggagttaattttgagcacgagataaacgggtgccacgtttctctacctaaccggaattaacaatacggttttaccatttggaccgagcctttttttagtactccctccatcccaaaaaaagtcaaattctagagatgaatctagacacatatgtgtacacactggtggagaaaccctttgtagtcccggtttgtaacccctttagtcctggtttccaaaccgggagtaccaatccgggactaaagataggatctttagtcccgggtgaaataaccgggactaaagatcgatctttagtcccggttggtgttaccaaccggaactaaagatcgagctgaccttttttttttgcatggccctgttgctgcatatataaaccatgcatatatatgcatatatatatatatatatgaccaaaatatatttacattatagaaaatgtgtacacatgcatatagaaacatatgtagtcatgtattaattacaatccattatatgtcctagctagctacgatttcgacgtagtagtagtactcgctgctagctcagaagctaaggatcggtgaattgtgtttccgtcgtagtagaattcacccttgggatcaaggatttcttcgttgatgaatcccatgagttggtcttgaaccgccgcgataaattccttgtgtgtggtcaggttatccctcatgcgaataaactatatgaatgtatgaaattgattagtaattaaacaagaaatcgttacgtaatgaaattttgaatttatttgtacgtacatcgagctctcttgtggtgatgatttggtctgcaaggcagtggcaatactcacacacgtaatagccgcacaagttagttccctgcttttgctttgcgcactacaaataaatgacaaacaacgagagatataattaatatacacttgtatgtatttgaatcggagaaatataaatgtagagcatgtgtactcacaggaaatttgaatttccgcctaagtctttctctccatttgccgcggatcaaatgacggaaccgataccaagccctacatggagtttaaagctatgattcgtagtagcaattaacataacaagattttcttaattaatagaggaacttatgacggtacctgtctataagttcgaaaaccttatcaaacgtagactcttttttatccattgagtcatatacgttgacggtgcaggccgacaggtcgaagagtaaaagcacccagtggaatctgcaatgtgcgtgggatgcattacatatgaaacactaagcaagttcgtacgggaatgaaatttggtatgtagaaagacagtaaaattaaactaactctgtgttgtacggcaacagtatgaacgtcttgtaatgctgcgccttcaggagatggacgagattgtcctctgtttcttgtggatattggtcgagcattgcgacgtttactctccgagggtcgatgaatccagtatcgaaaaccctccgccgtcgggccctttgaatctccattctacaatgataaaagggagtatattattttctatagtctacttatatacaaggacctaattaattaaaggagacgtatagtaagaaatctaactgaacgatatacttacaaaatccagcaactcataatagagacgtcgagggcgtccagctggtatagttcgtagattcccttgaaattgatccaaagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtatcaataataaattgttctatcgtcatttctttaccggtcaccaacggctctatctcctggtttggttgctctccaagctgagggactggtttggactttctagaagatgctttcttcagcgttcgctcatagtccgatagcttgatggcctccttgacagatgcagacatacccctgaagaagttcctaacactggggtctataggaatcttcttttctggacttcgaggcttgaattgtctcttgacttctgatgcaacgtaagtgtcaagctcctcttgcgtgcaatcgtacgccgggtccttgttcttggcggcgtcaactttcgccttcttcgttgcccttgtgtgggcaggcggtggagctggggggcccttgactttgaaggtgctggaagaggagcttgcggaggagtaggtgtaggagcccgaggaggagtcggtgcaggatcctgaggaggagtcggtgctggagcctgaggtggagatggtgctggcggagcatgaggaggagacggtgcaggatcctgaggaggagatggcggagccggaggatatggtacacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttatgagagattatttattagtaatcaacatatataagcagcaactagcggaatggctaaatctaaaatatataaactacgagtttacctttattgataagttcttgtaaggaatatgcagctcacatggtgtccgctgagtgatgtcatcaacaggacaggtcgattcgtcctgtgtttgcatggcgtccatgctctgtgatcctacttgccccgttgaggcgcagctgctacagtttcctgacgggctcaccattgcaggaggaatggtcggctggggatcatgggaccgatgtgcggccatgcgttcatcaaccttccttgccacctcctcttgcatgctgagttcgtagctcaatacccggaactctagatctgcaatcttcgcctcggtatctctcttactcctcatccgactcctgtacgtgtggatgtcctccttgaaaccaatcttccaaggaatcacccatttccctcgtgttcgtcctggatgctctggagtctacagggcgagtgtcagctcgtccctatctctgtccggtcagaacgtgccctgagatgaggcttccactgcatctgttagtcgtcgcgcagcctctcgtatctgatcgccgaagaccagtgagccatcagctgggttgagcgttccaccgtgagcataataccagaacttcgatcgttccgaccaattggcggttgccggttcgaaacccctctcaatcaagctagcctccatctcctcccacttcggcttcgcgacgctatagcctcctgaccccaagtggtgatggtacttcttcttggcggcattttctttgtttctttccatcatcgcctgcccttgttcacctgtcttatatgcaatgaactcgtcccagtgatcccttagctttgggaatgtgtcgaagttcggtgtctgccccttcaggatatatttcttgtacaactctcccttgaagctctgaaactgttctgccattttcttcagagtccaccttttcactttgtcctctgtacctgcgggaagggtgaatgtctcgagcattgtggtccacagcatctctttctccgaatctgggacagagctctcatgatctccgcgtgcccttgttcttcgccagtacaccgtactaacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgtgtgccctcttctgtccaacggagggttgactaccactagcctcctcctcctggttcccctccacatcactttccacgtgcccctgctggttcccctccgcatccctctccacgttcccttcctcgttcaagtactggtttggatccccattcccctcttctttattccagtactggctgcttccctccgcgattgtatcatacaatatctgttcctcatcgtggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcatgacataagctaagtctaggtgacgtatattatacaaccctagctagtaaataattatatactaagtctaattacaaataaaataatcttatattaaagctcaaataatattacatgctaagactaaaatagtcatgtatatgctaagtgtttcgtgcgtatatgctaagtctaattaagactacaatagtcaattgctaggagtcgcaccaattccgtagtcaataattgcatactaattctaattacaaataaagtaatcttatattaaaactcaaataatattacatgctaagactgaaagagtcatgtatgctaagtgtaactgtcgtatatgctaagtctaattaagactaaaattgtcaattgctaggagtcgcaccaattccgtagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctaggagttgcaccaattccgtagtcaataattacatactaattctaattacaaataaagtaatcttatattaaaactcaaataatattacatgctaagactaaaatagtcatgtatgctaagtgtttcgtgcatatatgctaagtctaattaagactataatagtcaattgctaggagtcgcaccaattccgtagtcaataattacatactaagtctaatttgcaataaaataatcttatattaaaactcaaataatattagaacactacacattcttatatgctaagtctaattacaagtctaatattcttaattgcattacaaatataacaatcatttatattattacgtcatttgcctgcacgaattccttctagggctagctcttccactccggcttgaggaacgactccgacaacacgtcttttctgcaagatacaaaaaaatatgtattaggataaatgcgaagtaacatatatatatattgcatttcacgttcacgttcgttcgctcgttctcattcacattcgttctcgttcacgttcgttgtcgttctcgttcacgttaattcgttcgatcgttctcgttctcgctctcgttcgttcgatcgttctcgttctcgttcacgttctcgcgccaacgtacgttgacgtgttcgttcttgttcacgtgttcgttaacggcggtgtggcggcatcgggccgacgcttggcacagcggcgtggcggtgacgtcgttgcgcggcggcgaaggcggcggcgtggcgtgccggcggcggcgtggcgcggcgtcgtcgtggcgcggcgtcgtcgtggcgcggcgtctcgtggcgagcggcgtgacggagagagagatcgagatcggagatcgatgaaggagaggcggcagcggctctcaccccagagatgcggcggcggcggaggaggcggaggcggcggcgaggacgacgagctcgagacgacggcgagatacgtcggcgtcggcgcggggatttaccctaggcagtggcggcgaaggagagagtccgagagagatcgatcggccaaaaacattaagtgttggtggagaaaacgagggcgcgcatcggggaacaaccgggactaaagaaaagatctttactcccggttgttctcaacaaccgggactaaagatatctttagtcctggttgttctcatcaaccgggagtaaagatcttttcccgctatttccaaattctttttaaacccggttagggttaagaaccgggactaaagattatagcactgcatattattttcgcttacatatgtgtttctaaaatagaagttaatgcattaacattatttaaagtacaaagattaatgacaattacttcgaaaaattatttttgtctgtaataaattaagtggataaatcttaataagaaaatatatggcttaaaattaataaaaattccaataatcatatatacttagcatctgaatgatattattaaattggtaaaaactctaattaagatatgtatgtacatactgcatgatttaaaatgaataaaaattgtaatcatcatatatacttagtgtaggaattatattaaattaaatgttaaaaactctaattaacatatgtaaatgccacatgcatgatttaaaccttttaaaaattcgaatagtcatatataagtagcatatgaaagatagtaaattaaattgtgaaaaactctaattaacatctgtaaatgccacatgaatgatttaatacttttaaaaattctctagtcaattataattagcatatgaatgatagtcaattaaatgtagcatatgaatgatagtaaattttgccatacatcaattgatttatatggataatcaatacatccaaaatagtttacatcgtgtacacaataattacggcattacatcgccggtgacggttgaccgcacgtactttctcctcactattgttccctccttgtgatcgctgcgtgagtaaggtgtgtcttcatttgataggaggatgctagggtcaatcgtcaccgtgaaaaggggttgcccatccaactgatcataatcctcgtcagtcttgtcctcaactccgacgatttttcttttgcctgggagaaccacttgacgcttaggctcgtcaggccctctgcccttctttcctttgctagacatgtccttcacgaaaaggacttgcgttacatcattggcaaggacaaaaggttcgtccgagtatccaaccttgttaaggtcaacaattgtcataccactgtcatcaatcattacgcctccaccagtcaacctaacccattggcaccggaacagaggaaccttgagaggaccatagtcaagttcccatatatcctcgatggcaccgtaatacgtggcagttgttccatcgtgtcccatggcatcgacacgaacaacgctgttttggttcgtgctcttcatgtcttgggctctcgtgtagaatgtgtacccattgatctcatatccctggaatgtcgcgatcgacccagacggtcccctcgccaggaagacaagttgttggttgatcgactcgttacccatgagatgttgtcgtagccacgtggggaaagtatcaatgtgatgctgtgtaatccatgcatcggacttaccgatgttcctggcgcgaactagagccaagtgctcctcgatgtaaggagctaccaatgaagagtgttgcagaacaatgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgaccttctctgttccataacccttggcgatgcttgcctctggacgagcacggttacgaacatacttcttcagaacgcccatgtacctctcgaaaggaaacatgttgtgtaggtacacaggcctgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcg

SEQ ID NO: 73037 - DNA, 667 bp, Oryza sativa
actggcttggggttggtaagtttatttggtaggcaaaagaattggaccggggtgctccagcctaacacagtgcagcctagagatattaagaccagctcatagaaaagcattaaccgttgatgtgcatggagtatttgtcctgtatggtttagaaaatgatcagatggagtgctcgtttttttggtcaaaatggtaattacatataattaatgaataaaaagaaataataggaaggattaaccttttttttttctctttctctctaaggagaacatcagagagcaaatcacagaaaggatctccaatgcatatttaccttgtatttgtttgtcaataagatgctggcagctccattcctgaagatccatgagctgagcatagtgggttgcctctcccaatattaacatgagacatgaattatcatgaagtaaacctattccttgaagattgagcggggatcttgggcctatcaagattgactaaggcgacatcaagcacacatcataagcatctcagttgaaagaacttttttttggtaaacttctcttaaggtaaaactaaatatttaccatttaaacttaaaaagctacttgcacagaggctgtaaaactacaattctcttttattgtaccatatatgttattcatgtgtatgaagagaacacggg

SEQ ID NO: 73038 - DNA, 858 bp, Oryza sativa
ctcacctacagacaatatgatagtagtatgttgggctgtacagagaggcaacagagaggacagcttcttctcgtcctaatcctcctctatgccattggcctacccagtagacagtagaaactcgaaatccacatttaaatcaatgtaatcgcttgaatcacagcccattgatgaaaggggaaaacacagggagctgctaatcacgcacctaaccgccagcggcgacagtgacccgtcgaactcgatgcgtcgtcaccacgtcgaagacctccaaaaaactgttgggagagccgcagcgaccttaaatcgctgggacctccagcagcagccgccgctgccaaacccctgtgctagaggctccgacgccgccgccaggtccccgacctcaaggctatgttgaaaccgccgttgagcccctccatcgagcgcagccaccaccgtacactttagggaagcactgttggaggacgggtaaaacgatggcgctggaaaggccatggaagaggaggaggaggcggcgccgcgtcggaggagcatcggcgcctccggtcaaagaagcgataagcgagatggggattgggatgcgacgtggagagacgagagatcgtggattccacgtctgggtaaggacggaaccatgtacatgggagacgaacgatcacattatgtccacgggtgatatcgaacggctctgattcgatggactcaatcgtaaataccaaaatggtaagggcttttctgcaaaaattaatggcgtggatcaactaggtttgcagatacgtgtcacgatacgattagttgacggagtccaaatcgccctggttgcggcaagctaggagctttaagatatctagtatt

SEQ ID NO: 73039 - DNA, 1067 bp, Oryza sativa
ttaagaaaaataaactatatgtaggctattatctgagaatagcagctagcttcccacgagattctaaggaaggacctgttaaattttttgagtggtacggaataatcacccaccatatgctacatgctagactcaatcccaagttagagggactaacccagacgatgaagataccacgctgtctctcgacggcgactgatgcggtgacagtgggtagaatggcctcaccggccaatagcgcggtgctgtttgttgccggatccaccaaatccttctgcattaaaccaccaatgcaactcgagcagaaaaaccattagatttcaaccgcatagcatatgacatatctctctactattattatcaaagtgcagccatcctagcttctctccgtgtctctattaggaaaaaagaaccattctaccaaaaacggtacacccccaaaactggcaaaccgagaaaaaaatggacagaaaaattgaaccccacttaaaactattaacccgtcttttcacacaccatgttgtaattccacaatagtaatatcagctaattgacatgtatacccttgatcgcgtgagtaggtgtatatatacctgcatatcgatgacgagcatggccgtctcactccactcgtcgccggagccggccaccggcgccatggatatcaccaagattcgcacggccggacagctcgatctactcgatcgggattatattaatcctcttgcgatgtagtgtgtgactgtgtgtactagctagcatatatagcactgcctgatcatggagagaagaaaatggcagcactggctgggtcctttttatggttggagaggagcatttctataggtatagcagcagcagacatgacatggacggtgatcggcagcgaccctagaggtgcgtgatcgacggtaggtacgtctaatcctcgtacgctggaggactagtctcatggtggcgacacgtacgtacgcccctcctctaattacttttccacactccatcgcgtcgatcgtctcatctatcgatccccggtagtcaatcaggggcagggcgcattgccaacc

SEQ ID NO: 73040 - DNA, 1381 bp, Oryza sativa
  unsure (1)..(1381): unsure at all n locations
gtgggatgaatgctatacagcttcgnacccnagaggcccggtccatccaaacttgcggccgcatcgcggcatccaccaacgaggccgtcatctcggcccgcgcgcgggcattgggccacgggggcatctcgggcattccggcccacgtatcggtgtaacggcgaaatcactagccgcacacgcgagcggagccggaggaggagacggagccggcaggatccaccactgctccagctttctccactctcactccccgattcgccggcgagcaggcggcggcggcggagctcaaggcttcctctccgctccgcaggtaaacaccaggcaccatcccctcggctgtggctcccccgttcctcttgtcccactctctcttggccccgaccctcgggagtccggcgctaccgaatccgtcttccccccggagctgtcgaaggagcgccgcgtgcggccgtgctactcccaccgacgccgcgtcacctcgaaggcgaaggggctcttctcccctcccctccaatggactgaggcgtatcccgtctaggccgatttcttctgttgagacggaagccctaacatagctagattgctttttccaatgatttgtcgcttgctaccagcaatcaaatccttgtgttattttttgcttgtctggggccactccaatccacacatatagtcgcatatttgatttgattttattactcgaatggcagcttgctttgcaaaattttcagaagcgcaactgaaccctcgcgcctgatatctaaatagctgctcacgaatccacctcccttattgtgtaccaggtaccaagatgaaggtcaagattcttcagtggcattcggtggcttcttggacatgggacgcccaggatgaaacctgtggtatatgcaggatggcattcgacggctgctgccctgattgtaagttccccggcgacgattgcccgctcatctggggctcctgcaaccacgctttccatctccactgcatactcaagtgggtcaattctcaaacatccacaccactttgcccaatgtgccgtagggagtggcaattcaagggctaatggcatctgaaattatatcactagtatctagtttgcatgtttccttgtagacccctgcaggaaatcttttctgaaacataaaaatgttgtcttcaagtactatgtactaatattttctgcaaatgctgatggtcacaatctgctaagttntnctgtnancccgtttgttnnntgtcaaggtcgacatgcattcaacatgnnngggggnnnggaagagaagaaattaaattttatatatatagacaaaattcgnaattattattatgannaaagacgcggaaatttttagataatacgaacacctaatttgtg

SEQ ID NO: 73041 - DNA, 1047 bp, Oryza sativa
ccattcatattaattcagttgattgatcccgtgcttgcatggacagaaccgatctgatgaccccgcgtaactccggccgttttccccatggcttatgtttttttcaacccgcagtgatcagaagaattcacagcgcggcggcacatgtaaccagagaggaaaaacaacagaaaatcaattgtgattatagatcaatctgataacaatatattgaaacgacaaaccgattaacatttggagtcgtcgaactcgttgagattaatctcaatgcttgaattgattccatcgcactcgtcgacgggaaactcgacgcatcccctgcctggcgcgccagctgtcaaaacatgaattcggcaataataaaacggggtagcgcacgaaacctaaaagtatatggatgcagagacaaggatttagacaggttcaggccctctcaatgagaggtaataccctactcctgtttggggatttgaatccgccgagtgtagtatagatctgacgatctaattgtctcatgccccctagagggcctcctgcccaccttatataggatgggggacatgattacaagatagaaaccttatccaatacggtatcggtttcctaaatctactttacaatcttatcaaaccaggactttaggccgttccgtaatatacaaggaaacgtaatacccaagtcatgatctgttacatatttcatatatataagttatcccctataactagtcggataaccgtgccgtgtgggtatggggtacccataatctccacaagtgcgcccgcgagtcgaactcgaagatgcatggtgtgttgtggcaacttgggaacgagctgcttgcattggcgttgtttgggtggttaatcgatcgaggcgtgcgggtgggtgatgggtgtggcccacatggctcacgaggcgcaacagtcaaaatctctgtcactgcaactaaaaggtcactacaactaaaaggtggtaaatgtctacttggacaggcaaagtcaccatccgatcccacgcccctacgacgcttcttttccgtgccgatag

SEQ ID NO: 73042 - DNA, 2421 bp, Oryza sativa
actgtgacaataccccttgcacaacacaactcaccacagtgcaccgttcctggatcataatctccccctcaaaaccagaggcaatggactccccagcgacccccacggacttctcgccgcttcacagtctggcgcactataatgaatcatgctatacaaaagataaagccgttgcccacgctggcttgtggttggcacggtaaaagttttacaacagtagctcgcgaaccggtccttaattgtcatgagcacaaccatcaaaaccatatgctcacaacccaccttaaccaggttttaatcatcaattaattaacatcacacgattaaccatcgtgagctaccatttaatgtaaccataattaaaataataatgtaacatagtttataattaatccctttagttagctaacgtttctaagcatggctaagcaaacttgcatatagcatttagttgaaccaatccaacatataaggttcatgctaatcaaattataacctataggaaaataagatcatcttcggccattaattaattgggaaaggtttaccacccgatgacattcgaaaacaatgcgtaactgagataaaataatagctttaaatgggttcaacatgtcaaagggttgtttgggatctgagtgacttgccttgggcttacgcatacagctcaagaacctttctcatcggaaacactctcctccggaacgtcggaaactaaagcaattaaacaaaaattaacaaaacagtacaaaaacaagcatacacagtacatgtggatatttttaacatgtagatcttgattttagaaaaatttagcaacttgaactacctgaaacggatctacggttatttagttatgattttctgaagttttaatctattagaaaaacgggaaaaagaaaagatgatgatgtcacgatgacgtcatcaatggtggccggcccgaattgacgacctcgccggagctagggcggtcggccggaactttggagggcatctacacgtagagaacgacgagacgaacgcgacggtacttaccaacacaccgaacgaccaccgacgatagccggcgtcgagaaggcggcggcggcggctcgggttgactggcggcgacgaggctacggcggccggcggcgaaggggaggaggcggccgagcttccccacctcttggcgaaaccagcggcggcgacggcaagcgacggcgacggcggaggcggcgcggcggcgcaaccggagtccggccggcggcgggtggcttgctaggcggcagggcgacggagctacggagcacgggaaaggacgggagttggggcaaacgaaagaggaggactagggggtcctatttatagccttggattgaagagatcggactcctcccgcaagaaatcgactcgggaaaatcaaaaactcggttttggagataaactcgaaaacgagttcgattcgggcaagatactcaaccatttgctccgattcttgaggggaaagatagaggaagatgtggggataaaaacccctcaaaaatccggactaggggtggagagatcggggcggaaacggaggcagaaggcggcggctcggccggctcgggctcggcttgcagccggccggaggtaggagacaccaccgacaggtgggccccacctgtcggcctccacgcgagggaggggcggtggtggcgggttgggccggatgggccggctcggccacgggatgtgggagggatgttgggccaaaatggcccaacggcttcagggaggagttttggaactttttacttaaaaataatttgtgaaatgttgtttcatttattaaaaatacttcccttgctcaaacaattcccagaaaattctagaaaatagaggaacaagcaaagtatttaataaaattttatctagctcaattttatgttgaaaattttcctagataattagggtttagcttgtaggcttttaaaataatttctaaaaatgatttaaacaatgtatttttaatttagttgatttttagggcgtgacaaccaacaaaaccatgcacccacagcccaccatgtgatttattttaattgacccacaccgaagcggtggcattaatccaacattaccattagaacctacagtctatacattaataggattttccccattgtgtgctagttgaactaagcatggctaagcaatccctagtccaatatctagtcatgttatatcccaagctaacaaaggagcatggtaccaaaatagcatggctgtaacagtaggtaaacatctcatagtattactgaaaacaatgcagtatttgatggaaaacattagaacatttgcaatataggatcaacatgttcaagtgacaagcatgacttgccttgctctgctgctggaggaacctcggcgactatctcaaagtacaccggagcgtca

SEQ ID NO: 73043 - DNA, 3316 bp, Oryza sativa
  unsure (1)..(3316): unsure at all n locations
gctcactcgcttttattatcatctagtaataaaatttaaagggttgcgcgcgctttttttttaacaacataaaagatgtgctggctgctcttttttatnnncataacccccccccccgtggcatgatttgcttttgacnatccacttggnacccgnatataaggggattatggcgttgcaagataaggcataccatcatatgatagatggatttgtcatgcattctttggtgtcgctggttctaacaatgatataaacatgctcaattagtcacccatcttcaccaaaatgatatttgggacagctcctagggtgaggtacacagttaatgggtatcaatttgagtatggttactacttagctaatggaatttatcccaaatgggtgacgctaattataacaataagttaccgcaaagtcacaaagaccagttgtttgcagctcaccaagagtcaacaagaaaatacattgagtgtgccttcgacatcctgaaggcgtgttttagggtggttgttgtgccttgtcgattgtgggaaataggtggcattggattgatcatgatggcttgtatcatattgcacaacatgattcttgaagatgagagagatctcccaccctttgatcataatgacaacaatggagagttcgaggttgacgaacccgagtataattaaggtgcactggatgaatttgaggctgtccttgatgaggacacaactagctcagatataagcatgactaccttatgtattaatcaaccaaaaggtgcatatgttctatattagatttacttgttatatatttaaacaaatgttgctacacaatgagttttgggtgttttcatttccagaggtacttgcttgggcgaaagaaaagagaccgaacgtaagaaatgcatggatgattgaagaagttgattggggaccaaaccaagatcttcttcaagtcttctttcattttaccacgttacttttggtccatagaacacaagagacaagagacaagaggaatgcgtggtcccgatcttccgataggtatagataaacaatcgatttgggcggagtcgcggcacaactcgattcgggttctgaacgaacacgctactgagccctgcaattgtagcaccacgtctcctttggttatcaaccgtgccgaaacccggttgacctcgccgagaaggttaatccctgcatgcgaatcgaagaacacaagtatgaacaagataaattgcaacacaattgcatatgaatgattaagcactcgaatttggggttccacaaaccgatctagcatcaaaaaagttcttgacagtttaatctaagcaaaacccgacactaaacgatgacggctactgattaagtatgattagggacgtcctagggttgctctagggcgcacacccccttgggctaagcccacggcacaattacaaggcccaaaacctaaatcagattcggactggatgagatacgtggctttttttgcagattcccggcagctcggtaggaattttgacgtgagaccaaaaccatctgaaagtagattccataagatttccaacaagtactcatgggccctgaaattccttctagataagcgactatgtccgtttgaagttgatgctgtcaggaggcccgaatccaaattcaaaacctgtacgactttatctcttgtcttctatggaccaaaagtgacgtggtgagatgaaagaaaacttagagaaggtcttggtttggtccccaatcaacttcttcaatcatccatgcattccttacgctcggtctcttttcttttgcccaagcaagtaactttgcaaacgaaaacacacaaaactcattgtgtagcaacatttgttcaaatatatgacaagtaaatctaatataaaacatatgcacctttggttgattaatacataagttagtcatggttatatccgagcttgttgtgtcctcatcatcctccctttcttgattggaaaccgtcctcggtttcaccttgtcatggagcgtattgaacttatctttatctatcacaacatccggtgaggaacatttcttgatggccatatggttggattctaaaatctttgtagtcgaaaaaccccaacactccctttcttgcaaattaacttgtaactcatttaaacaactagaggaactagaaagagaattacttatacgcatgcggtcctctagaaaatacattttatcatgaaaaggaggtatagtcaaattcgaacaaatatatactcgatgcacattttattctcctttactatcataattgctaataatatgtaaaatcacataagaaggacatggcaattcaaatctagcaaataatttcttctctaaacagttgagtggacaaagatcatcaaattgaatataaccccaagtattcaaagaagatagcagtttaagctcttcattctcgctagcaatatgaataacatgtttaaactcaacacatggtggctttactatagaaccaacatgttcattcactagttgtggcatggatataagtgaagcatcgcacaactcttttttatcacaagaaacatcaagcaaattgttttgtgacaaaggtatttcaacaatcgtttccctatgggttgctctaatgtagcacaagtactggatatagttggtacatcataaatatgcataccttgattagttgtagcaccattatcattacatttattctcatcttcacaaattataggtgcttgtccaattgaacattcttcaagcatgcatgaagctatagataggtttttttctcttcgtctttcttctcttcctcctcatcatcttcaacgtcggaaggtgcttggttgtagcccatccttcacgtagcaaacgttatgccccgttgacattagagcaaaccctctctcacacgatgtgccaaaattccaatgagccagacgggtgggacaacttgaaatccctgaggcggtgcggtccacgtcggaaggttgacaagatgagagcacctcttattgaatacctgcgaagaacctttacctgaatctgcaggtcgtggaaaaaataattttggcgctgcgggtnctccgggtccncttggtcgcttgctcgctcgtggggtcgtccgggnggtttgaaatgggcggccccgtggttggtttcgcccgcggcgtggctgcctcgcctgtttgtnttttnttngccggnggtgcacagttgtcacatgaccggggggggggggggggagaatttatcctgcaacaacacacgaaatttataaatagagngttaaacagatataataaacgttttacatctta

SEQ ID NO: 73044 - DNA, 5054 bp, Oryza sativa
cgctaacgggcggtgtgtgcttgatggagtgggcggacttcaaaatgcgcacccaaaatccctttaaataggcgcacccccgacggtgcgaattccaaggaactgagagaaatccccgccggaaatttctaggtccattacgcgcggcagtttttgacttaagttcaaaattcactcgtgaccgttgggcttcaaacggcatgttcgactacacgtcatctccgtggttctcgtacctggaatgataacgttctcgacacccgaagtcgcgaatggtcgcacgagttcattttgagcagaagtcgggagctactgtcagggttacgggtcaggcataccctctacccttcgatatacgttacgtatcgacatggcatacccacgcgtatgcggatatttcctttatgatctaaggaaacctttcacgaaatcaatagacgggaagagtccttctcggataagaactgggttacctacgtattgagctgggtctgggtctggtgtgttcgagtcctactcggagaccaccagacctgcgatataaaagggaccccccggggagggcatagaggatcgaatctcagagccaacacaacccacacagcctacgaagccggagcctgcgaggggccacgtcgtcaagagctagtcgaatcaactcgactttaatctcgccggattcgacaagttccatctttcctttgtaacctgtgttttccaccatataatcccatatcaaatggattagggctattacctgtcaaggggcctgaaccagtataattcttgtcttttgattacttgatgtcgtactacgtagatccttgtaccagcgtaccccaataccctctatatccagtctacgtacagtggcgcgccaggtaggggcacttggtactcaaggttctactactatgccatcaagcttcgtcgacaacaacgtcaacaccagctccagtcaagcactctcagcttcaataatgctggtatggactcaagtcggcgaaatcgtcttcccggtttacaccacgatgccgatctcaaccggtcctccaatgactggaaacgagaacgcagtggctatgaaccaggacggctccatgtcgaaaaatccacccgttgaaacagagaacggattatcgactacatccaaactcgtgaaggattctgatgcggccaagtcttgtccctccgacataaaccacgggccaacaaagatgacttccgaagttatctggtctttgtgtcctatccacaaaaccaagaaacatacccttcaagattgctaggtattcatcaatgtccgtgctgaaattcgcgcctgcaaagaacgcggaattcagcgtacttctctaactcgggatgtctattgtcctatccacaagacaaagaatcacgacctctcgagctgcaaagttctcctcggcgccgtgaaaactccgtctcctaagtcatacgtccccgttagggataacggcaaggaacaaggagcgactccagcctcagatcgattcgttggggtaatcgatctcgacccccacgaaccatcggtcttacatctcctcgaagactgtgggtcatcgacaacaagtgcgtcgcgggaggtattggctatcgatgacgttggcacgtcagcacaagccaatgcagaggcggcaaatcaatcgactactccagcccagcacatcagggttgttcaagccatacagagggaaactccttacgatcccgttctgaacgacgacctcgagcgttggacggaacgattacgggagtcggtgaccaacctcagcaatgcgttcgaagaagccgctaccgcagcacaccaagatcagccaccgatcggcgacaccaatggtaaagatccggagcggagggaattacctcgacaggctacccctccacctcgtggcattggagatcttcgagatcaaatcaatgatcgccgagaagcacgacgcacatgggacgacgcaaatcgctcccggcgtcatgtctcttcacgacgccatgatcgaggaaatcgcccaaacgaggaccgagactacaacgatcgcgaacggcgggggccagacaatactggtcatggccgtcgccgcaacgacgacgacgaaggcgatcggcgccgagacaacagcgagagacaacgacaggatgcccgggatccaggtcgtcatcctcgtaatcgtacgccagaaccaagcgacccatcgtcatcgtcatcatccgcgtcctcttcatcgttggacagacatccacgaaggtcacgcgaccgccgacaaaccaccgcccccagtgctgggtgtagggctttcggtcgttccctatgtgatgtccgatggcctgagagattccgacccagagccattgaaaattatgatgggagcgccgacccagaagaattccttcaagtctactcgacagtgctttatgctgccgcagcagatgaccacgcgttggtgaagcatttaccatccgcgttaaagggttctgcgcgttcatggctgatgcatcttcctccctactcaatctcctcgtgggcagacctgtggcaacagttcgtcgccaatttccaaggaacatacaagcgccacgcgatctaagacgacttacatgcgttaacacagaactcgggggaatcattgagggaatacgttcggcacttcaacgagtgcagaaacacaattcccgagattaccgacgcttctgtaattctcgccttcaagtctggtgtcagagatcgctacactacccaggagttggcgacaagacgcatcacaactactcgaagattattcgagatcgttgagcggtgagcccatgtggatgacgcgctaagacgcaagaacgacaagccgaagactgggggagagaagaaactatccgcagacgcatctgagtcaagcaagaagaaaaatcgcaaaaacgggaaaaggaaagctcaagcggaagtcctcgcagcagaatacgcgaaccctcccaagcgcccagaccgacagggcagcgatacaaagaaatcatggtgccccatacacaaaacggacagacattctctggaggattgccttgttttcaaaaagtcgctcgagaagcacatggcgtttgaaaaaggcaagcgagtacgcgttgttgagaagaacaaggagacacctcctcacgaatcggattctgcgtacccagactccgacctccacgtctcacacatattcggtggttccacaacgtactcctccaagcgagaatacaagaaagtggaacgtgaagtctgttcgacgtggcagggggctgcaccctgatcaccttcgatgtcgctgaattcgatacagcttataacgccatcatcgggagaactgcacttgtgaagttcatggccacatcccactacgcatatcaagtgctcaagatgctgggaccgaagggaacaatcactatttaggggaacgcaaagctggcggtgcagtgcgacaagcggagcctcgacatggtcgagcaaacgcccaccccacccgccacgtctgagccacctaagaaagtgagcaagccaaataagacgccaaagccagacggcaccatcaagatcgttccgctctctagtgctaaccccgacaagactatcaaaatcgggactacactagatgagaaataggaactcgcgttcatcacattcctccgcgataatgccgacgtgttcgcttggcagccgtgcgacatgccgggggtccccagggaggtgattgagcacaaacttatggtgcgacccgatgccaagctagtaaagcaaagactgcggagatttgcaccagaccgaaaacaagccatacaagaagagctcgacaaacttttgaaagctggcttcattagagaagtacttcacccagagtggctagccaacccagttatggtgcggaaggccaacggaaaatggagaatgtgtgtcgacttcacagacctcaacaaggcatgccccaaggatcactttcctctccctcgaatagatcagttggtggattcaacagccggttgcgagcttctaagcttcctcgacgcttactctggctaccaccaaatcagcatggcaaaagagaacgaagagaagacagtgttcatcacgccgttcggggtattttgctacgttaagatgcctttcggactgataaccaccgggaatactttccagcgtacggtccagggcgcacttagcaaccagcttggcaacaatgtcgaggcttacgtcgacgacatcgttgtcaaaaccaagacaagtgactcattgattgacgacctgcgggaaacgttcgacaacctcggacgatatcgcctcatgctcaatctagagaagtgcacgttcgaagtaccgtcgggcaagctactcggattccttgtttctggcagaggaatataggcgaatcccgagaagatcaaagcaatcgagaacatgaagccgcccacatgactcaaggaggtgcagaagctaaccggatgcatcgcagcattaagcagattcgtcgctaggatgggagaacgaggacagcctttcttcgccttattgaagaaacaagacaaatttgtatggacacaggaagccgaagaggcatttattgcactcaagcgctacctatcaaacccccctgtactcgttgctccccaacctaatgaagaattattcctttatattaccgccacgccatattccgttagcaccgtcattgttgtcgagacagagaaaatacagcgaccagtttattacgtcagcgaagctctccatgacgcaaagacaagatatccacatattcaaaaactgctctacgcagtcatcatgacatcaaggaagctacgccactactttcaagcccacagagtcacagttgtctcctccttcccccttggcgaagttgtgagaaacaaagacgttgtcggccgcatcgcgaaatgggtagtcgagctaagccaatttgatatccactttgtgccgcgaacagccatcaaatctcagatactcgccgacttcgtggccgattggaccatgccagataataagtcagacaaccaaggtg

SEQ ID NO: 73045 - DNA, 707 bp, Oryza sativa
  unsure (1)..(707): unsure at all n locations
gagaaggaaatatctatagtatatctggtactgcatccatttcatattatagggccggttcactatgatgccattttcatctcttaccaaacctggtaaagatacaaaaaaaagtggcttcatttagtttgctaccaaattttgctaattacataagacatcctggccaaaatttgggcagctaccattctggctatgccaaaatttggtaaggatgtttttcggcatcaaagcgaacagtccctataagtcgtgtaacatgctcctttatcaagcatctgtaagtttatttttggtgaaacacaatacaacacatacgctgaccgcttctataaacatacacactgtgcctatgagcactctattaagtttgatcgagtntatagctaaatataataatgtttttttcattacaaaacaacacattatatgagaatatactcaacgttaaatttaattaaactagtctggtgtcgtggacattactatcttttgtataaagctggtcaaacttaaagaactttgattaagaaaaaaattgaatgacttataatatacaaagagagggagttcaatgccgtgtccagtgagattctatatatatccctatagggatttggtacatgagttggacgtgtcagtcaaaactatatgctcgttaggcgtaacgatgtgtcttatatgttgacaccagtgctctataaaga

SEQ ID NO: 73046 - DNA, 638 bp, Oryza sativa
gcccggaaatgcaatggatctggttgagccaactctaagtttgttggggggtttttagtaagaacatgggatgctcatttgttctttatgtaaataaatccttttcttcgggatgagctcttcagaaaatgaggcggctcttcttttctgcttacgcaaagggcctttaattctgtgtcatacctatatttaatttgcaggtatgcggtacgatcaaccaatgcttcttggcggactaacgatcatttgggtagaaacgaatcgcagaatatatgaatacatcctgttctcagattactttgggcgatactagttattttcatgactcatcatatcactttctggagatgctgaaacaaacatccactgtctagcagaaagatcaatcattcattatttcacagcttactcctcagcagattatatcccttgtcacagcttgcaatctttgctactctgcacatatatgaagaaaactgcagctatttacgcaccatgattggtggaactttactgcatagaatttggtgtgacactaggtaacgaacgacatagcttggcaatatgggacgggtatcatttgctcattcagataggggcactacgccctaccgacattagtgaagcttgatttagct

SEQ ID NO: 73047 - DNA, 6500 bp, Oryza sativa
  unsure (1)..(6500): unsure at all n locations
ccggatgaaatcaantctgtttgccagcacgctgactctagaggatccccttaataagttctttaacagcggggacctcccttgcggtatttctttcaaaaaaacacacaatatgatagccgcattcacattcatccaaatacacatccaattcacatccattcatcaactaacacacaatatgatagtcacattcatcacattcatagccacatccaaattgacatcaatttcacatccacatccatatccctccccccctcccccccccccacacacatattggctgagttctttcccccaactttcccaactcacctgcctcgtggttccgtgcgcacgcttttcaaactactaaatggcccgttctttttgcaaaaagtttctatacaaaagctgcttaaaaaatcatattgatccaattttgaaaaaaaatagctaatacagtacttaattaatcatgcgctaatagactgctctgttttttccatgcgcaaatgggtttccaacacacacaaacgaacccaactatacaggagttggaattttacacctaggtgcatatgcaccagcaatctgcaccattcatttgcatgtgcggatctcaaagtaatgtacgcttagccccggtaaaatgtaccaatctagctttgtccccttatagtaaaagtagaggatgatacataatgcatttttttatgactgaaatgtccttcaagtagtactacagtgcaattcaatatgtagtttttgaatttcttttttgttgctgcatgattaattcatttcacatggatgctcagatcctgcaagcagtatgtcaatacacaatgatagatgtatcttcccttgttaaaaaatgatggtatatatcttcttgctaaaaaaatgacaggagtattattattttgagggaaggtcagaatttacagcaatatatggttacctttctaaacacgaaattcacacttttctgccatgtggagattatgatctgagtatagtgtgatgtatcttttgtataacgacacctgtgatataaactattactgtagtttgggatatgtatggtgtggaattgatcgatgaagaaaaaattgtgtacctttgttggcatcaaaattcggaatgtcatgagttaacgggttttagagatatataaaacttttagtgtttagttccatattatgttcttaatgatgtttagtgatacatcatttacaaacctatcattaagatttataacttttgttcattttaagataaaaaaacttgctaggagatatataatttgcaaatgtcattgtatatcttgaaaatgtagagaaattttgctattccaattgcaagggaattcttatttttgttttgggtcataccacagggtctttcttgtgtgtaccttcagagcgctttgtaatttatagcacgataaagtcccaacgcaattgtgtttctttttcctctaatcttcatctctggtttattccagtgaactgtgaattgggaccgtataaaccacagtccacattattctctatagattttaataaaattaaattttagcatgttggcaattagaaaggatgtcctatatgtacgtatgagttttacctatatattttatcgctagtgttttttgcaagttacatagacaagccacacctgcaaaattagatttttagcatgtaggagcagtgaagaaaatctaaatagcatatgaagtgaaaaaatcaggtaagaggggctagctgaggggcaaacctggaaggctatggtgaggctgagtgagaggttgaaaagattaaatatcacttcaagaataccagtagcattattagcacttgatctctctgtatgtatgcactatgcacgcatcttatgatgaaatgaacaaaaaaacaaattcctatgaaatgcacgcatcttatcattttaatggcccatggtacgtttgactaatcctcatgcatacacgtgattttggacaaggctaatggagtaggcgagcaactgttttcacattgggccatgctaacgacatctcaacaatataatttgtcctagctctatgtacttcatttatttactcttttggaacacatgatttgcacccaaaaaaaaagtaggattcaagtggcttagcacttcaaatactaaggtggggaaaaaaaaactttggaaaattgcatgaatgatcatttagggttcctttgaaaaaaaaatagaggatttttggagaattaaaatccgttggaaagttttcctacatgggactttggaaaaaaaggaatgtccctccccccaaatgctttaaaatccgtatggaatagttcatttcataggaattttggaggaaaactaacatgaggaaagacggtcccaaaactacaattcactcttttatttatttcaacaagctaaggcacagctgcatgaatacactatgcgtggtaaacggcaggcaactttactggaaactgttaggtcctcatcgtttggcttattaggaaataaaaataaatttgtagataaaacttttataaatgtgttcttcgtgacttaaaagccaatgttgaaaaagaaactacgttgaaaatatctcaaaattaagtttgaaaattcaaaatttggctttttctttggctgattaggccatccgatgagggccttagattttcatcttacaatttcaaaaatcaatcgtcaaagtagatatcaaaatccaccaggagatttactttttctccaaaaaataaaaggtgtcccaaaaaagaaaaaaaagggcttttcatcacacaactttcatctagatatcaagaactttctatcaggacagtttcaaaagacttgtaaaaagaaggtttttctgtctcacaactttcttctatctagaacaaatcatctgcaattctgtgtgctccatgactctaaaacacataaaactgatagcagtaatcccaatatgatcaattttatataggaatggttaggagttgtacagttgaatatatatatatatataaacagtatctgctgttggtctacctgacataaggttaatataattacacccactgagatggaaaggaacagggatgtctccaatactttggagttgagcatgtagtatatcactagaaacagcaattttatcgtcgccattcttccaaggttggtgtttccactccgatattcttcatatctcttatatttgctggttaacataaaatagtaaccttcagtcaccagtaatctcagagaacagaataaagacaggaaacaaactccagattcttttcgtcagctgacaaagcaggaagaattatagttgccaacaagagctgtggctgattattaacttattgtaacctaatacttgcaacttcgatgctaaattattgcacattgtgaatatatcacatattgaaactatatatttattcgtattgaataggattttacaagtttccctaccctttgattcctacatttgtaacgcattcaaactgtactaatatttatagaaataaaaggctaaatcacctgttgtccaacatagcatgcgatctgacaagcagctctagagaacgaatcaagtcactatgcaataagaatttgatggaaccataacatataaagagtctatcattaaatgagcttagctctctaggcctacgtgctattccagaatttcagtgtttacccagtaacatttacatcaccgaagacaaaatcgggtcgtgaacaaaatctggtatcttaaaatagagcacttaattggcatggaaagttgtcttttagtttgaaaaggtgcatctaccattaatctaaagtctaaacatgtcatgtccatgtcaaatcaccaagatcaagaagaggaagtgagaaaaatgattactcacacagatggatctctggcctagcagcagctgttgcatcaataatgactgtcactttctcatagtccaatgctacagcatcaaagactgtctgccggatgcaatttggtgtttgaacccctaaaaaaccataaacacttaagtaatgtgattctgagcaatgcggtagagatcctcaggcacaaaagaaaagtatcaatatttgtctgtaatgtactagactacaaaacagtactgtgcaagcattcaatttcgggacttttcaccacttcatatgatagtttttactgccattatatgtccacttagaacataaggatgttgaaaattgcaaagtgaataaagcgaaaaagaattgctacccttaaagaacaaacacaaaacaacaagaatttattgtcaagctaagaaaacaatgttcacctctgtctcgatagatggatatcagtgcttaccaacgataaccaatttctttattcctgaggttttgaggacagaatcaaggggtgtcgcaaagaaagcactgaaccttgtcttcaccaacttgtattccccttctttgataacaagcccatcagctagatcagcacctttcaaacctttcactgttgggcccttcccaccagaataatagcgtctccgaaaaatttcaacatctgctccagaagggtcatgctctctgaccacctacatgcagtcatcatcaaccaaggtctcagaactcaaaactatgaccacatgtaaatctattggcattaaaatccctacctggtgaagcaaaatgctttgcataggaagggggaaatgtagatcacattaatacaggttagctgctagttttgcaacacgtccaatgattatcataatagcatgtttagtaaaattcaaaattacatttaatgaaccatgaacatgtataagttgcagaagccaattcaaaagaaccaaattttagtttcatagtggaaaccgcacctagcaaattattcgctttgtagattttagaataatgtcgtgcagcgccaaacattaaacaacacacctaccttctgctatttagagatgaaatagagggagtcagtcacctaatccagcaaagcagcgaccctccaatatgaaaattggttttcatcagataaaaacaaatgtgtgtctactataccacataaactctgttctttgcatacactcatgcagaaaataatgcataatatctggtttgttgcctagaatatggttctaaatgacctgacagaacaagaaatcaaaagataacttctattcgtcaatcagtctacagagtgaggaaatgtgagcaaccattgcaattccacgccattaaacgttgaaatgctggcagatgctgcacctgcaaaccgaaacgacgagcaggatggtcaaaaaccaaaggaaatccacccacgaattttgatcccacactgctgcacatacattgcactgaaccaagaaatctgtggcacttgcttagagcaccacaggctacacaagattcctcctgaatccgaccacgaaattcgcagtcctcgtcgcattcaaccaaaccaagcaaccgagactaaacaaattattacacgaggacgaaatggagcttcactaatcaacaagaaccgagccaccccgcgagaggagagagagagaggggaaggaagcaagaagtgtacccagacgacgtagatgccgcgctccctcgcgacggcgaccgcctcggcgacggtggggaccaccgcctggccgccatccaccagcatcgggctccgcatcgccgggtcaacgaaatccttctgcaaatcccacatcaaccatcaccaacccaacatctccaaaagaaaccaagaaatttccccacacacacacacatacctgcatgtcgatgacgagcatggccgtctcgctccacttggcgccaccgccgcccgccgccgccgccgccatggatcgccgcgatttggacggggaagtcgagatcctcggggagagccagcgcttcttgaggtagtggaggaggaacttgtcgagggagaggagcagcaccagcaggcacgacatcaacgccagatgtgatgtcataaatcaatcccaacaacaaaaaaagaaaaagaaaaatatgatgccgatgcgatgctgcagataatatgactttgttttcatcccaaagctcactgtttgaaaaagaaaaggaacgaatttgtcaaaaaaatggattttcggaatgctgtggtggctcctgcagaattgtgaatctgggattctggatgggtttgaagtgagtgagattcagaggattgtggtggtttggttggaaggagttggtgagtggtagtccttggaggttggaccttgacgacttgaggagtaaggttttgacgtttgtagtgaaaaaaggatattcttttggcttttgttgtctgacggctgctggtttgttgntatgtntgngtggggncaagcgactgcatcaactnnnnnnnggggnggtgagattattttaaaatcagcacaaagtttttgtnttaaattaacaacagcgannttattataatattataaacaaacctacgccgcttgtggtgttagtga

SEQ ID NO: 73048 - DNA, 7263 bp, Oryza sativa
  unsure (1)..(7263): unsure at all n locations
aatatacatgttttgataattgcatgggatcagggaattacctatctgcttgtttgtgccatatttatttgatattcgtcctttgtcaactctgggtgataaatcgactagcttgtgttacttatgtgacctagctagaactatatgcttagccatgcttaattaccactagctcagttgatgggataattgcagtattagacctttctagtttcagaacgagctgcgtgctcgggacatccgaccatgtttcattggtcgtaattacccaactgaaatgcgacataatggtgggctgtgggtgcatggttttgctagtcgtgcccatggcaattaaggaccggttcacgggaaatcctagaagaacttatcatgcttaccacaagccagcgtgggcaacgactgggcttgtagtgtagctttcctctagccgacgtacccaggttagggtgggcgtgatggagttgggtcggccagggtgttcggttgatcggctttcggattcaccgtggcacgagagggtgaagcatctaggcctccggtgttaagtttgataattaatgacaagcgctaattgtggactaactgatgtctttgagctatatattttaagttaggtccacatcatgtgtgcgcatggatgactatcgatggattaaaattgatggcgcgaagcgaagaaaagaaaacggtaaaactagtgttttagttttaaaattgatcgaggtgaagggcgatcaaatttgctagtttacttgttagttttgccgtactatcaaggggggtaatgacctagtaaaaagatgattaaattgccacattaggtcattgcattttctcttgtgctcacatcttcacacacacacaatcacctttgttttcacttggttcggcctgactaggggcggtcagaccggccacacactggcggtctgaccggcgtgccctggccggtctgaccggtgccacaacggcggtctgaccggcgcataaggtcggtctgaccggcggcacatgcacggtcagaccggccccctggaggccaggatggtgctgctcagggtggccgatacagagccgacggagccgtagtcggttagaccgagccgatggtggtctgaccaagccgaggccggtctgaccgccctctcaacgtcggtctgaccggccaggccgatggggccctctgacagcacttcaacggctagttttctagccgttgcagagtagcacggtctgaccggccacatacctccggtcagaccggcagagcacaaagttgggggatttcgcccccaacggctagttttggtgggtgggagtataaatactcccccaccagcagcaaggggactcttttggcacccaattcaattgcatacaccccttgcacctctctcacacccacttgagctttgtgttcatccatctagtgtgttagaggtttgatctagccaagagtcaagtgcatttgcttccattgtagagctagtgtggcacttgattgatcatctccacaccgggtcattgcttgttactcttggaggttgccgcctactagacagcttgtggaggagttgcccggtgacctctctgagaagattgtggaggaggcatctggacgggtcaccacgtagttatcccaccccgcagaagcgggaccttgcaactggtgtgtagcaaaagcaactttctctttgtccgtgcattgcagtaggttcagcttcttctcaatagcacggagccagtcgttggcccccattgggttggtggtgcttgagaaagtgggtggctggatacgaagaaagtctaacagtttggacacgtgtgatggtggaggaccaaactgctggttctgttgcgcctgctgcaacatctgatggtaatgttgctgcatctgttgcatcatcattgtcatcatctgagtgactgttgggttctcgggcggcggagatgaactgctgccaggtgcaccactggtatgagcttcatctgtctgctcttcactgccactggcgtcgtttgagtcacggggatcattccttgtcttcaccatctggacgaggataggtagaaataagagaaaggaagaaaacagatggctcagaaactaatctctctgataaaattaagtgcaattatcttaatcttgattaaaacactaaaaaagaggcacgcaattcctaattaaggctgtcataccactcacacatgatatcgaccgccgactaacccacaagcaacaaacctaaacacaaaaactagcacgcaaacagactaagaagacgataaagctaagggcggcgactctgaggctcgagcggcgcttgcgatcgaagaacaggtctgacttctaaggtagacaagggatgggaatcaatgcatgctcaaatccaaatttagacaacgcaacaaatggcccaaacaactagccaagcatgatgatttttatgcatggaacatttttcatgaacccaaacaaaaaaacactaatgcaactgactaaacaatgacttaatgcatgaaataaatgcacgataataatgatgcgcataaagactgcatcccatcgaatctagacacaacttaatgcataccaccgaacaattcccgactgactgccaaataaattccaaataaagttttgctaaaaccctggactgtccctagtcaagagatccgattaaataggcgaccaagattttctcccaaaatcaaaagatcaaaccccaaagtttcccgaaacaaatccaagtgaaaaaggcatgtgcatatgaaaaggggtttagatggctcttaggttttccagttggcttgtcctacggtcaaggtcggctctgataccaacttgtcacgcccagaaattcacgaaccagaatttctaagctgaatgtgtattaaacccctgtccaggaccagccagggtacacaaatgacaattgttgacatacagatccacgtcttacaaaaatataaaagattacaaatgcagcgaaaaaaaaggtaaaagcgagctaagcctgaagacttgactcctgcagcgggcgattccattccacaggcaacccttaacggcagcgacgaaaccaacctcttcaagacatctccaactgagaagaacttcaactctggtgtgagggaaaagagcaagactaagtactacccactgtactcagcaagtcataccggaagaggaggtatgatgcaggatataaccaaaggaggctacggggttcatttgcataaagcaggcatttaaaaccagtagttgaaaacagtaaaaacagttgtagtaattaagcaatattaaccagtcactgtctaacgctacgccacgttgcaacaggcccaaccaaccacctgaactacaccagttcattaagcttaactaggggtgagactaatcacggtgaatctggtcgaccgcccataaccgcgggcacggctattcgaatagttttactctgatcagaggtgtacaactgtacccacaagacacagccccacgacacgttcccgtgcgccgacatgccaccacgacatactccggaaagaggccgtgacaggacccttcgcataaccctctctaaccgatcgcaccacaccttagggttcgcccccgtccccagcaggcaactggcagcccccctttcgtgccgcggtgaatccggaagccgatcaacaggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaatcgccatgggcacgtctagcaaaaccatgcacccacagcccaccatgtagtgtattttaattaaccaacaccattgcggtggcactaatccaaagctattgccaataatcagtctatgccttaatgtgatccccttttgtgcactagttaaactaagcaaggctaagcatctcccaaaccaacatctagtcattttaatacccaagttatcaatggcgtaagggaaacaacatatagctgagtaataggacccatcccacataatattgtaaaacaatgcaatatttaatagaaatgcgggacatttgtaaattgggtacaatatgatcaattgcaatgtatgacttgccttgctctcgcactgatggaaccacagcaacgtcttcaagaaaccacgaatcgacgaaacgggcgaaatctacgcgacaaacaaagcacacaagcaaaacatgctataagactactgaaacaggaaacaaaaccatttttaatggattctatacatttttatgaatttactgagacttgaatgggcttaaacggagctcggatgaattagttatgaattttagaagattcactgtgtttattactatacaagaaaaaccttaaatcatttattgcgcaatatattccagggctgacgtcatcaaggcggggcgcggcgccggcaagcgggccccaccggttagcggctcgggagagggaggaaggggcgccggcaagcgggacccgcatggcagtgactcggggagggcggtccatggcggatcgggtccacggaccggggaggagcggcgcaccacgcggcggccacgcgacggtcgaaccgatggccccgatctacccaagggtagatcggacggcggcgggagctcgcggccggtgcgcgcgggcacggcgcaaaccggcccggcggccatggcgcgcgacggcgcggcgcgtatgcggcagcggcgcaaacgtccggccgccgccgaccgaccgcgatcggagatcgtcggcgtctcggcnaatcgacagctacgcggctaagcggcggcgcgacggctaaacggtgcggaagagagacagaaacagtaggagagtcctcaccgacaacgatcgacgacgccgagcgacggaggacgatggcgacggcgggacgagctctggaacctcctaacgaacaaaagnagaggggttatagggacaaaggagagtgcgaaagggcgagggccccggcaaaaggcgccggccatggcgtcactcaccggcgcacgacggggatggggctccggtggcgaacctcgacgcaggaggggtggacgaggtggacctcggccgcgtgaacccaacgccggcgacggcccggtgcggcggcgagtgtaccgccggctagagtcggccggagtagcgggagaggcgtcggcggatgggcgcacggcgcgggaccaatggagggcacgggagagagcggtggaaaaagaaaaaaaaggtggaggggagtgcgggcatgctttataggggctcgggagagacggacgtggccgaggcgagcccgatttcgccggcgacgtgggaggttggaggcgggggagagagagagagagcggcgggattcaaaatttgaatcccggccatctcggttgagggcgcggcgagagaaagagggggagtgggtgcgggaggcgcggcgcatgcacgggcgtggccgacgtggaccggagaaggcggggtgcggcggtttcgccggcggtgacaacgtgggcgtgcggccggaggttggggaagggcccgacaggtgggccccacctgtcggcgaccctggggagaggagggaggcggccggcctggctgggcctcggcctgcggccggcccagcagggaggagggggaggaaggagagaatgggccggcggcccattcgaaaaaaggaggaaaaagggaggaaaaagaaaaagaaaaaaggaaaaaggattttccctggaattaaaatattgcttgctcaattttaaatggttaaaattatttctagagctctgaaaattccactaaaaatcctgttaatgaatttcgacatgtagaactcaagaaaaattccacatgtcaaatccgattattatttgcattactttcttaaggattcatctctaggttaaattaaacaatttcttcggacgatttattttatgaatttagagcaagggaggggaacttcagggcgtgacgctgtgtcttgtgggtacagttgtagttgtatacctctgatcagagtaaaactattcgaatagccgtgcccgcccgttatgggcggtcgaccagattcaccgcgattagtctcacacttaataaatcgacccaatgcactgtagttcaggtgggatggttgggcctgttcaacgtggtgtagcattgttcagtggagatataatgttatcttaaccaactgtttcactgttttgctcaataaaatgttttacaactgcctttatgcaaatagccacaaacctccatttgtcttcccttgcacgtatgcatcattagggtggcttgttgagtacggtggttgtacttagccttgctattatttccccttttcagaagtgtagtgcttctgagctgaagacgaagttagaagaccaaggctcaaaccccagttgagttttgcctgtggagtggagctgaagccctgctatgatcgccttttccgctgctgtcgttctcattcggtgtgaggactaagtgccttttctgtaagtattttacgctttatttacgtttggaacttaatattacttgtcgttttgtataccttggctggtcctggacagagatttaatacacaaaatagtctgcaaatttaggctaaatttctgggcgtgacagcacatcgctggcaccgatggcggctaccggatctccctgccaccgacgtcaccgcccgccatcgacgcctcctatctcgcccccaccgacgcctcctctctcgccgcccgccaccgatgcctcctctcccgccctccaccgacgccttctctctcgtcgctcgccaccgacgcctcttctcccgcccaccaccaacgccatcctctgcactcccaggttgaagacgacaatgacgagctcgggcgcggtggcagcgatggagtctcggagcctctgagtggaagggcagagtcagtgatgctgcgtgggagggcagcggggccgtccccgtgtgccgtcgttcggcggccggcccccgccccttcgtgccaccgatgccttaccgtgcgcacctgtcgacctgcgtctgtgagagagagatttaggaagagggaaagacaaatggggggcaaaatgcaaaatatgttgccacgccagactgccacgtaagccagacaactcgctcagaggccctttagatctcaatgagtcacttaaacaagatggtggacctaagtgac

SEQ ID NO: 73049 - DNA, 1213 bp, Oryza sativa
  unsure (1)..(1213): unsure at all n locations
agtgggtatgctaggatgaccttccatgccctgatcaactctagaatcaataactccacacttccgcatcatgtcttcgatgcatacactgtcatcttcaattctttgcataggagctagacaagcaaaagggtttttgagcaaatagtgaagatcaatttaacagaaatacatgttaaatataacaaaatttgtgtttaatgttaaaactatagtaaaacctataacaactgagagactagaattattgctcatagcagttgttacattcttgccatgaaaaccacaagggtataggcccctgcaataaattgctcccacagagttaaaagtctctagagaaagatcatatggacacataacgtcacttatcttcctttgagatggagttggaggcaaatgggtgtgctctacacccatttccccactcccgaaaacatgtttgttgtttgaaggatcttttgtaaaagaccaaggtattttgcatgcgtattcgtaggctacgtagattgatctcatgcactcatgtatataattattagaatggattataataataattttcatttggaacttataagatggtatagtatatttatttgaaagttgccaaacatgcggnagcacacatatatgtactatacaaacctattggggttcacactttcactaactaaattgtgcagttatgtaccagttcgtatttacacttgcatgagaacaaaagaattatgactacttgagatgcttccaaccgatgaattaacctttttttctaatcaatttggagaaattgggtcaatttgaagggcaaactgatgtcacccctggattcggtgcattaggttcttttcttttctgccattgaacttggaaaagaagattgcttttcgatttacacggttaaaccgtttatatcctacaaaaacaattggaattaccccagagtaccctggcaatattggccctctgcattggggcagggaccaccgaagggcggattattggtttcttagaacccaccattccctgttttataaataggcttttaggctttgggtgaacctggtaaaaacccctcttgttacccccattattctctcctctaaaaccatttgttaataggtttcccaactctacctcaaaattcgataggcccttttttgtttggggaatttcaaccttttattgaaagaaaacaacattttgggtt

SEQ ID NO: 73050 - DNA, 1676 bp, Oryza sativa
  unsure (1)..(1676): unsure at all n locations
gcgtatgaatctcatccgtggcctcacgtcgactctagaggatcccctagttggatgatcaagatagtgaagcattccatataaagtaagatataaacaagaaactgaaaccacacgtgaaactaccttcacgacaagctttgcagccagctctgcaggcaatcctcggcatgcctgagcagcagcttctgaggacagtgcatcccaaattccatctgatgcaattattagcctccctccagcatttgatagctacaatttcccagaatgaaaagcatacacagttaagttcattgcgataagctactccttgcatttgatcaaactcttaaaatttcaccttcacttgcttgacatgtggaattggcacaatgaactccccaacgtcagtatccccaatcgatcttgaaaggcacaatccacctggccagcatctgagaggtcccacctaaaacaacagcaagatttcacatcaaaacccataatgagaaatgctttgacagcattgaatgtatccttgaagttctttccaagaatatttactagcagcttacctcctgtccaccacacaggttgagccggctgacctcccttcactcgcggtgacgcgctcccgctctctacatttttctcgagacgatggtccacggttagcagcgagatcacaccgccctgcgtggccaatatgcacctggagtccccaacagacgccaccgtgaccgtgaacccatcgacgacgaccagcgtcgctgtcgtccctgatgccttccctgcaatcacactcacacaacatcccccaaaagtaacatcttcacagcggcgatggtccaggctttcaagtttcaacggcattgcgaggatcttctctcacccttgcgttggaagtcgatgtccgtttttacgaaagcccgcgaccagcgcgcgcggcagcgcctgcagccagtcgttgcggccgatgccctgcggacggcgctcatcacgtgctccagcaggtgctccttgctgaaaaccgccgccgacacgccattgtgtccgtcgaacacctgccttaccgcagttccaagaccaagatcaaaaccggacgcgccatcagcatctgggaatcccgagactagtccaaaaacgccacacggaggtagggcacgtccggcgaagtcgaagaaggcggaggaaggttcgcccagtacgcgaagccagtcgggcttgacgagaaagtagtcctctccgcgcttggcgaagctaaagtggccgtaccgttcgatcggccgctcggatcccccgccacggagctcgcgtccgatcagggtcgccaggggaagcgacggggcagccttcccctcctccccggcggcgctctccatcacagcctctcccgagccgccgcactcctagtcctcctacccaccaagcatcatcccaacctgccaagaactcacggaaacggcgccatttcttccccggaaaaaagctccggcttgctgccaagggcgggaggaacccgagatggatctgatttntcncngnnngtgccggttggaggtgagtgcaaatcatcggggngagngggaaagagacccttacacttatttaattaatacacccgtcccctacataagtattatntaagataatatctacccttcatatatatataatattagaagtgaggtggtggt

SEQ ID NO: 73051 - DNA, 1390 bp, Oryza sativa
aaccagtataattcttgtcttttgattactcgatgtcgtactacgtagatccttgtaccagcgtaccccaataccctctatatccggtctacgggtatcacccgtcgacaatcgtaatcaaaaaggtgcatcgaaacgttatcggaagggaaaaaaagatacatttttgaactaaacaaactatcagaccagcaaataaatgatccacccacacagtacatttagattaattaggtgcatgcatgtttaggaacagcccatgcaatacaccacagaccacacttttttgctaatattaaagcacaaactaacaaagtcagcagtactactccatccgtcccaaaaaaagacaaaccctaattttcgtgcccaatatttgacgtccgtcttatttaaaaaaattatgaaaaaaattaaaaagacaagtcacgcacaaagtgttaatcatgttttatcatctaacaacaataaaaatacgaattataaaaaaatttcatataagacggacagtcaaagttggacacgcaaacccagggtttgtctttttttttttttgaaggagggagtacttgtcaaacttggcccatctgggggtaagagccgcgcctatttagcatgccacagttccgatcgtgcggtaggaactagtagccctcgtccccacagtatcgtcgacatgagttcttgaggatataggtcccatatgttagtgggcccatgtttcttttgtgtgaatgactaatgggtcccatgcatattttttaattctaccgccacgtaggtgctacgtcaacgctacgtggaccgaaaactcggtcaatattgccacgtaggcaccgcacggcgccacatcagcaaaaccgcctcccaaaacggtccagggagtcaaatgcaccggttttaggagtttgggggtcgagatatccgattttgtaatttaaggtcgtggacatttgagggtcataaagtgaacttattcccgctgcaaaccccaacacactgatgggcccaaggcccatgagtctccccgctcgggctgaaaccctagcccctctcactatataaacccccggcgccgcacgcggccaacccttgcacccccctcaccacacactccacacaggtaagaagccggcggcggcggcggcgatggtttccctcaagctgcagaagcggctcgcctccagcgtgctcaaatgcggcaagggcaaggttggctcgaccccaatgaggtcaacgagatctccatggccaactcccgtgagaactcccctcctcgtccctcccccccataaccctccccactgcccgaccgtatgatgttctgtgcctgctacttgtgtggtgttgatgcgtgatttgcttagatctgaagccgggctgcaggaat

SEQ ID NO: 73052 - DNA, 27534 bp, Oryza sativa
ttactacaagcattccagcaaattgcacaaaccaagtctaccgaaataaaaagaagagaaaacagggaatgggggaaaaatccgtggatcttgtcgaccatcgttatccaccaccaccaccaccacgccgctcgctgccttcgtccccagccaccgccgctgcctccctctatccccacccgaactgctcactgcttccatccacgccccatagctccggaagggcgcaaggaagacagtgaggtagatgaggtcggcgacgctgctgtccgattcctcctgctttctcagatctagcggcgccgagctcggggacgcctgatccggcagcccgcccgctgtagccgctaaagaagaggtagaccaaatattgtttttcttttttcttttttttttgggaatttttggattggatttgtttccgtaagcttcggttcttgttgttcgtttggttggatttttttttatgttttgaattttttttcctttctccgattatgaggatgcaaagaacgcgatcggatttagggacgacgggtgcgatgggcgcaacggacgaaaacacggaacgaacgtgtactgactacggatggatgaagtaaaacgaactcttcaactacgcacgggacgcggacgaacgagaagttattaattttttaattagttgttattattattaagttattattataagatttagcatagcagcaacaacatcataaatcagttatacccgtaaagctacgatttttctcttttttttgaatttttttcggctcctcggagaggtttacacgtggttggtaactttgcaaaaatttatattactccggttgagttgttgtgtacctaacactgtgagtgagttggaagaaatttgcaatttaatttgggccgtaacgggatttgagatgaggaaagcccattagacccaaagtaccagcaccataaaaaccctagccgccctcctccccttcctcacagccgcctccactcctctcctcttctctcctagccctagccctagccctagggcgcgcgttcgctcaccgccgctgccgcctcggcaggtaagcattgatcgatcccctcgccgaccgtctctcttttcctctcttcttcttgaggcaggtttgccttgtatgttcatcgcgatcagtcatccacatgcaaagaacacctctctttttttcttttttgttaatttatcatccgatctagcaggatggaaatggttttcttcaaatcttttcagtactgagtgctctagttttgttgcgtctagcttcttgatttgccttctcatagatcggatgttccttttcagtattttgactgcacatgatttggttgtgaggatagcagtaaaaatgaattgatgtgttcttgataatagccataagtaatcatctttggtatcatcctaaactcgatttggttggtttggtatctgggttctgtgaattttccttgggcttattaacttctcctgacatagttgctggaagatttttggctaagattgcatgcgcttcagttttttttttgttggcttctaacgaggaggctcctttgctttttgtaaacaggaatttgcatccgtagcgtgatcttcaaaggctgccaagatggtgaagttcacggttgaagagctgcgcaggattatggacaagaagaataacattcgtaacatgtctgtcattgctcatgtcgaccatggtatgtgctacaagatttgatctattaagactaacgatgttttacagtagtacttcttagttctagcagttagtgttgtatttcgcttttcctattgtatcttgtttgcatttgtcctctaatgatgtatattttcatccgtgcatccataattccacctgttaccttctatatgtattgatttctgttaccttctatatgtatgactgatgcttacttttatatagtaccaattgtttacttgttcattttaacatgcctataattgtattagtcaattatttacttgttcatttgaacatgtgtaattgtattagatttgacatgaaatctcaaaatttacactgctttacttgtgtgcttgacatcgatgcctccatgcatgtcctattaatacaaatttgtttgaggttatctatgcttactaagccttaggattttttttggccaaatctctagtttctgtttttgtattgcaaatagtcaattatctttcaagttgtgatgctatttgtgtttttgttgtatataggctaatatgttcaatgctcatgctctaagcgtcattcatttcttatgctgagtatttgtttaattctaatgttttttgctttaatggcatgcctaatatgtgaaattttgttgattctaacaaggttttactgcttggtctgattcataattgtaacatgactatctttggactatttctaaatttctaaatattatgctgctgaagtgtgaattcatatgctatatactcctttaattggctatgcaagcatttcaactcttctgtaaatttgctgctgaccattccattttctgttagaaatacactatgctaatatgttatgtgttccttgcaggcaagtccacgcttacagattcccttgtggcagctgctgggattattgcccaggaagttgctggtgatgttcgcatgactgatacccgtgcagatgaagctgagcgtggtattacaatcaagtccactggcatctctcttttctacgagatgagtgatgaatcactcaagttatacaagggcgagagagacggaaatgagtacctgatcaaccttattgattcacctgggcacgttgatttttcttcggaggtcactgctgctcttcgtattactgatggtgctttggtggttgttgactgtattgagggtgtctgtgtgcaaactgaaactgtgctccgccaagctcttggtgagaggattaggcctgtccttactgtgaacaagatggacaggtgcttccttgagcttcaagtcgaaggtgaggaggcgtatcagaccttttcccgtgtcattgagaatgccaatgtcattatggcaacatatgaagacacgctccttggtgatgtccaagtttaccctgagaagggaactgttgctttctctgctggtttgcatggctgggctttcacactctcaagctttgctaagatgtatgcttccaagtttggagttgatgaatctaagatgatggagaggctttggggtgagaacttctttgacccggccacaaagaagtggaccaacaagagcactggctcagctacctgcaaaagaggtttcgttcagttctgttatgagccaatcaagcaaatcatcaacacttgcatgaatgaccagaaggacaagttgtggcctatgctgcagaagcttggtgtggtcatgaaggctgatgagaaggatcttatgggcaaggctctcatgaagcgtgttatgcaaacttggctgccagccagtaatgcacttcttgagatgatgatataccaccttccatctccttcgaaggcccagaagtaccgtgtggagaatctgtacgagggtcctcttgatgatgtctatgcaactgctatcaggaactgtgatccggaaggtcctctcatgctgtatgtttccaagatgattccagcatcagacaaaggtagattctttgcctttggccgtgtcttctctgggagggttgcaactggcatgaaggtgcgtattatgggtcccaactatgtccctggccagaagaaggatctgtatgtgaagagtgtccagcgtactgttatctggatgggaaagaaacaagagtctgttgaggatgttccttgtggtaacactgtcgctatggtcggtctggatcagttcatcacaaagaatgccaccctaacaaatgagaaggaagctgatgcctgcccaatcagagcaatgaagttctcagtgtccccagttgtgcgtgttgctgttcagtgcaaggttgcatctgatcttcccaagcttgttgaaggtttaaagcgtctggcaaagtctgatcctatggtcctctgtaccattgaggagtccggtgagcatatcattgctggagctggagagcttcaccttgaaatctgcttgaaggatctacaggaagacttcatgggtggtgctgagattattgtttcccctcctgttgtctccttccgtgagactgttcttgagaagtcctgccgtacagttatgagcaaatccccaaacaagcacaaccgtctttacatggaagctcgccccttggaggagggactggccgaggccatcgacgatggacgtattggcccacgtgacgatcccaaggtgcggtccaagatcctgtctgaggagtttgggtgggacaaggacctcgccaagaagatttggtgctttggacctgagaccactggccccaacatggtggtcgacatgtgtaagggagttcagtatcttaatgaaatcaaggactctgttgtggctgggttccagtgggcatcaaaagaaggtgcattggctgaggagaacatgcgcggcatctgcttcgaggtatgtgatgtggttctccacgctgatgctattcacaggggcggtggccaggtcattccgacagcgaggagggtcatctatgcttctcagctcaccgcgaagccaaggctgctggagccagtctacctggtggagatccaggcccctgagaatgcccttggcggtatctatggcgttctgaaccagaagagaggccatgtgttcgaggagatgcagaggcccggtaccccgctgtacaacatcaaggcttacctccccgtcatcgagtcgtttgggttctcgagccagctccgtgccgcaacatcgggccaggccttccctcagtgtgtctttgatcactgggacatgatgacttctgatcctctggaggtgagctcgcaggcgaaccagctggtgctggacatccgcaagaggaagggtctcaaggagcagatgacccctctctcggatttcgaggacaagctctaagaaaaaacccttttggtctcgcatatgtttttgccattaatttacctgttctaatagctgttctactattgttaaagagttataagacaagtcagaaatatgatgtgtttgttacacatcaagtatcggtgttggtagtgttgtgctgtggaactatatattttgctgtctggtgatatgcaacagatatggaactttgataatgtatctgttgatagtttttacggttttctgaatcagtttcagtttgatatatcatatccatatagtacctttcactttcgtttctgccgaaatcaaatctaaaccctccacatagatattattgtacgtgcctggagtcgtggactaactagctgctttgctgtaacctaacaactctttctttgcattaatcattctgtgcaactttattctttcttactttcttcaatattgtttcactcggataaaaacttttggaacatgtaaaaagaagctaccaatggttacataataagaaaagtcatcatgcaagtaagaaaaatatttaaattcacaagaccatgtctgtcttcaaattcacatcaattttagttatgaattaacacttactggtgcataattaatacacattgagagaaagtttaatggtttagtctgtttctagctaaaacaatacaaaaaaaatattaatacatattttttcagctaaagcaatacaaaaatattaatacatactttttcagtaaaactacataccccttcataaaagaatagaggatatattattaaataaaacgctctcggtgttattgatattcagactcttttttctcgttattgtgtaagatacttttacatttataagaaacgtgattattacaagaaagcagaattatctcctctttttcacattgtttaattttttaatataaaaagagtgatagtttttctgaaacaaacagaacgagttttttaatataaaaagagtgatagtttaaaatattttgtcgaatgatagtttttacagtctcctgcggcccttatactatttactccctccgtcccaaaatataacaatttaggattggatgggacacatctagtctaatgaatctggataaaaggctgtcgagattcgttggactagaatatgtcacgtacagttctagattgctatattttgtgacaaggtagtatcatataaacaactaatatttttcattattcttgtcattttcgtaaatatctactcgtttattgtacggactgcctggtttcgtcttcctctgatcttggtcatgctatcaatttttgtggcttttttttttttgcgtgtatggtggacggctaactagttttgggagatgaatgcatgatagcaaaatttggcctgtaagatgcactgcaacatactctgtcaaaaaaagcttaccgcattcctttatcctaggttatgttctatccttacctaggttaggttttttttgggacagagagaataagctacaagttttataagatgcatcggaaatttctagaatctgttgaagagatgagctatgagatgaacataactccaaggatttggggttaaggtttcaacagttggaatgttggtctagcttaatagaaagcaaagaaatggcagattgacataattgtaaagtttgttttggagcaaaattggttgaacataattccacgaaaattcatttcaccatggaaccaagaaaattctccagattttaaatcttacttcagaggtaataattattattatccgaaaacatagcctacaagagcctgcccgtatgtaagtttggttttcttcagatctttagatcgttaaaatcatattttctacacccatgtgtccattcatatattgatagggtttccaaatattgaaaacaaatgaacaatcgctagaaaacggagcaataggagattaaaatgttcatcacggaaacatgccataccatgtgctcaaatgtcgaaacaaaagcgggtcgcggaacatatcatattcgttacagggttcattttgatttgaagttttaggctaccagaaaataacatttggaagccaaccagctgacgatcgatatcagcatcttaagcagtgcgcaggatgatgtgaacaccactgtcagtgtccacagtgtcactcatctcaccaaccttgagagcaaatgtcgcatcttcgaagggtttctgcatctgcctcctcccaaaagtgcctgcaaggagggttacgccacggttagaaaagacctatagtactggcaaagatagaacccataccagaaaatcattatgcattatctgtaaagataacagtgcccaagaagcacataaaacataagtggccgtaatgcaacacaaagattgcaaagttattcccttaaagctatacttaaagatgcgcacacacagagaagaatatgggtgcttaggtaaattctcttaaagaattctcgattaaatatttctacttgaaacagacatgtgacactccctactcggcatgccgatgctaaggaataatgaagacaatgccataggctgatggaagacgtgtaatgtggctacaaacaagtcttaacagaataaacttgcacaataaaagatggatatcacaacataatggaatgactgcagaagtgcttgttacactgatataacgcgtgcaaccaaacaattgggaaacacaaaaggaagagaaaaaaaaatggtgcagtaattaactacaaaaaacattttatcagaggagctgaccatcaatgatcgaatgaagggaatcaacagtaacacccatttgggaattaatactctagttttcagcataagctattcatctgacttgtatgctcttacagctgaaccagctcatttcatttggcttaatttagcctgggttaattattcttgaaaggctatagttctacctgcaaagttagccccagtagtgcacaaattcgttgacaaaatagcaaatcttgtatcgcgcagacactacgtccactagtaggttgcagacactaacaacacagatccagtgggaggctggtgatctttcatgataaacagaccagcaaactatgccatcagaccaagcaaattattggatgtcctactcatgtcatgacatctgtgaatgttatacacgagttaaaattagaatttcattaaatgcctcatttcacactgtgacaaaaatgagtagatgatagatgtgaacaagctaactgatccttgtacaaacagttaggcaacaatccatagatgatagatgtgacctacctcctcctaggagctccaggaactcccgagcatatagctctatcgatcgataattcttgtttgagtagttactgttactattacaaacttacacataactcctgtatggattaagggttgcaattatagcgcaaaagttgattgaagtggcaagatgaaagaatcgcgtctcactcacagaagaaaggttgaaagatctccttgatttggctacaccaactaagtccgcaagaaacgaatggatgggccaagaagtggatctgagagagagagagatcagatcgggggacgcacccaggtcgccgccacggcgcgcggaggagcagtcggagtggcgggcggcgaggtcggcgaagttggcgcggccggagaggatctggtcgcggaggtcggcgaggcgcgcggcggcgtcggcgcgcgtggtagcggagatgacgcggccgtcgggatccttccaggaggccttgcggcgggagccctcgtgcttgatcaggatgtgcaacgccctcaccgtctccgtctccgtcgccgacgacgccatctcgatctcctcctctactcctccgcctcaccaatacgctttctgcgaatacgcttttcgagtccgtttgtgcaaaccacatggagtagtgatgaatgaatgaaataagggttttagagttgctatagggtgtgtgtttgcaagagaagttaccaacactcccctctcgttttccgcgtgcacgtttttcaaaccgttaaacggtatttttttgaaaaaagtttatatacaaaagttattttaaaaaaaatcatattaatccatttttaaaagaaaattagctaatacttaattaatcacgcgctaatggaccgcttcgtttttcgtgcatgggagatgggttcccaacaccacctccgaacataccatagtcctagtatgaacttgacttgaattccggatgttttattttccaaaatgataactttgaaagttcctcacttgatataaattcctaacacagccaaaattattcatattgattaaaccatatatattttggttgcttgtaattccattcaactttgtcaaatcgttgtgacttgtgtatatacttttcatgctctataatcaagatcatacacccacatattatgcacgtgctaaacttctacactggaagctagcatatatccatttcatccattccatctttatttccactatccaaataaattctccatgcttatatatgctttcttctcctaaaagaaaatcctttctaaaaaaagaaaaaaagagaaaataaatatggagggaaaggcatggttataaaaataattaagttatgctctctcaatattgagcatgatattaaaaaaaagtagccatgccctctacgtaattatgaaaggaggattttggagaagaaagtaagcacaaaggagaagtattttctttatttttcacatttcatttccaccatataccacacacacacattgcacgatcttgatcttgagtatgtttagtcatctattttagtccaagtttttgacttagtaataaatgtgaatacaagtatatcatgtttgattcctactaagctgtaacatcccggtctagggcttaataggattaatataatactcatatcaacaagttgcaacttcttttctggaagccaatctccaaagaactctagggttaagtgtgcttggcctggagcaatttgggatgggtgactgaccgggaaattcttcccgggtgcacacgagtgaggacaaagtgtgtagaaaagacatatgttggtctgtgagggcagtctatgacctatgaaagctgccagatgtaagtgggcccggcctgggagaggcgggtcgttacataagctccacatattaacttaagagtaggaataaaaaggcaatttggtgaagaattcatatgcttggagtgattgagtgaatcatttgaggaacttggatttcttttgaaaaatcatttgaaatcctccggaatgaaagttgaataaacatatgaaagctgccagatataagtgggcccggcctgggagaggcgggtcattacataagctccacatattaacttaagagtaggaataaaaaggcaatttggtgaagaattcatatgcttggagtgattgagtgaatcatttgaggaacttggatttcttttgaaaaatcatttgaaatcctccggaatgaaagttgaataaagattgggtgattagtgctctatttgctgttctgtctctcaagcgcttaaggcaaggaaatgaagtgtctcatgggaatcaggggtaagggtaagccactgtgccaaatttatttaatttgagagagagtacacatactttacacatttgagatatacagcatagtagcaactcctgatcaacaaccaagttttatttttgaggtgtctggatagttaatttctagtggttgcttcgtatccatcatggtgaaagtgaagcattggttatcccaatagtatgctaatgtctctaagctggctaaacaattatactaatatatgtagttgaactattataattactttaacttttattgatcttaactgagtttcattattacaaaactgaagactctcacaccactaaactcaccaacttcctaacactcaaaagcaaacaaacgcatgcacttacatcccaccactgatgtaaatcacatgcaagacccacacacacaaccaaacttaaaacaagcaaactaacacaacgatctaagacaacgactagacatggcactctagttcttccgagcatcgaaggtcgattgaaggctcgtcttcatcatcttgagttgctacccactcaatcttggaatggttgcgcttggattcttcttcttcatcatcacttataatgatgaccggaggatctgttaaggctggggcaacttctttttccaccacacggacctttggcgccaattgatagcgagggacaaatagagctctcttccttgcggtaagacgaatcctggccttctgcggcggtgcttctcccttcaatgcagctagttccttctccaaacgatccactttgtcctctagcttgcaaatcttaccacgattccggtcttcacgatcttgagccgctaacacagtctctgcacggctttcatccatagcccacagcatctcaaccaaatgccttgtagtagcatcattctcaattccttcagtctcaaggtagctgccacggtcacttccctggggttggcgaggatggtagcgatactcagtgtcggccaactgatcactgtagcgatcacggagctctcctatggcgatccttgccacctcctgacatgaatggatgtagtttcttcctccagcttcgaacatcactgaggggatatcttcactattactgttcaaggtgactttgactcgacacttctcttcatgacgatcatgaggaatctgggcataaaaaggggcagtcccaaatcctatggcaaaggacatcgtacgcaactcctggacaaatccctcaacaccaaacaagtactcaggcttgtagcgcggcatctaaagacaagtgaaaggagggagttaagacatttatccaattaatagcacaagtttttggattaatttgaataaagtttagaaaatcaaagtaaaaaggtaagtaaataaaataaaccaagcttgcaagataagttgaaacagttggaaataaggttacaaattttgtgcttttgaataacaggtttcaaaagaaatgaaagaaagttataaaatcaacatgttaaatttatttcagtgcagtaagattaaataaaacaatattgtaaaacttttgctggtaaatgagccattagtatagtaatagatgtacagtactaataacactggaataaattttgaatgagaaccattaaaagagattatgaagtgcatgtgccagtagtttggtttaattaaaagagaaagggaggagaacagttctacttttccaatatttttagagagcttctatggataaccatttggcataacctagggtcaagggggctctgataccaacttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagtggaaaataaaataaacggcgcagacgactccactccacaggcagcttgaccagggctacacctaatcctccacaccatcagcatcattgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttgagaatttaataaaacagttaagtaataattaaacaatattaatccaacactatacaacataccctgttgtataggcccaaccattctgaacaaccatacccggctgtacagatctatctccaaaccaggaatataccattccaaaccaggagctaatcaaattattaccaattagcatctgttaacatgatgagaggtgtgagactaatcacgaaagacattgttagacccgcccataaccgcgggcacggctattcgaataggtttactctgatcagaggtgtaccactgtacccacaagacacaaccccacatcatgtcaccatgtgcctcaatacccccacagggtacctcggaaaggagttgtgacaataccccttgcataacacaatctaccggagcgcaccttcctggatcatattcccccccttataaataaggcatggactccccaccgacccccgtgggctcatctcccccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccaacaaaaccatgtgctcacaacccaccattatcaggttttagttggcacattaattaattaaccaatcacgattgaccatcgtgaactatcattaagccatcattaaattatagtgattcataagttatcccaatagtgtgctaatgtttctaagcagggctaagcaattatatctgatatctagttgaaccaatatacataaagctcaaccagtcaaattataataacccaaggtatcaaggaataaggtaatcaagaacaaaagggctataacaaacaataggttaattccacccaatgacattcgaaaataaatgcaatagttgaatagaaaccatagctttaaacaggatcaacatgctctaagggttgtttgggatctgtgtgacttgccttgctggccttggaactcttcaaactcttctctagcgaaaacggactctccggaaacgacggaatctaagcagaaaagagcaaaataaccaaaacagcacataaacaagcatgaacagtacatgtggatatttttaacatgtagatctcaattttagaaaaatttagagacttgaaccaactaaatccgagctaagatgaattagttatgaatttttgaagattaaatcggattaaaaaacttaaattgattttaattgaattatgacgcaataatgaattatttttgaaaaggaaaagaggatttattgcgtcagcgggctagggtttcggtggaccgggcgcacggcggcggttcacgcgaacggacggccgagatcgacttgatccaaaacggacggccgagatcgatcggtccacgaccggctcacgggagagggcgacgatgacgtcagcggtgacgtcaccaccggcggcggcggctcggcggctcgaacggcgcatgctcaccggcgaacggcggcgcttcggcacgaacggaggacaccaacgggtagcggacggcacggcgaactcaccggcgaccaaagcgacggcggaagaccaacggacggcgacggcgacgaggttgaaacggcggcggtcttcggcttgacgacggcgatgatgcttcggcggtctccgacggtggcgaagcggtggacgaggacggcgacggcttggcgaccacgacggcggtcttctcgagcgacgacgacgtctggaacggcggcggcgcacggctggagcgacggcggcgacggcggcgctagagcacacggcgctagagcgctacgggcgacgagaggcgaaggcgagggtggcggcgggtagaggagacaccggggaagcttataaaggggttaggaggcggcggcgaaggcccacggcggccggcgacgagaaggaaagttcgggaaaatcgaatccgaaacaaactcgaatccacgaatttgcaaacgattttagccggtgtttccaaaggagaaaaggtagaggagatcccaaagatcatttcccctctatcaattcggccggaaacggaaagaaacggccggattggaaagcggcggcggcggcgcgaaactacggtttcggccggaggaagacgacgggcctgacaggtgggccccacctatcagcgggcagacgcgcgcgcgcggcggcggactgggccggactgggccgaggagagagagaagagaggttttgggccgactttcggccctaagctaaaagaaactttttaaaacctttttcaatttaaattatttatgaaatgcaattccatttattaaaaatacttccttagctcaaataaatcccagaaaaatctaggaattatagaattaagcaaagtatttaatgaaattttatctggcccctttttatattggaatttattaattaaaattagatcttctcttctaggcttttaaaataaattctaaaaattccatttaaacaacaatttatatattttgaattttcagggtgtgacaggcggcgcgaaactagggtttcgggcggcggcggccggaggttgacgacgaccctgacaggtgggccccacctgtcagcgggcggacgcgcgcgcgcgcagcggcggactgggccgaactgggctgaggagagagagaagagaggttttgggccgactttcagcccaaagccaaaagaagactttttaaaacctttttcaattaaaattatttcttaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaaaaattccaattaaacaacaatttatatattttgaattttcagggtgtgacagaagtagagtatagagtccatatagaaatacaattaagaaataatacaaattcagaattaaaaataaggaatattataagtagagtatagagtccatatagaaatacaattaagaaataatagaaattcggaattaaaaataaggaatattagaagtagaatatagagtccatatagaaatacaattaagaaataatagaaattcagaattaaaaataaggaataatagaagtagagtatagagtccatatagaaatacaattaaggaataatataaatttgaaattaaaaataagcaatattagaagtagagtatagagtctatgtaggaatttaaaactaagtaaaattcgaaataaacataataaaattaaaagtagagttttgagttcatataaaaatacaatttacaaataactaaaattataaattagaaaaatgggatgaagagtctaaattcaatataggaatacaatttaaaagtgactgaaattcgaaattaaaaattaaagaatattgaaagacgagtttagagtccacatagaaaatagaaataataaaaattcagaattaaaaataaataatattagaagaagagcatagagtttatataaaaatacaatttacagatagcaaaaatttgaaattaaaaaaagaaatattaaaagacgagtctatagtccatataggaatataatttacaagtaaataaaatttgatattaaaaataattaataaataacacgtatataaaatacaatatgaatattacacattagtagtttcgtaaagttagtacaaaatttaaaattatgttgtcattttaaaatatttgaataatacattgagaaaacgtatatgctattatatgagagaaaatataatgatgctagccgcgcaatctgcgcgggccaccatgctagttacacatattcaaatagataaatcgtagtggtaattttctaaatcaaagaagttgtagtggtatatatggatccaattaacaaaaagaaacggagggagtataaattagaatttagacttccagtggatgaaatcatacgcccatgactccaccaccatagtctccttatagtactggtgttttttttaaaaaaaattcccaatttctaaagatgaaccttgacaagagcttgtcggattcatcacaagaaattattctattttggaatgagagaaagtactactcactctgtccacaaatacaggttctataaaaactcacatctataagggatggaggccagggagtaacatccaaaaattgtcaaaaacaaattgtttaatcgacttgtctgcgttttcagtattgtaaaaaaaaatcagaaactaataaaacatggtaaatatctagaaatattatttcctgttaaatatttgtaccatatgatatatatatatatatatatatatatataataaaaaaatgctgctgcagtcagccactgtctatccacccaaccagccactgactgaagcttcaccatccccatccctcccatggccatggccgccgtcgccgcaacttcgccgacgacgacgccgtcgccaccgaccacgcacccaccttccacctaggcgacagtccgctccctgaccgccgcgggcaaccacgccgccgccctccgcgcgctctcctccatcaccatggcgtcgccgcagcagcagctcgaccactcggcgctcccgcccgccatcaagtccgccgcggccctccgcgacgcccgctccgcccgcgccatccacgccgccgcgctccgccgcggcttgctccaccgcccctccccggccgtcgccaacgcgctgctcaccgcctacgcgcgctgcggccgcctcgccgccgcgctcgaggtgttcggctccatctccgactccgcgcatgacgccgtctccttcaactccctcatctccgcgctctgcctcttccgccgctgggaccacgcgctcgccgcgctccgcgccatgctcgccggcggccacccgctcacttccttcacgctcgtcagcgtcctccgcgccgtctcccacctccccgccgccgccgccgccgttcgcctcggccgcgaggcgcacgccttcgcgctcaagaacggcctcctccatggccaccagcgcttcgccttcaacgcgctcctctccatgtacgcccgcctcggcctcgtcgccgacgcgcagaggctcttcgccggcgccacgcccggccgcggcgacgtcgtcacgtggaacaccatggtcagcgtgctcgtgcagagcgggatgttcgacgaggccgtccagacgctctacgacatggtggcgctcggcgtgcggcccgacggcgtcacgttcgcgagcgcgctcccggcgtgctcgcggctagagctgctcgacgtcggccgggagatgcacgcctacgtcatcaaggacgacgagctcgccgccaactcgttcgtggcgagcgcgctggtggacatgtacgccacgcacgagcaggtggggaaggcgaggcaggtgttcgacatggtgcccgactccgggaagcagctcgggatgtggaacgccatgatctgcggctacgcgcaggccggcatggacgaggaggcgcttcgtctgttcgcgcggatggaggcagaggccggcttcgtgccctgcgagaccaccatggccagcgtgctgccggcgtgcgcgcgctccgaggcgttcgccggcaaggaggccgtgcacgggtacgtggtgaagcgcggcatggcgggcaaccggttcgtgcagaacgcgctcatggacatgtacgcgcgcctcggcaagacggacgtcgcccgccggatcttcgccatggtcgacctccctgacgtcgtctcctggaacaccctcatcaccggctgcgtcgtccagggccacgtcgccgacgcgttccagctcgcccgcgagatgcagcagctagaagaaggcggcgtggtgccgaacgccatcaccctgatgaccctcctgccggggtgcgccatcctggcggcgccggcgagggggaaggagatccacgggtacgcggtgaggcacgcgctggacacggacgtggccgtcgggagcgcgctggtggacatgtacgccaagtgcgggtgcctggcgctgtcgagggcggtgttcgaccggctgccgcggcggaacaccatcacctggaacgtcctcatcatggcgtacggcatgcacgggctcggcggcgaggccacggtgctgttcgaccggatgacggcgagcggcgaggcgaggcccaacgaggtgaccttcatggcggccctggcggcgtgcagccactccggcatggtggaccgtgggctgcagctgttccacgccatggagcgcgaccacggcgtcgagccgacgccggacatcctcgcctgcgtcgtggacatcctggggcgcgccggcaggctggacgaggcgtacgccatggtgacctcgatgaaaaccgtgatggagaccagcaggtgtcggcgtggagcacgatgctcggcgcgtgccggctccaccgcaacgtccacctcggcgagatcgccggcgagcggctgctggagctggagccggaggaggcgagccactatgtgctcctctgcaacatctactccgcggccgggcagtggactcgggcggcggaggtgaggagcaggatgcggcggcgaggcgtggcgaaggagcccgggtgcagctggatcgaggtcgacggcgcgatccaccggttcatggccggcgagtcggcgcacccggcgagcgaggaggtgcacgcgcacatggaggcgctctggggggagatggtggcgcgcgggtacacgccggacacgtcgtgcgtgctccacgacatggacgacggcgacaaggcggccgtgctccggtgccacagcgagaagctcgccatcgcgttcgggctgctcagggcggcgccgggcgccaccattagggtggccaagaacctgagggtgtgcaacgactgccatgaggcggccaagttcttgtcaaagatggtcgggagggagatcgtgctcagggatgtcagaaggtttcaccatttccgcaacggccaatgctcctgtggggattactggtagtgaagtactagtctctcaaattaatgatgaattatatatagcatctaatacacatggttaagaacaaaaatgatatactcattcacataaggtgttcttgtaactcgattaatttacagcaaatgttcagttcatttgttgccactggagagacggggaagagagaagagtggggaggatggatgaagatggaaacgtggggattggaggcaaatgtattttagatgcatctaaaactatagaattatatcctatgttagatttaatgaaatattgctgatcaaacttaataaaatttcactaggaaaaaaaatctgttgtaatatacaaacgaatgttgtaatatgttacggtaacaaaatacaagttcaaaataagtacttcctctgtttttaaatattttacaccgttgacttttttaaatatgtttgaccgttcgttttattcaaaaaattttaagtaattattaattcttttcctattatttgattcattgttaaatatacttttatgtatatatatagttttacatatttcattaaagtttttgaatagaacgaacggtcaaacatgtattaaaaagttaacggtatcaaatatttagaaatagagggagtagcaaactaaattctagctagtgaacatatattgacaagtaaattttgttttttttatttattgcctgtagaagttgaagtcttacgtcacattcacatattaatctaatcttattattcttttcaaattttgtttaataaccatttaccccctccgtccaaaaagagtcaaacgagaggagagaatgtcgcatgctcttaacccaatttgtaactggtggtagtataataatttcctgcatcctccatggcctagttggatccggtttccagtgtcggcttcctcccgttccgtccagccaccgccaccgaccgggggatttacaattataacactacaaacattaacttttgctataataatattggacccacatttcatagacacagatgggctcatttctcattcactcagagtgtcaaaacagcgatcatgcgtccacaagtacgctgccggagccagtgagccaccaccacatcgatcacgcgcagctgcgcgcggccgcacataggcgaggcgcgaccgacttacctgctgtccggacaaggtcgcggaggacggcagagcgcgcgcacgccaggtgttcgacgcaattacatcgagaagaaaactctctggtagatagaattctcatctcggcttcggctgtgtgataagcaaatggtgaatttttggtttgctgtgagtgacgtctgttctttctgggtcttgaccagatgtcagcctgcaatgcaggtcatcaaagcaggagcatatgagcaccactgaggtcaggtagcagataccgaggtaactttggtccatcgttaccatctcagcagccacgggttccttgtgtatttgtcctaggctgacgcactccagcccttttgttttccaacaatttgcactcccaagtcccaactggcaactgctgttgacatttaagttttttagatcaaaaggctaccgcccagctttacttgaaaaagcataagatgtctggatacaggtttaaggctggggattccagcttacaagacaagcatttagccaagtctggcaacataagctgctggcccagcagaagcagagacaaaccagagagagcgccaaaactaccaccagattactgcacatttatccggcaaatcagctgcttcttcctgcttcttggatactggcatgcagtgaggccctcaaagcttccagctctcccctcaatttcattgggaccagatttttccactgtaagaaaaaagataaagctttatacggcacatgcataatgtcagaaatgttgacatttaagttttactcttgaatgccgattacagtacgaatcatatgatactctcgagctcaacttcctggaaggtgcaagttgcgatatttgatggttgatgcttaccacaaaatatagtctaaagtgtggcgtacatgagttcaccccatcgccattggtagcgtgagcgatcagttcaacaccgctcaacaactattcgacaaaacaccttcaaggcatctccctggcccttgtgattcctggctggctggctggttgcgaagaattaattcaggttccttctctcgtatctcttagattaatttgatgggtggtttcgatttcatacttccataagaagggtgttcggctatatcacaaattagattgtgtctatattacatttttatttcagtgctagatggatattttgtttgaaagctcacacaatcatttgttttcgatttaacacaacttttcagcaataccagtgcaaagtttgtacatatgatgatcgatgtttcacgtccaatcccacttttcaggtccactgataataactgtaattgagccagctatatttgactgcaagatttgaggactggatggcagaggctgtggtgtttggaatcctatgcaagattggatccatcttgagttcacatctaacacaggcgttcgttgcacacttgggaaaggaggtatcagttttcattgaaattgaaagcagtattaagcaaatcagaagtgagtttaggttgatgcaagctttcctgcaagacggccaagaaaaagaaagtcatagcaggctggcagaaacctttctacacgaagttcagcaggtatcatttgaagttgaagacattctggatgaatttgtctatttgtttggccaaaaacaaaccgcatctctaaaatcattgaggaacttctttccaaaatctaaaagtatgatgcactggcagagactagcagcagagctcaaagaagcgcagaaccgcctccagaatttgcgaaatttgaaggttcagtacaatattgacttatccgaagaaagtcctagttctatcaggtatgaagatagccaagttcacacaatccaacacataaagcataataacaaaattgttggttttgcaaacgagcgagactgcctacaagagctgctgatgacaaacgagaaatcatgctcaataatttccatatggggcatgggaggttcaggtaaaactactcttgtcaaaactgtttttgaaagaaaagctatcaagaatcgttttgattgcctgatctgggtaactgtgtcacaaacatatgacattactgaaataatgagaaagattatacaatgtgcattgaaggaaacttgcccagctgacctagaaagcatgtgtagtgaaggtgtagccctgaagctccaggggactttgcagggaaggacatacatgatgatcttggatgatgtgtgggatacaaatgtttggttcaacttggaaccttttctagatttgaacagcagaggaagcaaggttgtaattactactcgcataaacgatgttgcttctttggcagatgacaagaaccgccttcaactacgaggactaaacgaggcagagtcttgggacctcttttgcatgtgggcattcagacatactgaagatcaaacatgtcctctcagattggagagagtagcaagacagattgttggcaggtgtgaaggtctgccattagctataacggctgtaggcaatttgctatcattcaaaagactggattcgtttgagtgggataaattctataatcaactaaattgggaattgcacaatcgattggataaccaaggacttaacatggtgacccgactcctaggtttaagctacaggcatctaccagcccacttgaagaactgtttccttttgtccagtatctttccagaggactatatgatacacgggaagtggctaagtagactgttaatagcagaaggtttagttgaaccaaggaaaaatatgacactggaggagattgcaacagagtacattgaaaagctagtagatcgctgcctgctccaagttgtcaggagggataagcttggaagaatatggcaactccagatgcatgacattgtgagggaactggcaatttcaatatctgaaaaggaaggattctgcatgatttatactagtaaagaagcacatacatcagtggttgggtgcgagcctcgtcgtttatcagttcatgagaattatgacagagtccagcaaattataaatgctcaacgtattcgttctttctacccatatcaattggatagtgattattccgtgatgtcaaatgtgcaatgggtgtcaacaagtgctagatacttgaaggttctagaattaagcaatattccaatcacaacactgccgagagacattgggagcttgttcaatttacattatttaggattgagacgaaccaaggtcaagcaacttcctgaatcaattgacaggctccaaaatctccgaactttggacatctaccttactgaaataggaaaactgcccagcggcgtaaccaggctaaggttgctacgccatctgattgcaggcaaagctgaagctacttattttggccttgccgatgtctactcaggtgtgcaaatgcctaatggaacatggcaatcgctggacataaatgtattcacaggcatttctgcaagcaacaagttggtggaacaattggctaagttaacacagctgagatcgctgaagctgtcagacgttaaaagtactcactatgccaagctatttgtatccatcagcaagatgcgtcttctacagagcctgctaattgagactgccaatagggatgagtgtgtgagcttggaagccctgaaccctgcacctcatcaccttgaactactctttatgaaaggcaaactccatgagagcgtcataggctgccacctgtttgaggtaaataggctaagcctccgagagctgaatcttcagaatagcaggctcagcattgatccgcttccatcactctccaatttttgtaacctgacccttcttggtctgttcaacacttacagtggagaaagcttgctctttcaggcagggtggtttcctaagctccaaacactcactttggctgagctgcaaaatgtcaattcaatagtgatacaggagtatagcatggcaaatctctacaacctagctctcatctgcttgaaaaatctggagtatttgccccaaggcatggaattcctaaaatctgttgaagagttcaatctagtgggcatgcaccacaagttcatggaagatgtacaagctggttcctcatatgagaaagtcaaacacataccggtagttgactactttgaccaaagcaaagggaggtgggatcgactttcacgagtttatggcaaaggtaacccatgatctgctcatcacctcatcttctataagctgcataatgcattcttttgaccttcagtgatcaattccctatccttgcagaccaagacaacaagcatcagcagtaagcaaataaaagatggaaatatacccggtctccaagttatatatatatactagaaaatcaacgtgccttttggcacgctcatgttatagctctgcagatgatttctgtgggctattaagaaatagaaattttgcaaatactacagaatatgttcaatttccttaaaatttgaaaatccttaattatattttgttggtattatttagcgtttatttgttgtgtataattataattgaattgtccattaaatgataaaaatgtggtgatatttttatacttgttctaagttttgtttggaaacttatgcttgatgggtgtaattcatatgtccaagccggaataaaatttgtaattgataggtactacaagctaaccaacttgcatctgggctccgttgatatatgcttgatatttgctcccttgttcaaattattttgagcctcaaggatccttctagattaatccctaattcagaggccaacacctcttctgtaggtagaacaggagacctacaacgcagcaacattcaagcctttttctcaacaatgtatttttctttcacataatatgtgatttgtttggaaagtaaggggttgccacgtggcccaatcaaaactagacactgccaacatgagaatattattatattatagaattttttgtatctccatccattgtaactgtattcactcttttgccatccaaaaacaccttttatattttgccaatcttcgttagtatttcttaaagtaacacctgtcactttacctgtaacggacatgaccgttttgtcataccacggtaaccaaactggcgtggcgaaacaacgttgccacgccactcagaccagcgtggtagtgttgtttaaccacgccagcgaaaagattcggatcttgaaaataaccccccccccccccccacacacacacacagagagagacaaacacaatgtccttgtatatgtccaaaaaaaacaaaaacttaaaatataacttaaggatcatctctgaaatgttcttacatttttttgaaaaaaaattatagatatggatctaatgttctcataaaaaaattgcccaaggaaattatgctattacatagtaattgagacaatgttggaaatttttgaaatccttttcaaacaaccttggaatttgccccttcatttttgtgaaacttctacttgaactatcaatgccttcttttcttctcatgttttctggattttttattattttttgggtaaagaaaaattttctaaaattggaagttcgcgtgaggtcggatatggttttggggagcaaactagtgcttattgaatgacaatggcaaaagattgagcactaaaaaaaggaaggaaaaaagatggtaaaagatagaagggcaaaatatatgcggcagaagagagaatacagattcagttagtggcaatgagaccttcagatgatccttgcaatgtttgaatacagattcagtgtgtcaaagtctcaaagatggttgggtgagggatcgtgctcctgttgggattactggtagtatattacttgtcttctctgcgaaattaataatagcatataatacaccatacatgagaacaaaattgtaggccatttgctggtacggttaagtggaagctgtgccaatttctagatgaaatcatgaagttcaattattagaatctttgcagaaattatcataccattttgtccactgacgaaattattgtgatacggcaagctcttagcctcgcattttagaaacaaatttgtgcttgtggcgaacaaattgtgcacgcctggcaaaatgcttggcaaaccgtgtttgttatccaaacaaattggccacaaataacaaaagattaaatttgacagactaacaacaggaggctagaaatataaagtgcggtagtcatagaaaacgttgtggcacaggtacatcgcacagagttttgccttgatgcacaacacatcatatctaaattatactagtacggagttccaggtcaacaaaaggtaaaagattttcagttcgactacgaaccacccatgagtacccatatctaaattatatatatagtacggagaagacaagttcttgctatcactgctaaagatctagagaggcagatgcaaacccttcagcaaccagccaaccacccttgagaaaactctgtcaatcataagctcttctgttggcaagtggggatcttgatcgccggacaggaga

SEQ ID NO: 73053 - DNA, 1280 bp, Oryza sativa
ctggtactgcctcaatgcatataattggatcgatatttaccaaacggctaaatctggatcttagctgccgtatggttcataactagcgatcattcaaccaaggttgcatacacacattcaacttggggtacgcgtgaaatagctgtacctttttactaccctgtcttgctctagacaattgcaatttgtcaccatagatggacactggacgaattgcagtcctgcagacgcaaaacatgatgcatgaatagtgatagtgacaatcaattagttgcaaaaatatgaaattattaataaaaaatatgcaattgtcgctaacaagaaaacttgtttatccgagaaatgcaactgaaccaaagggaaatttgaggcagcactggaaatccgtgatggtagccaagtttgtcataaaattagaaagctcaaaccacatgttttttaaatacttctcttacggttcatgtttcctacttctatgagtttttttttcatttgttatcaagattgggagctcagaaatattttgtaagacacttatatacagtttttcctacattaaaaccatagctatccagctaatggaatgtatgtcacatatttttttcgacctgaaattggtatattttgcactgtagtatttttataaaaaataggaagtagcacatcaaattggattaatcaagttgaagttggagaacgacatgcaaacaaaatcatttgcacgtgatgttcaaaaatattgctctcatacttcaaacagcatcgttacttccatcatcgtcattaattgctgtcccgcttgactgcccaacttctagcatttcatcatagaaatcgtatcttcatcttcattgaaaacttcaacatcatcctcactattgtcgctcagtgcaccaagagcctcttgatcataacttgcattatcaaattctggttgctgctgaggataaaatacatcaatttcagtgaagaaaacaaaaaacaaaaggcacaaagaaagcacagataaaaaaaaaaagctcttaccttatcttccttgtctattagagactgttgccactcaatccattcctgtaattgaggacagttcgtgataatacattactgaagctgctgttgaagtggttgtaaagggcactgcaggtttgggcaatcttttatttttagaagcttgagggattcaaggctgaacaatcctaccacagaaaatagcccccggcatccacttatagctagtgcctccaggattggtaggttcttattgtcaagttcaaggcaca

SEQ ID NO: 73054 - DNA, 3623 bp, Oryza sativa
  unsure (1)..(3623): unsure at all n locations
ttggtccataaaagcatcctggaaagttaatcatggggccagtactttgtctctagctttacacctttaataactatcactgcaaacttagctttgattaatcacttaataactaatacaacaccctctttatgtgtggttccattgtacgagcagctcctacatgacaatgccgtgaaaaagagaggacagcctgatcaagtgagtcctcatcccttagaacgatacatgtactctcatcgatttaaatttcatgtaaattacaagtatacataatttagcaaaataattgtaaaatactaaatggtgcctacgataattttgtgtgacaataattaactcgattaattaattaattaatcaggatgaaagctgtgaggaagcgaagacgatggatctgaggagcaggggcctgtgcctggttccggtgagctgcacggtggacgtcggcgtcgacgccggcccggcggactactgggcggcgccgccggctttcggcatagggttcggccgctagatcgatgcatggtccggtgatctttgtgggcgccatggccaatgaaatggctggctcggctggctaattaagctagctgaagaatcaatggaaatatagagatcatatcttacatattacatcacatgcatgcatgcttgcatttgggttaattagctgcataacatcaggagcagccatcctgctgaaaaggctggttcctcttgatgctatgcacgtgtatgctcatggtttgatgggtgcaacaacagagtatataactggtagtgtgtgtgtgtgtgtgtgtggctcttgtctagctagagattgatctctttgggtggattaatggattattatgcactggaagaatgaaaaagggttaagttgtagacagctgccatagcgcacctatgcttgctatagcttggtgttgatcatcaaacatcagtaacacccttgtaatttaagtcttttatcttggagaatgcatgcatgtcaccttgcttgttcaccaaaataatggtcatgaatgtgtaatgcatgcatgtgtatctacgttttaatttattgcttgctgtaataaagtctaaatggtttcattttgcgagactggcccgttcctttttaaggaaaaaaatttgataaaattccaatttattaaactctgctctcatctttttttagaaatacactactggaaatttgttgtgtagttgccgaaaaatcgccactccggtatgtgcttttcctgtactatacagtgatgctcctcaattcatagatacatatacccttttctcctccctccccatttgaggaactaggtcccgatttttcgataggtattgataacttttaatttagcggaaacttgacagacacgatcctgccctgcaatcacaacaccatgtctcctttggttatcaaccgtgctgaaacattgaccttaccgaaaagactaatccttgcacgcgaattgaagaacataagtaagaacaaggtagattgtaactcaatctgaagatgaatagttaagatctcaaagttggcattacacaaatcaaactagcaacgaaactgcaatgatagaaataatctaagcaaaatcttattctaaactatgatggctactgaataaatattcttagggtcgccctaaggtgcacaactctttgggcttagctcatgacataattataaggcacaagacccaaatcagactcgaattggatgatgtacatggcttgttttgtagattttcgacagcaaagaaggaattttgtcgtgagacaaaaaccatgtgaaagtagattccataaaatttctaacaagtactcatgtaccttgagaatccttctggatcagctgctatgtccgtttgaagttgatgctgccgggagacccgaatccgaatctaagatatgcatgaacttcatctcttgacttctatggagcaaaagtgatctgataatattggagtagacttgtggaaggtcttggtttggttcccaatcaacctctatgatcgttcatttcttccttgcgctcggtctctttccctttacccaagcaagtacctttgcaaacgagaacacacaaaactcatagtgcaatatgtaacgcgtaaatctcacatagaaagcaggcacctttgcttgatgaatacataaggtagctatggtcatatccgagctagtgttgtccttatcatcctccctttcttgattagaaaccgtcatcggtttcatcttgtcattgagcctgttagggcatggccgacacggggacgtggaccgcacccccagccctccacattagaccatccgccaaaaagcgtcgaggagcacgcgcccgtagggaggcgtggaccttctgcacgtgcgcgcacctctgcgcggggagttgatgcgaggcaaagctttgggtctgggcaccgcgttgtgtaggtcgattcctcgcgttgttggagcggtcccccctctctcaatccacaggggtacaagcttgtcgctcttgcccctctcgccattcgctcggccggtttgcccctctctttctgcctgggttcacctcgccgtgcgacgcaccgtcggtcatcgtcggccatcattcgcaggcattcccgtaggtcgcggcgagcctcgtcgagccccatcagagaaaacccccaaaaaggttagttctttttatcctgaaccctaggtctgtacaccctagtcgccacccccatttttgtttgttgatttggttttcctttgcggttctaagaacaatctgtttgcaggtcgacatggatccgaatcctcccactggcttccccaacatgttcaatgacccagatctggtcaccaatcttggcaaatcttcgagccaacctgcctttgtccatccccagttcatgttcccctatgctcattcacagtttcgtgcattctgcactcaaccccctcccctctagtagtgaattcacgggcagcagcacaaggggctcaagatcttgccagcaccatagggtttcagcaaattcccacccccaagtgccaaatccctagctgccaattccagatcccccaccccaagctggtgatgacgggagggtcaaactctactacacacatgatgaggacctaaggctggtgagaatttttgtttcatcctatttattttggtttatgtattgatgatgctactgctgtgatgggtgaataattggttggttaagtcaattatttgtgaatgttgtacatgtggtggatgagtatcattggtttatttgttatttgttagtgagttagtttgattacttcaatgatgatgatttttggagtttgtagatgatagatatgatgatggtactgagatggattagtttgatatgatgatgttagtgagttgggatatttttatagaattgttaactgtgagtattgattggttttaaatttagttacttatttagggtgccggactttctgtnaaagggtttatgcntgtaggtgccagtgatatgcaaatcaaanccccttggnggggggnngttnnnnnaggaggaatacgcgncccgggtaagcgcggccgcgtttaggcannntttatatcacaaaccacacttatatacggccca

SEQ ID NO: 73055 - DNA, 1136 bp, Oryza sativa
caatccatgcacaaattttattatccgagcattgcatttcaagtttgaaaataagttggaaatatgtttaaattcattatttttacaaaaagatttactgctgttacatcattgcttgttgaagcagttggtggtttgtccctgccgctctcgtcttctcacatgatcttctcttctgtctagttgaagcagttcgggggatccagaggccgaagggcttgttcgccaacctagctcacttagctgccaagctcggctctattggtaaggtggctgcttaattgccctcatgaatcacctactgcttatatttttgattccattcaccaacctctctgtgagtgttatgggtgagttaaggatataattattggggatcgctagaatgaaatgcctaggccataacgcataattctttgtcttatatcacagatacaccttacctttcaaaggtccaattgagttagtaaagtcagaaaaaaatattaaagaacttgaatcttttaaaagaaatttcatgttacatagctatattttactcacttaccttcaaaagaggaagcaggtttgaatgaggccatgttctgtttggaatttttataagtgcataaatagaattttctctattatgtttgctgctaaacatccaaatgaaaactgattgtctttgttttcataaaaaaaaattgtagataatgttgttttcataaaaatggaagctcaaaaaaacgtttctgtgtgttcttgattaattcatttactgaaaagagttcataattttacaaacatatagagaaaagtccaaacaggacatggcctcaatcaattgctactgccatgccctgttttcagtaaatgaattaatcattatgagctaataaaaaaattctggagaaaataagaaattctgtagactgcctaaaaagattctgaaaattctgaataccacatagaaagttctaaaatttgcttgatttttgtaagctatttcatttttgagagctatgcattttactcacctcacattcaaaagaggaaacagacttgagtgaggactgacatgccctgttcggaatttatactagggcataaatcaattgctctctatatgttagcgtagaaaggtgcggtctaca

SEQ ID NO: 73056 - DNA, 4169 bp, Oryza sativa
attttatcatgaaccctaggtctgtacaccctagtcgccacccccatttttgtttgtctgctagttaagaaaaaaaacttttctatactagtatttctttttatgaattaagtgtccctttgaactgtaaaaattctacaagatttttgtaccgatcagttcagttccagccggaatctaaaaacttgccaagttacaaagatattttgcttgataaatcatgtcacattgtcatcttagctaaggattaaaaagtatatgtacctggggctatgtagccacatgtccctgcaaagatagtgctccagctagatgaattgtccttcaacttctttgccatgccgaagtcggataaataagccttaaaatcatggtctagcaagatgttgctacttttaatatcgcggtgcacgatcggatcatcacaatcatggtgcaagtaagagagagcttgagctatgtccatcacaatagtgactcttttacaccaatcaagttcctttgccaattcttggtcattccaaatggacgctaaacttcctctttcgatgagatcgtatacaagaaatttgcactgtgaatgagagcagtaaccgtgcaacttgacaatgcgacggtgcctgatttttgtcaacacttcaatctcagcaagaaatgctccaatgtcaaagtaatcttccattctgtgaagcagcttgatggcaaatacaccttttccttggatctcagctctaagacagatccataacttccaacaccgatgcagtatttttcatcaaaattttctgttgcgtaaagtgcatcttgaaacgcaacctttgcatcaaagttccatatggaaacgaagtctccagggatgatttctttgcccttttttgcaagttttcttctccaacaaaccactgtgatgcttccacccacgagccagatgcaagaaaacattgcaaaggcaagaagtagcctcggaacaagatgtttactgtcggaattttcatttgtatgtaaacctgcaggatttggatttgaaggttgacatggtgtcaagccatataatggatcaccacagatacctgtattatggtctagtgaaactacaaaaaacgcttcagttgtgtagaaaccaaaaatctgccgcccaaactggtgtatgataaattcagctcaagtaaacggtaaagcatcatgaaagtcattggtatggcaccacttaaattatttctgctcaaatccaactcagttaggtcggtacaatacccaagctcttctggtattggtcctgtcagtaagttgtttcgcaggcgcaacaaggacaaatggtgaaactgtcctatctgaggtggaatgcttcccgtaaactgattgctgcttagatctagaacaaaaagattacgtagaaatcctagttctggtggcagtatagcatttagcacattggactcaagtttcagtgttattaaagatataagtttcgaaaaggttgaagggatggggccaatgattcggttgttggaaagatccatgttttgtaagctcgttagatttcctatactttcaggaatggaacccgtgatttcatttgtggagagatacaattttattaaactccttaaatttcctatactttcaggaatgaaacccgtgatttcatttatggagagatacaattctattaaactcaaatttcctatactttcaggaataaaacccgtgatttcatttgtggagagatccaaggactttaaacttgttagattccctatggttgtaggtatggagccattgatattattatgatccagatctagcgcaactaaactatgaagcatccctatctcacgtggaatatgaccaaaaagattgtaaatccaagaactagaaaatacaatctagccaggtttcccaaactggaaggtattgggccagttaagctgttgtggcttaaatcaaggtactgcaagttatgtaatgtgtcaggcaagcaactgagtatcccttgtgacaaaaaattgttagaaagctcaaggaatcctaggttcgtaagaaacctatcgatggcgggatggatccagtgagcttattgtagagagatccaagtacgagagctcagcaagacgaccaatatcagacggaattggtccatagagagagttaatgctaaggtcgagaaagacaagatgaggcaattgtgcaaatcggagcttgctcaaaccaccggagatgttacatgagaaaagtgtaatgtttgtcacaactaggatggcatcacgctcatggccacggcgcaccttgtagctgcagtatatgcctgaccagttgcatgggctggttgcgttgctccattcctctagcccgcagtaggagagatcgccccttagaccagatttccattggagaagtgcttcagcttggcgatccaacgcaggatttgcaattgcaaggcaggaaagacactgcagcgaaatcagcagaaccagcaatagctcctgtgaggcaactagtcgtctcatcttgtgttttgagtggcagtgtaggtgaagctctaaaacacacatagtacatattgatgggtcgacagaaagcgagagccactttaaccaaggagaccttgactctgactgacttcaggtaaatggatcaataatgcacgctcttgacaggactagtggagtcagtcaatgccccaaggaatgaggtccacctccatcactccatgtgcaagacaatgaaatccctggctcatacaagaacacatcgttggcacgtttagaaaggaaatccgcatgtagcagttccataagttcatgtttagttgggaggttatttctctgtatggatatctttaacaatattccaagacattggttagagggcaatcgcatgcttttcgcccaccctaataagctttaattttttcttttggctgctcctcttaaagtttttatagcatctcagcaatagaccttattttgaagcccctaaaagttaaatgtgggctgcccccatttcccaaggacaaaaaaaaaaaaacctccaactccaccagtagcccctatttcttagcctctattcatgtttctcttgtattttaaaatacaatctatgtttacactatgtttaacaccacaataattcaaacttaaatatttctgacacgtataatttaaccatacttaaattcacaatttcaaagtacacaattcaaattcaaaatcaaaattttcaaacatgtaaatatggtgtggtggcaataccatatactcatttttcaaacatgtaaaatttttggagcaagagatgcaataaaattaaaatagactagtagcaaatgccaaaggcccatatactgtacactgctgctgcttcttttatgcatcaggtcaggaaaaagaccttgttttccaagtttttagaatattgagttattgatccaacctgtcactaattgatgcaattatcgatgagtaatgcacattagcaatagaaggttgatttctgcagattaatgattaaattacaagattcataaccatggaaataaaatgcaaaggggaaaaggggcagaaggaagtggagcagcgatgtgcaaagtatagatctagacgagcggcagcgtgggatgttgatcgccggagttgatgagtgcgaggttgacgacggcttacgcaaaaaaaaaggagaatggcagcgacggcgccatccaaggcgcgagagagacgagagaagtgcgcgcttgggattttccaccgcgccaacaaaaaagaggagagataggggctgggcctagagtccccaggattaagggctaggaggcgaaatttgggagctttccctattttggggccttttataggagccctggtggacctttatttttctttcccttcacctcaaaaactctttgggggctttaatttaggtgctctgcttgaagatgctcttcactctttgtggctttcatttgatttgtaatctgcaaacctttttctgttttggccatgtggtcaaacttttccatctctcaataccgtcgcagttttttttttaaaaaaaaactttaacaatataaaccagaagctcattgttttgatggagtttcttgatttttcttttatttccccaacaaaaaaagtacctgtcctatattgagctttgcataataaaaatgcaca

SEQ ID NO: 73057 - DNA, 19989 bp, Oryza sativa
tctgactagcttaggtaacataaatgttctggtgtcctcaagaaaatatttgcttagagaactgctgctcctagcataacataacatccccaagcataaatagtgcaatccaaggaactacttaaatgaatgtatgaaggacataccttcgatagcgatcattaacaggactcctgtcatacgaaccgtacacaggactcctttgacgaccgtagtcaggacttgggcgtgacctgtacactggactaactgatcgacgatatggactatcatctcgcctaccatagccacctcttgcaccatcatacctgtcacctcgttctgtatcatccctgaaggcatactcaacagaaatcaccctgtccaacaacttgctgcagacagaaggaaaaatacagaaggcatattggttacatgctacaataatttcaaaaatatcaaaatcattagtgtgtacagaattgcatagatttcagaagcagcataactgggtagctgtgtgcctctactgttgtgttttaagcaagactagaagaatgattgaatagtaacattcctaactgaatcgaacaattaaagcaatatctgctaattttccatgcacgtcagaaacaaaataatcaatgaagcgcctatgtggaaatttcatttatcctatataagcttgagaaagttccttatttgccatgcaaagttatccaatttccttatttgtcagcgacaattgattgtccccttgcgacaaccatatgaaattgtgacccttacatgccttcaataccattaacgtttctctgtttttggcatatcctaggaattaccaaaagatactccttccgttcacaaatacttgtcagttttgactttgactaatcatgctttctatagttatacctttcaaattatataactattgtatcaaattggtgttgttagatttgtgatcagaagtactttactaatattgtacatttagagctattcacttttgtattacctaattaaaaaattaatggtcaaaatcatattcataaaagtcaaaactgacgaatattcgcaaacaggagtcctttaattaacttcactatctcccgtattacccaatctacatccaactatctcccgtattacccaatctacatccaagccagtagctgctcctatgctatttcctcattccctcccatcagctcaagcagaaaccttcctccccaccctccacggcggtcttcgcccagaatcctccccggcactatgagcaaccatagcatgagtccggcagcactacctcccaaatataaaagctgctactcaggatccccatggctgcatggaatttgagggcaagcaccatcaccatgtccatggcaaccaccgagcagcccccaccatggaacgtttctactactgcaagttgtaatctgtaccaacaaactgcaaacagcagtacatgttgggccaccgatctaccacatatggtatttcgaagaggaactagatatatagcaccactatggttcaagggttcatgttttgttggccggaccaccagacagatttggcaacagcggcatggttgcagttgagggaaactctaggaagatccacgtgcaacagatttggctcattcatttttctataagcagtgggatccacatgccatgtttttttttgttatatccaaattctgaacgggttgcgaagaaaggtagactttgcatatgcacccattaacaaccctctaacagaaaattaccatgagtggcaaataagggagcaattgagaaaaggtagcaaataaaggaagagacaactctcagtggcaaacaaaaaattcacgtaactttacatggcaaataaggaaatctggtaacttcgcataaggaatctcaacaaggttaagaagaggtgaatcagattcatacgtagaatgagtagcttcaagtgcttttgtggcctcttcctgtgtttcaaactgcacaaaagcaaagttcctcctgatccgaacattcgaaagctttccaaatggttcgaaatgcctttcgatatcagtgactctggtgttgatggggtcaaagttaatgacaaatagtgtcttcgtgggtttagtattcacaggtggtttgctatagccatcacgcctggaaccacgatcaccctgtaataaaggccataataacgaatgcaatactttgacattaaagaccgactaaattaaacaacaaaactctcaacatgtaagtaaaacatgtttcaattttttcagggttataggtggtgacaagaacagcaagagaaattacccgtgaccactccaccgaaagcctgcgcctcccagggccaaaaggatagccatcaagggctcgtatggcctcatcaccatcacgctcatcctcaaagtagacaaaagcaaatcctaaagaaaaggtaaacacaattaagaacagagaaaaaataaataatgtctttgcgccaataggtgcaagcatttccagttttcctttatgataaacaactcaacacacaatccccgttcaatcagacctaataagaacagaagagtactgcacctgcaaaatatctgatggtatgaagagcactagtgtggttattggtagattccattgatggatcagagctaagcatgatgttgtaataacttatatccaaagtaagacgatacgactcaggagatactgagagtgcttcaccaataacagaacaatctcacaggcattgcttattgagacagcacgcacagaacattgtgatgttgatgccgggaggatggcatggtgatactgctagtcatggcatggtatggaatgatggaactgacggcacggcatggatcacatgatggtgccagtccccgctaaacatgctcgggcagtggtaacaacagtaaacagcgcgcgtcatgtaatggatggtcaagtgaaggggatggccggatgagtgcatggagggtgtttcaggagttgagttttgcctctgtagttcctgcgccagagtaaacatttaaaacatcttgcttcctgctgtacatatattgcaactgcggctacatgggcatggaccatcatacatatgcacaatttatgtgttccacgccgttggatgttacagatgtaacgacgacaagctaatcttaaacatcctaattgcttccacaaaacatatttaacataaagcacatcgacatgcttgggtggttattcttggtaaattactaaagattattattgtgaaaacatatcataaacatgagagtggtaaccaagaacagttcaaagttggaaaagaacctcttgttttctctagggtgaaaagaaaagaaaatttattagacaccatggactcgcaatctcgcaggagattaacaaatcggtgccgtatatgagcaccaaaccggatctaataattcacgggggaaaaaaaaagaagacaggtggagaggagggcaaaggcagacctgacttcatgtcgatgcggtcgatcctgccgtagcggtagaagaggcggtcgagctcggagtggcgggtgtcgtagtcgaggttccccacgaacacgggcctcatcttcgccttcgccttcgcagcaaatcaaagatcccaagacagcaagaaccagaaaaccctagcaaggaaagcagcagacagcgcaaccggatcagcccgaggactctctccaggtcgaggggttctagctcgagaaaccctagcgcctagagcctagcaccgaggaggaggaggagggtcacctgcgtcgtggtctcgtggagcggaggacgaagggggaggcggctagggcttttggggcttttggaggaggagggcttcttggtcggcgtcggtcggtgtcttgtgttggttggtttctgtttgggttcgttgggctgggccatactcgacatgggctggtaggcccatgcaatcatggactgtttggggagtcccaaccttcccgacacagtctagcttctttttgttaagattatgagaagatgttagacagtctccttacaaattataaaataataaaacccactagaaaccacagtctccttacaaattataaaatccacaagtgatattaaacagtaatatataaagctccaagacaaaccatggcttgaaaaagatggaaataagtaggagaataatatcttttttttcttggtgtttgttattttagggcctgttcagattgtagccaaaataaaccttacgaaattttggcaattccaaaattttggtaagatggcaatattgctaaaattttagcaggatttcttatgtatttactaaatttggcaacaaactaaacgtagacatttttttgtcaactttaccaaaaaatggtatggttgaaaatggcatcaaagtgaacaggcccttaatgtgtcacaaacattatggttgtctaatggcgcctttcttacaccttgaattatgtaatgataattctcatttgctcaaccaaaaagaagaaaagaatcttgtagtcaccatctacatatcattatccatgagagaaggaaaaagtgcacaacccttgaaggcttggagcattggatattgctgagccatcgatcttgtggataagagattctgaagctagggtgctatccatctagcaatcgagcttcttcagcaaaactacaaaagaacactatgtcgagcaacgtggattcaaagacatccaacaaagcctcctatcctcttgcatcttaagccattgaaacaacagcagctcaatcccaacatatttactcttcttaccttctccattgcatatataatagacacagctagctttgttgtaccattgaatcaatcatcaattttgcagcaatagctagacaatcagcgagacaaagtcacaaaaccatggcttctgcagatgctatcctgtcttcgcaggtggccggtgaatgcctgaagatcaacaaggtcagtcagtcacttcttctcactcaaatcaacaaagattcttcacgaatatatatacatatattcttgatcttgcacatgctgctgctggtgctggtcttgctcgattaggaccattttacatctggtgatttcttgggaaattttttcctggtgaattttgcagctggcagcagcaagcccagtgaaagtagtgcaggtgcagaagccgagcaaagagacgaagaacatcagcggtgcacctgtagctgccgctgccgtcagggtggttgtgagcaagcaagtgatgaagccacggtttgccgtggagctggatgggctcaactgcttcgagacacttgtccctcgctgatgatatcatgaagcgcacacacgagctgctagctgtgttccatctgatttgttgattttctggtcattatttttgcggggttatattatatttgttcaaattttctatgagttggatcctttcgcacgcgcgattatgtattttctttctttgaagtgatatgtgtaatttgctcttacgagtgattccgactgtgaagtattatttgttatataaagatatacgtgctattgatatctcagaggttataataaggttgggaaacgatttttctatgttgtaccttcgtactatatcatgagctttaaattttatgttttagtagaattcttcttatatcttaaaataaaactattttagctattcaaggacagaaggtgatttttccaagaaaacagttgattggtgctatgtgcagtgctacaactataatcataacaaaagcattgaattataaacattggtttaagaggttaagatgataagatcgaggggtggttttttcatgttgtaggggcgccatactatattatgagctcaaaatttcatcttgtatgaagatattgtttttatatgtagaatttttttagctactcaaggaaagaagaagttgctttcacgacttcttccaagaaaaagttgtttgtgtactaggcggtgtagtgctagcataacaaaataatggaattatcaacctaccaatgtgagtggttttcttcctcatagatgcattaattctttggaaaacacatacaacattaatcaagtagtagtattataaaacaagcttaatttgcactatctattcactatctacccacattgtaagtactaatgtaaacagtgatagtataaattgggctattgttttactcaagtagatatacatatcaacataaataccgcttaacacgttaaatcaatttgagaaaatcatattttcttcgagcatactctagctattcacatgatagaactacatctaaatttatcaaatacacattaattttataactgacataacaatacaataaaactgtcattttatttaagaccttaattgactgcatcaaatgagcaatcatgtatgccttgagaatttttttttaaagacaaagcaggacctataccaacattcattgaagagataaaaaatttttgctaattagagggaagtctaccttagacttcaaactccttatgtttgcaatatagctaccaattaagaaaaacccacatgactgaaaacactacatatgttacatatgttagtcttggcttttacacatttgggttttaatgtacttgaaataaatcaaaagtgccttatttttttttcttttttttttttggcccaaacctcttctcagtcaatttcacagtcaaatttgttggcctacccacggaaggacgatggatagactaagtccatacgaggctcctagcatatatgcaaaactaatgaaacaagattagatgccttgaaattatcttagagcattattaattgttaacttttgcatgatgttactcactactctaatagacatgaacaaatatttaatagttttatattaaaaaataaaaataaaataaaaagatatatatgttagcttttccataatgtttctcactactctaattgatgtggacaaacatttaattgctctttgtatcaaaagaaaacaagaataaaataaaaagatatgtccttatattatattatattatattatatgctaacacgaaattttttgtttgctgcttgaaaattaacgtttgaactttcaactcaatagcttaaaaatattttacctaaaagactacaatatataacttaaggtttttaaaacttccacatgagagctcctagatattttttttttgcatgaacagcagagccagcccctgagctggtcaggtggctactaggactctattgttgtaatgcttcactgtggattatcaagaaacccataaaaagttgtcgtcaacttataatattcttttatcacccaggctgaacaataccagtggcttcgtcattgattattttctccgtaaaattgtaatgtccgctttattttgggccctgtttcatcgtttcttctctattgggcctaaatttcccacttccctcccctttcatctcagcccacaatcagtttgggccacaactagttcatttcccctcctcgcctaggcacagcaaaccaaagccctaattcccaaatcggccaaaccctaaccagaggaccgaggacgtgcgcggtgtggcggcgaggacgtgcggcagtgcggcggcggcgacttccggctgcgtcggcggaaggcggcgccaaggcgggtaggagcctaggcagcgcgtcgggcggcggcgactgcagtctagtctgcagcgtgctcgtcggcggctgcggcagaggcttccggctgcggcgtgcgcggctgcgtcggcggcaggaggcgccgaggcgtgcaggcggcgcgtcgacggctgcggccgtgcggcgttggggctcggccaggcgtgcaggccgccagtccaccaggccaccatacaggtacgcgatgcggcagccgaacgaccacggcttgccggcctggcatggattgcgtgaggggcttgattcattgattcattgcattgatttgttctaggtagttcaatagtagctatgttttccggtggcgacggcttgtttcattgatttgttctatagtagttcaatagttcactagcaccgaaggattcaacttcctcagttcctgtcttctttatttttcagagtgttaactgttaagtgtatatttattgacagattgatagtataaagctgtaaatattaggaatttagataacttagaaccataatatttaattttcagtgtgttaaatttatatatatgatgatagtatgaggctatatatgagctgttgttaggaatttagagaatttagagagggtgttttcttcgatgaactatataaaaacaagaagcaagatgagcaacaatctacatttattggaagagaattttttgtacaagttaaaggatgaggacatcatcactcatttttaaaatatcaagcattgaaaagttctcctctaaattgtaagttttttttatcattttaccattttctatcctttacatgttatatatgttgccactttcatatgtcgaacaattagtacttatatatgttaaagaatttggacttatgatcaattctatcaatttataaagttatggccatatgctataatattatacaattagtaatgtgtaatattataccaattaattattggacttctagaagtaaaaagaattttgttttacccctacctatttcgaatacccaacctctaaatcctgggcccgccactgcatcaagcccagaaatttcaacagaagaacaactatcactttcccacttcaaagtgatggaattctttgataagcctgtcagctaaacattaagagagtcatcacttagcacaaaattgtacaagcagtgccttttatcttaaccatcataactacacactgagggaaaaaaaaaaagaaatattggtgagtgttcacttacaatgtcagcagtagccaatttaatggcttccaactttggaaagcaagctcgtttactctgcagaagaaacatatgttcaggggaagcaagtagcatagtaacataactagtagcaatgtggtaacaggacaccagaccaccaacagactttactttgtaagatagttgtgagagatgtacacacaggcaacctgttggtatccattggtattaccagtgcacacaaattataaaaacaaaattattttcccacacacattgttttgtactgttctaaacagtataagatacctgtagtagctgatgcccttcattaagactgtagccaagaatccagaacatatacgccaactgaaaatttatataatggtatcaggatcagaatattgctgctctcaagataatggacaccatcaaatcatagaggatcctgatactataatcatcaatccagcgtgaaacttggacaggcatcagcaatatcatgagagtgaaagtcagttgtgatactattggattatttaagtactataacattgtgcaaatagaacaatttaccgactatacctgtgatgattatgttatagtctaggactcactagacactagttaatgttcattatttgggaatgtatatatgtgttttccatttttcttccctttttgtgggtgggccaacaactaactgaacaggaaagaagaagacaatattataatgtaaacctaaacctattataagaattcttgggaaacaaaaaagaaaagaccatggaaacctactgtcacagcaggagctctcccaagtccagcggtacagtgtatatatgttaccccaccattatggttgacaagcttgtgcagtttgctaatcacagcaggaagcctcaatcgcaaatcaaaagcatcaaaatccctggtgtaattaaacattatgccactttaagactttgaaaatatggacagaacagacaatggaaaaggcattcaagtcaatgcaggaaaagttacatttgacaaataaatgctgattcaaggaaagatgaatcatctattccaaaaatagaagagcataggaattataattggaaagagaagggggaaaagagatagacgttcagatcatgccatcttgtagacattattaatgaaaataaagggatttctattgcatttgacatagactacaccaaatcaccaaaattcttagtttctcaaagtaaaacgaagttatagaactttaggtacctaatttcggcacgacagtgctctatatctttacattgtagacaatattcttgaatggcacagatgtcaactccaaaatatctgaactggttaaggatggaatacaactattcactgaaagaacacattgggcagcaatggaaacaacaagcaactatgctgtcagtataaaatagaactatttttatgagatgtacaatatgcattgtgctgaatatcatagctgcagaagaagtacagtagcagggaagtgaggagcaaatgtaattgttcaatagaattatggttattgtccaatagcacagtaacataattaggaagaaggcatgctgacataaaagcactccctattccaatagttattttgataaaaagccatcaccagaattttataattctcttcgatatagttggtgtgattcacagtaagtgacagcatacatttcaagaatcaagaggctcaaattctctaaaccaggagaactatggaaaaatgatgtattatctatttaattatgagaaatatattagtccaaatcaacatatatgtagaaaataaaaaacaatatgaaagaattacggaaatacgtactaatgtagttatcatatataatacaatgagaaaagaagaccatagtcaaatgctttattattgagcaaaaatgatggtattatttttatcatcttttagaggaatctatctaaatatagttaatcagcccgtgttagtagaagcatgtatcgtcatgcatcaacatatcatgagattattagttatagctaagtacaccggcgtaatcatacttagcatatcacgagactatcgggtaatggacaattatctttaattgtgctagagaaaaaatatcatacttagcatatcacgagactatcaggtaatggacaattatctttaattgtgctagaaaaaaaaaagtactcccttcgtcccataaaaaaccaacttaggactggatgtgacacatcctagtaaaacgaatctagacatgcatatgttcagatttgttgtactagaatgtgccacactagttctacattcgtttttttggaacaaaaggagtaaattacaatccatactatgtattctaaaaaattcttacaaattttcatataatgttatcctttaaccattttcatttacacaatagctaactttacattttaatttggaccaccatattttatccatctccaagtccggtgactcagtaatcacgtcgcacattaactctctctctctctctctctctctccattttcttctttcatctgacagttggataaccgatagatctagcaagaaagagcccggatatagcgccttcgctcttcgtcgggtcagctcctgccttccaaagtccctgcaagcccgacatctccgacctcaattgcaaccataacaatagtgtgcatcatgataggggaggagaaaaagacttgtcggttactagaggttaaggctgtgcatgtaaggcaaaggggaggaacgatggtggctcatggagaaagagcggtgatggcggtgcgtagagtgacagttagcagttgcaggtggtatgaggaatttgtcgtcgacacaatcttttaatttttttcctaagtattgatgatacgtgggtcaccagttatataaagaaatagcttttaaaatattagcttgccctaaaataaatgtcaaaacttttgaccgtccgtctttgaaaagtttatgaaaaaattaaaataaattagtcacacgtaaaatattattcatgttttatcatctaataacaataaaaatactaatcataaaaaattttaaataaaaaaaaagttaaacgccggacgtaaaccgtaataaaaaactacacttaattagggacggatggagcggtaaataaaaatatggagataaggttggagtatcgctacttgagataaagaaaaagaaacctctcgttgtctcctccgctccttgcctccttgcgccgccgccaagacgagtggcggctgaacaagggagggccgggcggcgatctccatcgcagcggaggggaggggatcctggtgcgtcttctttctgattcatctctctctctctctctctctctctctctcccaccccaccgggactggaatttgcgggattgcgttcgtaaaccctactagcttctcttctagatcttctcctcctccttaatttgatagccttaaacctctcttaaataaataattcaagtaataacagtttgtttgttcacccaaaagtttgggggttcaactgaacccccatgtcccaagttggatccgcccctgtgtcgaggtcttggtggtggtgggtaccatttcagaatcaaacctcatttcccatgcataaagtagtatgtatagtgtgtttacttaattttaggagagaaatagaatgctccattcacacatactagcactcattttgtcatcagtaatggagatgtcatcactactactccccatgccatgcaaaataaatatccatattaccgtttcattgcccacattatgatctttaattcggaaataataaggcattgcagcgagaaatccatggcatggggaggtctcttcttgagcttcagccgtccctcacaggaccaacagaagtcatgcctttcagctgctggtggtttcaactatgatgcgcctctccatggtgcctcaagaccaaaatcagtagctaaattgactgcgggagatactgaagcaagtgacaaagcgcttgtcgagcgcggcttcttcgtgaaccgttcacgtgttctggttggctctggcactaccaccttcaaccatgccaaatccgcgcttctctcctggaagtaaagcccaagaactacaaattttgttatgttgttcatctggtctccataaccaagcaaactggtgtatatctaggcatttggcactaggctgggcaaatgtggaacccgacacaccggtgaaggctggaacaaggttctgcatttgttacaaggagctgatcccttgggtcatgttgcccctccagattgcctatgtgaccgatggcaatggaggcaactcctcaggccatggaaaaggctgcgtttttgcttatggtagcggcactctacaaggccatctgctggtacgcctgcctcctaatctcatcaagtaacaatgaaacattgtagtactcactactcagtaatgtaaaatgttcagaatgcagtgcagagttgcaggtgtttttttactgaatgagttggatgatcatattttgatggtttgcaggcaggggaggagaggttctcggtgcagctggacgaagacgatcaggtgtggtacgaggtgatgtccttctcgaagccagcacacatcctgtccagcctctgctacccgtacgtgcagctgaggcagaagcatttcgcgcatcagtcagggcaggcactgctcaggcatgttgccagccgctccagggacacacggtgatcgacttcgtctgcagatttgatcttttcttcaggagtagtcttcgcatgttgtgagtgagcctgcttgtatgttcctgtatctatgtccgaatctgctcctgagagcattattagtttgtagtttgaatttttgagctcagggtaattatttagcatttgtgctttgttgttaagttttagatcaaattgaggtgttatggtgatgtaaattcagatttccatggtttgttactaaatcaaaaggaagaatgaaagataagcacaagaggaaccccacagttccacggaacaggtagaagagacgtcttgcaccaggcaaacgccccttgtttatagtgatgagagtatggattatctgtttgtcccctttaccatggtagtagagtactcaatggattagcaactttttccatgtctgtcactgtcactagaagaagctttgctagtgcaagtgttatctgagttgagcagacttgcagcagcaactgctgcttgattttcatttcattttattgccttcattattggtcagcttagcgttaagcattcaagcatagcctctgctcatcagaggaaagagaaagatgatgtcaaaatttatgcatgtttgctggcctgcacattagtgcactgtatattgttctgtctgtccacccataaagtttgaatacaaacttcagtcttttttcatcacattaacctattatacacacataacttttcagccacatcatctttaattttaaccaaaatccaaacttttgtactgaactaaacacagccaaaaagaagaagaaagcgtcctcccctccacgcaagcaagcaaaaaataaaaaaaataaaaaatttttcatgtgatgaagttgataaatctcacatctaataaatactcctccagtttcattttaattgatgttttggacaatacacggtctaccagatatatctttgaccttatttttctattataatatatacaatatataaatacatgtttacttttattaaatatttttaaagttattgatggttaaatttataaaagtttaatctcaaccttattcaaaacgtcaatcagagcgagcagttagtttccacggtatattttcccggtttgggttaggccatccatcctccatccctgggcgcttgctgggcctcggcggatcccccgaagcagccgccgcaacaacgagagaaaggcaacaaatcaatcaattcccccatcttcctcgttctctccgcctcctccccactctccatttatactcctcttctcctctccatcgccgcattgctcgccaccccgacgacgacgacgacgacggcgacggcggaggagtagagacagagagatggccgccgcgtcctccttcaccgccgccgccaagttcttggcgccggtgtccgcgagatccgccggggactacaagccgccgctcccgctcccggcctccgcctccctcaggcccgggaggaagcccgcgccccgcctccgcaccgcgctcgccgtctcctccgacgtgctccccgggaacaaggccgcccccgccgccgccgcccactccgtacgaaccaaatcccacatctcttcttgcttcttctctccctctctgaaatgatcccaaaatatatatatatatatatatatatatatatatatatatatgtgtgtgtgtgtgtgtgtgtgtgtgtgtccgatcttgcggggcgccgccgcagtttagctacttgagatgtggtaaaatttccgatcctgggtgttccggtttgtagattcgtcgtcattcctgaggtggtttaattctagaacatagttaagattacacgcgctgcttggaattttttttatgctaggctactttactgaatctcatgttgagcagctagttctcagtactaaaaatggcactttcttttagttagatcgaaagtgttccggaaagctgccctcttggcgacttccttactgtgactgtccaaccttttaagcggttttgtattctcgattgagatttctttagtgcaaataagaggtcaccaacaagcaactagaattcattgtttgccacgaatttggtgatgcaatttactactaaacctgatggaatctggaaatgcaaagtttaaagggaaggatccgtccttgcaatttcagaactggagaatgttgcctcacttcttgaaatgcagcttgcaattttgtagccactgtggtgcttcgatagggaaaactcatcttgtctgctgttacaagtgttaatagtagccttcttgattcatatcgtttcattttccacaggctgtcacgcgggaagaggctttggagctgtacgaggacatggttcttggccgtattttcgaggatatgtgcgcgcaaatgtactaccgtggcaagatgtttggttttgtccatttatacaatgggcaagaagctgtctccactggcttcatcaagctgctcaaccaagctgactgtgttgtcagcacataccgtgaccacgtccatgccctatccaagggtgtccctgcacgttctgtcatggctgagcttttcggtaaggccactggctgctgccgtggacaaggtggttctatgcacatgttctctgaaccccacaacctccttggaggttttgccttcatcggagagggcatccctgttgctactggtgctgcctttgctgctaaataccgccatgaggtgctcaagcagtctagccctgatggacttgatgtaaccctggcattctttggtgatggtacctgtaacaatggccaattctttgagtgcctgaacatggctcagctttggaagcttcctattgtgtttgttgtggagaacaatctatgggcaattgggatgtcgcatcttagggctacttcagacccagagatttataagaagggtccagcgtttggaatgcccggcgtgcatgttgatgggatggatgtcctgaaggtcagggaggtggctaaggaggccattgagagggcaaggagaggtgaaggaccgactcttgtggagtgtgagacttaccggttcagagggcattctcttgctgatccagatgagctcaggagacctggtaagggtcaccttccttgttcattttttagttcaatggtgtctactaggctaactaaacagagaaatggaaactataaggaaaatattcaggcacttaggtttctaatatttttaataccgttttgtttcatgtctgagtaagtacaatacacttcacaaactttgtactaattcaccacataatttccctcaggcaaggtcctctgatcctgtttagtgacgtcgtaattttataactatctagaatttttgatctgcttatatcactgaaggagtacttatatccttatttcaatgaaggagtgttaataagatttctgcatgtacatgcaaaaattttgcttccaaatttagtatatcctgtttcatcagatcagtatacgcatgatcttctttgctgatgaataactaatagggttatttgatacttaatgaaaatttattaaaattagttattgctatagaatagtctggtggaatgtttgtatttttatgccaattgaactattgaacaaaaagaaattctcgaagtctgtagcttttgttcttatcgtcatcccagtcatcttatctgacatgtcaacatcctgacagttattgctagattgtttggtagttacttcataggacatttggcaccccttttttcaactatcattttgacaatgaaaaacatcagtttttgggagaaacaaagagttgttgattaataggatctcatgagtcatcattgtttaaatgtgcttgcaatacatacaatcattaagtagggttgatatgtgagttgtgtcctacatttgttagttttttttgtctactttgatcttgagtaaatatgcccttgtttatatctaccaattctgtttgatttttgtaacctcaccgatattcttcatgatctatcttttttgtttggctgtgtatattcgtcatatttagttttatactttgattcatagccactgtaactcatgatgtttttttattggtctatatctgaaactatattctcattattcattttatggtttgtatcatcacacagttattgaatccttaagtcagctgtacagtttctttcctcctaatttgctctgactaaatcgtcttatgacattgtgcacagatgagaaatctcattacgccgcaagggaccccattacagccttgaagaagtacatcatcgaacagaaccttgcaactgaatccgagctgaagagcatcgagaaaaagatcgatgatgttgttgaagaggccgtggagttcgctgacgcaagcccgctccctccccggagccagcttctggaaaacgtgttctcagatcccaagggctttggaattggccctgacgggaagtaccggtgtgaggatcccttgttcacgcaaggcacggcccaagtctgagaggctcaacgagcacgcttatcagttattatgtcatgctttttcttgtctctctctagctctaccctatcctagtttttgtcgaacccatcgtcgtgttaagcgtaatgtaagcacaacctacttcttcatttgtttcattcttagacctcccatatcaatatgctcaactgctgccccagtttttgctcagtgtgttcgatttgctcttcagtagttctattggtttcagaacagctgggcctgtaatcactcactcctatgtctggacatgcaaagatacttctggtttagagtttcagctgagttacagtgattagtttcctgcctgttatactatatttataaacatcatgatggaatgtgagacaatatctgctgtccttgttttacttttggctaaaccatggacattgtcccagtcaaaaaggtactccctccatatttttttgttggttagctaaaaaatgaactaaccaacgtcatacatttgtgcaaggaggtagtatgaaatttagtatttgcaaatgttatagtctcataaggaagggcaggtaatggttagcggaacttaccaataaaaaatatcaaataaaggtttgaaaatttgatcagtaaagtttcttttttatatataaaaaaatgaatttatatccctctctgtaccataaccagtaccattagactacatgtccttttgcaattgaagattacaaagaaagtcttatgtgccaaaggatcctctttgaatcccaagtcatggtttacattagttctggctagagttatgtaacgccccgattttcgttcgggaataaaaatcaattaataatgcatttctagaaattatattaaaagttaaatcaatttaatcaagtgaaattatagaggaaattaaaatttcctttaaaaaaatcattggccgggaatattttgcaatattctttgtgccccaaaaatactctccggatttttccgcaaattttcggagctcaagaaataattttaaagtcacaaagttcatttaaccaattagaataaaaagaaaagaaaataatcttccccttcctcccttttgggcttagcccaagccttcccctccactcccgtgggccgcgcgcctcctccctctctcggccggcccgcgccttgcgaaagtctactttacgtcccccggttttcctcccctcctccttcctaggccggcctcctccctcggcccgctcggctctctctctccctcaagtctgctttacctccctcgcccgttttcccctctctctctccccgacaggtgggacccgaggccccacctgtcatcttcatcccttacctcccgtcgccccaaccgccgccatggccgccaaatcctcccacgtcaccgcctctcccgcgcgtgcgtggacgcggtcgtcgcccacgtcggcgccgttttcccccactctccccgcgaaaatcggcgccggttaacccctccaccaccccacgtcggcgccccacttcgccggccgattccgccacgtccggcctcgatcccgccttcccgagcccataaaaagcacccccgtgctcccctcatccatttccccttgtttcccgggcccggcactctctccctcgctctccccacatcgttcccgcgcgccgccacactccggcgaactccggccgccgtttcccgtcgctagggtcgccgccgcactactccgccgccaccgctggctttgccacctcaagggcacgctcggccgccgtttcttcctccccttccaccacgcgaaccacctatccaccgtgctcccgttctccatcggtccctggcgagctccggccacctctagccgccgccctagccactg

SEQ ID NO: 73058 - DNA, 757 bp, Oryza sativa
tataaaaggaggagctcattcactctctcaacacactcaagcaagctcaaatatctcttctacactttagtttagtattctagtgctaagtggagtagaatagaatagcatctcggagttctcggagtcttcggaggaatttcggtaaggttgtaatagcattcttcctttcttttgtaagacttttggaattaatgaaatattcttcttcatatgctctcgatactttagtttatctaagtattgtctttactttatgtctgtatcggtacagtcgtatagttagcctaccagagaggtgcagttgtgtgggtttaatgtctgattattcagttgctctatgtcatcttgagggatatagtgtagtatttataatgtacacatggtgtctagattattaggtatcattatctgtgtttatatgctacgagtcagtcgaggtgggccgctgatggtgacagctcagtacgatcctaaaaaactttcctggggagggtattcctccgtatttagcccccggatggacggccatgacaggttgtcgtaagaaactcggcaatccggggtggtctctagaagcaccaggagtgcactattaggggtattggctatatggttgtatactaacagatgtagactaaaattgagtgtatattataattataggaaatgacggtttttctatttcttcttatgcttagtctagaaatgattaaatgagatatatgagtgctttgcttcgtgtcactctacccaa

SEQ ID NO: 73059 - DNA, 865 bp, Oryza sativa
ttttgtccttgcaagacagtgacagcatacagtgactgcctttgatcttgttccatgattacttttccttatcttaccaagtagtactttaatgcctttatttccctttcgactttttttttctctctttctcactctgcatctgccgctttcctatactactacctaatctaatctgcagccaattcatgcttcctttttgttcttccatgattgccttgctcatcacctccaataacagtacgtcacattggtgtcatatgattcataggttaattgattatcataatcaagcaaatataaataggatcatatctaggataagagtactttttgggagattatctataggcacctatccaactagtgctgagcagaatcgatcaaaaattaattctgcgtaagttaatgaatcaactagttgagttggtaccaagaatcgaaatcgtgcaaaacaaaaaaactttcttgaaataatttcagttccttcatgagcaaatttttgacaaattgatgcccatcaagtctgaagatttttgcatcgtggggttgcattctgtactaatttcacttcaatttccaggtgacggcaaaccggaggtagagctcaaggacgacatcgagacactcttcgaccttatcataccggcgacgttcccggcggcggcgccggagcccgccgccgccgcgacggccgcctccgccgcgcccaaccactccagctccgtctcgcagcacagcagcgacgaccaggaccactccaacggcgccgacgtcctcgacctgcccatcctcaccggcggcggaggcggctcgtcggagcaggacgactggagcctcgacggcgccgcctgccagtgggaca

SEQ ID NO: 73060 - DNA, 1167 bp, Oryza sativa
attgaatacgccctcctccttgacaaccacctcggcaagcgcttgaccgccgaccgccggcgcgcggatgctcactcgtcgcctgcgcccgctcgtgtgccgctcctcccccgccgcctccgcttcgccggttgccgcgctctcgcctgcctgccgccaccgccactccactttgcttcaccgaccgccgcgctcgcacgccgcctccgtcggccgccgtggcggcgccgccctccgcctctcccgcttcgccccggccgccgcgttcgcacgctgcctccgtcctccggcttgtagagacagtgagagagagatgaggaagggagagaaaaggggaagggaggagaggaggctgacatgtggggcccacgtgggtcccacactgactcagctgccacgtgggataaaaccgggatcaaggtgaccggttttgtatagttaagggacctcgtatatctggttttgcggttcgaggacgttttttaatcacgctgacaagttgagggaccttcggtgtactttttccaatccacatttgcaacaatcacggtcacatgatgcgcgtgtgttacgagcatggcccatgtatgtgacaaagcccaagttcatcagtctcccactctctttgcacccagcccagtccgagcaatttcttttacgttgggccgagcccaccatctcctgctagctcagcccacttagctccgcccccaacccccctccacctcgtagacgtgctcagttccggccgttcaccgccgcctccatctccctcctagaagcgcctccgccgccgccgccgccgcaaagaagaggtgtgtgtcggcgagcccctcacctgactccaaccgccgccttcgatggggcgcgtgaggcctctccaccacgcggcgagaaggctgctgctgctgttcccgcggcagagggccttctcctccgccgccgctgccgcgccctcgcgcgagccgctccacgtttgcgtcgtcggcagcgggcccgccgggttctacacggccgacaaggtacgggctgctacctctcttcctatagggtcctttctccaatttccccactgtaatgtagttgtcagatgacctgaaatccacttctagtttgcttctgaagatacttgcttgtgaaattattttagtctgagagcgtgtagat

SEQ ID NO: 73061 - DNA, 1415 bp, Oryza sativa
ttgtgcggttgataagtgggtcccacgtcgatttttacacggtgttggcattagggatgaaaacggtcggaaacggtcggaaaaaccctctaccatttccattttcattttttttctcgaaaatggaatcggatcggtatactcggaaacggtaacgatatcggttatatcggtatctcggaaacggaaccgtcggaacgggaatataccgatatcggacggaagtcgaaaattcatgtcggaaacagcgagcttgtggtatcatcccgcatttaactatgtatgaagataaccttataatttcacccttgcatcatgcagctcctaccatacgctgttatatgatgattaataagtggacaattagattgatggataatataaataaagttcaatgatacttcaacatcaatgtggctaaagcatacaatgtggcttacatgataggattacagcataactaatattgtccgactttttttaggatatagatttgaagtcttcgagaacaccaagctcacaagctggcatggcttcagctgatcagctccttgtcaaacatcattcattatttcatcatcaattgacatagctatatcgtcgtcctacagtggcacattgcataagaacttttatgttgacactgtataactactgttgtaattaagtttcatgctaaactagactttttggtatttccaggtcgatcacagagaggagtcaagatggtggggcccgccagtggatcccacagtctttcttttcctctctttcttttattttttctctctctctcttatccttcccttctctcggttccttttcctgctctctcgatttcttctctgttttctctctcgttctcttctctgcctttggctccttcacgcgcgcccgagaggagagaggcgccggagatggcggcctggcgcagggcggcggtgggggaaggagagaggagaaaggggcggcatcggtggggaggaggaggctggggcggtgcggcggcgctcggtgcttggctcggtggcacggaagccggcgatggagcatgggggagggaaggtggccggctgcgacgaaggccgtcggggcgaaggaggttgcggccggcgtcggcgacctggtggcggcgcccaacatggcgcggcggtgccctagcgccgatgaagacgacgatgcggtcaggcctagttggcttctttattcggaatgggctgctccttaatgcctaatgggctcctcctcctgctagccaggcccagccgacttccttcttcggaattttgtcggaaatttgacggaaattaccgataaaaaacggttaccgacaaaacggtcggaaaaaaccccatatcatttccgctaccatttccgaaaaagattaccgtttccatttccgataccgacaatta

SEQ ID NO: 73062 - DNA, 3469 bp, Oryza sativa
tttaggcccttctctccctctattagggtgggcgggaggagtatatttttgccaaactttaaaatggtaatttattttttaaatatttttaaaaataaatataaatataaaaaaaaattccttcttgctacaccaagagataactcgtaccactaccaagccaaattgtatatactaatgtccattcgtgtcgattttggtctttctgctagttctagaaaaacacatagcaatcctccgtcaacctaaaagaatggaaaactcactctctctatctatatatatctttattcaagtatcgatcttattttcccataattaaagagttctccatagagcatattaaatatatagaaaagagagaaaccacaaataaaacatgaattatcaacgacgacagctagtgacactactatacaaatgatttttgtgaatgagacccctttaaattgcaagtggaccataattaaccgtgtcatgtacggctccttaaaatgcatgtatgcaaaaatcaattttcgcaagcggacctcttaacttactcacataaaaaaatgagcatattttcacatgtggatcttttaaaggaccgcatgagaaaatatattttggtgggcaggcctcttaaggggatccgctagaattctaacttgccttcttttccctctcaacactacaattttttccaagtcccttattatctcccctcctctccaacctcctctccctcattcacacctcctctctctatctctctcatttctcattcctcccctctctcattccaaagcggcggcgacgactcggtagtgggtagcggctggtggctcggtagcgggcgacgcccgggctcggtggtgtcatcgcccactcggatttggcgacggtggctgtcccccacctagcctcgcacggatccagcggcggtggaaggagcggggccccacgcgaactcggtgatggcgatagcttgcggcagtggacgacgatcggctcgacagcaggcgacgggctcggcgggggctgtccctcacctggctccgcacggatctggcagtgacgacgagaggagcctaaccccacacatactcggcgacagtgacggcgggcggcagcaccgacgacaacgagcgtcgacggcaagatgttttgatttttgagatttttgtttttttttggttttttgtttttgcgtgaggacgacataagcacccacacgcgaaaatcaaattaccgcatgcggttgcgccacctgcatgaaaaaatagcgatttttgcagacattttagggcagatgagcggctcaaccacacgcaaaaataggaaccgaccgtttggaaaaatggttttttaagtagtgtgaggagttaacgtgcagctcttttgctctacaagggcttcgaggagtctaaaatttgaaattaataaaaattgaattgtttcgtgtttggagactcaattatagagttggcattatttaataaaaaaattgttaataatacgtagttgtacgcggttttggggtcccaattacatcatttttcttgttttaataattttataaaattgaaaattgtaattattttgttctacttcagtatagactatcagttacagatttttttttatgttttatagttcatagttaatatatgccaacttgtcataattaagcccatagcttataatagatgagctctaaattacccaacattcagaacagttgggtttttaatatgcagaacgatgttaaatgcaaatctacagccataacaatacaattcatccaaggtcttccggtcttattatgtgtgagataataccaagtgcataattagaatagttatttacttgtgcgaagtcaatagcaaggccgtatatatgatacgtggaatttcagtaacatggcatacgttagtttaattttgaaataatggagtattacttatcataagagggaccaatctttttaggagcacacacaggttggggggggggagggggggattagaatgaaaagagctcaaaaaatattttattatgcagaaaaatataataaaagcatcccaaaacacataattaagatagatacatgctcccaccggtcacaaatattaatttaacatttgtaataagatttttttcaaattttgaccgtcaccaataagtactgttgtaatctcataaacttattagatcttataatatttatctaatataaaattatgatttaagccatgcattggaccttgaaaaaaaaaatctaacttcatatattatctgctagaggaagtacttggttcagagagatcagtgtaacttattgttgaggatgcaaccagcacaaatttatagatttaaacaaatcctccttccagtaggtaaagtatagtagttcctaattaatgaatacctgaagagatgttattagtaagcaaaccagaaactacatcttgaaataagccatgcatcagacctacaacttggatggaaaatgtcagaagactcaggatcgcaagataaatatatatataattatatagctatatatattcaacttaattccttccgcaaacctataaaaacactccagcatggaaaaaattgcagatttaactgtgaacatcatgcacaatacatagtactacttctaaagcagctagtctgtgtgactcgtgaaccccagaaaagatgaagcatatatatatatatatatatatatatatatatatatatatatatatatataggacactcatatggggcaccatggtgccgggcaccatggtatttaatgcacaaaatcactcaaattttttaaaattttcaaattgtgagtatatacctagttataataatttgattcatacctatacttatcaacaaaacaactcaaatttaactttatttcacaatacatgattacatacctaactaattatatgtatggatgctatatacctagaatcaaaatctaacaaaaacaagttcaaattcagttcaaacttgctttaaactagttagtaaagtagttaatgttaatacctaggtaattgaaaaagtttcatactcatttaattgggtatatactcaatttcaacaatggtgcccgggcaccatggagcaccaaacaaatttactatatatatatatatatatatatatatatatataacacctttaatttgggaactgatccgacgaactccacgaggtaggaagatcggagaggggacatatgcttgagcatgacacactacatgaagtaaggaagcaaggagagatattgacgcggctcaatccaagaaacatggctgcatgcgctagatcggtcgaggtgcctgtaatcagccatgccttcggattgaggcacgccaatacctctttttacccaagcaaaaagaccgcaacaagcctagcagctctctttcttcctcttacaagcttactggtcatcgccctctcgata

SEQ ID NO: 73063 - DNA, 4993 bp, Oryza sativa
  unsure (1)..(4993): unsure at all n locations
taatggtaatgctgtcgtatcgctttatntttaaancctttaatgtttaccnttttatattatttnnncgtttnncgtttgntctattgctttnnccccnnccccnnnnnncctggtgaaatgaanatcncatcntcgcagcccgcaggncgactctagaggatcccccaaaataaaaataaatttacaaataaaaaaatattatttttttaaagtatcctatcttactgtaaatttacaattcattaaattctaaagtgcagcatgtaaagataccatatcattatccaataacaattattacatcttaaacatcatacaaagtatgctataattctataatttattaaattttagagctctagaaatacaaaaatattaaatcatcatccacataattcacataatatgtcaacatatctctccatcattttttattcctcacttaattaatgttatttttctcttctctcataagtcgtatcaaattaattggttttagcctttagatgaataatctttaatccaaattatctccttcatttttttctctcattaagccatatcacctcaactgtttttagctcttaaatgattaattcatagtccaaattatcttcctatagttcatcctcgcttagttaatgttatttctctcttttcttattaagctgtatcacattgattgtttttatctcttagatgattaatctatgatccaaattatttgcctcttttcttctctcattaagccatatcatctcaattgtttttagcccttagataattaatctatggtgtaaattatatccctatagttaatcatcacttagttaatattctttctctctttgcgcattaagccatatcatatcaattgtgtttagcccttagaattaatctacggttcaaattatcttcctcattttcttctctcattaagctatatcatatcaactgttttttagaccttagatgattaattagtggtcaaaattaattatctctctcattttcttctctcgttaagccatatcatctcaactattttagcccttagtgattaatctagggttcaaattatttccctccttttcttatcccataaagccacatcaccttacttttacatttgaatcatcattattccatatactatttaaattatcataaatcatatcaacttatataagctgattccacctagttatccattatttactaaaggctcacagcaacgcgtgggtttcacctagtattaggagaaagagaaaagggaaaaaaccaaaaaaatggacaggatggacacccaagggcttataactgaagaatttaaccaccacactattgcggttctgatcaaagaatatgcctgtgctactatttaatccggggagacctcaacgccaagtcatttcacactaagctatgatgacttggcaaagtcacaacacctcggacgagagctcagcaccaatattgatggcactaagacattatagcttgatcagcgttatctaggttagcactaagccaacggttcatttttcaataagatttttttcacgggtcattcttcgaataagttttctaaaattatcatttttgtcaaaattttgggtacaacgtggccggtagcccccactgctacggaaaccatttctagataaacagctaaaatgcgtttggaaaggtggtgcagatgatggcctctaataaaaagcatgtgaaaaatgatgcaaaggacaacgtgccgccacagacggcaggcaaccttatagcggccgttgttggaagtcgatttttagagatgatcagctaagatcaccagctaggaaaatagggataggcggtcgactttaactgaccgtttctagcctctagaaatatgtttccacatacagccggtgacacaggccccagagctagcatatactgcacgggtaaattcccttatgagccgtgcacctgtgcattgtaggggaacatcatcaaaagtcgtctttattagtgcccaaactccatgccgttggagcaagatagctgctcttaacaaatcaaaagtactctagctaaagcagggagaagaggacagcacccaaaaaagatactttggtgccggttggaaactggtcataggtgtcggatttttcaactgacccagcagacgacactaacgacttcgattatcgtcgctgtagacatacatgtgtcggtttttatcaccgaaacctatatgttattcgatattataggtgctagttctaaactaaagtgtcatgtgactgtttatataggtgccggttctttaaaactataaatagcatatatgtgtcggttgttgaccagtctagacacgtggcaaagactataggtgtcggtttttaataaaaccagaactttatagttggcaagaaaaaaaaaggcagaacctaccaatttcacatacaaatcatacaatcacaaaaattccaataaattcacatccattcatcaacatacacacaatatagcactccgggatttagatggcgagctcttcggctctaggaggcgaccccccatggtgatctctcgtagccggcgatggtcacacctgcgcctttgagaggatgggatttctccctgggggattccatccgtgatgaggcgtggcggtgttttggttctccggtgcatttctcttctcacttcagttcttctccgtttcgtttggtggtggatgttccaagatctacttttcggttgacaccgtcttcggtggcgctttacctgagggccactattcatggttctccatcgggttttcaagttcaatctctaactgattggagtttctcgtttgtggtgatgggatggaggagagtggtagaagctcggggagaagggagtgggaggcggggcccgttcagccgccgcacattcctccccacctcatgtcaactccatcctccccgagcagacaccagcgaggacaaccccacgctttcccccgccgaggacatgctcgagcgcaccaagctcgcccaggttccactcacttcttcaggcttcggctaagtagagcagtaatggtgaggatgtgtgatgtgatgtgcccttgtgcttgctggtggtctgtattgtgatgtcaataagtgatgatgaagttgattcatttcatttatactaaaatttgcttttttttgttttgatagaactgatgaagatgacaatgatgaaatataaacaccggcgacgaaagtaatatgtgtagctgcagtgagtagcaactgtggggttgatgagaaaggtatttactttcatctataacattcatctgttttgtgggaaaatcttgccacaattaattatgatgaacgttgccttcacttatttttctccctggtagagttagaagtttcaatctgaatggtatctgtggaagattgtgggttatttttctaagttattatttgtgttgtaatgcttcaatgcggtgaataaaatacaggcatctccacattttattaactgaaaaactgctcaagttacagtgttgagttagatattgacagtctaacagatctagttatagtttatccattgagcaactagtcttagtttccattgctatgttttgcttcaattgtacaaccttttcatgtctttgcctatttgtttcttataactttatcataattgcaagtatattcaagtatcaactctaggctctgtaccatcaatcaactaaataagttgtcgctagttcttgtctcagtgctttgagtattgctttaattgacatgaaccatgaactgcttgtatgctaattaatcttaacctatgtttactgaaatatacacttgttctttttattgtgttgtatggtttgtattgcattagagataaatgtatgggacatgatgtagggcttgctgatgatttgtatatattgtgatggaaaaaggggtaaaggaattacaggtagtaaaaaaaagatataaccagtgtatacttactgggtaaaaaaaaatataaccatcctatatgcgcttttcacgtgaactcaagggaagtccacacagtaaactggtgaagctcctatgtcaccgttaccgtgagctggcacttggtaacgccgttatcgtgcattttttacctgttcccgtgtgaccctggggcacacaggagccttccggtctctagtagtgccttagtaatggttgatgggataagtagcattctagaaatcattatatttgtggataaattttactgttaaggatgctaatgtctgtgggcatccaccactccatatttggttggcacggtcagcactagatgtgatgccatggacttgtgacttaagttgtgtgctttgttcagttaactctatcgaggacctgctttatctcttctttcaatgttcttttgcacagagctattggaatgctcttgtttttctgggatacttctctgagcatggatagtatgatgattcatgcaaaatctcactatcagggatagtgttttatggaaaagtttgtgtatggtgcatggaatatttggaagcagaggaatggcttcattttttaacaaaaaattttttgctttgctttcctaaaagcaaacttttaaaaaggaaaccctcccccttttgttggtttagaaataagtggaaagaaataagggatgtaactcttaaaattggatataatttgggttgaaaacttttctaataataccctttaaataaataaaaatttctttaacaagcggggaacctttctcttgggggtttttttttttcaaaaaaacccccacattattgtttgccccgattgtcaatttaatccacaaacaacacaccaatttaaaaatcctgttgtttacattaaacacacaatatttagtgtgtgccaattctttcacaatttttaacccccttccacaaaggaccgtaattgttacaataccacatccttattcttcgccccgatatgcgctaaaa

SEQ ID NO: 73064 - DNA, 755 bp, Oryza sativa
  unsure (1)..(755): unsure at all n locations
cgcgtgaagggtgagcnccctgtcacangcccgcacgtcgactctagaggatcccctggaatttatagtaggaaaaaaagaataacgaattaaaaaaggaaaacaattttagtttcctctttttctaattaccaattgaggtggcgaagatttcactcggaatttcaccaaagccgaccgattttcataagtttatcggtaaactctagggattttgactcaaatatttgtttacgaaatttggccgaaatctaccggcttttcatgggatttcacgaaaaacgctattccggcatagcccgaaacggaaggccatttcggaaccgtaaacatgcgtagtacattatatttgagagaaacctggtccaatggatgttacatggttgaaaaataaaactactactgtttggcgctacttaccaacccaaactaaacaaaaggaaaaggcataataactgggcttctagaggagtaatttggcttacataccctgatgttcactttaatctttaaaaaaaacatcgttatggccatcgncatcacacaccagtgattagctcctcaaccgacaactccacctccggcagctacatcgncgaaactagtaccacgccactgacaggtgggtcagtgtcgacgcaatggcccacccgtcagcgacgcggaggaacaagcccgtttcgtttgagcgaagtggtgccacngccgttgatggggacgcgtgtttaaacgttggagaaaagtcaccgcgtaat

SEQ ID NO: 73065 - DNA, 6389 bp, Oryza sativa
  unsure (1)..(6389): unsure at all n locations
ctgcaccccctggcttgtggttggcacgataaatgtttcacaacagtagctcgcgaaccggtccttaattgttatgagcacaaccatcaaaaccatatgctcacaacccaccttaaccaggttttaattatcaattaattaacaccacacgattaaccatcgtgagctaccattaattatagccataattaataataacaatataatataatgtatctttaatcccatttagttagctaatgtttctaagcatgactaagcaaacatacatatggcatttagctgaaccaatctaatatataaggtccaagctaatcaaattataacccataggaaaataaagtcatcttcggccattatttaattgggaaaggttcaccacccgatgacattcgaaaataatgcataagttgaaataaaacattagctttaaacgggttcaacatgctcaaagggttgtttgggatctgtgtgacttgccttgaacttccgcaaacgcttccgaaccttcctcaacgaaaacgctctcctccggaacgtcggaaactaaagcgaaagaacaaaattcaacaaaatagtgtaaatctagcataaacagtacatgtggatatttttaacatgtagatctcagttttagaaaaatttagcaacttgaaccactcgaatccgagctacggttatttagttatgattttccgaagtttaatcgatttcatctataaaaaacaactgaaaaagaggagatgatgacatcatgatgacgtcatcgatggcagccacggcacgggtggcgacctcgccggagctaggggggtcggccggacttttggaggacacctacgcgtagaggacaacattgcgaactcaatggtgctcaccgatacgacaaacgacgtcggacgacggacggcgacgagcttgtgcggcggcggtggctcggtcgacggcggcgacgggtctccggcgccgcgacagcggggagaggtcgcccaggcttctactccaccgtgcgcacctacggcggcaacgggaggcggcggcgacgacgcacgcggtggcgcgaggcggctgctcgtcggccggcgacggcggccgcttggacggcgtggcggcggcgctacggagcactagagaacacgggagatggggcaaacgaaagaggacngccaagggggatgctttatataggcatgggtggaggagatcggctcaggaacggatggatttggtgaaagaagttaggatttatccgagttcacccgaatataaacggccaaaattcgtgagatatataacgaatttgatgggggtttcttcgggattaggtagaggagatagagaggaatccgtttttgcaataaattttggaaggggatcaacggatgcgccggatttggtggagattggcgccggtatcgggatgaactcggcctctggacggctggctggtgcttgaagacccactgtagcgagagggacgtagattagactttaggctgggctgaggaagggagagagaagaggaaggaatgggccgaaaagggcccaagctgaggaggaggattttttattacttttccaaataaatcaatcaccaaaatgatctttgaattgttaaaaatacttccaatgctcaaataatttcaagaaaaatcctgaaaatacttggacactcaaagtattcaaaaaaattataatcagaccatttaatgattaatttaatatttgaataattgctgaactgctctttgtataattaaaattaagagttgagctctgaaaaatctgagaaaattccagagagtataattaaccatggagaatttaataaaaattaaatccatccatgctttatatttaggaaatttatttcccacatttaactttactggtaaattaatgaacatttaatataaattctaataataatttattaaataatttataaatcctaagacgaaaatcaggatgtgacaacgaggtatacaatgtagtcatctccaaaggattttgcaaccctttgtctcttactcttgcgagtatctacaatgttgtcctcctcaggatttttcttaggcgtttgatcattgtgttctatcggtgcaaagtgctcatggggcatgacagtttcttgactagaagtgctaggtgtatgtttcatgggaaattcattctcaaagaatatagcatctctggactcaaaaattgtaccaacatgcatgtcgggtactccagagtttactattaagaatctataacccacactgtgaatagcataaccaaggaacacacaatcaacagtatttggtccaagtttccgctttttggctataggtacatttaccttggccaaacagccccatgttcgtaggtatgagagatttaatttcttcctttcccattcctcgaatggtgttactttcttatgcttcatgggaattttattcaggacataacacgcagtcaaaactgcctcaccccaccattccttgcaaagccccgtagtgtctaacatagcattcactatctcagctagagtacggttctttctttcggccaccccatttgattggggtaaatagggaggcgttctctcatgaataattccaaactcttcgcaaaaggatgcaaactcattggaaaaatactccctacctctatcagacctcaaccgtttgattttcctttcaagttggttttctacctcagctttatagattttaaagtaatgcaatgcttcatcctttcttttcaatagatacacatagcaaaatctagtgcaatcatctgtcagtgtcatgaaatatttctttccccctttagtcaacacgctgttcatttcgcacaaatcggaatgaacaagttctagaggtgccaaattcctcgcctcagatgccttgtgaggcttacgaggttgtttcgattgaacacaagtatggcacttggaacctttgaccaaagtgaattttggaattaaactcatgttagctaagcgcgtcatacaaccgaaattcacatgacagagtcgcgaatgccacacattagactcatcattctcgctaatatggttcacagcattatgattattacacatgtcattcaaagcaaagcgaaacaagcctccgctgtcataaccttttccaacaaaagtctcatatttagatacgacacatttattggactcaaacacaagtctaaaaccttctctacacaatagagagccgctaacaagattcttctttatatatgaagggacatgctgcacgttcttcagctgcacggtatttcccgaagtaaacttcagatcgatcgtaccaacaccatgaacagccgcaagcgacccgtttcccatcaacaaggaggaacctctcccgacctgataagaagaaaacagagaaatgtcagcacatacatgaatattagcacagtatccacccaccaatcaggtgagtgaaaaacagagagaactgtaggtaatattttaccgtaccccgatgttcctccgccctcgctaatgaccatgttagcagacttcctgtctttgcgctcaggacaatccttggcccaatgcccagacttgccacacacaaagcagtctccctttgcctttcccttgcctttcttcttaaagttggttgcagccttgggtttgacatcaggcttgactttcttgttgttgtgggatgcttgagtgtcacgcccggaaattcacaagtaatttccgaacttatttgtgcataaaatcctcgtccaagaatcagccgaggtacacaaactgacaatttaatatacagattcatcaaattaactaaaccgataaatacttacttaagaggcacttagtcctcaccaagaagaaaactgcagcggaaagaaaaatctagcgaagctccggctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggattccaaaggatggcataatatagggttcatttgcgaaagcagcatttagcaaagatttaagataagtaaaacagtagagtaattaatcagaaattttaatcaacactgaacagcacacccatgctgcacaggcccaaccaaacctgaacaaccaaccccggtcgtacagatcaaacctccaaaccaggaattatccattccaaaccaggagtcaaattaattatcacattattaccattaatgagtagtgtgggactaatcacgaaaaacattgctcaactcgcccataaccgcgggcacggctattcgaatagttttactctggccagaggtgtaccactgtacccacaagacacgattccacacatgttgccatgccccgaagtaccaccatggcactgcaaaggaggaaatcgtgacaataccctttgcacaacacaactcaaaatagtgcaccgttcctggatcataatctccccctcaaaaccagaggaaatggactccccagcgacccccacggacttctcgccgcttcatagtctggcacaccataatgaatcatgctatacaaaaggtaaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgagctatcattaaatataaccataagtgatagtgaaacattagttatcccaattgtgtgctaatgtttctaagcatggctaagcaattatatctaatatctagttgaaccaatatataaagctcaactagtcaagttataataacccaaggtatcaaggaataaagtaatcaatgcaaacatgccataacaaaggaataggttcacaccacccagtgacattcgaaaataaatgcacagttgaaataaatagagaatttaaatgtaggatcaacatgctcaaaggattgtgtttaggatctgtgtgacttgccttgcaataatcggtcttcaattaatcttcttgaatacttccggcgcactcgcgaaccttcgcaacgacggaaacgacaagctaacacgcaaaacgaagaaaaagactaataaaaaccaaataaacaatacataaaaagtaaacaaacatgtaaatcataattttagatgaattatgagacttgaacggcctcattctgacttcaaatgaatttattatgaattttacaagattaaatctaattaaagcccatttaaaaagaattaaataaatttaattcaatttatggacaattttaatatgtagatctttattttacacaacttttgcaacttgaaccacattaaactgagttaagatgaattagttatgaatttttaaacattaaatcggattaaaacctttatatggattttaattaaattatgacgcaataatgaattatttttgaaaaggaaaagaaggattattgcgtcagcggctagggtttgcggtggaccgggtgcacggcggcggttcacgcgaacggacggccgagatcaaccctatccaaaacggacggccgagatcgatcggtccacgaccggctcacgggagagggcgacgatgacgtcagcgacgacgtcagcaccggcggcggctcggcggctcggcggctcggacggctcggacggcgcatgctcgccggcgaacggcggctctacggcacaaacggagggcaccaagacgtagatcacggcgcggcgaactcaccgatgaccaaaacgtcggcggaagaccaacggacggcggcggcgtcgaggaaaaggcggcggagaagatcaggtcgacggcggcgacggtgctccggcggtcttcggcggcggcgaagcggtggacggggacggcggtgaccttgcgaacccgatggtggcgacggcgaccgacgacggcggctgcaacggcggcgcggcgcggctgaaccgacggcaacgacggcggcgactagggctacgcggaggcggcgctagacacgacggcgggctaaggcaaaggtggcggcgggtagaagagacaccgggggtccttataaaggggctagcgagcggcgacggaggcccacggctgccggcgacgagaaggaaagattggggaaaaacgaatccgaatcaaactcgaatccgcctatttccaaaggaaattgaccggagtttctataagagaaaaggaagaggagatcgaggagattatttcccctcaatcgatttggccgcaaaggaaaggcgcggccggatttggaag

SEQ ID NO: 73066 - DNA, 2479 bp, Oryza sativa
  unsure (1)..(2479): unsure at all n locations
agcttttaatcagatggataactttcttgaagaaaggtggacatttatttcttttttcctagttaagcttgaatatatatccttcgattagactgaaattgaaaatttaccctcataactcacatgcatgtaacaagaccccgccatattatgtcattggtacaagaggttaaatccactcctaatttttatctgagagctataaatgtgtgtacgacgacgtaattaacattccttttgaatatataatgacatgaatccaattaaccttatagagtagtattctattgggtatatatctggtccagattgtataatatgccaagcgcgcgcgtatagtgggaaggtataaagttgctggctgtctgtctgtctccgttgggtatgcatactcctacttaaaacatcattaacaaattatctataattttcgtctaaaaatttgtttttgtttcctaaactgaaaatagaaagtgaaaaactccttccttcaacagatagcctaaattcaatccccaaaacttaaaagtgggcccttctattaaactatcaatagaaaatttcgttttttttttctttcacgcgcgcagaaagatcgctatctcccacgcgcgggaacgaaggagagaggcgggaatgcgtgattgggagcgcctttcgcactactacattcaagatttttccaaacgggcattttgatttttccgtgcggttgtccggcccgcctggagccaatcgtctgggaaaatcggcattttcgcgtgcggacggtccaaccgcacgggataatcgatttatcccgtgcggttgtgttataccgaccgcacggaaccaaaaaaaataaaaaaaagtgaatcggtcgctcgctgccgccgcgtcgtcgacgtcgtcatctggcccgccgacgcgcccagctcgccgcatggcctggtcgcggccacgcccagcgcctggctcgcccagccggcgccttgcccgctcgctgtcacggccggctcgccacctggcctgttcatcgtcgtcggcccactcccggccgccgccttgcagtcatcgtcgtcatcgcgcacacgccacttccggccgccgcctcgtcgtcgttatcggccgggcgcacgctgctcccggccgccgcctcgccgtcgtcgtcatcgtcggccgtgcgcacgctgctcccggccgccgcctccccacgtccgcccgccgccgttgagcccactgctgctgcgcctgccagccgccgtcgaccctgccgccgagagccgcctggaggagaggaggtgtcggcgccatgcacaggaggaagagacgaggcgttggcccggccccctcgcctagccgccgctggccggggaggaggcctgtgggaagtcggagagaagaggagaagagataaggtagagagagaggtggaggtgggagtggttgagggagaacacataccgtcttggctggccgccgcccaagttctcctttcatctgcctatgcctcctgctccctctccactttggcttctctcatcctccccctcgcacacgcctcggcccctcctcccccccgcactcccccttcttcattcttctctcatccttcactccgccctccttccctcttctccctccgcgaccctcactcatcccccaccccccctcctacgctcgacctcagccctccaccccctcacccctcctctccacacccatactacctaccttctatcctttcactgcgcttcccacctccttactgcgattatggactctacgctccgtcaactacctttacggctcatatctgctcaatccttcccctaacctcttccctttccctcctgtcttatgtatactactcagtcccacgttcactagcgttggtacgctctagtaccggagttcccttccaactggtacttagcccgccctctccttcctgattagtcttacgcactcttatctgtgacgctcttcctgttccctctgtctcttctgccactgtgtccctaacgctgaatcgcgtcgcctgttctacctcgtcccagctttcttcattactcacttngtttaccgtacctcgacttcctcaccggttagcgtctactcgactcgttctcctctacattgtctctgtgtttccttactcgtacttagctcaagccgactagtgtcacctcgatacctcttcgacgtcctctcctanctcctctcactacttgcctccggccatctaaagcactctcgctctagcctagacgctaccagtcctacaagtcatacgctgccctctctcttgccttaacaccggtaaccgtgtantgctacactggccncaagcgtatgcgcggatactctcgtacctcgtatctggccgttctgctctttattggtcttcgggacaaccggtgcaagcgcgatacgctctcatacgacatctcggcggtatatctctcttatgtcgcatgtttctcttacatagctctcc

SEQ ID NO: 73067 - DNA, 2729 bp, Oryza sativa
gtcgagctcccccgcctttccccgccccaagttgtcgcgtccttggggagctcctcctctccctccttgcctccctcctctgtctgccgtgcgtgctgccgcgccggtgcccgccgccggcgaccaccgggccgtgcgccgccgctgttaggtcgaccggccggcttgtcgccgccccgctcgcctaggccgcccggatccccttgccgcgccgcgccaccgctttcccgcgtgcgtcggccgtcgccgcagaaggccgcgccgccgtgagccgtcgctcggccgggccggcctgagctgtgccgtgctcagccgcgccaccccgtggccgcccgtcggttcccgtggaccggtggtggaccgcctcggtggtcccggtccacggtggaccggcgcccttgtgccgctgaccggtggggcccgcttgccggcgccgcccctcccctttgatgacgtcagcaaccgtctttgcctttgtaaaaataaataataattgcgcaataattcgtgaataattctagaaattcatttaaatggctcaaaacttctaaaattcatatctaattcattcgaactccgaattgagccattcaacttgcaaaattcatctaaaattgagctctacatgtttgtttactttttatgtactgttttcttggtttttattagagtttttcctcgttttgcatgccagcgtgtagtttccgtcgtttcggaagtccgcggtcgcgaggaaaagagttcggaagatcaaagtgaagaagcaaggcaagtcacacatttcccttgagcatattgatcccaatttacagatgttttactgtttgcaaataaatatgcatgttttgctaattacatgggatccgggtattacctatctgctcgcttgtgccatgtttacttgatatctgttctttgtcaaccatgggtaataaatcgcctagcttgtgttactttggtgacctagctagaactatatgcttagccatgcttaattaccactagctcagtcgatgggataattgcagtattagacattctagtatcttgttgagcttcgtgctcgagacatctggccatgcttcatggtcgtaattatccaactaaaatgcgactgcatggtgggctgtgggtgcatggttttgctggtcgcacccatgtcagttaaggaccggttcgcggaatgccctggaagaacttattgtacttaccacaagccagcgtgggcaacgactgggcttgtagtgtagctttcctctagccgacgcatccaggcaagggtgggcgtgatggagtttggatgggccctgcgacggcctatgcggcttccggattcacctaggcacgagaagggactgcccactgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgttgggctgtgtcttgtgggtacagttgtacacctctgatcagagtaaaactattcgaatagccgtgaccgcggttatgagcggtcgaccagattcaccgtgattagtcccatcttaataagtcgacccaatacactgtagttcaggtggattggttggacctgttcaacgtggtgtagcgttgatcagtggagatttaatgttactttaattactcaacagttttactgttttgctcaataaaatgttttacaaccgcctttatgcaaatagccacaaacccctccttgtatccccttgcacatctgcatcgttggtgtggcttgctgagtacggtggttgtactcagtcttgctattattcccccttttcagaagtgtagtgcttctgagctgaagatggagttagaggaccaaggctcagaccccagttgagttttgcctgtggagtggagctgaagccccgctaggatcgcctttttccgctgctgtcgttctgtttcggtgtgaggactaagtgcctcttccgtaagtattttacgctttatttacgtttggaactgtatattacttgtcgttttgtgtaccctggctagtcctggacagggatttaatacgcaaaatagtctgaaaatttgggttaaatttctgggcatgacaagttaagatttaccaaacgttctaacgattttcttccgttcttggctagggacttgcattctgcctgtaaaaccgaccctgagaccatgtgtgttcggctagatgccgcgctcgaatagagctgtggcttaccatctccaattgtaggacaactcgactcgtatggatgaaaatgacttgtgtacggagaaaactgcctctaccacatctatacctaataaaaaaattcgtaatgcttccgtgaggtttttttgtccgtcgccggtttcctgaacgcacacgcggttttttcgtccatcttttgtccatgcacaatcctattcggttagcaatagccatggaaaaaattgcaaaaaaaaaagggcggccgacgacgccaccaccgccgccggagggagccgccgctgccggatccgcacgcggatgaagccgacgccatcgcagccgttgggagggcgccgtcgccgtcaaggccgacggtgagagagagagggggagggacggccgtcgccgtcgtatccgccgcaccccgccgtcgctgcgccaagccgacaagacgggaaggaggggggagagggag

SEQ ID NO: 73068 - DNA, 2093 bp, Oryza sativa
  unsure (1)..(2093): unsure at all n locations
ctcctcacgtagatgaaaaaatttaacttctttcttcggtccgtcaaaataatatatattggctatgggttagacacattccccccccccccccagggccttgatgactacgctcgnacccacaatgggcccgggggtatgctaagcgagggagagttcccttcatttcctcacacgtggctctacagcctggtcctacccccgcacctcgtgagtcgcggccacggctagggggcctcggggtgccacgtcatgcccctcggggtgccatgtcaggcccctcgggccctcgagttgccacgacccaaggccctccccagctgccacgtggcgggcagagcgtgagggagggggggaaccctaggctgagcagccatcaatgcgcggtgccccaaccgtccctcaccgcgtttaatgcagtaagggcggacgtgcggtaccgcgccactggcccgtgtcaaatcgggtgtgaccggcctgtcgtcggtcatgtccggttgacgcgcggtcacgcccccacgtcgcctgtctccggtggagtgaaggtaggtacgtcccattacatcggagcgtcatccggagtcctctccacatgaggaggacggccactagtcttcgcccatttaagggcgaatgacatagttgtcccccgtgtcagatgaggtgcggcgctgggtcccattgaagggccaatcgcggcgtagcttccgggcgaaggcatagaccacggtctggtcaaggtagaatgggcccattctcataaaaaagtaggtagaggcgatgcatgtgatatccccttggactataaaaggaggaccgtgcctgccgtaaaaggagaggacactgagtagacttaaactctagaaagaaaaggcaggcgagctctcaggagtttaggagcctttgtaatacggatccataattccatacacatgagtagggtgttatgctcgccaccggcaagaacttgtataaccccggtgcccgagagtgctttagcaggattcagggcggctacacaatctctccaagcgagcctcttcccccggccgaactcacaaaaagggggtctcacgatctcccgctaaagagggtaacccctcgacacacgggaaaaaaggaaaaaggaggagagagataggaaaattttaaagtggttgggaggaggagataggaatatcccgtgtggttgggttagaacgcctgcacgggaaaatcgatttttccgtgcgggcgacaccccagcgtcggttctttatttttccgtgcggtttcactaacggaccgcatggaaacaaaaaggaggacgtccaggataatcaatgttgtagtagtgtcgcgcccgcatataaacggagcgaggaagcaggagaagggaactccaaaactcgggtaggagagtagggatctgttagagctgatttttggactaaaatccctcaaaatcaattttgggaatcatataggtagactgttggtaatgcttggcgccaattctcagaaaaaaggaaaaataaaaaaataaaacgtacgtggtggcgccgatcgaccaatgaccttactatctgtgttgtacacttgtacgtcgatctccggtcttcaccgctcatcatcgatcgaccgatagcgccatgatgggcgtgcgcacgcggtgtcgggcgcgcctacctcgctcgctcgttgaccatccatgtccatcaacggagacgcatatgatttgttgtcccgtaccggccgagctaaaagctagaaggagaagagcccaacaaaatgcaagattattcagatttccgatcctggctaatcgacgctggacaaaactataaaagggccccgacgcgtgcgtgcgtgcgtgcgtgctgcaataaagcgctgaaaacgaggcggggagatggatggatgggggatcctctagagtcgncctgcnggcntgcgagnatgacgatntggcatttcaaagccgcgggggggggggggtgagnnagnanaagatcatgagantcaatgtacgttagcgtgaacgagtaacaatcanggaagcgagggaagcgagaatgtaagaggtatatacatagcgagagcgaagatggcgg

SEQ ID NO: 73069 - DNA, 686 bp, Oryza sativa
ggaggggggcgatagacccaaaattttgaaaatttcagtccgtaattttgaacctgcttattacatatatagtacgttaatttaatcatgttattacaagcttcccgatccttgtgtatccgatcataaattaatttatcacttggtcatttttgatatgaatggtgcattgcagctgagaaccttgggttggcgacatctccaccgtacctcgccatatcgtcaagcagcagtgctaactacgtgaatggcgtcaactttgcttcaggtggcgccggagttttcaactctacaaacaaggtagttctaattagtttcaactcgtacacgtaattgcaataacaaacttttctcatagattaccaggacgtaggattatatgtatgcatgttagtcgtcaacgcactatatataaagttcattttttttaaaaaaataatacaaatggtttacatatttctgtcgacagtgatatagtcaatttgttttcaacttgttttagagttgaaaattggttttaattacttgtgttaaacattaatgcaggatcagtgcatcagcttcgacaagcagatcgagtactactccaaggtgcaggcgtcgctggtgcagagcctcggcgaggcccaggcggcgagccacctggcgaaatccctcttcgccatcaccatcggcagcaacgacat

SEQ ID NO: 73070 - DNA, 1387 bp, Oryza sativa
taaaatcccaatataattatgtctctctttatttattctctatccatttatcttctgctttcacaaaatttgatgcaataattacttaaaacaaatttagtttagaacaaaggacttaattaagctgcatggcgtggcgggcccttgcgggccagcaactaacatatccatctccatccaacactgccgcgcgggggggccctcgcgagcgtcatgatgggcccggcccgctccggcctgtccagtggcccacgcacggctcgacgggcgactctgaattactctgatgattcatcagatttcagagcgagcgagagagagagagatgcagtgcaggcttttttggtatggagccagtagcagctctctctctttgatttctttctgtgccgctttcatttcttaaccgcatgccttttgacgttttcccaccgactatctagcgacccgcccgcagccacactcctctagtcggtctctacctgcatattttcagtgctggccctgccacgcagcaccacatgctactcctgtgtgtgtgtccaggtcggtctggtcaacgcagctactcattgctacgagtactgaccttcgattcatcgtacataccctgaatattatacatattttgtggaatgatagtatgtgaaaatcgatttgtcttatataactagagccctccaacttactatatacaattaagcggatctctttatacatgttgaaagaaaatgtgggttgctaaaactattttctaatgggttaattggatccatatatactgtcgtaaccgttttaaaagatgttattacagttcacctaattgaaatagtaccactataacactcttaaaatcgaatgtgtgccatgatgtacgtctttttatctaatgtattttcgtatggatcaaaataccatatcttctttattcatccttcctctccctccttcatctcttcttccctcgatgcaacaggtggagctaaggtcatcacgccttcttcactaacaccactgctcatgctggttccacggcgacccaactcgtgcacagtttcatggcgagatcggacgataggctcctataagaaaggcagcaagagaggagcgacggcggtagggttgaggcttgcacctgtaccgctgtagggacgaagccatccccaacgctgctcactcctcctcctcctcctagttgttgatgccgccgccgcgatgagctcattgtttctatcagatctgtccaccgcagtgcagcttgccaccaccacgttgccctctgccgcgtcaaacagcacgctacatgacccgccatctttgacacctttccaccttcgtgacaagctcgccacttccaccaggagtgatctcgtgcaccggttcatcg

SEQ ID NO: 73071 - DNA, 1602 bp, Oryza sativa
  unsure (1)..(1602): unsure at all n locations
agtggtganttagnagactcactcgngcaagccngcaggtcgactctagaggatcccctgagggacacaactaattttagaatcgacgataaattgaaggacctcaagtgaactaacttcgtggataaatccacatggaaaaagttcacccaaggtccctcaacttgttattgggataaaaaacgtcctcaaaccgtaaaaccagataccgcgagttccttaactatacaaaaccggtcacaataggttccttggtggtttgatcccgggttactcctaccgttgctgagtcagcgtggaacccacgtgggtcccacatatcaggaggtcaacgtatatctctttcctctcttctcttttccttcctcccctttttgctctctctctctcaggttgggccgacggtgagcggggctgagtggcgagaccatgacggtgctcgtgcacaccactcccacctcaccgatgccgcatgaggcccgatgccccgagcgcgttgtcccccaacaccaggctcgccgtctcattgcccgcgacgacctcgccgaggccacgcgcctcgtcgaccgctcacgcggggaggcacccggcgccgccgtcgctgccttgaagacaaacgccaacgtgccccctgtgctgcgccgacgtgccggttccggcgaggccgacgagctcgacgatggcgaaggggaagcagcagcaaaccgcggacagcgccttcctcctcatacagccttgccgccggcctctccgcctttttttttcttagtgccctccgccgctggcctattccggcgccggttgcagccggtcccatacactgtcaccgccaaccggtgggagagtgcatcccctcacccgtcaacgtccgactgactagtgcccggaaccttatttctctttgtacctgtagccgttgacgaacgaccatgggcttatcggatacggatgatctgtggcggccggatttttccctattccgaaggcccgtgctctgcccggccgtcccgcaacgggttttttatttcacgcgcgcaacgtccgtctcgttgtatcggggacctatatgggccgtgataaagctgtttctctcaccccacacgcgggtatggcgcgtttgttatatttctatctcatattgactatctgtatgtctgatgcatgatcttcgtccgtcgcgttctcgttctttcagatcttcgctttattcatacttctgcgattaactcacatacgtgtctcttcttcctcctctgattcatcttcttaatcttttaatctctctcttactcttatactactgttctttactatatattagtctctacactctctacacgttctcccggtatatgtctcttatctcttcgtatacgacctgaacacgatgtcatccaatactactgctcgtcatgatctcatactactcatcgatgacgtgtccatgtctcctcgatctctatgttatcctccttccttctcacctttacttgctgatgcgttaatcattactcatcatatctatacatattctcgtacctgtcttcactatgcttcgactacactcgtggcaacatctgattactacttcctcttcctccg

SEQ ID NO: 73072 - DNA, 2881 bp, Oryza sativa
aacttctacttaatggattaattacaaagatttctagttgcatacaaggaaggtggaaaaaaatgcgagacagaaagcaaagaagagaaggaatacgaataggatgatgaactgatgattacctggatggataaaaaatcgtcggcggaacacatgagtccatttgcggattagcaggtggggaaaggtggacaggttccggctgacgagggcgcgaagtcccccggcttctcatctcccgccgataatccgtcgccgtcgctgctgccgccgccgcggcgtgtccgcgaggggccgagggcatgttaagagcatcagcttcctaaaattttattcccagatttttgattatgtgaatcctaaccataaaggtgttaaaatttttctctctccaagagatgaggttaaattggaggtgaatagggatctgtcgtccgatcaaaatcttagcgtccgatttacgtgcaaaactactctaaactgatttttctcctaaattacttatccaaatcatgacccgattgcaccattaaattcgttgcaattaaatcttgaaaacaagaccacacttggatatattccggcgaaaaaaattagcttattattaaattatttttaaatattgcacgatgttccaccagttatttcggaattgtttcactgagtaaatcgaaaatgtttcactcgtttaaatcgagtgttgttttaccttatataaaaacaatgtttcagcaaatagcgaaagaatgttttagttcactgcaacattagatctatacatagtgaaacattgtgtgtacactaggtgaaactttttcggtggaacaaaaaataaaccaaattcccttaatagagggtttccaaaatatgtgggtcttttttttgttgcaatggaatgtttcgttcactgcaacattagatctatacatagtgaaacattgtgtgtacactaggtgaaacattttttatggaataaaaaataaaccaaattcccttaatagagagttttcaaaatatgtgggttttttttgttgcaaaagaaaattttaattcattgtgagtacactaggtgaaacatctttagtggaaaaagaggagtgagaagtgggtgggcccaacagatagcacgtgggggaggggcgtgcgggggagcgcccgatccagctcctcccgcgccggtcgccccggtacaagcattatcgggttaaattggtttcctagaaattgaaaagatgggccatgttaaaatctccaccggacaaatctattttgtgctccttcctcccgccagatcgtgtgcgatctcttctcacgcaagaagtgctgggagcccaggtgcatcctaaaaaagagaacgataatcctggtgtagggaatagagaatttttggaatgagattagagaatctgttagagcaaatttataaaaaaaaatcctcatatttttttatagggaatgatatacatatttctgtgggtgatactaggttgccgatcttcggcccagctcagtttgatgtactatgcatccacaacccattttttttcttttagatctaaggaataagttcacttagatccctccattttattgccaggtctgaaattcatcttgtacccagtttgatgtattcgttgtgatggctcgctaatcccagttaggttacagaccgtttgagatgagatgatctgtactagtaataccagatataacgaattttttaacttataaaatcggtgcaccgaaggtcccacgcagtatactcttcggttttagttggcgtggcgagtgggccccacttggccccacatatcagcggtctcctcctctccacatgtccgccgctcgcatctgctgcgccctaggtgaggcggcgcgtgtcttcagccacgccgtgcagagctctatacgcacgcgctgccgatcggagtagcagatgacggcggcggggcgggtggtagtgtggtaccataccatcaagttcagggtagcgcagctgtcggcggccacagacggcttccacgagtccaaccttgtcggcgacggtggcttcggcagggtctacatgggtcggcccattgcctctcattgccagaggcaagagcccccggcccgctgggctgggtcgcgcgtgtgacagtcgcgctcgaagccgccatggggttgcgctacctgcacgaggtggtgacacagcaggtgatctaccgcgatctcaaggcgtccaacgatatcgtgctcgacgcctcgacgacgacatccacgtgtccacgcgcgtcatgggcacctacggctactgtgcgcccgactacacaatgagcggcaagctcaacatctagtccgatgtctacagcttaatttggcgtgctcctcgagctcatcacgcacgcaaggccttcgacgctgcctcctctttgggcgcggccctacctcgtgcggcgaccacaagaggtgcttcgatcgcctggcctgttggaaatatggtcatgaatcggcatattttaatccaaaatgttaagacaataatcatggcataagcagtgtagagtgatctagtgacaacatgtaacataaccagtagcatactaaagacatcatgcgcatcatgaatatcaggaacaaaaacatagcagtaacgcaatagcatgctagaggcatcatgaatatcaggaataggaacatagcagtaaagtgctaacaacgggaacaagaacaggagaaggatataccccgagaatggccctccgctggattgtgaggcagaattgcctccgttggtgttgttgttcacgccaccggctccagctcctggcgcaccacctccggctccagctcctggtggcgcaccacctccaccatctcctccagcagcagcagcagcagc

SEQ ID NO: 73073 - DNA, 9582 bp, Oryza sativa
cttgaccctctatatttatagcaagggtggtcttgcgtctacagaactctttgcatgttctattaggttttttttggaaattttacaatcaaggacaccccggatcaatgaaagaaacatggggaaactctacttgaattcggactttgtgctgaatgtctaaccgttcagacacctgagtctgatcggccatacaatggcggttagatcagtcttcgtgggaaagcttcgattttttttaaatttggtttgaacttgctatacgtgtaaattattgccaaatttgagtgtcaacaatattattgtgatagtagataatattaaggatttatgttaagtaaaatatagaaattataaataccaaagactctttagtttttactaccatgaatctctagctttagttttgataaaattaaatcatttttaaatttgatattaacaaatacaaagttgcacccatcttgaaatcctaatttattaatttatattattgtttaaacacggtatagacacatgtgcctatacacatatgcacactcaccactatgaatatccatacggataccgtacccatatgagtaccttcgaagactagcctagcatatcttgagattgatgaagtcaccatagatgcttcgttgtcgacggatacatcgtctaacactaatactgaaataatttataagctaattctaaaatagaatgaaaacaaatatacaagtgcatgacacatagatttacggttaaataccatttctaaaataaaaacttagacaaatgagttaggactagaggtacctagtctaggtctttgtttgctatacgctatgcaaggagacactaacatattgctgtggtcagtcaaaaactatatgatacatttttcaacctgatacagctatgcacagggactcctcgcgtgcatatggaaagagagaggagccatcaacaatattgcatctataacattctaattttgttatgcctctttgcaacccaaatttgacttagttcccaatttcccatccatgccgtgatacatcgcagcgagctattctggtcagttttcagcaaaggttggtctgcaattttgggggaattccagctgtgcgtccaatggacgatgcaacttcccagtgaccattaaactaggtcatgctgaaagcaatcctcttttgataccttctcagaagctacacaacaaagacaggcgtaccagcttatttctctgtgcttcccaagttagatgtttacagggtttacaatcccgatcggtttttagcaaaaaaccgatcggttcttatgaaaccgctagggtccggtttgctaaaatcaagcctgtttatttatttgtttttggagttgatcgaaagtcatcagttttttttgcggaaatcaagccggtttatcttgttttttatggagttgatcgaaagtcgtcggttttgtttgcggtcggttttcagtaaaccaacatgaccgggtctcagctcgaaatctgtaatgtgaacctggctgttactgtcaatcttctctctgaagttagctgttagtgtcaatcttcagctgtgctgaattaatcaatgatccctgaattaaagtttgcttgcggtattaaaagtgcaggccttacttagaccactactgttgcctaacatccatttttttaggtagtaatgacatgtccttttttacttggagaaagcacattggctagtggagaattgatgccttctgaaaaagcagttcaatattgtgagaagcaagaatgactaggtgttaatagaaaagataaagagaggacaagaaaagcaaatggaatgaaagaaggaaaaaaataaaggaagagggcatgacacacgctaagtataagcagtcacatgaatcctgcgtatacaatacccatttgctagtaataaaagtataaatgggtgattttgtctcggggaagtatagtaaatctccaaaaaggggtcaattttcatgttgatagaatcaacatgttcagctgagataatttgacaaatccaatggagatggacaatccaattgaaagcagatttctctgaaaaatattcaacaagaatttcaccatgcatgtcaccaccacccataggagaaaacaataaatgtttgcgacgacgagagcgagaattcttgtaacaaacaatagcactatattttatagcacctcaaatttgagcgttaatacattgtacaccatacaaccggttttttggtctcaaaatcccagcttagctagttctaatcctcagaaactgcagtaacagcagtatgcccctagtctgctaaacgaacactcctttttgtctcgaactagatcttttcatgaactgatctaacatggacaaaccaacccagaatatgcaacaatggcactatctgaactgcaaaaaaggcttgatctgcatcatctgctgtattggactattggtacgatgacagctttgcgggcgaccttttgtaccttctgttgaaaaatgataagcgaagaattgttcattaggacttaacttcatctccttcctggtcctgcaaacctcctcgccgtaccaaatatgagagcctttgttaacagtccatggtcaaacgtgcatgccagggcaactgcgccacctacaaggatgactttgggtatattgcctgtccagtgctttggtttctcagcttcagcgttgttggttgaactggcctctgtcttgtcctctgcagtgatgagctcatcaggatcaaccttcgtgttgacatgtgccatggcagcgcattttgaaaggggctcgccagcagtccttgcgatttggtatgccctcaagccaggctcaatccttttgacgcagccccacatcccctgccgaacaccgagctttgcaatttcccttggaatccccatttcctcatgatggaacaggagcacctcacatgcggtcattgagccatcaccgtttcttgattcaactgataaaaagaacaagtgttagattcattggcctcacaaaatgtgtcatcccgcaaaatggagcgatggaactgcaaaattacctggacggatgcaccaactagagtagtacacgtccacacgacgaggtttgttgcaccttggaacagaggggcgaggcacaccctgaaaaattatgacaaaagttcaataacctaattcgcgcatatacggttaaatatttaaacatacaactgctatatgtagctatagatgaccaggatgcagcaagtatacttagcactaccagaggtaaaaagggcaaatgtaacttctcttagactcattctggaatccacaatagaacaaaaagcatgccattatcatgagcaactctacaggcatggccttgtcggcaaacataggaatttgaaaaggacctcataacagctaataatgcctttactcacaggacaagcatctcagccattgtgtggaatggcctgagaatatagtattacctagactgcaaggttgaaaacacatgataagtttggttatccggacctaaatagttggtggttcagagaattcatgcctactgcgtgctgtaaacaaacaaaaacggagtttttttttcccttgtgcaataggatgataatgcagtatgcaacaaaatttccagctaaacagttgcttgaaaggaactatgagaattgtaaaagcaattacaggaacttatgtaggagcattaaataacttgctaatagaaaaaaaaagcagattgtttcgttctatacctttgttacacagtaatacgtctttccagatgcccatatcctgcgaccgataatgtactccctgtcactgcagaagaacgggaactgcacagccaaggcatatagtataagcaaaagatatagtttgctggtgctctgtacaaagaataccagagatatcatacgaaaagctcaccttcctgacccaccggagaaccatcgttccagtctttgtgcactcctccaacgtatcgtgctgaagaagcatgtcgtcccaagtgttcttaatccggaactcgtcatcccagaagaaatccctgacaacttctggcgatgcatcctcaaagatagtgctactgcggtattgaggcgggccaccctagaacgaaacaaaccacataaactctttaattctaaagaattagggcttaatgaccagatattttcaactatgaactttattatcagtttatcatctaccgtatttcttagcagtaattcaaaactaacacagcaacaacaaacttgagagacaattcggccggtgctccccaacaaacacacaatcccctaaacccgaatttctcgattgtagaatcaagaaatattcctccatgtatgtactagtaagtatccatcgaattgagttcacgccgctgcggcgagatatcgattgaattgaatgttcacaccggattaagtagtactacctcaggatctctcctccatgcttggtagcgcatcgtgggcagcgtcttgtccatcatgtgaatccacgccggcccgccgtccttctcctcgacaaggcggcggaggtgcatcaaatctccggtgtcgacggccaatccctcatcctcctccggcgcggcggcggccatcgcagttctgcatccacacccaccacagtatcagtaaacaaaccagatgtccactcgaattcacccaatcgaggctcgtttgatttctgaaacaccataaaccctcacctaggaacggcggcaactagctcgttcttgcggcaggagtcctcggcggcggcacgcggcggcggcggcgcctccccgacgacgacgagggcccagcgcgggcgccacgcccagccgatgagtaggccgacgagggcggcgagccaaagcggcgcggcgagggaggcgagctcgagggcgacgccgccgagggtcggctggcggaagacccccatgagcagatcgagcaacgccgacatctcgcttctatttttcttttttgaactaatcacacacacgcctcaggaattaatcaaggaggaagaaaagatccgatttatcctcgtcgtcgtccgcccaaattctgaatcctgaatacaactagtacaagagcagcagcagcaatctgacaatcctcctactggtgatgcaatctgagaagaattttccaagacgcggaagagtagaggtttttgggcctagatgatgatgaaatcagtgtgtgtctattggcaccaaaatctctctctggcgctcatggcgtctgtttttgctcgctggagctcactggaccactataagcaaacgcaacgcaacaacaagcacaaacaccaagcgatcgagaggaggggaaaaaatcagggaagaatccaaaacggcggaggcgagtaatgtgcggtggagaagcgtctgcgtgggggataaggaggctcccagccaccgatcgattccgatggatttgatctgatggagaagaagaagacaatggagaattggagatggaggaggatatgccgggggatcaccgaggtgataaataccgtgtgttgggttgggtctggctcgtgtttgttgtggttgtgaccgtgtggggttaagacgtaagacgtgtgtgtgcgcgctgaccgggcgaccgtccacaaggaaggaaggatactggacgacggtgtgtgtttcttggtaatgggtcaccaccatcgatcatccatcacactactagtactacgatggagtatgtacgacgcccaccgtccgtccatggaattgacccgcacgcacacccgcgtgccggcgtggaacacgtatagggccttatttatacttgggttgaacgagtcctagctactagtatcagtctgtgcatgcacagcacggctgttaaaacttgggaacttccttcttgccattggtgccataggacattggtgccataggattatgttttatttgtgtactttttatcttgggttagcagtcattagtttatttctggttgatggttggtttcatcttttaaggctgtgtttaggattccggcacacaaaacaatatttgtattaacacgtaattaattaaatattagattttttcccccctaaaatggatcattatgattttttaagcaactttcgtatatagatttttttttaaaaaacacgccgtttaatagtttgaaaagcatgcgcgcggaaacaagggtgaggagttgagaactcccagcaaagaactggcctaagtttctttcaacttcacttattttagtgtgagattgtaataattggctataactctttgagcaaaggccggaatgctctattccattatctaaaaagaggattacgtttgatttcatacttacataatactccctcaaagcttgattcatattataactttttatttgactctttttttaaattaaacttatttaactctgaacgagaatgactccataaaaatcgtgatagacgaatcctaggctacctaatactccctccgaactgataatacttgtctttttagacaaggatgagatcaaacttcagaatctttaattgtgaatcattttaaaaatatttatctttcaaagatggtgactacatgcatatattggtctttaaaagcactttaataaaatcacatatttgttaacactcttattaatggtcaaagttgttttttagagaccatgcccttgtccaaaatgatagtaagtattatcaacccaaagggatcgtatatcggagtgtatttagagcaagtttaatagtatagccaactaatagctctaatttatctatagctaatctaatagctcatttatacaatagatacatactacactattaatacttggtcccactagtcatacacacattgtgtcttggagtccgtgctacagctgactataaatctgtagcctgctgctcttttctctcctcatttatcttcttaaaatatgtttgcaactggcttttagcctgctattgtacctgctcttacaaagagagatgctatacatacgatttttcatgtacgacactcgtacgacgtaaacgtttcccaatgcaagcctgtggcgtttttcagtcatttcccggcgatgcaccacaccatgttcaccatccgttaataatcgtatatgaattgcacgtacaagtcatatgcatactattttcgatttacaaaacaccctaaaaaattactaccatgtaggaatgttaacggcgtaagtttatagtatgaactagagattacggcgtaagtactgaaatttgcactaagttttgaaagctacaatgtattttgtaaatttagtgtaaatgcatattatttattgtttaaagaatgatttttttctttgaaaaatgtggtgccataaatggcaatatagctagagtaacagatcaagtctatctcattatttcatattataattaattgtctcttacaatattggcgaggcaaaccatttcaaaggtattttttatttgcagattataaaacatagtattttaggataagacttttgtattttataatttcaataaaacttttatattcttacaatccaaaagtcaataccaagaaatcaaaaacaaagtaaaaactatattaattcaaaattcatctctaaaatacataaccgaagctgccactaaagttttctcctttttatacaccacgcgtgtttggttcttgatttcactatcccaccaccattatttaatggaatctttacaactccaactttgtttaaaaaaagcctaccgtccaccccagctgacgaagacgagatgaagaagaagagaagaagcacgttttgtttcttttatttgtgaaatttgcgcgtgtgttgaaattgtgtgtttcctaaaaggggaagagtacaagtccaaatcactcacacgcatataatttatttaatattttaaaaagtactcctactctgtgatcatcggtaccaacatggcgtggaattttaatgaccgcagatacgtatatagagtagggttgtgtttagatccaaagtttagatccaaatttcagttctttttcatcacatcaacctatcatacacacacaacttttcagtcatatcatcttcaattttaaccaaaatctggatccaactaaacacaacctagctagctttagctttttcgtccgtccattcgtccagcagatgtgcttaattaattaagtttagctgcctgcagcgtgtgaaagtgaaatttagcaaagcaattaactgtggccacagtatgggtggcagactggcagtgaacgagtactacaggtctctacacgagcgttcttgtatgcatccgtacgttttgttaacattaatagagtaccacaattaataatcaattttgatgtattatattttatatagtggaaattttatatcttctacatatatgtgagaccttaattaatttgttggctttgggttttatttttaagaaacatagtataaacgcagacgctcataacgtacacacactcatctaaacacatacgcacaccctatctctatgagtatatccggaaaactggaccggcatatatttagcacgctatggtattttttagctctgaatggcttcttgaaaaactttttcatcttcagcactgcttagataaactttttctaatttatttgttagcttgacaatgtataatatttaactaaaaaaataaatggatggggtaatcggataatccggcccaattcatctgtttcgaacgagatgcactggcaataattcgtttgtaaataaaaagttaacgagacaaaaagatgatattttgtatcctctatggtactccgccctatcagaagcatgttttatatcgtccatatgttacttttttttctttagaacttgcatattttactgttgtgtgcagatttcattctctttattagtagcgtgtcatctcaagctggttctcagctttattacacttttacagtgtactatgtaaggcttcattccttcttggaaaaagtgcacccaaggtccctcaacttgtcatcgaattacaaaatcatcccccaaccataaaaccggatatctggcgtcccctaactaaccaaaactggtcataataggtccctcagtggttttaaccccgtttttgtcctatgtggcggctgactcagcgtgggactcacgtggaccccacgtgtcaggctgccacatcagcacatactctatttccccctcttctctctctgtctctgtgttctctccttccttcctccccctcgctctctgctctcgcacgagcggcaacgcgcgcggccggcgacggtggctcccaagtggcggcgcgtgggctcgccggcctccccgtccccctagtgcggttggtgatggcggcgtgcggctgcgtccatcatgtggagatcgactcgacgacgccgccatcaagtcgctgccgtcgggcgtcggcgatggcggcgcatggctgcggccagcgggggaggcggaggaggtataagcggacgccctcgccctcattgtcgatgtcgacaccaatgaagaggtccgcgccgctcaccagttcgcatgcctcgtcgtcgtcg

SEQ ID NO: 73074 - DNA, 696 bp, Oryza sativa
  unsure (1)..(696): unsure at all n locations
caaaaaaaatcgttcgtggcagctttgcaaccctagagcgacaggttatggcgttgtctaagccagctgtagtgcagattgcagaagcctactgtctttgaattctccatcctttttttctcttcttctatgattctatccgtagcacaattcaatgcccccgtagatacaagtatacaacacggaaagacaatctagcacgtcgcagcagagagagagaggaatcaatcaatgaacaaaaagctcaccctgtggacacgtgtcgggctctggaggcccccaagcgtccgcgtcaccaatctcgaggcggccaccgcggagcccatgcttacagcctggcaccggtagtgacgccagccaccagcgcagcgcgcgccgctcgctcgctctgcggcgcaatctgtgaccccacctggcagtgacacggcgcctccgcgaaacgcaacggctaaaacgtggaaggccgcggcggcgtcgcgcgcgcgcgcacgttgggacgtcggggagggaagcggccaaagccatagacgtcgtcgtgggcagcaagctgtgaaaaaaaaaatggccttcaaaattcgaagcggcgacgttatcgctctctcgtcgtgagcggngcgtcgtcggctccggtggatagtcaacggtcgacgcgaggatagttcaagagcggataatgttaaagaaatcgttgagatt
